United States Patent 9,487,797 (GENOMIC PLANT SEQUENCES AND USES THEREOF) - sequence listing, part 107

SEQ ID NO: 103129 - DNA, 690 bp, Oryza sativa
aaaataaatggaggaggaggtatacaaaaggagttacttttattttccgttttccacccacaaattcaccatacacatacacgtgcacattcttgatccataaagtatatcttgtatttccgtggatccattattttactttgcaatatatgtgatgcaagtaatgcttactcttttccataccctgagcttcacataagccttactagatggtaggaaaagaaaaggcacaatcatatgcctttgtgaggaatcatacaccttgagtgatcgatagaatcaatggaggagcaaagcaaagctataattttgtgttacatgaaaaaccccaagttgttcttcacgaaaagttagggtgacttgagtcaagattgttccatttcttaattgcttaggattgcatggtagacactacaaagatccacaagtacaggtatagctttgaataatttgtttgcatgttatttttcagggagatcatgatttctaattgtaccatccctagcttgagttcaattatcttcgatattttagaattggtaatcaaattaaactcaagatagaatggatgtccaaaagtaaaaattggtgcaaacctacgctctatataaaacagaggacgattcattgggtctggccgcatcaatttccctgtgtggttcgtcatggctcgtcactctggagtgatct

SEQ ID NO: 103130 - DNA, 1020 bp, Oryza sativa
ctgatttctttgcattaagagacagacgatagctattgtatccaccccgttgaccgatttgtgtcaactagtaaattaactacctaataagcttcctagaaggagatttattgctatagattcacctgtgtggatagaaatgtgacacatagaagtaaaaaagctaagctgccttgtcaattgaccgatctcttgcagggattgggatgagatatgattcaagctgatggatgctttacaaaagtcacttcatgtgcttgacatgcatgcgcgtgcagtcccattctgagaggtaattattttagcgcgttgattttgtcaacattatttactttgttttattgggtgtggttaactatgcatgttggtgattctttttaacagaaattctgctaatttattttggtgcatgcatcatgccctcttttcatgtgataattagtcaaattagttaatgtgatccattccttttgtgatggatccatcacaaacatggtatctgtcaaggtttgataagtatggtaaatgccaaaaaaaactctctgaataatttttagaattggccctgtagattttggaaaatgaactaattatatatgtcgaattattatgttactttctacgagttcatataaagagatcatccatatacggatatgcatttaattgccctcatcataggggacttgtataattaggagttgcatatgatagcattagatacatgagagcagacattcctaatgatctaaacaaaatctaattttatgtggacaatattaactagggtaaaattcacttttatctgttaaaacaacacagaagtatatagtcttaagaacagctcgaaagtagttgtgcaatagttttaccctttgccgacttaatagttttgttgattcgacgatgtgcttgtactgttctacggtggatgaaagaagtgtgagaagtaaaataatgtacgtgttgaaatgaaaataatttggacatgcattttgctgtatgcactggttaactaca

SEQ ID NO: 103131 - DNA, 1241 bp, Oryza sativa
tgcaccctaacctagtttttaagattcaaatgaccttttttttaaggtactaatgcctttatcagagaataattaatattggctttggttataatttttactcatgatgtgttaatgggatcgctcttaccattttgtaccttgctatgaattgaaatggtagcttcactatgatctgccttggaaaattcttttacgacatgatgttgctcaatttattttcagaaagatgacaatttcaaatgcatgcaaaccagaacgtactttggccattaacctaccgctatctcaaaaaaaaacatttatagtgtatatatactacattctggttgcatgttgtattgttgtctgtggtgcacacaaataaacaagagttgtcggtgcgattcttttgttaaacccttataaacccactgccactcagctgcatgctcgctcgtggtgaagcggcaaatgaaccaaatacgtactagacattgaaactgaatggcctgatgtcttataaattggtaattacttcttctagtctatcataaattaaaaaatatttgatgtttagaaccagataaacctccaactaataattttatattagaataaatttctaaatataatttcaagacaaatctatacatatcatttttttaagaaacacggtacaaaagcaggtgctcataacgcgtgcacacttactcctatggatgcacaaacgcacatcctacccctataagcatctccagaagaccgagtccacatatctaagattgacgaagtcaccacgggtgagcacatccggaagattaggccagtatatttgatattgacgaagtcaccaaagacgttgctgtcgacgtcgacgtcgtctatcactgaaagaataattagctgtgaatgtgagcacctgtgttaaatctaggatttgaattgggtgggctggttccactacaagaaacttaacgacttgagctacgttcatttcgccatttttcttatttttgaactaagcattgaagaaattaagagtcaaagttttaaaattggaccaaatatcgtccttaacattgaatatttattgtggatggagttcttatctcctttttattgaaaagatatcatttttttatggttgaaaaaatcttttaagcactataatatttagtttggatataaggatataatacatgcaaatccgtcttaaaaaaatacttcaacacaatagtactatagttttatattttata

SEQ ID NO: 103132 - DNA, 2041 bp, Oryza sativa
cccctcccccttactagctttacatccccttcttctcttactactacactatacaaatttgaattaaaattcaaatttgaaatgggtatgtaaactttttacttataaactttgggtctataaactaatatttgaattcaaattcaaatttaaatttgaaacaggtatgtaaactttttacctataaactttgggtctataaactaatatttgaatttaaattcaaatttgaatcgggcatgtaaacttttgacttataaactttgggtctataaactaaagtttataaactttagatgtatagaaatactatatatagaaaatatttgaattcaaattcaaatttgaacgaatataattcaaattcaaatttgaatcgggtatgtaaacttttgacttataaactttggatctataaactttaggtgtataaactttaggtgcatagaaatactatatatagaaaatatttgaattcaaattcaaatttgaatcggatatataaacttttggtctctaaattttagatgtataaacttgaggtgtataaattttaggtgcataaatttactaaaatagaaaagtaatgtggtgccaaaaaagaaaatcaggtttaggagggagggggattgatcgctagccctgtgcccaagcgatcgatccccgattagcacttccgcatcatcagatcggtaaaatttacgagtggtaattagagacgacacgtcggcgctgttgtttcagcctctcatccttctctacttgacagacgaatgcagcaggtacatgtgacttctgcatttgcacaatttcaaaaagtttattaattgcatgctactagttctgaaacttcgtccccaaatattcccctaataattttaaaatatagctatcccatactaccaatctgaaaagaaaaaaatagtacaaatatttctatgcatttttaatgaaatgtccaaatatatttaaaaaccacaaaagtatatttatattatgaaaaggaggtagtaatacttaccatttgcatatctgacgctgcacatcaaatgtaaggttatacggaatggtaattaggagctgatcaatttgttgccaaactcaaccctattttggctttatgaaatattaacaaggtgacaatttaaacgttataagaactgtcttcattatcaaagttcagtaattctaaaatctctcttataaaaacttgacaaagatggtaacctaaatagtcaaagttttttaggttttactaagtttataaaaaaaatagcaatatttacaacaataaattattttcactaaatttaatattaaatatgtgttgataatatgtttgttttgtattgcaaatgctagtatattttttaacaatttggtcaaacgtaaaaagtttgactaaaaaaagtcggacaactaaggaagtacaacctacacatttcaaccacactatgcagtaccaaattttagtaagactatcaacattcaacacgtggacgccattgtttcaacctcttattatagtggcatggatccaattaactttttctaatgacatccgattgctggtgctaggtggctgacttttgtgtttgccaaatttcaatgcactaattaattgcatgttagtactgatttactccctctggttctataataattgacgttttggacaatgttgaggttaaacttttataacgttgaccatcaataactttaaaaatatttagtttaaagaaactagaaaaacatatatagatttgtctttcaaaacactataataaaaataaacaagtatttatttattgtatatattataatagaaaaatagggtcaaaggtatattttgtagagcgtgtcattgtccaaagcgtcaattaaaataaaactggagggagtagtacactatttgcatgcccgtaagcaattgtttttaacctctcgtccttttctacatgatatacaagtaaaagtttgactttagagcttgtttggtttgataccaatttattaccctactaaaattttgttaacttca

SEQ ID NO: 103133 - DNA, 2282 bp, Oryza sativa
aatataaaaattttatgtggcctccttacacaatatggaagtttatatacaagttttaagttttttttttatatttattttttagaaaaaaaatatttttatggggtatatgagagagaatttgcttatacaagacataatagcacaaaaatatcttatgtagtgttatgaaagatgatttatattaaaaacaacaataaaaaggtattttatatagcatataacaaataagttatatcttttataaaaaatagaataaaaaagttgaaacttctatacaaatttccatgttgtgtaaggaggccacataaaagttttcatattttttgaaacaacaaattaggtaaatcaattgttaacactgtatgtccataagggtattttgggtatttttcaaaagaaggcctagcccaatagtgtattgtaaaacaattgataaagtcaacggtatattatagaaaacgacaatattgatggcaaatcgttgaactcgaaaaaactcagtggtataaaatagattctctctcttttttttacggaggaagtacatcataccagtcaaatagcaaaatataactacaacattatgattttttttaacggcgcgtagtcccttctactcgaggagcacaacatggttaggcagtgcatgatcttcgcataacactatggttagactatcatacttcaagctacaaacgtggagcggtttctttcggatgtcggagtcggtgaagacccagttcaaaaacagattataattgttggatgttacatgtatatataatcaatataacattaatttagcaatacaataggcaacactatattaattaatggataatatatcgtaataactatatacttaaatgttaaataacatgaatacatagtctccataatataaaaacgtagctacacaagtgtgagatgagacgataagagcctcagactaaggagtctaggttaattgataaatgatgtgatggctcgtgttgtatgtaaccagatctagcggttacgtgggttgacaattttaaattatccggcatatggcctatcggataacccggtagaaatatctaataatctggatcactggatctagagatactatattcgtattcctattcacaccattctatttgcatccgcattcatatccatcagatttctatacaactatactatatccgtgtttcagacatatttgaagggggagcggagcagatatttcttttagattttgacctttattcctagttatctccctaacattttttttcttttgcccgcgattgatcatcagagagtgataagtgactcaataataaaaaagattgatttggtttgctacatataccctattcccaaaaaaaaaagttctgcctacaaatatgaacataggttatgtccagatttatggttagaagttaggctttttctcttgacggggaagtaggaaatattagtaggtaggtaaggattatttgagtagagcagatagcaatcataccaaacttttgcgcttagcaaatggaataatgtcgaatcaactcaatttggtgatacatccaactaacacactctaccaagttctggtaatgcaaaaaactattcaagtatggacacttcaaagatttgatagcaacgcgatcgagttaaaccaaactaaaccttttgacatgtgcaaagtactagaataacattatatgtgttttggaacggagagaaactaattaccaaatcttttaacgacaattcattatttgcttaacaaattgcctagctccttttggccccaagtgaaacattgctttctacatgcgtgcaccctgattccaattattaacgggaccaatagactgttactcagttcatcttttcaaggcattttcatctattcctgagcaagtactatgattatagtaaatatatacacactcatcgatgcaagttagagggatacgtgtctctgacacgtgcacccatgagagtgggtcctacctaacagggatggatgtccctttaactttacgtaaaaagaactacttccatttacattatgagtgttggtagccctaaaattttaaaaataattttaggggcggagtttagaatggagcagtggagtggtccaaactctactctatcattctagtttattttaagattactctagcttgttccacttcgcttttagatgaaattaaaattgtttggttcagttttagctagaggagagatgaagctaaaggagaagcttggccaaataaatccta

SEQ ID NO: 103134 - DNA, 3640 bp, Oryza sativa
tccttcgtatcacacctgtaaacgctttatagataagtgtcaacctaactttataaatttgggggactaatacatcaggaattggtaaagaaaagacattctagtcttttaattttatattagtatgtgtatatactagtacaacaattaagttaactttacaagcgctctcaaggaactacaggaatgcttaaataaatgtattatggtatttgaattcgtctcgaataatacttaataaaattggcctaatattggatattagatttataaaaattgctaatcttgtgtgcttaagagaaactgcctagcttgtaacggacgaagtgacgatcgttgtaatcaatatgtcccttgcaacaacgtggggcctgtgtggtagggagagaagcgtatatatatatgcatatggtctggcagctaaggtagtaccgccgtcataaaatgctataacctaggacgagatttgaccgatctgaatagaactttgggtatgtttagttcatgctaaaattgaaagtttgattaaaattagaacaatgtgatggaaaagttagaagtttgtgtgtaggaaagttttgatgtgatggaaaagttaaaaatttgaagaaaaagttgggaactaaacaaagcctttgtccaatttcattgttttagaagggtcaaatctcattctaatcattctaggttgttatattttagaactggagaagcagctaattaagggtgtccccacacttttgcagtgtcaaagaccaaagcaaagtgaccaatcaaaacacactttataactacatgcctgatcgatgcataaatatatcagcagccatgtctcatatcttgcttaaggtatatgggtttcacctgcaacttcctgcaaaattccaaagaaaaaaataaagatgatttaatttatatataccaactaagggctatggtagtagcatcatgtgtataggaaaatataaagaaaatcaagtagctagtagtatacatagtactatttaggagccaaataagctgttcctaaaatttgaatttttaattttaattttggaattgattttgtgagatattatcatagtttatttttcagcattacatttaaaccgcgataacatagatataaaagttttagccgcagataattagtgttctgcttatatgccatttacggcttatcagcagtagcctgtagctaggccaaacaatcaacagaagaaacatgagaatatttagtgtgtataaaagctatttttatttgcttaatgaaatcttcattatctgaaaagaaaaaacagatatgccattcttggcgaatgtaagtgttgctttaatttggatttataaattttgatatgcatggctacttgtacctcgtctggattcgtcctagctatctagaaagctagttggtacggcttaattcagttgagcttgcttttacctttaatttgctagttatttatctaagaaaggatgtgagctttcatggaaggcctcacgtttgtctccatctttctgccaaactccaagctatacgtggaagaagagaagttaataaaggtggtggctcaaaaggagatttgcaaaaggatcacttgggatatggtattttacacaggacataaagtattatgtataagtgataatactttttttaatatatgacaccattgacattttatctatatttgacattcgttttattcaaattttttatgcaaataaaaattattcttaaaaaacatttgatgataaataaagtcattataattacatatttgtttataagacgaatggtcgtcagatgtatcttacaaaatcaacatcgctatacattaaaaaaacagagagagtaatatataaattaatagtcatacatagagggtcttgatcgtactccgtaggagataagcctcagatatccatgggtgctctacaactcaattgaaatcttgggatcagctttttctctgtgtcgatcggagcgcaaaatattaattgtaccgcgtgcatttttttcttagcaatgcaatagagatagcaaaacaatattctacaaaaataagtacatgttttggccctcttctcttgtctcagactggatttaaacttttaaatacgaaacattattcactttaacaaaccgtagacctaaatgatgtggttttgtcggagatggtgcagatatattgtagtgtgtttggctggaaaagagtatttattaattctctatttgctaataatgctttcgtggtgtagtaaagcaagtgctaaccaagtgcaacgtcatgggtaacaatttttttttccttggaaataatcaaataagatgttggatttctaataaggtgacgacaggctggattcaattccattaacgaaaaaatttggtgacgatcgacatgattaactttagcgcctataatacgacatttgcttgccaaattgcaatgtatgatggatacgattaatgtaagtaattaagcacttatatagagacaaattgctctttaatttctagcattcccaaatatataaatatccttatacacacttgggaagatgtacagggggacacaattccacaaagaattactagttacgcaatatatgtttcatggaaactaaaagggctaataattaataatgtcattgagatcagcattcccccgacaggcttacataagtattactgtttattattgttcagacaacttatagttgggttgttgagaattaagcactaattagtcttttgaatggtgaaaacttgccaaggttaaaaacaaatggttttagacttaatagtcccctaacctcatttgctagctaagccaaagcttgttgttcctcttggatgctagctaggttgtcaactggcagcaacactggaagttggaagatgacttcatgtactatgaaacatgaaaaaaaaattgacatctagctggctacctcatgatgacaagtgacaacaccttgttccaaggttatcacaagcaaataacctagctaatggcatatgcgccaattgagataaaatgctagattcagcgccaatttcacatggttttcggaggaatttttcagaaaagcaactcaatttctgcaggaagatgaaattttagtcaagatgtaataggtaaagttcctataccattcttgtgttttctttgttgttttgtccgagtgcactttgcacagaagctaaatgttttttatttacttaatgaaattaatgtccactatctacatgaggaagatgaaaattttcccgacagctcaactgtagccttcagaaaatgacccaactaaattcaagcacccagaggcaactgtgcacacaccatagacacatcatcagatatatggtattaattgttttgtttttgagatgcagaggcaagaagaaaagcatcagtgctgacagctggtacatgttgcccattgtatgattgtatcctgatcagtgtgatgacttttcaagttttgcccagttgagttttctaatccaaaggctgactcagatgcacttactgaatgtcatttttctcttaagaaaattattttcctgtcccctgctgatgtgcacgcagactgcaaatcaataggtttgctgattgggtatatataa

SEQ ID NO: 103135 - DNA, 667 bp, Oryza sativa
tgaatagcaatgttgatattgaaatgagcttattcgccattagcaacaacctcagggtcaaaatctttcacctctcttagaagtgttgacatgttatggcacacgtggaaaccacattggtctccgatctgttgtgcgcatgcgaacttggtgtcatgataaagttcgtccttgccctccttgtgcctaccacccttttgcacatatgggccccaagccatatttaaggccttggtgatttcactgaaatcataatctttggacttattggagttaaggtaggtaaccctactccacttaggtacgatgactaggagaatccaatgtcacctgcgcagtggttatgtagcgttagtactaagaaccttaacttcaaaaacaatatacacgaagggtattgtcttcttactcttggttgtgtgcgcacatgatgtactccttgtcttgatgggcccataaacaccggttgacatagtcaaccacctcagtgaagctctatcgtaaattaacctcgttcaccatggatggatcaagaaacccaacctgattaccaaggcgacgactctcgatccaacacaaccttaaaacatttatgtattagaactaatttaattaggagatatagtccaatcatatcacaagtatagaaggtatgcacttacaagga

SEQ ID NO: 103136 - DNA, 695 bp, Oryza sativa
agatgagcacattgcagtgttggggaacttcaactttttttccataatcaaagatttaaacaaccacatttcgaaatacttcaataggaacttgtccatctcacttgttgggccgcatgctattagctctacttactatggctgaaaaagtttgaaatatactaacgggcaggactatcgatgtctgcatattttgtacccacgaacattaccaacacattgcagcttacattttttttcatgctttctgaagtaacacgcatttttcactttttacagtcgtagtgaatctgctaatgagttctttgcttacacataagaagacccgaaaataattgaaggatcagtgtatggcgtcaaaacagaaagtaataatacagattgatcctaggtgggctcaggccctcccagtttgtggaagtgattccctgcattatggacggagcagcaagacagaagggtcaaggaaggaggaacagcacgcttggcagaagtgattccctgcattacgtcaactgccgcagcagctctacccgtggcagagcagctggcaaccatagcgagcgaggccagagcagcaaacgccatggtcggtcgctcgccggtctgttctcgtgccgcaacgcgtcctcgtctactgtgttctatggcgccgagcagacagtcttcactgctctcttaggaggggtgcagga

SEQ ID NO: 103137 - DNA, 669 bp, Oryza sativa
aagatgcatgtgtgtatgacaggtggaccagatataaattacatagtatatgtttataagtaactattgtaagaattagctattaaattaactatatatgatttatatatgatttgtagccagcacttaactatactattaatcataagagatttcttaacaaattatctatctgattgattcagccaatccaaagtccagtgcaattaaaatgcatgctattcaatagagttggttttacagttgtctgatacgtagtacttgatccctactatgtcactgaaaaatgaatctaggctgtgtttagttccatgctaaaattgaaagtttgactaaaattagaagtttgaagaaaaatgttgaagtttacgtatatagaaaagttttaatgtgatagaaaagttggaaattcgaagaaaaagttgggaactaaacaaggtgtaggattggatgtgacgcatcctatcgctacgaatttggatagatgtatatccagattcgtagtaatagtatgtgtcacatccagtattatgctgattttttatgattttttatgggacaggggagtatgttccacgttacattgttgtattgcaactgatagccattttgtctgatatatcgaggagaaacactcaggggtcttccggcttcacaagatgttgggtt

SEQ ID NO: 103138 - DNA, 721 bp, Oryza sativa
atagctagtacccatgcatggaaatacgtacggtatagtcgttgatttttacagattaaagtttaaccacaataatttcttataaactatattcttcattgctataaaatcaatattacttgaaaacactttaaaatagtatgaatctatcagtgtaaagtttataaatcaaatatacttgtaattttagtttggttagaaactaaggaaactaaggaaatacttccggatcaacaaataaatgacattttggaaatgtgtgatcaatgcgcttaaactttgacagtcaatttctctttaaatatttcaattcaccttttaaaagtggtatatggttaaatttgccttcaaaacatgttttaaaatattataattttgctatatttttatagggtttatactagtaaccaaaaacaagtggcttggtgaaccatcacttgttgaaccatgttgctttccaaaacgtcacttatttgtgctcataggaagtagtgataagaaaattttaatcaaaagagatgatatagtttctcaaatgcagtgctatatttttcaaagttattttaggaagaggtaaactaaagaacatacctagcgcatgtacacacacacacacaatatatatatatatatatatatatatatatatatatatatatatatatatatatatatatatatatatatatatacgcacacgtgaaaacaacgggctgcagga

SEQ ID NO: 103139 - DNA, 708 bp, Oryza sativa
acagacatgaaggaaacacactcatgcaagctcagctcagtaacacagtaacagatccccgttttacagtggttggggaagacagcaagagacccaacaaagggcaaagagtgtgtgtgtatgtgagggagggagaggggccgggctaacctaagatgcgagccagatctggcaaacgcatagcgaaacaaccttgcatgccaaatatgggtcatctgttagcctcttccatgctccatttttgaccaagcaataacttgatgaaccccaccaccatggccaacaacctgcacaaggagctttagctgaaaaacaagagagcaaagagagaagtgaagagaagagatggggtagaagaagaaagagagagaagatccggttaatcctgttgatgaatcaccacagtgctccagtgtactggcagcatctccatgcttcagctcccaacgcaaggagtagtactaccactgcaagagtaggagaaataagtttggggataaggaaaacacgtagcaaaaccaatcatttatccccagtaccacatagccgggactaaccattatcaccagcatccgtatcactctcctcggtagtagttccggcgacagcacggctgaaaaagattgagaaaaacaggggtaaacatatgcatttacgcacatctaagagataaggaggtgacagggtaaagtgtgggagaaaagacag

SEQ ID NO: 103140 - DNA, 680 bp, Oryza sativa
acaacttttcgttttttatatttgcaaaaaaaatttggataagacgagtggtcaaacgttgcaagcaaaaactaaaaatcccttatatcgtgggacggagggagtaaagccaagtgatgatcaatttgatcatgcagcacaatgcaggacagtgacaacacatggcccacatcttggaaaaaatgcccgccccaaaactaccttgtttacccaaatttaaatttcacaacttaattttagcttgagtttgaggtttcctcgtaatttattttctatcgtttgcttttaaattattaagaatgtatataaagttttattcataaattatgctttgttattgatgaaacagcgtaagcgaaacaatgattgtttaagctcttctatccttctttgagaaattcagcccatcaagatcgaaacggcacgtcaatttgtttgctggattgttcacacaggccattgctatgccaattgatgggattttacaactcagcgtcaaattttttagaaccttttgcattttattcgggattttacaactcagcgtcgaattttttagaaccttttgcattttattcatatagagaactctgctctaatactctatctgcaatacaggcgaacaatagataaacagcaatatcaaagagaaatgagtagatattgttccatacccgacc

SEQ ID NO: 103141 - DNA, 867 bp, Oryza sativa
cttcaactatacagactagagtctgaacttttgttttattactttttggaaaaggctatatgagtggcttgctttttctcgtgaagaaaaaaatactatctataactattctttttctaattactaagaaatatgatcaaaactagtcgtgatatataaccagaaagttcttcgtttgtcccagcttctcctattgtttatccagattcagcggcgagtttatacaattatacctaaactagagaaaatgttcgtgcgttgtaacgggtgaaggttattttgatcttattattattattattatattgtttacttaagataaatttcgttgtgttaaattcttttggatatatattttattagaaaatcatgagctataattaggtgtccgatcgtctcaagttagtatgtgagtttttaaagagatttcttatacgatttcttctgtatttctaaaaccgaacgaacttaaaaaccgactcaaatacggatttgtatttccaaaagcgaacggacttaaaactcatatacggatgatgtaccaaaatactagcaaaaacatctttaattttttataataatagagattaagaaaccatatgcaactagtactcttggactatgtgtcattctttaatttcatcagaactaatagaaacggtttgcatgtctacacttgagctctttctctacaaaattattttgatataaaattaatggctaaagttccaaaagtttgatcgaatattgtctcaaaagttaaaaatttgtgaccagaggtagtaattgttctagatcacatgcaaatctatccaatcctacacaaaattcctttttctaagctaggttactcatcaacagatacgg

SEQ ID NO: 103142 - DNA, 941 bp, Oryza sativa
atgtatgagccataattccatatataggttctaatttttgtgatccatacaagtcctaatttgtgcgatttatacagccacttaaggcaagaaagaacacgcacaagagaaaatggtggttcttctccttgaatcgagcgacatgcattgacccgctgaactatatatacacttacataaaagtgtataaaaccgttagagattaatcatccaaatgatacaaaaaaattatcatcataccatgaaactacttgtacatttaatggtcatatgtactatttttacttttgcaaagccatatgttactattgtcatattaacatatgccgtccccttaataatacatgccaatctatatatctctccttaatcatcttgtctttccttaaaaaaacgtatgatcaactttttctcaattattttggtataaaaggcatactatatatacttagacgcaataagtataaataagaatgcacgtttgagcatactgcgagtagaaaatggaataatacagtgaatatttagataatgaaaattgattacatgtccggccaagaaataatacaattaattcggaagcacccataaacctcgtaaaacactagtgacactgatactaaaatattaactttagtatatgaagtcgtgcatcttgaatttcaccatgcttattgaaatgttttttcctcagcaaattaacttatgttagggaactactccgtggtttgagaaggggaaaaggtttgacaagaataaaagaaagttcttgttgacatgacagtttaatttccccaaacgatcgcgtccacttggcgtgttgcgagtcgggtggaaagtgaaggtggagatgatggggattcaattagattgacgcgatattttggaccattcgaaaagggtactccctccgtcccataatataagggattttgagtttt

SEQ ID NO: 103143 - DNA, 1852 bp, Oryza sativa
tcacccatcaccccccccccccccgcgctatcagaggctaagtgtgcgccttcattcttgcagaaataatgaacaagaaaggacgttttcacgtcaaatagactcatgaacttagctagataatttattgtgatgtaaaaaaatgatgtttttataatttcttgtgatgtaaaaaaatatgtttttatggagtgcaatgtaatttactttcatatgtgcaatatttatggtagtttactaaattgtcatccaatttgatcaactacaatttacgttgtactattcatctgttttctccttttttttccttattgacaggttgtggaggttgaggacattatggctttaatccatttggtaagtatatatgcggttctatgagcaacgaccgaaattgtggctttcaaggggtgtgaatttgctgtgcaaaattgtggcatttgaactgcatatgtgaatgatgtcaatttttgatatggatctgtgttgttggggatctgtgatgtttgagatggatctgtgatgttatattgaggggatgactagaatatatctgtgttttagagggcatggctagcaaatcctgaggctagccaatatttagcattttttttctggaattaactcatcagtgacgggttggaacaaaaatccgtcaaaggtaacctcacctgtgacggactagcaaataaaggcccgtcagaggtgacctacctgtgacgggcctttacttttggggttgtcacaggggtcgtcacaggtagatcacctgtgacagcttctaactacggagaccataacctctgatggcctttatttaaagggccgtcagagatgagtcacctgtgacgggtcccaactcgtcctaggctagcggagacctacacctctgacggccttctagtaacttgcccgttagaggtgggtgtcacctgtgacggccggccactcgtcaaaggtgattgaactcaccagtgaccacttatcattgaccatgcgtgaagccgtcaaagatgagggtttaggcccgtcacaggtgaccttggccagtgtagtgttagttagtactactcatgcatgtaattggcataatgctggatttggtgctgaaatttcgtgccttgttcatcaggatggacagtgtcatatctgaagttgatgtttctcttatcctgattagccctgagctttcccagagaagactcaatgtgaagtgtgaactgctggtataaatgcattcttttcaggagtttgttagcctcacttgattaagctaatgcttcaagtagattctaggagtgttctgctgctccaattgattaataccccatgatttggatctgatgagtcaactagtttcagcagtagtggctgcatatatataataagcacgcttgttgattactcatgcatattgtcatttcaggtgctatagaactttgtactacttaacaatggagggcacactcctagtagatcaaaatttgatgacctaatgcatgatatatggatttagacatgggaataatttggggacaagtgtagttgacagtcatgctctttaggattctagtgtgttgattactactctgaacatgtagtagtgagcctatcccaacacacatccataaaaatattcagattgacattgactcaaaatgcatgcatgtatatacatacaaaatgatacataatttggaaagcactaatgatggatctaggggttatgtcgggctccaataattcttttctttttgtgcagattcaactcgtcttcagaggaaaccagctaccttgcagctgtttctgatgacaagcttagctactactactgtcctctactgtactagtg

SEQ ID NO: 103144 - DNA, 706 bp, Oryza sativa
attcctgcagcctaaccggtggctggtgttccacaacgggagtaaagaagtggacaagaattagtggtcattacgctgtcctaggggaaatttttaagccgtaatgacgcagcatataccaaattggcagcacctctaatcatttagtgcagcatatctttaggtcctaatgccccatcaggaaacatgtgacaaatttgatgatggcatgcggctcagcaacagttcaacaagataaacaagggattaaagcaaacaagccaatggcagaattgacgaatcgaattactgccgcagcactacacaaaggtcatgttcacagcctgcccagaggctgaagattgaacttggtactcttcaggagatagattataggacgccgttcttttcctcccacatatagcagtacaaacgatcacatgtacatttcccaaacccctaaacgcaacgatttttttcaaaaagaattatatataaggttaaatattgtttaaaaaatatgttttcaaccttgcaatagttaattcattcatttataatcttgtaaatattatcacaaaattagataatctatcatctattcggagcaaaataactgtgcagtggtatttttgcgagtaaatcgtacttcggactacaaattcctaccaaagtttcactttgtaccactctcacaatgtttttttttactttacactaggtattg

SEQ ID NO: 103145 - DNA, 4076 bp, Oryza sativa
aaatagcagacagtttgccgtttcgcctatttgaagatatgacaaaccaaattcagatttcttctcagtatgatagagttaagtcccagtactcacctgcgcagatgtcaactgaacttttctgaaacaaaaaggtgcttgctttttttctctagagatgttgcggttctttgaaatgtacaaaagtacgtaaactttgatattcttctacaaatgtaagcttcttagacatcacttggcaattatctttacctttttttttccttgatgattcaagcatgtcattcctatggtgctatactgctatccgaatctctgtccgctggaactatacgattccaactagactagtttcattgttgcgctttctttacatttgatggaggctataaaatttgaattcaagactgaaaacctagtctaaatgctggcttgttggccgttgtaacaaatgcacttaccttctgattaacagtgctaaatatttatctgtgactgcagagaagtgcaagcatctggatctctgttttgcttatgattgtctaggactaacgagtcatgtgggcaagtcagttctccacgttatcactactttgctttggcttaatataatgctaatccaattccccaacacgagagagaagctaagttgtcattagctgccaataaccacaacggacatagttcctctcctagttcattgtacttgtacactgttcagagttcagcttaactttgtcgttgctgcaaaacaattgcttgcttttggacgatgcatgaaccttgagaaacgcattcgtgaagatggctgttagctctatctttgatgcattggaggacttcacatgagtttgatcagcacccttgtcttatctgtaatatcaaaaggagagtttaatttcttcccaaaaaaatagtttaattaaggaaaaacacatttacataataatattgtgtctactttcagtaatcacaatcttagctacaacaaagagttatattttacagccataaattctagccctactgagaaagtgagaaggtgtgaacatcaacatcaaggcccttacgagtgatgatatattttcttaattgtaaactactaatgctcaacttacatttccggctggtatatgtcactttacagatcagtatggtctatctcaaactttcttttggtggtcattttcatgctttagtccatcatggaatgaacctttcatgttttttttatgcatatcctctcatggcgctagccagagattgcagaaaagcattaatgctcagccattgtcaggtcaacccccataatcacccatggcccaaagtcaacacggtgctatattagcagagctgcagaggcactcaaggagattggacagagaagtccactatgttgccacctgccactgccataccaatccctgatggtccactgtcacagctttgggttgacttgttgggtgatttcaaagggcagaatatgaaaaaaggaaaaggttatgagctaatgcaaggattagttcaacgcttaaataaatgatctcttgaaaaaggtagctgctatggagggagaagccattacccaaccatgatccagaccaggccatgagttggtcatgacaagaagatacacttgacaaaggaaaaggctaaccttagggatgatgtatctaattacaatttacaaattatctgatcacgacataacactacaacaacagtgacacagtgtacctcagctcagtagccgttgactctagtgaacgagctctgcatgctttttcttcgaataagaaaaaggaaaaggagagatgttcattcttttcagttttttaatcataatgttaactgttaagctaggactccataagctgtttggatttgatttgcctggttgaccagatcaccagtgagagattggcgcagcaaccggcggattttgatctcaggtttgtggccggaactgcgaggagcaccagccggagaatgttgatctggtcgactagctttggtttccactagccgaactctgaaagtcagagaaaaaagagagacagtttatatgcgttttcagacttcagagttgtccttaccgtctctccttctcatacattagaaaggggaaaaatgtaaattcagtagtcggatttgcttcaagattcagaatgagacaggtgtctgatgaaatgggataacctgaaagtgaagcagtgaccatgatgatgcatgaacctcagctatgataaactctgcacctgcagattggaacagtgaacctgccatcatgcgcgtaccatgctgctgatcttaacaattatcatggtcctggacaaatacacgcatatcaacgtcgatcgagagccatcagccatccatgtcggcagcgcataaattttactgtcattgtcagtcaccatgccggcagagcaaggcctcgcatggttcctgacaaggcgatcgatcgatctattgcatgcgattcttgttgcttcgtgttgggcctgaatatacttggtatgccaggcccaatagctcaggacctcgcgaactgactgagctgaaaagcaaagtctattttactttccttctttgttgttccgattgaatcgcctccctcaatactaaaaaggggtataatgcctcttgcatctctgaaaatcgatacaaatcgactcattggatagtttaaaaagcaatttctgctcacgtgatatgttaacgtgctaagtcagtacgtgagacccacacgtttgttccaactaaaaactacacgaatccacgaagaaccaaaagtagtatttcttttcgataagccaaaaagggatcggatttgctatactactttttttttacgcattttttttaaaaaaaaaatttttgacgcaaaactatactacttgtgacagcatttttgctaaaaaaaacttccgaattgtgaactacccacgtgcttattccaacttaaaaactacacgaattcacgaagaattccagcccaaaagtagtctttcttttcgagaagcccaaaatggagcggatttgctaatactacgtacggcaattttttccccttaaaaaatttcgaattgtcgaccgttagatcgtgtctacgattcgtgcagatcggcgtgaggaaaaaagatcacactgcccacacgaggaagggaatcaatcctgcgaccttagatacagagcctgcgtgggctaaccacttggccacgaacgcttttcatgtaattacatgctatttatatataagttacaatgtaattacagtcttagttacaacataactacacctataatcatactatacttatatttagaggttttctaactgaaaatttgtcaaaagtactatagctacttccaaacggagcggagtccagcctagcccagcgtgtaattgaatcgatgctttagtccccgagttgaacataagcttgagaacatttgtccaaaattcacgccaagtcaagtcccagaatttggttcgtaaacaatttacacgcaaatctcatcaaagagtctggcaatttttacacgaattcgtatgaccctatccaagctcgttgtacatgtcgtcagtttccaaagcggctcttgcacgtttgcgaggagatgtgcacgtctttcctcagcccggcggcggtgatgtggcacgacacggccagcgtcctccgctcgaagccgagcgcgccggcgtgcacctgcacggcgaactcgacggcgaggtcgagcgtcacggcgcccttggagccgcggagcgccttctccaccgccctgggcgtgcggccgtcgcgctgcgtcccgtggagcagcacgttgaagcccatggcgtcctccccgccgtcctcgggctccccgacgccgcccttcgccagggcgttgcccttgtgcgccagcctcgccgtgccgcggccgccataccacagcgcggtcaccttgttcgggttgatcgccgtgaggaagaagtcgtaggccacgtggtgctgccgcgacgcgttggtgtgcacggagaggttgtcgacgacgaagctcggcgcgtccggccgcagcacgacggcggacag

SEQ ID NO: 103146 - DNA, 805 bp, Oryza sativa
tcaccccaaaatttttcaccctatcacattatacgtttgaacacctgcatgaagtattaaatatagactaaaaataactaattgcacaaattgcgactaatttgtgagacgaatcttttaagtctaattgctccatgatttgacaatgtggtgcttcagtaaatatttgctaatgatggattaattaggcttaataaattcatctcgcagcttactgacggattctgtaattagttttttattagtgtccgaataccccatgccacaccctatataatacttgatgtgacatgccaaaattttacacccctgaatgtaaacacctcctagcctgtgtttagtttctaaaaaaagttgaaagtttgaagaaagttaggagtttagaaaaaaagttaaaagtttatgtgtgtatgaaagtttttaatgtgatggaaagttgggaataggggagaaactaaacccggcctaagcaaaaacaaaaatgcaagcacatgtgaaatggagatttgtggacatattctagggagacctagctgaagtcaagcgtcaatatcatcggtatcaggacaccacgcgtatgagcgatccgtattcattgcttcggaaaatgaaaggtgtgctaagaatgagtcaactaacttataaatcttcacatcagcttttgtatgatgtggaagagagagaagataaggagagagagtgcactatctcttcttcaagagctaagctcctaaacaaaatgtgagagtggttgtggaacccaaagcattttgaacaatgtgctacgagacaacctattaaaaga

SEQ ID NO: 103147 - DNA, 655 bp, Oryza sativa
cctgaaagagaaacataacccatattttagtctgaacattctcctaatctcctgtggggcatgaaatataccattttagtctgaacacttaggtaatcattcacaaagtcaggcaccaattcaatctttccaaaaagcagttcatttggattgtctgaaaagtttagctttcctgaagtgcagtaacagatatgcaattacaaagacacctatgacttatgcaacggactgcataatttacctggccgaggaacaacatattcactcaagaaaggagacaaataattcatggaatgaactaatgaagtgaccagagaagataaaatatttacctggtagaacaaccgctgcattgcattgttgcaatcagagacactcccacggaacctgataccagctactctcaggactatgcgatcagcactggaagtctgaaggggctgccaacagttgttcccttcaatcttcacctctgcagtggcgacgataccagctgtcaaggttaccatgagagctccttcatgaacttctaatgagagaaccagctgaagatgggacttgttccctgcaaaacgaatgagaataaagcgagctaagttaatctgaaaggccaaagaacaacagttacatgtcaaagtaagcatgatattcctca

SEQ ID NO: 103148 - DNA, 664 bp, Oryza sativa
aatattagaagtagagtatacagtccatataggaatttaaaactaactaaaattcagaataaacataataaaattaaaagttgagtttagagtttgcataaaaatacaatttacaaataaataaaattcgaaattaaaaaaaacatgggaagaaaagtctagaagtaactgaaattcgaaattataaattaaaaaatattgaaagatgagtttcgagtccacatagaaatacaattagaaataataaaaattcagaattaaaaataaataatattggaagaagagcctagagtatatatagaaatataatttacatataacgaaaattcggaattaattaaaaaaagaaatattgaaagacgagtctagaatccatataggaatataatttacaaataactaaaatttaataccaaaaataattaataactagcacatatataaaatacaatatgaatattacacattagtagtttcgtaaagttagtacaaaatttaaaattatgttattattttaatatttaaatattacattgagaaaacatatatactattatatgagagaaaaatataatgatgctagccgtacaatctgcgcgggccaccatgctagttattctattattctagaacatatatgtgcttgtttcttttttttaagacg

SEQ ID NO: 103149 - DNA, 3508 bp, Oryza sativa
ccgctatgcgtggtcgatcactgctagacctaaggagggttgcaaaatgccccatgcacaacgactccgcctggaagatcgtcgacgagttcccggttaaccttacgtagaggggttggagagagagagagagagagagagagagagaggatagaagatccacttgtccctggtgacaatctgacaatgacaaccaaaaaccggcggcgaccaaaccaagagaaggcggcaaaggcgaggaacaaaacctcctaggcaacacctccaagaaggtcatgacaccttaggtgccaccgttgtcgttcaagctggaccgggttttcacttggcgagtcttgccaggtagaggaatggtggccgctcgacaatacccctaaagggatcatgactcccaaaggcatcgacattgtcagctcaagaaaacctaagctaggctttctcctgcgacactctctcccaaacctgtcattgccaccctaaatctccttagcccaaacaacctctaccagctcgcaggtccaccacaccggcgccccatcgtgggctagcccaatgttgcctcccgcaatgtcgtctcccacgccgaccaacacttccagcagccattccaacccctcgccgcaacagccgtcattctcctccgtccacgttggcctcacccgcactggccgcctgcttcccccaagcctgaccggcatgcttgccactagccacaacaagctcttgttgccattgcccacgcgagcctcacatcactatcactgacgagagtcccccgttgtcatcgtccacgcgggcctccctccgctgttgtcggtgcggccttccggccatcgtcgttgcggccttcccactgttctcgtcgccaacgcggccttgccaccgccaccgtcgcggccttctcacggacgtcgtccactcgtcgccaccggctgctgaggcattccgctgccgccagccgccgtcgccagcgcgacagctcctgtcagatccagcgcggaggcgccagatccatccgtagggagaccggatcctcagcctctatgtcgtgctttcatcccctagctcttggcgctgacccaccttccacgcaaagatgcagagcaccatcgaggtttggcctcaccaccaccatcctagctaagctgctcggtttccgtgctccggcgacggcaaggggtgggagaggaggggagagggattgcggaggcactaggtttctcctccgagtcgcctgcacgtgggctacacgggggtcgggtttctgatttgtgctcagaacataaatttgacatagatatatctactacatttcaggggtaaaatctttactcaaacctatacttttaccgtccttttccaaatatggatgatgtttaatattaccaaagaggacaattaattaaacactatagtttattatccattctacaccctatagttagttccaaaaataattaaacaaagaactatgtaaaagtagacatagtcatttattgtatttcatttaattcacatagagaaatgaaaatacatggaaaatacacttggcatggtaactattacaccagcatcatgtccacttcaaggatttccaccagaaccagatccataaccatacccttctccaaattctaaacctgatccattacccgacccacgcccatatcctccaccctcaccatacccagatcctgaacccgacccactaccgccaccatagccatacccttatccgccacccgacccagctctagacccggccgaggaccctgctcccgatccacctgacccagcatacgatccggcactcgacccagcagaagaactagcccctccaatcgagaccgacccagatcttgacccggaggtagacccagccccagccaccgagccggaacctgacccagacccagaagcagagacacctcccgtacccgctctgaccccaagcccaagtccaatccctagcccaataccctgcccgctacccaagccgatgtcgaggcccatcctcgccacacggcggctctccacgcagccaccggacatcacgcacaggagcgccaccaccactagagcagcaaccgcgccgcccttgccgcccgccatcctcgttttttccccgagctggcaatggacgaaactccgcgcggtggtggcaagcttttataggaggcgcggtctgcactgcacgcgaggccaagaggaacaggacgatggccgcagcatcgatcgggtggtcgggcgtggggaaaaaaaccctcagctttgtgcacgaaacgtaccgggaatcaagtcatcatgtggtcgagctagcacgcgatggtggcgcggtggtgcaacgcgaaaaaggtgcctgcctgattgatgaatcgattgatttggctagtgcgtggagtggttgcgatgcatgcggtttggttagtagctgcaggagaacgtacgcacgcaccggccggcgtgtcgttcgtcctccgcgcactaaggtgatgggtttggtataacctgatccatctcatctatcgatcgatctgcaatctcgttcttagagatcgggtgatgatgtcgaaagttcgcgactcttcagttaggcagattaattcatatatcgaatagtacttgtcgtgatcgatctctccggatgcactatagagatggtgatgactgaactttatcaggatcttggacaatggatgtgtgaattgcaggtagctccatacctgcaaagggattcatgctcgccagtggactgggaatctgtactgtagctcttttaaacggcgatgttgtcacagccgtgcagtacgaaagctgtagttggcgacttggggttgtgttcggcacccctttaagaacccctccctctcgttttccacaagtatgtttttcaaactgatgaacgatgtatttttttaaaaaaattttatacgaaagttgcttaaaaaatcaaattaatctatttttaaagaaaataactaaaacttaattaatcacgcgctaatgaaccgctccgttttttatgcgtacttggtgtcgctcggactctcacacttccacacttgcagtggcaggaatgatgctgatgaatcttttctcttttactttgatcgagcatgcacgcgcttcaatctgtcaatcagacaaacgaaaatgaggaaattctcatgaactgcctcccgtaatttgctcctatgtctgtctctctttcctcagactgaggggatgatcgacctcagtcgttctatacacgaacagagttttccccctgtccaagcattaaagagagactctcttaattactccatattaattggcacgtcatgcacacaagtcaacttttttaaaaaaacaaaataagaaaaaccgagaatgcagtatgctaatatgctatacttgaggaagtctactaacaaaatccataggtccaagtaccacatgtgaaacgggaccatgattatttgacgttgatatacagctgctttgtacgtagctagcaaattaaagc

SEQ ID NO: 103150 - DNA, 673 bp, Oryza sativa
gacttagcatatatcaccaatatccattgtaaacttatccattcatgcactgagcaaagacataatagtagagtattacgtttcctagcgatccaaacctatataaaccatccgcctccactctcttttgtacctgtcccgaccacaagtttagaaattgcacccatgccgaactctcaagggagagtattttgcctttccgctagaggagttttgtgctccaacacccaatatcacaaactcttcacgctatcccacgaagttctccacataaatatagccttcaaaccccactttaaattcaatggtttacaactagaatcaccaccaacctgtatacaattattagcgatcacgccaaaacgatgacatgcaacagttaagccacatgataatcacgtcattaatgagtagccagctccgccaatcaattatgtgcccatagtatgaacgcagaaccgctaaaaacttattttttaccaaaaagaaaaaaatacaatccctaatcttataccaaaaatttaaactttgctcatccatacagaattttccgtacaattacagccttcaaactatctcattaacttgaagggctattgacatagatccattcgtaccgcacggattaagatcctctaacttactttcctctaatactctaatagaggatcct

SEQ ID NO: 103151 - DNA, 706 bp, Oryza sativa
cgctttatgtgtaattgacctatgatcgaaaccttgttgttgaccttggtcttagagtaaggtatttcaacttaagttgcaagtcaagcattctgaatacagattttgtaataattaaccaacatattaccaaatattattgattctatatatgctcctttagttagtaaaatatatatcattactgagatatccgtgtttctataatagttacaacttatcaatattttcttaaaaaaaactactcccataactgaattttatggtaaattgtaatactcttattcttataggatacctacaaaagtttttattcaagagaaccataagtgatgggttatcacttatccctcagtaatgcatgaggctgaagtattctcggtacgattgtatcaccttggtgtaattgcttggtttaaataaaatgtttcattatacagaaaaaggtgacattataatggaagtgattcactacatcaaagtagaaaaaaaaagaaagttaatgttggcaatgtttttttttctcaacagaagtcaccagtggctaaattatgcggatatatatgtccacaaacattttgatttctcaagaaatccactcatatacaccagtctttatagccaaactatacatgagcacttgtaagaatcagctgatacatcaaacctaattataattgatgtagtttcaaatcattatgtatgg

SEQ ID NO: 103152 - DNA, 1763 bp, Oryza sativa
atcaaactacttacagatttggaaactagcttcgattggggagctcccctgcattttatatggagtaagtatataaaagaaaatgtgtgccctgcgctgatgtgcttattggttcgaattgcactggtatggacgttcagaaagtgatcaagattgagtaacttttgtagggtgtttttgcctctggcgcaaacttctttctccaatcctggtgcatatcagtgaaaggccccctttatagcgcaatctttacaccactgagtgctgtgattacaacaatattatctaccatcttccttcatgaggaacttcatataggaaggtatatatttactcatttcatttattatttgggtatccatgttgttcctacttcactatacaactgcttgcttttaatacttttttttgtctgtactgttgtgtacatgaatgatcattgggttgtaatggtatcctcttgtgcagcatattaggtgcaattgcaatcatcattgggttgtacgttgtgctatggggcaaagcagatgatgcaaagagtgaggggctgaccatcctgtcaaatgattccaaaaggataactgaacctgaatgtacaggcgtcaaagttgaatgtggaaccaatctttcagtaccactgttatctggtaatgcaaatgctaatacttagacattttttcatacttgcctgtgaattgagaactgggtatttttcatactttccatcgcatggcaaatgtttatgattcaagagtccttgaccagactgaatgaacaaatggataatctggcaaaatgctcaacatgatgcttgacgaagaatcgaagattgctggaggttgctgtcaaaactgatataaccttccatgtaaaaggaaaatactgccgtcagcctgtcaccgatagagcatttcgtagttaaaacggtcgaattccttgttcaggcctccttttgaatcagggctttgtggaggaattttgtatgactcaaatgctataaaaaatttcctatcattgtacccatcaaaatcctatgaaattcttttggagtggctcaatgtatggaggttttggaggaaaattagtatgaggtcaacctcttggaaaatttcttttgagtgtatcttcctcatgcaattattgttcttttttttagcccattcaaacggttattcctataattttcatgcgttttaccatcatctgttttccatatgcattcctatcaaaatctgatatcttaaatccctgcttttcaactagtagttctgaatgcattcttactggaaactgcatcagcacaatttacacgcagtaacaatatatcaaccgatggttcaggaacttattcagagtaagtttgataaatatatacaacttactccctccgtttcataatgtaagactttctagcattgcacatgttcatatagatgttaatgaatctagacacgtatatatgcctagattcattaacatatatatgaatatagacaatgctagaaagtcttagattgtgaaacggagaaagtattatccttcaaaaggagacatatagaacttatgtccttttatttgcgcatgtagcataatctggcaagcacatttgacacaaaccagccatcaatccatcaccgccttggcattactaggacaagataagaatgggcactaccgcattagtaagactttggaacttcctaccaatgctggatttagtgaaaagcaaaaaggttttaactatgacgagattatagaaagct

SEQ ID NO: 103153 - DNA, 706 bp, Oryza sativa
ctctaaattatgttacaaatatataaagagctatctatctatagtcagttacagtgagaaataacaaaagttacagatgtaactactgtacatctaactgtaactgggttgtaaatggaatcattcttaaatttctttaaaaattcagtattcatgcagcaacattaaaacactttcccctagtataacaagctctaaattatgttacaaatatataaagaactatttatctacggtcagttacagtgagaaataacaaaagttacagatgtaactacagtacatttgaacagtaactgggttataactggaatcatcctttgatttttttttaaaaaaaattcagtactcatgcactaactttttttttgcctatgacaaaatgttctaaattatattacaaataacctaatcatgtagggtcaggtatattgcaatctcaaaaatcaggagatacacaattagatggatatgaaatgagaagcaaaattgtgtctgaagaaatgagaagcaagaagacagttaaaggtgagaatcattctcacctagcattatggaccattttttatcttgtcagaaaatgtcatctagcaaaaatttatatacaacaaattagagatagtagcatgataaatttttaaagaactatatatctatatccagttacagtgagaaataacagaaattacatatgtaactagagtgg

SEQ ID NO: 103154 - DNA, 755 bp, Oryza sativa
actaatcacggtgaatctggtcgaccgcccataaccgcgggcacggctattcgaatagttttactctgatcagaggtgtacaactgtacccacaagacacaaccccacgacacgttcccgtgcgccgacatgccaccacgacataccggaaagaggccgtgacaggacccttcgcataaccctctctaaccgatcgcaccacaccttagggttcgcccccgtccccagcaggcaacgggcagcccccctttcgttccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgtagtgtattttaattaaccaacaccattgcggtggcactaatccaaagctattgccaataatcaaagtctatgctttaatgtggtccccttttgtgcactagttgaactaagcatggctaagcatctcctaaaccaacatctagtcattttaatacccaagttatcaatggcgtaagggaaacaacatatagctgagtaataggacccatcccacatgatattgtaaaacaatgcaatatttaatagaaatgcgggacatttgtaaattaggta

SEQ ID NO: 103155 - DNA, 644 bp, Oryza sativa
ttcctccaagcagtccagcggatgcgatgagatcaccttccgtctgacatgtggagcagggcacggaagtctttgttttagtcatcaatggtcccacccactagccaccgattctgatgaaggggagtccatggagtgagcgctaagtgtgcatcacgttgcccaactttttctctggggcgacgtgggtacatgacaggcgacatgcacagccacgtgccccatatcaccctttatctactcacaggattcgcataaccctgattttaattaaacttgggaataagtttattttatatcactctcatctctatcgaatcgcatcccttcaatcacaaaaccgggtataacctttctctcaactttaaaaatatgtgtaaatcaactccttgaatgatttggaaaacggtttatttctaacgtgccaagttgaccatggttagacttgctgagtcagtggatgggtcccacgtgttagttatattcctttctcgctcctcgcctctccctctcccgtctcttgctctctctccggtctccacacgcaggcaagcacgagcagcggaggcgggagaggccggaggacgcatatgttccgtttcatgtattgtactacctcggtattgcggcgttggttggcgcgg

SEQ ID NO: 103156 - DNA, 1416 bp, Oryza sativa
atccacgtatctctctcacatagtttattagaactcgtacgttagctggctataaatttgtagctcgctttgttcaccctcccctatctctcttcacatacataagttataagtacaaatctaacatgttaacttgtataattcgcttatgttatcttatggtacttgctcttaattagggaagggtagccgatggctgtggcgagcttgaggaaatggacgtttcacccaaccgcggcgcggaaatcgctgaccgggccgggcgcgcgggggcaaaatggctcgtacgtaatctcgtgccgctgctttgcgttgcgcgcgggcgcggggcggcggggcaaaattaagcggcgaataatggattcaacggatcggtcgatgcgcgcgttgggtgtgtggagtggacgacgcgcggcggggcgtgtcgtgcttgagttgcgccgagctgaagcggacgtctcaaccgaatcgacgtgggcgcgtgtgtgtctgtgtctgtgtataccggcctgcatgctagctcgatccgggcaactgtttggtcggtagaaactgtactagaaacgaacggggggactcccagtgtatgcactcgaaaaggataaaattccaacgctcttcgatggtaagaatcatgtaaaaaaagtatttaagtaccatatccgtttcatatttgagtggttttctctagatttaagttttgttgcaaagaatattgttattgacttaaaagttatcatttttgtgcttttcattagatttatgtttctccttccttctgttcttctgcatacgtgtgaatgggatctcctgttcaaaacctcgaccatgtaggcacttctctcctcaactatatgtctccttttaggtgcaccttctcaaaccctaggaaaagaacatatgagaagaaattaggtccaaattcaagcgccccagatctatagtactatgagggatttatgatctgaagtacgtaaataacaaatcaactacataagaaaaagatattagagcaggtacaatagtggattataagccagctataaacacatatcgagaagataaaatagtaaagaggggaacagcgtgctacagatctatagccaactgcagcacagacttcaagacacaatgtttatatgacagatatgaccatgcattaataatatagtatatgtttatagataattattgtatgatttgactattaaattgactacacatgatttggagccaatagttaactataccattaaacttgctcttatcctaagcgtttgcctagttttgatttagaccttgtcttttgtctctgtggagactgcagcctggtagttgctatcgtctccgttctcccacctggtgaaccctacaaaaatgaattgaggcaagacaagaagaaaaagagatcattac

SEQ ID NO: 103157 - DNA, 739 bp, Oryza sativa
ttcctgcagcccataattaaccagtacagtactaggtatacttgtgtagaagtggtagtattaggtagattggccatggtcaaatttgggttcagtcagagagaatttataggctgaaaggaaccgggtacaaaaattaaaccgcaggtgatccaccgcactgcacgaacatacgcaacgctcatgtacaggacaacaggtcgtctctgcaataaagcctgatggtgcttatgcagttcgttgcccttttcaggacagctgaactgagctacagtgagataacacacacctgctggccaaatcctctgcaattagttgagtttgatatctgtcgttgttcagctaggaacgcctagctgcagtacgtgttattattgttctatatcacccccaattaacttgccaataatttggatggcagctacttgcaccgtcgagatacggatctctctttccgactgcgaagtaacagggaaatgaggagaaatccaacatctttcttgtggatagcaagcaagagagatgcgcgctcacacaatttcttcctaaaaaaatatttggaggaacgtatctccctcaaatcttgttcttttaattagcaatcaagaaaaatatgttacatagcatcatcctagaatatgctaagatatacatgacagtgattttagagtcgttgaaaagataccatatttttaagggggtgtttagatccagtggtgtaaagttttagcgtgtcaca

SEQ ID NO: 103158 - DNA, 690 bp, Oryza sativa
tacaatttagaaagagttgaaattcggaattaaaaaataaggaatattggaagaggagactagagtccatagagaaatacaatttaaaaatagttaaaattcagaattaaaaaataagaaatattggaggaggagactagagtccatatagaaatacaatttataaataacaaaaattcgaaattaaaaataaagaatattagaagaagagtatagagtccatatagaaataaaatttataaataactgaaattcggaattaaaaataaagaatattagaagaagagtatagagttcatatagaaataatattaataaataatagaaattcggaattaaaaataaggaatattagaagtagagtatagagtccatataggaatttaaaattaactaaaattcgaaataaatataatgaaattaaaagtagagtttagagtccgtataaaattataatttacaaataactaaaattcggaatttaaacaaaacaagggaataagagtctaaagtcaatataggaatacaatttagaagtaactaaaatttgaaattaaaaattaaagaatattaaaagataagtttagagtccacatagaaatacaattagaaataataaaaatattagaattaaaaataaataatattggaagaagagactctatatagaaatataatttacagataata

SEQ ID NO: 103159 - DNA, 739 bp, Oryza sativa
  unsure (1)..(739): unsure at all n locations
tcctgcagccccagggagtttgttgacaacaaagatggatcgtatactacttattatgtggcgaaaaataccggtttatatagaatttgtattcagttgaggatgcacaactgaaaccttgcccattcgaagtgcatgnttgttcaaggggaaacatttcagttggtcagatgagattcatagttaattcaaaaaaaaatcatagaaaaatttgagcatcaatacttctgtttaattgttaaatagctatgattagctgaaaaaaaaaacatatctcatgcagatgaagacttctccacggttcaaaacgatataatttcagtacgggagaatgaatctgtttcctttgatgtattgtcaaatgactacattgcaggaggccaagctgtagttaatttttatccggtaagcccatgccgtcaactaattccccagatcagccccaaaactatctaagaaccacccaagggtctttcggctagcttcacaaagtggtgagcttttcgaagccataccctttctaattatttgatattaggtcattccctaatattcgcgtcttttcagccccaaaactatctataacttcttagtgataaccacaaaattttctcatgcgatatattagtcttgtacatgttaacactttaacaacacaacttataatatactacaaatctagcaaaaaaagtcttttaatatgtggatcggagtaatattccaacttaaaatatactat

SEQ ID NO: 103160 - DNA, 727 bp, Oryza sativa
atctgtcctcgagtttgtaattcgtccttaaaccacaataataggtatagcccgtccccgacttgcaaaaccgtatcaacttacgtaaggcatatggctcttggttttcgtttgacgtggagctttgagtacggtcaactgtgctgagccagtgtgggacccacatgattcccacatatcagcaacatttccctctcttccccatcctcaccaatcaaggaggtaggggtggcctcacatggagaagggccgcggccggcatcccagggaggcgaacaggcccgtccttgagggcgtacgacatgagcgcttgcacaggtccccaagcctatatatttgccttccgtgattcaatcccattgatccaattgataacaacagaaggcatggaggctgctggagcatgagtgtgagctcaattaatgagagaataacgttgcacacgcataatggttccttttttcagatcgatctcaacgcgtatccgctggcctgctgcccaatcgcctcgctccctcgctacgtttttctttattttaagatcaatcccaccgtcggtccattcatctaccgccctgccgccctatcccttgccggatcaccctgcttccgatgccggagcgctgcatctctgtagtctgcacgatgaaaccaccacaccggcaaacatcacgacggctgtaggcgtcgtcttgtgttttttctagagaagattatgtgaaggtat

SEQ ID NO: 103161 - DNA, 714 bp, Oryza sativa
ccaaagaaggggtagcaactggtgtgacttttaaaaactatatgtagaaacacgaggatgataaagtttggtctttaaagtcttaagataataagatagctatttaataaattttaagtaaaatcatcctaaaaaatatatgaatttgtttgggtgctagccgcgcaattgcgcgggccacccagctagtttatattgattttagtgaatctagatagatatatatgtctagattcattaacatcaatatgaatgtaggaaatgttagaatgacttatattgtaaaacggagagagtagatgttatcttgtgaggcggtctggtgattgtgtttacacagtaataaaactgtagctctgtatgctatctcaggtactgtagtttgctgtttgcagttgttccaatcttgccaaatcttttgttacgatgtacatacactgtccgcatatctttgtccaatgtgatctgtatgagtttccacggactgtatctactgatatacagtaattgtgagcgccgctatttgaatcttcagcgacttgattggaagtaaaatcaacgatcttttttttagctcaagccaggccagcattgatagttactcccttcgtttcaaaatgtttgacaccgttgactttttagcctatgtttgaccgttcgtcttatttaaaaaaaatttgtgaaatatgaaaaattatatatgtacatgaaagt

SEQ ID NO: 103162 - DNA, 684 bp, Oryza sativa
gtaagagtgctattgatatttgttaatattgtgctcacatttataacataatgatttctttcacctatacgaacaaatagtacaaaatccaaatacgacatatataacacaatacattataattattctgtaattaactctcggtttcagtttaaacagagctaagtattggaaaaaaatacacaacccatagtgcttaattcatctctcgctgcatcacacttttaattttcttttcatgttattaacaaaattaatcatctccatatatgatttgatatgtggcaaagtggtagtgctgcggtagtcgtgatcaccttagatgcctcagacacgacgctttgtcaagcgtgcaaaaggcaaagctgcagacgtgcattgtgcagcgggcaaaaaagagaacttcggacgctttatttattagcaaataatatatcagatgatttaaataatgggtccaccggttctagtgtaagtgtacatttgttaatatagattttaaattgttaatttaatgggtacataatataatataatggtgtagactttattttgaaaccatgcattatttgagaataatagtccaatgtaacaaaaaatagttccgatgatttaaataatgggtcctcggtttaagtgcacgtataaatcaattaatatagatcttaaactgtttatttgata

SEQ ID NO: 103163 - DNA, 645 bp, Oryza sativa
ttagcccatttaattgcagagaaaaatttaagcccatctggaggtttaatccggccggggatcaagttaatttctgatagacttggcccttttcttttctccaagaaaagttggtagccccatcgtttggcctaaacagccaaagaataagccaaaatttaaatttttgaacttgattttgaagttgattttgaaatacttttaacgtaatcttttgttaatgttggcttttaagtcgctacgaacaaacctacaaaagttttacttataaattaattttaattttctaataagccaaataagccattttggccaaatggacaaccgatgggagcctggataaacttttggatactcgtggcatgtttttcaaactactaaacggtgtgtttcgtgcgaaaactttctatatgaaagttgttctaaaatatacgattaatctatttttcaagtttataataattaaaactcaattaatcacacgttattaccaccttgttttgcgtgaaatatttaatcttcatcttcattttcaggagattcaaacaccacccgcctcataaaaggcttattatgtccatgtagtgctaaaaaaaatggaaaaaaaaagaaatcggcgttaaaaaaaaagaaaaggaaaaaaaa

SEQ ID NO: 103164 - DNA, 1290 bp, Oryza sativa
  unsure (1)..(1290): unsure at all n locations
gttctaatcgtgttagtggaagcaacactgacgtgacgtacgtcccctcgaccaaaagaaatagcgatctctccacttcatcaaaaggtttgtatgcattgtagaatattgtaacaaggttttccncaggtgttatcaattccacttacactccatcgatcggacatgagtttgtctccttcacaaatttgaaaaagaaaagagaggggctgtcgatttataaaaccttgtaagaatcgcagacaaattcttcttacgttccaaatgtttgatatgctttatccgataaaaataataaatttcatacacagtaaatcatttatttcaagaacttaagaagtgagtatgctagtgcagtagtttagtacgtaggtataatacattacaagaacttttaacttttaagtgagcatgtaggtgcaacaatttataaggtgtgtgtgattttggtataataacttaaaaatgatacaacaacttaattattttgagtattttttctatacgctacttattttatcaatatactcatacatattttattttatcatatacttgcacatatttatataagtatgttattttgtcaacctagttattttactatatagaaaattttttatttatgatgagatctgagaaggtgagagagaacatccaaacggatggtgcaaactgaatgatcaacctaattcttatagattaaatccataattgtaagataatatctgcagctggagcataggaggtgtttttcaagtgctgagagcatcagaccaagcagcatgacacaaaagaaccaggacctgcaaccctgaatctttgtttgaccagttttgttatggtgaaaaaaaaacaaaaccggatgccatagtgccatgccgctcctgcctgtctttttctgtgccagttttcgcttgccctcaactgaaattctgaaaagcttcctcctttgctttaccaaaagtcagcaggcagcagggctagttctcttgaagagcacgaaaaatttgaatattttttcctgaatactgagacgctcttttgatgggactaaaacttttaattacttatcacatcggatgtttggacactaattataaatattaaacgtagaccattaataaacccatccataatcttagaataattcacgagacgaatctattgaacctaattaattcatgattagcctatgtgatgctacagtaaacattatttaattatggattaattaggcttaaaaatttgtctcgcaaattagctttcatttatataattagttttata

SEQ ID NO: 103165 - DNA, 741 bp, Oryza sativa
ttcctgcagccttccgagatcacggaaatttcggactgataaaagttgaaatttaaacaaaatttgattaaactttgaataaaatgtgcttaattaaataaatgaatatgtaacccgaaatttccaaaattttggaaattacgatccgaaacattgaatcccctgcgcacgccaagatcataagatcaaatgtcgactgagaattaatcaacttgctcttccgatatacgagtctaaccatgtttgatctctgtttgactgcagggcaacggtaaaccaatacgtgtactaccagggcctgcatctgggatcgtcgtcgatggcgacggccatgagcaacctgatacccgcgatcaccttcgtgatggcagcgtcagtagggtgagttcatgcatctctcaaacagatgatacacctctctgaatttctgtcagttcatgcactgtaaaacacagcaaattaaactgcatgcattgttctcttcgcttctctctgcaacggcgtatcctgtgcttgatcccttctagctagttccagaatttggttaaatttaattagttggtgtccatcaatcacgaacgggaccaagtaacacatgcatatcgtaccactcaataattgcgttctctccgagctagctactgtgtacgtacgtgcagagggaacaagaggacggatcgacataatcaccagagcacatgatcgaacagcatttgccatcattctgacctgtaaattcag

SEQ ID NO: 103166 - DNA, 1798 bp, Oryza sativa
cccttttttttaacgaaaggcaggagctctgccaatgaatggccacgattttgtaccgcgtggaggtattggacgataaaaaacctctttcaaaaaacaaaccttcccgctggcctgccagttgttgctgctctctgcaaacctgctcgctcccccggcgctgctgctgcacggctgctcctccttgcgggcagcgcgctcccgcggctcagccggcctgctgcactgatgctatcgcggccgctccgtcacggctgcgctccgatgctccgttgcccgcctacttgccggttgccgcagagccactctcgatcgcctcgcggcctcgcgccaacgcaccatcgcccgctggcgttgcacgccgcggtgccgccactcaaagggggactcagggggaacaatgggtccggtggatgtaggggggctcaagtcctcatgtacccacgttgaatttgcccctgactagtatataacttgcatgtgagatgttaggtaaattttgctataggacatcgcgacttcgtggttttagttgtaggacaccgcgtgaagtgacttttaggaagacactctcaaatgtgctataggacatcgcgacttcgtggttttagttgtaggataccgcgtaaagtgacttttgagaggacactctcaaacgttggatattcgctcattaaaataaaaatttccggttgaagaggagagaaatcacgcgaaatatcaaaaatacccttgggcccatatgtcagctttcctatctctcttcttttctctctctatcttcctccttccggcgtcactatgagaggcgagggggcgtgcggaggaccgccacgagcgcgacggccgtgcaggcggtactgcaaggcgaggcggcgagcggaggtccagcgcgggtgcggcggctatgcgggtggcacggcgaggcgtagtggcgcggcggcggctgcagtggctcgtggcgacaccgtgtagggtgcgtccggctggggctcgtggtggccgtgcgggtggcacggcgagatgcaatggcgcggcggctatgcgggtggcacgcaatctgcctctgttccacgacattgaacttcatcgttccttctttcctcggcaattcttgctcctgtgactcctcctagtccccttggaactaactcccccatcaatttcatcgatttgggccataacagtgccaaacccgagctccaaagctccgctcatggaggtcaccgtggacatgccatcttggggactctcccttctattttactggaaaaacagaacccacgtgcgccgtagatgctcctgccccccctcaatttggtcggagaactcgccgttcgtccaaaccccaaaccgccccaaagctctgccatggcgttgcaatgccgcaacgctcgcccctgctccgcctcgcgccgccgccgaaggtggagggccgccggaacccgtccgcacctctcctggtcgtagccgagccatcgctggccgagtccgccccacccaagccagtgctcatgcgtctgttgccctgtccgcaccaagtcatcttctagtagtgcctttggtgctcttcgttgtccccggtggccttcgtcatctctagagatggcaacggggaattccccgtcggaggttacaccaccagacccgcctctgtggaggagaattttctccgcccccgcccccgtgaaatgcaatgaggcaacatctttcaccatcaccgcctccgtgcgggtaatttatccccgtggagccttcatccccgctctcaggtttctcaacagtcaatagtcaacat

SEQ ID NO: 103167 - DNA, 1078 bp, Oryza sativa
aatagagggtggagaaggagcccgacgcccggtggccggtgccgagtcctcggcgtcctcggcgccaccaagagatcggacatggtcgacgaggtacgagcaatatagagattgaggagagacggcgcagcgctgtgacctgggaggccgggaacgggatggcggtgtggcactgggacctaggcggcgcggctcgggcgttgggacctgtcggcacgtggagactaggggcggaagggacaagggagtggataagagatggctagggtttctagaggctttatatactctgcgtcttgggcttgtttctatggaccatatatacatgaaatggaacacataaaatattacaatgggcctccacagagagcggggacagggaacagtgaacaaaacctgcccccgttagacccaatggaggatgttttcactccatttaatcctccatggagacataattcataccacccccacctcctaatgggaggattcaccacggggaatcggtggacggggaacctttgccattcctaatcatctctaatgggctttactgtctgtatgtctctaatggacttcgtcgcctttagtgatgactagctatatatttattgtcaaattttctctcaaaaatttgtcagatgtaaatataggacaattatattgtaacttatatttaaatataatataacctataagtaacactctttccgtgaagcgggtgtcttgtaatgaaatctcctcacctatacacacagctatgattttttttcctccctttacttgcatggatctagaaacaaatctaacgatataaaagttatgtaaaaagttacatataaattacattataattacactatgattacaatgtatttatatctgtgaaaaattttgagagaaatttgatgataaatatatatagcaaaatcgtcctctaattatcgctgaaccgctatctgccagggcccaccatagcgaagtcaatacgatcagccgctgaagcgcacgagagcacacgtcgacgcacacgcaagaaactcaaagttctcagttcatatctgaagaaaccgcctag

SEQ ID NO: 103168 - DNA, 504 bp, Oryza sativa
catatttctggtttgtctataatatttacgatatcaaatgagtataatcagattgttatgagatatattttcatagtttgtttatttaacagggtagatgctaatactcttctttataaacttagccatatcctaacttagccaaacttaggatagttcaacttaaatcaaaactatatatacttatatcttggtaaggggagtgtagtatgtattagttgggatattagtttaaacttttgggttgtattttttttaatgaattgcagtttgggcctttttctaccctcatctttcttttattagtagggcatattttgttttgctaggacacgagacttttaactaacaattactttactaatatattatttatgtgatatatataagtaaatgtataacttcccattacaaatctaataacattaattaattttgtatcatataaattaattatattttaatcgagtaattgttcatcgaagtatttcgctaccggtacaa

SEQ ID NO: 103169 - DNA, 712 bp, Oryza sativa
cgcgccgaggttatcccatggccacgacgacaagaatgcggcacccatgatcgcaagcccctcgacttgatcttcttcttcgtcctctcagctcagctcagtagtacgtaggggttcaccggtgttgtgcgtgcggggagagggagagccgtgaggggagttagaagatgttggcggttgtggttttgcacccaacgcggctggtcatgcgcgctgcgtctcgggatgcttttatatacgtgaaacacttgcacagttgcactgcgactggtattagccaagggacagacagcgcgcggtcacagcggtggagggcggggaaggtgagagtccgattcgggcagcgagaggttgacgcgaatcaacgaaggatcatcgatgggatccatccgtccatccatcgattggccggccggccgccaggccacagcacctgtcagtcgggctatccgccaccggcttccccaaccagacggagttaatggcaccacacacgatcgagatttgaaacgggattgcgaccgctacgtaccacacacacgtacaggttgtgaacttggggaaatcacgcacgcggctgggccgggcacaagctaagctagcctcgtgtttttttttctacaagtaaattaatccattgtccatgtataaaggagagagacgcgtggacgcgtggtgcgcgcgcgagccgctgggcgatcacgtacggagc

SEQ ID NO: 103170 - DNA, 704 bp, Oryza sativa
ttcctgcagcccccaaattcaaccacttgtggtctctcttctcagaggcaggatgacccggccttggcctgacagaaaacaaatagggctcaaaagcaacagcacattaagcttagtataaagaaactagtactgttacgtatcctgtcttcaaatatgatggtatttcagggtgcccacgatataactggtgcaattaatttcaaccatgcgagagaggttaactatctccatcatgtctgggctcgccatggccgcaaatatggcacttttactttgcagtttccacgcacctgctgtaacttctctaactagctaggtcaaaaatcacgttgcttattgcccaagacaccatccctgataataacactcggggacaagaagatcttccattattctgggcgtgtttagttccaaagtttttttttcaaacttctaactttccatcacctcaaatcttttatacacacacaacttcagtcacattgtcttcaattttaactaaattttaaactttaggccaatctaaacacagcctctatcacatccggtggttaatttgatacagtttgattgaagcgccgtggcctcacggtaacgcgcgagaaccagcaagttaacaaccgatcgagacgcgtacgtgcacagccgggatactactattttgcgagcaagcgagcattcatgcatgtatggtactcaac

SEQ ID NO: 103171 - DNA, 770 bp, Oryza sativa
cccagatgcagcccttggtaggtcaggttctggtttaccgtcgccctgttcgtcagaatcaatccaagattgtcgaaaacaagctcgcaaaattaactactagcagggcttcgcgcagatgagaaatcaaagcataaatactgcagagacgtgtacgtacgtgcccgagcaaagccgtcacaaacaccaagaacaagcctgtcgtcccaaggctcctcgtctccttcacttttgccctggatttctcacaagcacacaaacatgatcaatcgaacagaggagggtgatgactactgaccagctagacatgaccaaattgatcaatttaactaactatttaagtgtatcaatggttcaattgaacagaagagggtgatgatgatctgactgatgatcagctaaacatgatcgaaactgaacaatttaagtgtatatatcaatgattattgctatacctgttggcgaggagggtgatggggacgaggacgagggtgccgatggcctggcggtagacgacgaagatcacggggctgacgccacggccgaacatggccttggcccagagcgtcatggccgcgtagatgcactgcgccgccaccatcgccgcgcacggcgtccactccctcgccgcggccgcgagcatgagtgccatggtttggctatggcctattggcctagctcgatctcgatccggcagcgcagaattgatgagatcgccggcgccgcatacagatgcagatgcgcgcgcacaagacgctgggctgcaggaa

SEQ ID NO: 103172 - DNA, 684 bp, Oryza sativa
ttcctgcagcccagtggtagccatacgttgcgcttaattaagcataagagtggggggaggagacggagataggggtggtgggggcgctgggagtagacagggactagagaggtgagagggaaatgatggtcacgtcggcagggcgggggtagtgttggctggcgcgggtgcccggccgccaaccgacacgtggcagggggtacggcaggggccctgcgaaagcaaccgccacgtgatgcccagcagggcggtgtcagacccccgaaagggactctcacactcacgcacccaaatgcccaacccatggcctcctctctcatctgcgcttcggagtacagtacagtacgtacccaagtgcgtgcgaagtttccaaccgacaccccccgcgcccggcacgcccgcgacgacacgctacgcacgccgcccactctctctctcgcgagatcacctcagtaccacgtacgtacgcacccgacccgcgtacccggcaacaagcgggggtgcacgtagaaaatggtaggagtggctccacacaggctggcgcgcgtatttggatcagttaactaatccccgccccctcgtgggcgctgctgcagcgcgcgattagttagtgtatagttttagttaatcacggcgtactcggctactgctgctacggcgacgaggaaacggagtcacgtgtat

SEQ ID NO: 103173 - DNA, 677 bp, Oryza sativa
taactaccaccgcagcagcggctgcccccacgcgccagccatccgcaccgcacaccaaccaatctctctcattggcaactgcttttgcttcctcttccatggccaccgccacattcccacctcacctcacctcatcattgattactgcgtcaaggtagtagtatcagcagcagcagcagcaggcttgcagtgtcatcacaagtgaaagtgactggcttccggtgtgtagatatagtggtctgcagtaactttatcacataccagcatttctcaattctcaggccacgaaagcaactgccatgccatacacactgtgcactactaatctcccttcgcgcactcattggctcatctctcatataattttccattcccatttacacagccacagaaaactaatcactgacaggtggcccgtgaacagtgggcccatggggagtcatctgttgacaatataatgggggtagctacctaggtagcgtgtagatgtaatcgcgtttcgcatggaaaaaagtcattcatagaaagggtgccgggtatatataggatcctagctatagatagctggctagcgcccttttggagttttgaccagacccgtttagagtgtcaattgagcaagctgtggtcaagctgagacagctcacttcaagctcgctagctgtatataatgtata

SEQ ID NO: 103174 - DNA, 552 bp, Oryza sativa
tcatcatggaagaaaagaaatgaaactaaacaatgaacaatcacaaaaaacagaatagctagaacctttttggaaagggacttctttgttcggagggaattcaggaaatgatggggaagcctttgcatagaagccagccttgatgaactgcagcaacaaattccaagcgacaggcgacgggcgacgcggcttctcccacgccgctacgtccccgccgccgccgcccccgcgtccgacgaggggaacaacaacaacgtcgctacagccacagccggcggtgggggcgagaagaggagcacagcagcgcccacggcctccgcgttgccgtccccatcctcgtcggcttcctccgactgctcatctgaccgcgacgagggatgctcctccgctgacgccgcggcccagctttcgctgccgtttgaggcgtcgacgaccgccgcaatgtggccatccctggctgggcggatgcgcatcctggaggtgggatccaccatgcggcagtgacaggcaaagacggaggtggctgaggcgggcgggaactgcagcggctga

SEQ ID NO: 103175 - DNA, 672 bp, Oryza sativa
tcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacattactattttttgaattgttctaacacgaaacactatatttttcagagatggcacgtcaggatacacctcagttgttggacccagcgatagatcaccgacaccggtctcaccttactgcagtgtagggggctcagcttgggacgttccgggcacggacgtgcggtgagctactcacggttcacgactcctttgtcgagaggtacgaacagtgttttactataagttagttgcacgcggtcgacaagggactcgtgcactacgccaggagcatcgccgacgccgcggtaggcg

SEQ ID NO: 103176 - DNA, 699 bp, Oryza sativa
ttcaaggtaaattgctgctagtagaactgtgggtttccagcccttttaaccatggaaagaatatttgctcgtatgtcacatcaacatatgatgtactagtgatgatgacagagttacgtcgaggccagatcttaccataggacatgctacttatgaattatccaggtgtgtcaaaactgcaggcttttcaacattcagcaaggaaacaaacatatctggcatttttccagatcaccagtatgtactaaaaatcatgctcaatactatctacttgctacataataaagtcttaactcttcatgcgatcactaaaaaaaattggtgactgataggaacttgcaacagtactcaataatggtcaataaattttaataggggatacagaatgacaagtgaaaggaaggctagaggatcccaagaacttatcgaatccaacattcgaatcgacactacgttactaatccatgtagcggcatcaaaggtacaaagaggactgcatagaagttgcaataactgcttgtgaaaatatatgtaaccaacattctcaaccctcgaatagctcgggcatgactaaaatcttaggaaacatccttattgtacccgcatgcacactttaacaaactctgtagaagtataattagatccgttcatcgtctactgtgacaaccgacttttggcaaaactgaattccttacttat

SEQ ID NO: 103177 - DNA, 1295 bp, Oryza sativa
agcagctgccagattgcaggccttgcttctcgccatcctcacaagtcacaaccactacttgatgagcaaaatcactgtactctttcagctagatagcgtgtgcctctgcaagctagaaggcaagtgcagtgtgtgcagatgcagtgatgctagcgttgcttatgtaggaggagaagccgcaaagaacaacgcaagtggaagctgacgcgatcaatatccggccatgggagtcaacctttgcgccgaacgtactgacgtcgtgtggctccggccatactgccgcctagtgcctactggctaataactgtgggcaaaccgcgactcatcgaggttgagatgtcgcggtggtgggtgattaggagaaaaaaagggggagaaagatatatgtggttgttgtctggttgattggaagctagtggggagagttgttgtgaacctgtgaaaaatcgtgatgcgcctgccggataatatgccggtgcaggacggacgccgccgcgggatgttgggtgttgccgtgtgctcggcgcaggcagcgacgaccgtgaccacggctagccggctggtccgtcgcacggggttctgaccggtaattcgtcgccaccgccggccgcgacgttctcgcccgctgcccgcgctgctggatttagccggtgctcatgctgtccgctgcctgttgcagagctagcactgacaggtgacaggttaaacctcctttttttgagggaaaaggttaaacctcctgtaaagcagaatttaggtggtagacttttgtgctcacaaaattccatcggtttttccacgcatctagctagtatcgtttataagtcatcaagatggacgccacaggcagcccacaagtgaaaactttgtagcgttgacacagaaatcaaattaaatgcctcaaacggtcaaaccaagtttatttgtacgtaagtgtaatcgtgtttttagtcgttaggggagtgcttacagagcgtaaccaagagattactaatcacctcctaaaaaaatgtctttaggttttctagtaaataaattgatctggatctttctgttaaactaacgagtaaataaactgatcactttaaaagaaaagcctaaattttataaaaaaataaaaggatatgttggatccaatttttcacctaaaatccttaaaaatcagttttagaaacaatatattagatgctcaggtcacataaggagattctgaagatcttgcaacaccaaagaacaaaagaactgtgattggttgagtaaataatataggaacaagaatctgtaggggtgcagga

SEQ ID NO: 103178 - DNA, 709 bp, Oryza sativa
cgggatggggatgcgccccatcgtcttcgtcgcctaccgccaggggatcgccgccgccacgctcctcctcgcctcgctcgccgccagggggtgggacctccgccgccacatggccgtcggcgccccggcgttcgccctcctcttcgccgcctccctcgccaggtacacgaaacttacttcgtggctgattttggtacgcacacccttggatcgaatcgggcgcaggccgctcatctcccggttgattttggtcggcagcgcgacgggtctgtacttctacttcctggggctgcagctcgcgtcgccgtccatggccagggccaccaccaacctcgcccccggcattaccttcgccatcgccgccgtaatcgggtaccacttcttcatcgtccccatctccggcggcgacggcgccgccccctagtccggttgccgatttctccccctttcttgggctggattgccacgtgtcaccatgacatgtggcccactacgacggcccagttgaagttttgggctggatcgtttgaggcccattatttaagcgattctgaagggttttaatcgttcaaattgcatccgtgcgcgcgcaggttggagaaggtggatttgaggagttcgaggagcttggccaagatcgccggcaccgtcgtctgcctcgccggagcgatggccatggcgttcttcaaggggcccaagctactcggcg

SEQ ID NO: 103179 - DNA, 645 bp, Oryza sativa
ttcagccatgcggattcaattggggaaggatagctatggtgatcctgcaggtaaaccataaaatgtgacactgaaccggcaactgaatgtgctaaaccagatccattagcaaaactgtttgaaccatcgcaataccctgttcagattgaactaacgaagagttagttttgtgattaattagcaaacggatagttgaatattgagaaaaaaaacagtagcaacctcttaaatcatgactaaacaagtagcaaaccagactctactgataagaaaatcaccatataaaaaagagtgaatttcataaaaccctaggttttgaggtacttataacacaaacatctaagttctactatttgttttgagaaaccccatgttttggggcaaaatgtttcaagaaaccccatatttactcaaatactcataatttaaatattatatatgatttttagtatatgtttaagcaccaaatacacatctcatcctatataatttatctttttcctcactcttgagttgcacaattgataaaaacgcaacataacctcattgataatggcacataacatattatttatacctataaacaatcatactacccatgacctatgctcgttaaaatgaggctagcatttatatatactcaaa

SEQ ID NO: 103180 - DNA, 772 bp, Oryza sativa
ttcctgcagcccatactgaatttttaaagaaatttaagaatgattccatttacaacccagttacagttagatgtacagtagttacatctgtacttttgttatttctcactgtaactgactatagatagatagctctttatatatttgtaacataatttagagtttgttataattggggaaatgttttaatgtcgcagtataagtactgaattttttaagaaatttaagaatgattccatttacagcccagttacagtttagatgtactatagttatatatgtaacttttgttatttgtaactgtaactgactatagattgatagtttttgttacgagtttttctgaaaaagttacatacttttaactacttgatctaaagaaatttcctattccaagcacttttctccaaaagaaattcactattccaagtgcttttctccaatatttttacagaactgagttgtttttgtttgatttaaaagatgactggcagaatatggtgaagtcaatggggaaaggtaaaggtggattttgtgctaggtaatttgttacctggaagattatgtcttgttgatttcaacttcttgacctcaatgttcttggtaagaatttgcttcttcttctttttctcgttctcctcactgtctatggcgtgctcgatttgttttgctcgatctaggggatttgtgcgaactggtgtggtctccctgtgttattttgcttttttctaacctttattggatgtgaagttatcattatgggccatgatgt

SEQ ID NO: 103181 - DNA, 629 bp, Oryza sativa
atctagctactttaatgtcaaaagaaagaatatccacggctcaggcaacagtaattaagatgatcatggaagaaggaaaatcatttaagtcaactacagagttgacaatcgaaattgacaaatgaaagggacttgcaataggccaacagcttgataaggtttacaagcgaacttgcactgattaccaatccaactaaaagcaagagcttctggaaacctccaatgccatgcttcattgagcttcaaaagtcgcttcacttatctttgcagattattaggtaaggccttaagcatcggaaagacttttttaagcatcgaccttagtggtggcggtggtggtattggaattgatacaaaattataaaattcgatatttcgatgtagatccatatatatatttatgccgctcctttatacattcatggaaaatttgatgaatgctaagaaaaataaagttcagcaatgcatgcttgtagagtgatggcatcgtataatataagttgtcaattaacttttcatattttttaataactattcaatggcatctgtgaaacaataacatgcctcccttaacgtgaaataatcatatgttgaacatgttattatctgtgcatatgctacaacatgct

SEQ ID NO: 103182 - DNA, 698 bp, Oryza sativa
acatagtaagtagggtaaatacgtatttattgcattcgtttgcgataatatgttttgtatgttttatacgaagctaggggtattgtgcagcctacttaacactatagtttgtattagccgacgttggttcgatggacatcctccagaccacgatcatgttcctccatcgtcggttttaacatcccgtatagcttttaaactaaaaaaacagtagctagtcacactattgctactccctccgtttcatattataagttgtgtatatttattaaaaagaaatatagcaacattcagcacataaaataaacatattattaaaatatattcaatgatacattttataaactaatttaacgttctagatgttgataattttttatataaacttggttaaaatcaaaataattataatataaaatgaaaggcgtaagaaaaaaaaaactcgtgtgaaattcatgtttccaacggaagaaaaaaaaagaaaaggtgtggagaccggaccaccggagagactgaacgtctggaacactcaaatcaatcttccaaacggaaaaaaaaaagtgcagtaaagcgcaggcagaagaaacggcacgctatctggcggccgtccgtccgttagtccgttactcggttaggcggcgggcgtccgcgtgcgtctctctctcccccctccgcttcccttccctccacctgcctcc

SEQ ID NO: 103183 - DNA, 2143 bp, Oryza sativa
gtaacgttttgtttggattaggtcaatgttcttttagggttaggtttaggatgagcgacttcgtaagtccgataagattgattcaccatggtgaaaaggagagtggcatttcacctattaaaccaagctaattgtttgtgacatttcttacgtttctccatattacatgtaagatgtcggtaaaagttaaaaatcacaatcacaaggaatcgttatgataagctttcaatcgatctaacggaaagaccaaatcgttatgacaagcttccaattaatataatagaaagacacatgtctacgctataaaatatcttttctttgaaagaaaaaagaaaatctatggcacgattgtaatagtaggcatatttatcctgctaattcatatatgttggatgtagctaagagcccctttgaagtggattattcccatggattatttacgctatgagcctatgattaaaaaaatgatttttcaaaaaaaaagtacatcatttttgtttatatgcttgttctaagattttacccgttaggttttaatgtacaatattcagatgtcccaaaaaaatatgtagaccatctgtcagcgttcatcgatatttcttgagctccacaatatcgcaatcgatcctacatgtaatatataacaatatttttgaaaatgtaataaataacaatatttttgaaactcattaactacatgaccattgtttgtttcaacctgctgcacataagcacattacggatgccctcgcagcttaatttcgtcggacaattgcacattaggatggccttctaacgtaaaatatatacagtacaggtcaaacttaattgttacccttgtacttaagttgctgtactttgttaattgttacccttgtacttaagttgctgtactttgttaattgttacccttgttcttgcaaacgcagggtgtagtgtttatcaatcagatggaatacgagcatatagacaaccaatattttcaattagaaattaagaaaaaaaatcaaattagagataagatcacaattcatgacagtatgatgcaaactctcaaaaaaggagagcatttcatgatcattgcaatttgcaaactccaacagaacattttccagcacgatcaatttttttgaaggttcctattttgtacgcaaaatgaaagattcacaaaactatatccgatattctgattgctagccaaaaaaacagaaaagatattctgattgctagccagaaaaacagaaaagaggggaagagaataaaggatctacggattcagacagaaatttaacatctccccgaaagtctccagccacactaaacttccaaacgaaagaaacaaagttacatcaatttaaagatttgagaacttctcaaatcgaacatgcaacatcctacagagctctggagtctctgcccaatccaacaacccaatatcaaaattcttaatgaaccggcatgagcattcttctgatggtttgagttcaaacaaatccaagaattcaggtgtcatcgacctgggaatggaagacaaagcttggaaatgtagtggtgatgtccctgcacacatgtggcaagattagcttgtgctatagaaaaacaaaagtgtctacaacatttttatagacttgaacatttttatgaacacctaatcttttttaggaaaaaaaatacttctttagttaagaacaaaaaaggcagtgtgttattttttgtcaatatatgaagtgctgttgtatctgtgaagtggattgcttgaatctgaaacatggagcgaccaactcatccagtagttcaacacatgtttttttagaaataaaaatatgcgcagtgagttgacaaggcatgtatttaaaatcatgaacttgttcttttcctcttacatattatggattagataaaacaattactatttaaaatcaagagatgatacaacatgctctcctcactcctccatgcgactctatgtgcatgcgcaattttaattagaggatgcttgatttacacatttcaagcatgcatctctctccgtaacattctttcctttgcaagacattgcaatggcaaataaaatttggaatgggaatccgaatccaaccatttttgttcaagaacagcagtaaacattgccagggctgcagga

SEQ ID NO: 103184 - DNA, 637 bp, Oryza sativa
gcacgcttaatagactggcacatacagtcattctctgtttataaaaatccagagctgtcccatttttaatttcagtaaggcagcatgctaccccaggatcaggtgagcagttctgttctgtctgacagactggatctgttgggtgacaaaaacttctttttcttgttgataacatgatctcacctaagcctccagattaattgatgaaaactaaatagtattatcacatatcccccctcctgatcgcgtttcattttgcctattttaagcaatttcagttctatagttttttatcttacaagtggtgccagagctggttatctatgatgacaataggtgtgcagagcatcgactcaagcctgacattgatgtggacattaatcaaagatataaattctacttcctccgtttcataatgtaaatcagtctagcaatctaatagatatatatgtctagattcattaacatcaatataaatgtggaaaatgctacaataacttacattgtgaaacggaggaagtattaatattacagttgtacttgcaaactctcttgactaaatcttcaccacatttatccccacgtcggattcgtccatttattctcgcaatgaattgccacctttgttgctctacat

SEQ ID NO: 103185 - DNA, 857 bp, Oryza sativa
aaaaggtactagataagatgtcggaaaagcctagagaattctggacaaggccaaattagagcgggaaataatgaaatggtgcaggccatagggcggaagacaagccatggcagggaaatgactaaccaacggtcagatgttatttggagacatgtttggcaggaaacaatacaggaaaggaaaaatcctaaattaaagcatatgcggtatatagcatatccgaaacttagaccaatataatcctagataactaatactatttccatgcaattagaagcattcaattttgtccagtatagtcaaatagtctctagtgttcaattgctcatgcttcattgactaggcgcgcctaaatctgtcgcttttcaaaacttccaaaagagaagagcgcgatataccgaatcagagcaacggcatgcagcaccatacaataattaacaagtttgcaatcaatgcagacttacacggtcggcgaacaggctctccttcttgctggtcttgaacagcgccaactgaaactcctcctgcacaaggtcaacggacaaacacagtcagtgattgcatacaggttcacaataacatgccttcatcaatcaaccaatcaatcaatcccaattctacgatacaaaatcgtggcgcgaacagaggactccacaccaaccttgttaatcagcccgtcatcaatcacagcactgcttatcttcttgaagagctcgtacagcgcctcgacctcgctcacgctgactgcacaacacaaggccacaaaatccaacccaaccacacacaccagtcaaattcccccaatgagacaggctcagcaacaaaaggaaggaggagtacggcgccccaaccaatgg

SEQ ID NO: 103186 - DNA, 1329 bp, Oryza sativa
cacgatgttgagcaagctggccgatcaaggtatcgaggtatgaatcagcgacatatctcctagagcacggcatacacttgttgaatttctggctggtacctgcctgttcagtactataattagtactcacccatgcgtacatgaacattagacaactactagctaattaggagcaaaaatgtgcttaaatattcaaagcagcacttacatagttattaatagcaaggcatattttatattgcagacaatgtacagtgaactaccactgcactacataccatctaagtcacttacagcaacctaaatctaacatgggatagcttcaaagttcctgctcaattttgggactaactacatcatcaacgagaaagacactcccacgaagtaaattataccatttccacagttttctgtattctaatctgcactaataatacaatggagcagcagcatgccagcatctccgtgaattggtcaatcaattgacagtaaactaggggatttggcattcattctcaagtgcgcagccaaatccaattgaacaatttaacacaataactccgcataaatctgcagaaaaatcagtatgagccaagagcatccaccacaggtacctgcccaggcgatgacgacgacgacgaggcggccgcaacgcccaagacccaagccacgaccacgacgagcagccacggtccgctcgccgcggccatggattctctttcagcagcagggcctctcacacagagcagccgctcagagcgccggaggccgtggtggtcgagccggatctaactacggggacgcccggtcgcaggcggcggatcacaaacggtagctcctccctccctcaactgtagtacaaccggccaatcctccctcccacgatccaacggcagccgccggggggcagtgttggggatcgccgtcaggcctcgccggcggcgagtgtggtggggtagagggagaggtgggaggccgcgacggcgacggcgacggcggcggcggcggcgggagctcgcgagtcgcgtgaccgtttccggggaagacgacggagtgggtcacagataaggagggagacgtggaagcgctgtgagacgttggattttaatccgatggctgaaaaggttcgcaatattttgaggagaaaaattcttgctcctctagggattaatatttcttctatccacaaatataaggcatttctagcgtataaatttaactacaaatattagcattttctagtgtacttttgttatagttccctgcatttgtggacaaaaaatgtatttgacgttttggacgagattttatcaattttttgaaattcga

SEQ ID NO: 103187 - DNA, 1880 bp, Oryza sativa
ttgaatccaactgggggagaggtactcgacctctgaagcgatctagccaacgatgtggatggtgtcggtagagtggggtcaaccaaacaatatatatacgttgccaacatgcttgatgttggcggagcaatggtacgagtggcaagttgccaagtaggcggcaagcgaaagccttcccttgcgcttgttgggtcgacaacgacgacacttccaaggaccatgaccactccttaacggcattttttttgcaccctgccctccgttggcgggatcctccgggtaaaaactaagtccaaatccacacatgggtggtggcgacacttttgacgtcccgttctctttggaggtgtcgtttaggagatttcatttttcatctattagccttcaggcagttggagtgttttggattatggcgggtatgtacaagggacttctctctcgccctctccttggctagtggtgtccgggaggctgcgggtgttttcaaatgattggaggtgttgggggtagtttagtcgtggctctcttgtaggtttggtggtgtccggtcgcactgagtgatggttaatgcggcgctacttctttagtgtgagtgggcgctatcggtgtgtggtggtgtgttttgttttctatttttattggttataaccttacagggttatagtcttcttgttcatttaaagaaaatgatttcgagtaaaattgatctatgctctgttcatacaaagtaattttatggtggtttctatgactaaatattttgaaaaaaaataaatgggtgtgctgtatacaatgttatatgctttttagttagaactaatcatatctaaaggcatttacaaaaaatgtagaaaacatatgtaagttagccattgcccttttaatatgtactcctatatgatttcataagtagatctctaatttgatttttttaaaagcacgtcacatttgatcattttccgagattttatttatataatgcctctacaaagaagtagtaatgcagtgtgctcagtgcctacagagtaaaatatattttggtgggttactttttttttaaggaaggattgtgataaaaattgagtaatgtaacagtaaaatatagtttctccttgactgcaatacaaactaaagattcacgttccatcatcggatgcctcgtacgtggtttgtacaaggtttaaattaattaaacaagtagttccacactttcatattataagagaaaagtacagttacagcaacatgcagatgaaagcataaacatactaggttgcaaccttgcaattggaagagacacatgtaatgtaagtccatatacacatgccaagttgcataatgctttcacaaacatttgagtgagcagagagaatgctgatattcaagaacatgaattattgaaattatagtataaacaatataccacaaaatcaagtagcgtttcctcttccaaaccacagcccaagtaatctaatttgttattgagcccacaatatgtttaggtgaaggcacacatcaaagcaattcttttgccagaatctcaactcttaagacacatcatgtggacagctcatgttaggtactcacaacttaggagtcacccaacttaggagtcacattatttaacttcttcttaagataatgaaaagttgtttacatttttctcaaccatccttctgacaaagggatcactcagctgaattttgacccttttcagcttattcaagatggtaatctccccctggtaaggcacatgcttttctttctccagatgctcaccactgaagatttttactgaatcagattccatcttgacagcaaagctttcatcatgttgggactgaagtactgagttacaacccacactataatgctgcgaa

SEQ ID NO: 103188 - DNA, 1467 bp, Oryza sativa
gcaactccccttggggtacgcgatcgacgccccctccattcgctccgcccgcaccttcggcctcctcgacgagtacgcgcgggtccacgcgcagcacgcgcggggcggccccggcgccgtgcccgacatcgccgcctgggaccgcgccttcatggagcgggaggtcaccgacaccgacgagctccacgacctcttcatggtaaaaaccttgatcgcctctcgcctgcttgattgatgcgtcccctcgctcccaaccccgttcccttgccaggccctgtttgatggattggttgattatatttgcttccattttgttttggtttaattgcctgcaccgatgatatgatagttggttattctgtttgtgtagtactacctccgtcccaaaatgtagctacctagtacgtgatgtcacattacctggtaatacgattcgtagtcctaggtaatgtcacatcccgtactaggtaactatattttgcgacggaggaagtattggattagaacagtggattccaaatgagtacctgtatgctttgttggattttgacaggaaataatttcagaaaagaatttctagaccgaaggtccaaatcaggcagggtttggtaaaaccccccaacttctagaggaggcatgtacttgattacatggaattaagcatgatagattgatagatatattggcgtgtgcttttggttgcaatcgagcgtgttatcgtaatctgttagtgctaattgttgttgattaacaataagatacctgcgcattgctgtggcaaatcttagtactacacaggcacagagcacagatcgagggtacgaacaatatcaagtaatatatgatatttggttgctcatgatccgaggaatggtgatggattcagaatgtaagattgtgtgctattgtagatttattatactatgaagaagaatgctgtagggcgagtactacgtggtttgccatcttctaaaaaaatgtactagtatataattgtattggtgagtgttaatggtaaactgtatgggatgctcaggtggtagttccggtaggaactgttagtctggccgtctgggattgatttcctagtgccatggcaaaatgcgatgcatgacatgttaatgataacaagtactaaaatagtggaaatgatgccatgcataacatgttaatgataataagtaggagtataaaatagtggacatgagcaatctctttgttatggtgggtggtcaaggcgacggcaggggaacgtgtatgctctgggtatgagtatgctagctccggtatttttataatgaactctgatggtaaggcaaatggagactaggccccggtgggtaggctgtggtaggctggatcacaaggaaggttgacacgacggaatggttctggttgcgggcctctcttacgaccggctctgccctatgggtagcagaggaggtatatgtatactgagcgcttgta

SEQ ID NO: 103189 - DNA, 802 bp, Oryza sativa
gttttctgcatgatgatatagaaatttcaaccccattgtgctgaattcaacatgtattcttagactaatagtttcatccagtgaaggttccttactgatttatatttttaaaatgtcttattctattgtgtattacatattctgattaataacatgttgatagtattccccgcaaaagaaaaaaaaagaacatgttgatagtacgattggattgtaaaggaaaatctgaatgtcatgtatgcatgttaggactactttgaggtagtcaataagtttatataaacaagacatgcagaaacactatatattgatttttttaatcacaaacaccactttgtaaaaatatgtaaaatagtttatttttatactggtgtttataaatggttcagatcattcatctatgattggactatctgcaaagtttttttaaaagaacatatctgattgcacaaacttctccaagttttatttctaaatccattttgttctctgctgcaggctacagaaaattcgaccctcagataacctcgagtcatgggttggttaaataaaatatttaaaggttcagtaaatagagtttcaaggggccattatgatggaagctggcatgaaggtcattcatcagataacgccagagttagtttcttgccttttatgttgttatctgcacatattgttctaagtttctctcagagaaatcattgttctaagtgattaaacctcgatctgtagaatgcctattcctgagataaaagaatggtcactcagtgttgcatcttgattgctgtagggagcgtatgat

SEQ ID NO: 103190 - DNA, 1696 bp, Oryza sativa
cccgattcttggagaagctgcagctgtcccaaacagacttaatattgtctttttaaagttgctaagaacacatattctataaagtttaatccacaaaaaaaatgttttattcgctaataggcattgcggcctataatcaactgtagataggggtggtaaaaggcccaacatctaaagcgggcttattcgtttcaaaggatttgtaaaggaaaagtacaggaatatccaatcctttggaatgagcactatcctatcattcgtttcaaaggaaaatataaaaggaaaaattcatatccctccacttttagggggaaaacaaaggaaaaaaaataatccactccaacccaatgttttcaatcctttggattgtttgcaacccaaccatagaaaaatttcctatgttttccaattcataggtttgcacatgcattcctatattatttttatgttttccctattcctacggtttgaaaatcgtacaaaccgaataagcccttctattcaattttaaactgaaaatatatatgagggttgtttaccctaaaaaggaaggaaatatatatgaggcctgggtctaaagctaaatttctattcaattttaaactgaatatataatatatatatatgagggtaagaagaatatatatatgagagctaggtaggattgtgaataacctatgagccaccatggtcgtactaaatgtttttaaactcttttattgttttttatttttcttgacttccttctctactacagtctttttacctcttttagtttgattttgtggctcaatttgtccccgctgttccaatcttgcctctactgccactctttgtcgagcgtcagcaaatggactctgtggatggatgcttcagtgatgcctacacgctcatgacacttctgtttagacttagccagtcagccaaacaataataaaccgtgctcaatttgaaaattcccaagatcgcagcaaattttaaaccgttactcgtggattttctacgtattaaaaaatcacgacgacctttaaaccattttctttattctaaaatataacaacttagtatggtatcaaatttataattctaaatgcattttatcccgttactatacttttgagacggagatggagatagtagcttgcgagttgactcaaccatacacttacaaaagagagtaaagaaatcttcctccatggcgcccactcctcggattaactagaggaacaagtaaacacctactcttcggattaagatcctatgccttcaaaggcacaatacttttgtcactgacaggtgagctcatagttcatcgggcctgcacagtgacaaagctacaaaggcacgtacttttgaaggtaagggagcctgacccggcagaatggctgctttgaagaacgtgcgggactagaagaagaaggtagcgtcgtgatagcgagatcgcgtggccccagcgaagcacgaggatctttgcaaggtacgccgtacaactaactggtcctcctcctcctatcttctactccacattttggaccactcggccacttgttccgtacacgtcaagaacacagagatagcttgcaaattatgcagaaaacactagcttgaaattaaggttacaaactagtatgtgaatgagggtttacaattccgataccggattaaaatcgctcactagttatgggctgcaggaatt

SEQ ID NO: 103191 - DNA, 891 bp, Oryza sativa
ccgtcctcctgccaccgtggcgcacgcgaaccgacgtggcaggaggagggcggcgctagcatggcgccgccccagggaggagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcactttcactaaaattagaccataactcttttaataaaaccctttgatcaaaacataatgcactctaccactatatgaaattacttaatctaattcaaaatataaccacatgaaatgacatatataagttaaacagtacatagagatgcaatttttttatttttatttcattttttgatatttttttcacacttaggagaacataggaaccaaccgtataaaaaataaactcaaacggataaaatatgtgacatgtagaattttccaaaactctaccaaaatggacaaaatatgtcatctattaaaataggcataactttctcatacggactcagaatcaggcaaataatatatgcacggacatctacagaaaaagttacatccgattctccccggcctcgccgggttcggcgatactaaaacctccaaattccgcttgcaagattgtgttttcgaggagagaagtttttcggtggagctttggaaaattccatatgccacatatttcgtccgtttgagtttattttttacatggtcggttcctgtgagttcctaagtgtgaaaaaaatatcaaaaaaataaaataaaaattaaaaagttgcacatctctct

SEQ ID NO: 103192 - DNA, 708 bp, Oryza sativa
caagctacatattatacaagaggcaaactatgtaagaaaccacaatggcttttctttacaccttgctgattgctaacctggcattgctctacatatcagggcctgtttggttcgcgaaaagaaaatttttgggtgtcacatcggatgtttgaccggatgttggaagggctttttagacacgaatgaaaaaactaattttataactcgccgggaaaccgcgagacgaattttttgagcctaattaatccgttattagcacatgtgggttactgtagcacttatggctgatcatgggctaattagactcaaaagattcatctcgcgatttcctccctaactgtgcaattagtttttttttatttatctatatttgatgcttcatgtatgtgtttaaagattcgatgtgatgttttttggaaaaaattttggggaactaaacagggccttatacacttattcctaccccatttttctcctcccctcctttctactgaggtggaaaatgtttggcacacggagccaatgtcatattagtagctaaaatagaataaaatgctgccgtcacaattgatgtgacaaaagctaccactaaaggtagtcatagggtgaaacttgtccggtttttaaatgtttggggtgaaaaataacttttttaaaggttagggtgaaaattggattaaagtgaaagtttgagacccaaaataaact

SEQ ID NO: 103193 - DNA, 990 bp, Oryza sativa
tcccccgtgcttttaatagattcttcaatatttgtcagagtattaaggtttttatggaaaacgtgaaggacggtgtaagtgacttacatgcacgccagaacaggctgcctacggtaaaagctaccggacacaatgcaacactatgccattggtatacagtgaaatgactgagaggcagcctattgccggttcgtatgtactccctccatttcaaaatgtttgacaccgttgactttttagcacatgtttgaccattcgtcttattcaaaaaaatttgtgaaatatgtaaaactatacgtgtatataaaagtatgtttaacaatgaatcaaatgatatgaaaagaataaataattacttaaactttttgaataagacgaatggtcaaatacgtactaaaaagtcaacggtgtcaaacattttgaaacggagggagtatgttacgaggagttttcacacctaagcctacacgtgtcatgcgtgtgaggagcaaaacaaatatcgaaaaattgagaaaaacggagtgggatgaagtgttattatcttatgatttggaagagccattcctttgatccaaatgatcatataggaattattttcataggattaatttcaatcgtccaaatttcctccaccttttcatttgttccgaaggagagcttagtgtacctgtagagatgaacattactacattagcatgtttatgaagttaacgttaaggataatgcttagctacccttttcttacatggatggattatgacatgtacatgaagcaaaacaaaagtacatagatttcacagagagggtgctcattgtcaacttggaaactgttggcgtatggatggcaagggccttttcttcttttgacaaatgtgagagaatctatgcacaaataattgtaactccattgcccctctgtatcttcttcacagaataaatatctttaggatacatccagttaggaacttttacgccgcaggtgcctcaata

SEQ ID NO: 103194 - DNA, 629 bp, Oryza sativa
taaaatttaattaatctcatgttgtgttttagatggtctcttctttcaatattctttatttttttctttattttttattactagttttagttatttataaactgtattccaacttgaactcttatctttattttttttttctaattttagaatttattttattttttatttctaattttaattaatctccaattgtgttctgtgtggacttttcttttaatattttttttattctggattataactatttctaaatgcattcatgctggaatttttttctttgatataatccttcataatggacttgatatctggtttcaagtatgttttaatgatatactgtaatagatatgtgcactttctgcggagtctgcaggaaattcttgggtaaatttcacaaaactacagaattttgatcaaattatccaaaaactatagatttagtgtgatatatcatagaacaatagattgaacactaaatttctcacataactacatacttaagatggagaaccgtaaaactacaaatttaataatagtattatcacaaaaatacaggtttagtgacaatttaatcacaaaactgcatgtttataactcaaatataacactagtgctaaggatttaaa

SEQ ID NO: 103195 - DNA, 1547 bp, Oryza sativa
cgtcagagcagtggataaggaagaactagtgttgagcggcattgcagttagaggaaaaatgaaattgactggctaggaggcgacagagattggggagaaaacatgcatggtaggagaaattggaggtagaagaaacactattagccatttttttttactcaaagaccgtgggggaagcccccacggttaaattatattaaagaagaaaaataagaagtacacaaaaaaacaaaagaagaaagctaagattacagattgtcaatccatgattgaaccgtgggtctataaacttctttgaacctaattaaatgtaggctcaaatcctccttcaaacccttcatccaattgtgaactgatggctgaataccttgaaaaataaggccatttctttcattccatatattctaggttgccagtagaaatagttccataaaactatgctgagaaaagaaatttctttgaacctgcaacatttgatggaattctaatgaagagttccaaacctagcccaactttctccaacatgacttgctgaactcacattgaaagaagagatgttcccttgtttctcttgcattaaccccacacgtcaagcaataagcagtggcattcaaaggaatacaatgtttcctgtcaagaagctccttggtattcactctatccatcaacagcagccacccaaagactttgattttcatgttgagcttactttgccagatccaattaaatgaacaagggggagataaggaccaaaaggagagcttataaaatcgttgatgagcatttaagtataatcgtgtaagttctacaactaataccgtacaattccacaattgttggtcaaagccttccactatcctcatccacataactatgaagaaaatataaaatcatttttgataaaatggattgtcatctcacctatcacattagaaatgccagatggcagggaaggaatatgggaattgcggatcacacgacactggccaaatcagtactctcttcataaccaatgtatccccttacgacacttaaaggccaccaagaaatccatagaagtgcttgacaaatagagaaagcgttttctatgagcaggacagaaaacatatcagaaaaaatatgcaaggttaattaaatgagaacgtgtctaccaactacacacggtggactaggggtgttaaacctggagaaatttgcaaggatgttataagtgatcaggaggctatggcatgaatgaatgcacagacatgggttgaattggacaccgcatgtgaaggtcctgatatacttctatccgcagcagccacaacaataataatagaagatggggccattgccaacttgtaagatttagcttggatgcatggcacgtgtccaaaggatgttgcaccaagagtatatgcattcttcagaagaaaaaaatagagccttgaagtaggccagtaaacacaacacatagatacaagatctcaacctcttacctaatgggggtatgaccattgtgctcttggactaattgatcaccttatgaagcacaataaaagaag

SEQ ID NO: 103196 - DNA, 3615 bp, Oryza sativa
catatggcttaaaaagtttaaagaagataccatacttcttcttactattgggtctacaccttataatgacctgaaagtgttcatcatatcatcttcatccacttcaacgaaaaatatcccgctcaatgaaactatacaatcatcaaaagatcatcacacatctttcttcatgtttcaataatcaacaatttacaatatattactacaatttaatatcagaatacacaagagttaaaacttaaaattgaaaattaaaaaagctacgcaagtagaagacctagaagttgaagccgaccgccgatcaacaatgccacgccgtccaccgcgccgagccgccgatcgctgatctctggtggttggagaactctgaagcggcatcgacaactcgatgtcgagtgccactcggttgctgactgcttgacttgatgaggcccagagacagtgtcagtgagacgacgatgatcgacgtacgagaggagacgccggtcgcgccatcgtggttgctgtcgccgaggcgaggagacggagaaacggagagtcgccgaatcatcaaggcagctagcggcgccgctgcggcggtcagcccaaagtcagtgagacgacaacgatcgagacgagaggagtcgtcgatcggtcgcggtcgccgagtcggagagacgggaaacggagagtcgtcggcgccgagtcaccgaggtgggcggcggttggagctctcgaagtcgcggggggtctcgatcgcggagtcaaggcatcaagcggtcgcggttctccgtcctcggctgcagtcggctcctctcctcgcggccgacgcggcggacttgctgttgtgaatgcgggcggcgggttgaaaaacgagaagccgagcgagaggggcgcgcgcgcaacgtttcggtttccaattccaggcgtgtttgtgtgcaccatgcgatcagttttttttcaccaaaaaagtccgattatagtatggttggttgccattctagcttttgcgtgatccgggcatcactctgcaggtctgaggtcagtgttattcaatggtaaggatcgggaccatactcgaaaggagcagaggtctggtatggttgggataccatgtgagaaagtgactagagttaggattgttcaatgtcaacttcgatcaatagtggaatcgggactatactcatagagaagttgaggtatagactatcaatgataccatgtgatcatagaaaaggagtaagcttatacttgtgggagcctctgtaatatgttgggctctgtggttgagcaggaatgatttggtttttgacaaatcaccatatattacatatatgcagttaattttcagggcaacatattgactccggtgttgggctcagctacaaaggtgtgatgaagatggcgagtttacaaaggttgcatgccataggcttgagacgacagttatgcaactttttgccaattatagttggagattcacaaatagacttcaataatgtgttctccttatcttagatgggtaattttttattttaagtgtgtgttctcaatgttttgttgaactacactcttttttagtgcaactttgtaataattggttgtagctcgttttgagcaaaagccgggatattctattctattatctaaaaaaatcaatgataccatgcgataaagttggatactacttccttcgtttcacaatttaagtcattctagcacttcccacattcatattgatgtaatgaatctagacatacatcaatatgaatgtggaaaatgctagaatgacttagattcattaacatcaatatgaatgtgggaaatgctataatgacttacattgtgaaacaaagggagtatatggcacacactagatgaataccgtgtagaaagattttcgcaacaggtttcacgaggtgtacatatatgtgcaagtgtcggtgttcatgaaagaaattgatggagaatctggaggagtattttgactgctacactccatggtgcatattatatatatggcattgattcatgcatggtgaaacggagggtgcatgcttctgtgtggaattttttcttattttttcattaaaatatttttaaaaaaactccgtttcaaaaatttacaaatctagacgtcttacgcctctaaaaaggtgttttttaaaggcgtccttctagagagcattaagggacctaaatgtaaagtttttatttgtattcaaacccttatcgttggttttaattgtataaaaattattaatgcttattcgacactcaaatgattttaaatggaaaagtaataagctacaaagttgtaggtctcatcgagatctataacttttatatagagttcatctccatccgatgttgtttacaatgtggatctaagatttatgttaaaatatgttttagattatctaacgaatatttggacatcaaaacaatcttaaatgaaaaagttcttgtatatctccttgatctctaccattttaacataaagtttgatttcattcaaatttatatgatatatttttaaattgcaaaatcattgagttaataagctatactggaaattttatacgctactgcggaaaccctttttactcccggttgggaacccccggtaatcccgatttttcaactggggctacgaatccgagattaaacatgcccatctttacttccaggtgaaataaccgggagtaaagttgaatctttagtcccggttggtgttaccaacgggactaaagatagggtaggagcagtcctggttggtccttttttctttctttttttcattgtttctttgctaattgacagtgttaatccctgtattttctctcaaatcgagtgcctgcatatcctcgaatcaaactccaaatccccaaatcaaagtaacatcccaaatcattcacatcacaaatcctaagttacttatacacacaaatcaaatacatcacaaatcctaaaaaaatacacacaaattaaatacatctcagatccatgcaatgaatcacaaattctaaaaatagaaattatacatctcaacatgaatcacaaattatcaaaaacaaaaaagaaaggacgctgccgcccgccacgaccgccacgtgtcccgtgcgcggccccgccggccactggccgcctacccgccgccgccgcggggcgcggccctgccggcctgccgccgcttgccacgcccgtgcgcggccccgccggccgctggccgttggccgcctgcccgccgccgccaaccgccggatgggaggggaggagaggggaggagatgagaggggaggaggaggaaggggatctgagaggaggagaggggatgagatcgatgcaatcttatcttaaatatctcgttgaggaggaaaatcttgtatggaacttaacggatcagagatgggagagaaatatttactctcggttggtaactccaaccgagactaatttttactcctggttggtagtaccaaccgggactcgagtggtaatctttagtcctggttggtagtatcaaccaggactaaagatcctcggccacagacctgtaacaggggatgaatcgggactaaagatcatcttttttaatcgggactaaaaacaatctttagttctggttcttattag

SEQ ID NO: 103197 - DNA, 1476 bp, Oryza sativa
cggtttaatctataccgtgatatcccatatatcttggtgaaaaaaattgatgtgccggattggagatctgtttacaacaacggaacctacatgtcgagagcattctatttttatatgattttaagttttgggtatgtacttttgcatttgagtccctataatctttatatttatatttaagtctctataatcttgcaataaggtatttaaggtcgttttttaaaaaaaataaaagggagataacaaagaaaaaaggtgcataaaaataaaaggaaaagtcgcaaaaaaataaaagaaaaaagaaaaacaacaacaacaacaacaaaaatctgtttcccctaagtggaaaaaaaaccatagattcgaaccaaaaaaaatcctattcctataaaaggcaaacaaaatgtggtgaaaaaaagctagatccaatttctttaaaaacggaaaaaaaaagtctgattcctataaaggcgaaaaaaaactgaaaaaaaacatctaaaaaagttcgtccgattccctaagaaagtggcaaaaaatggttcgtaaaaaataaaaagctggttcgtatgaattaaaaaatgcacgcgagaaaaaaaaatagaatgggtgaaacaaagtctgatttaaaaaaatcagactaactatttaaaaagagaaaatgtatgagaaaataaaaatggttcaaaaaatgcgtgagaaaaaagttagaaaaaagcgcaaaaaaacaccctaaaaaacgtgcacgaaaagttatttccatcgtcggtaaaaaattttaaaaaaaacatgcgaggaacaaactgccagaaaatcatgccatttctaaaaaatggtttgagaaaacctcgcaagaaaaaaaacaccgtctattaaaaaacaaatcgctctgaaaaaactattagaaaaacgctaaattgatggacgcttgagtcagaaagaatccatcattttttttgccatctactacacggcttttatttcgtcatatattctcctgtattggaaaaaaagcaaaaaagaacattcgaaaatacaagcaaaaaaacacgcgagaaaataattatctgaaaaaataggcaaaaaacacgcgagaaaaaaagcaaaaaagggggagaaaaatatggttttcgtcgtcagtaaaaaaagcaaaaaaaacatgctaagaaaaaatattagaaagaaatgcgccatttctaaaaaatggtttgagaaaatcgcgaacaccgtttataaaaaaaacaaaccgctcattaaaatacaaaaattgtcattgaaatcattatgcatgaaaaacgtatattatcattacaatttttttcacccgttgcaacacacgggcatttttgctagtataaataaaaaatagtttgtgaattaaacttttacatacgagttcttaacgatctaaaagcaaaggctaaaaaataaactacgataaaaaaaatccaaaatcaacttcgaattaagatcgaaaat

SEQ ID NO: 103198 - DNA, 1131 bp, Oryza sativa
tttactgagtacatatcagtgtcatttcataaccatttttatatagtactagtggtgcaatatttaagaggtataggagtagtatatgcagtagtagaacgtttggtgattgattagaacgccagccaacaccaaagtctacggttcacaaaaaaattataatagtcattagtagaaaccaaaatatagtagtagtaggagtagtattatccaaggaggaagcgtaccaggagtggcaaacgggccgggaaagcaacgaactcatcggtcagtcaagtgccctgccgctgcacgtcacgtcagattccttcagaagaacacgagccgttgttggtagcgaaaccgtttgtagcactcgaggaatcgtgcacatagaagtgccacggatgcttcgcactcgaagaattgtctgtctcagatggggagatacatgcttcgtcgtgtacagaagctccctaatgttaacagtcctgcactcaaattctgaagccgtctactaccatcaacaatcgcgattcgcgaaggcagatgcaaatggaattaatagagtggttttcgggccagacgagtaacgccagaaaccaggcccatgaaactgctgcatacgtcaagatgggctgcaaatgggctctgtgtgaggcatatgacgcctctaggaataagttcacttatggtccctctatttgtcgtccagtccgattttcgtcccttaaccacaaaaccgggtacaacccgtcccccaacatacgaaaaccggaagtccctcgggggttttgatagcggtattggctgacgtggcgcctaagtggctaatttgacccggttttcatctgacatggcactgacgtggtgcttacgtggcaattcgatccgaaaaaaaaataaagtctatgggacccacatgtcactttcacatacaaaataataaaaaaatggtgggacccacatgtcatactcacccctcatcttcttcctcctccctctccatctcccctctctccatctctctcccctcctctctctagcctccaggtgccatggcccacggagtcacggggaggtccggcggtggcggccagcgacgcgacagccgctcgccccgacgagctccacctactcccgccccccccc

SEQ ID NO: 103199 - DNA, 1899 bp, Oryza sativa
gtaggttgcaaaagttgtaacttgcaaaaaatttctttattattactataaaatgtattacctagcaactagccttgaattgaaatagcgcaaatcacacgtaaccggtaccaatattgtgttctagaaatctcacaaagccctatcgtaaaaaaggaaacctcacaagactgataactagtgaaagtgaattgatatgtatttatttaaatggagggttttaattaatttgatttcttcttttgacgccccaccttgagttgaggtagttaggaacgaaaaggagtgaaaggtgtacaacatatatgtactatacacacaaagcagctagctagctagcctgatatgccccaatcgatgtactcccaaaagctaacaagattcctgcagaccctattcattttcacatctaattgggcaattggctctcatgcttaccaccaaagttaacttgtgaagaagcgaaagctagccgcaaaagcgtcacatgtacaggtgcatatatacttaaccgcattttgcatgcttgcatactccacacatatgtgtgcagtggttaggttatcaagttaggtacttgcacccccataatttgtggaagaatttaatagtacacttcctccgccaaattttgtagacgataagggcaagaatttttcaaaattcaagattctaaagtttgctagagctcagcaattagcaaactaaataagatggaagtggatttttatctctcgaggtgtcccctcgttttgtgcactcgttttgtgcatatagcatacatatctagtttattttcactgtactgtcatagtgatatatttcctccgttcaaacgaaacatactgttttcggtatcgacatggtttttaatatgcaaattttgaacactaaatttctgctgttaaacattttaaaattaaaacccaataaaactataatatggcatatggacatagttttcgatgtgctaaactacgtatgattttcatgcatctaatctaaatatttaaaaatgtattatatcaatattcaaattgattattgaaactttgaaacatgtagatattttttgagaaaataacatgcgcatgcccaaaataatacgtttttttgtgaccagagagatcgagtaaattgtaagaaattaaatctaagtttaatgtaaaagacagtgccaagtcaaatcacacctcgtcaaaatgaagttggcttcgcctgatcgatcgcttttctggtatggttgaaaacttgaaaaatatcttacagttccagcaagaaattgacaggcgtacgtatagccgatcagatgatacgtctaattaactagcttataattaagccgttaccaaaatttatttcttttaaatttaactttgaagctgattttgttgttttatcatagttaatttcttttttcacattaatttttaaatcactaaaaacacgtatataaaatgttttacccacaaatacaattaatattatgtcaaccgatgatggtagtttgtctgattcaaattaatccaaacttttgaatgcagaataccgattaattatttacttccttcgtcttaaaatacgtaactttagtactaagttgctttattattttggatgaacatagtagttaattaattgatgggaatggaactcaaggttcctagctaattaaacgtcgttgatgtcagcttgatgcacgtacgtgtgtatactcctcgttaaattcgtcaggagctgtttctactatagtagtagtagtagtttcccatgctagacacccaattaaatgctgacagattaccgttaattctcgcatagagaaaaaaatatactttcggataagcaagtataacagtagactataaaccggctaaatgctgaagtggaggagagaag

SEQ ID NO: 103200 - DNA, 656 bp, Oryza sativa
gataatgaaaaagatctattaaaaaaaaaggctcacaaccacaatttctaatcggctccaccgtcgtctgatgtgatcgtctcctcacctctaccggtccgcctatattcccgacgcggcgccgcctccactgccgtcgtactctttgatccccatgcgcgtgtcaccgagatctaatggctgaagaaaaacctctgctccaaccccaagcaccccaccgcctctggccgtcaatggagttccagttgccgacggaaagacagaaggagaacagtagagaatagagatagaatgaggtgaaagggcatgtagcctagtggttgcagtgacctgagtagcaccccaaggtcatgtgttcaaatctccataggagcgaatttcagattgggttatttgagagctaagttccctatgcgataggctaagtttctactttaaacctattcgataggctaaccggatgtagatgccgggtaaaaaatatcctcctatgtgataggctaaatttctactttaaacctattcgataagctaaccggatgtaaatgccgggtaaaaaatatccttctctcttaaaaaaagagataggaccagggaagaactagcctaccagtcagggactcaagagcagcgacgctggtcactggaggtgccca

SEQ ID NO: 103201 - DNA, 2279 bp, Oryza sativa
taagggctcgtgtataaaacgattttatagaatggtcaaatataaaatcaaattggcatctaccctgacgcctcttgctgttgctcatgatcatcgatctctccatcactcatttttcctgccttggctctggaagcctcaggaacaagcaatccctttattatttgtacctctatccaacggtaaatcctgttttacttttagcatccaacggttaatattatttgaaagatgtggcacatccatgttacattatgggattcactttttcgtcgttaagatatggcttgccaaacaagcagcctctaacttatagcacgtacacattgttaattttaagaaaggcagttatgagtatttatattttaatttttttttctttgagacactaatttagatggcatacaattttacaattttattatgacttaaacatttatgaatatcagtgtaatttattttaggggtttgttaaacagttgatgttaaattagttgaattataacttaattgaatgctatattgaaacctgatacttgctatggtgtatataagtctcatgacaaatactgatattattttcagtggaaggctataggtaaagttaaaaagctacaagccatgaatcgtgagttacagaagctgaagctttgaatcgtgagttagcccaagctatgaatctcgagatgcattatggaatacgaatgattgtttgcttcctgaaaccgtcgattcatgttacttcatcatttatgctgctattttgagtaccagacattcactgctcatggtaaggatccattgctcatttatgcttgatcctttttttagtaaatggtaatgcatcaaacaaaaaacatgtatatattatatcaacaaaatatttttattgccacttaataataaaatattgcgtattaatgctactctaaaggaaatatcaaagatcaaagattatatgttttacaatttaatttattgtcacttaatgataaaatgttgcctattaatgctactctaaaagaaatattaaagatcatatgttttacaatttaacttgtactgttctacaggctgtgagcattaccaatgctattttcgctgttattctgcttggcatgcttatcaaaaagtacaagagctacaaggcttacagacaagagtatcgctctctttcctcgtcattagcgaatgtgtaatttgagtaactcaatgccagctatgagagcacaagcatgcattaattttgttttgtgggatgttggtactcaaaatcgattagctatttgatccgtggaatcaatcttgcatgtatgcgttcagactttagaattcagatactgggcgtgtaggtgtagctgtaatcaacagctgtattctttcttcgctggtcgttattgcccggcgagcatttgccttttgcactgtttacaacagcgtaccgaactttagtccttgagattttactgaaatttatgttgttattatctaacagacactgtgaatttgaagtagcgaagattagtttaaatatacaaatagagatctcgtgagttatgtttttaatatttttcaaaaaaatttaactaaaacggatgatagttggaagcgaaaaatcatagctgcacttaaaatgagaggaagggagacgaagggagtacatgttatacataagtactcccttcgtttcacaatataagtcattctagtatttttcacatcaatagaaatatgaaaaatgctagaatgatttacattgtgaaacggagggagtattataaagtatctaaattagtagtacctctgtctcatattacttgttgctttgagtttttatttgtaaaattttatcattcgtcttattaaaaaaatttaaaattattatttattttatttgtgatgtattttattatcaaaagtactttaagtattacttatcatttttcatatttgcacaaatttttcaaataaaacgaatggtcaaacgttgcaaggaaaaagtcagagcaacgactattatgggatggaggtagtacatacatttacagatttggaccaataaagtacaccgaaggttccttaacctcagacggttttgaaccggttttattcgacgtgacgactaaatcagcgtgggacccacgtggaccccacatctcaggaggccacttaagcaagccagcctctcctttcttctcctctcctcctctctggactctgagcaggccgccttcctcatcggcggtggctgcgttgtctgctccgccttgcacgactgc

SEQ ID NO: 103202 - DNA, 1769 bp, Oryza sativa
cgccatggacagcgagcgcccctgacgccaccgcgccagcccctgtcctcgccagacttgttgttgcctcggcttcagcctgcatctccgccgctttgttttcttgctctctctaataggacagaaactccattaagccgtcacgaggaactggcgatggcgtatattgttgtgtttgtgtgtaaaatttttagggtgtagctatatttatgacgccatatttttcatcaaaaaatagtcggcatgtatttatattgtaagtccctaaattacatatgtaattttagtgtatttacaatgtaagtctcaaaattacatatgtaagtactaaaattacatactaattatatatgtataagtggggtttaaatgaggtgtaactactgtgtaagtagctgaaaaaaatcgactgtagcatatggcaccatatttttagcaactccgaaatttttattcttgtgtttttaatatgatgtgcatgtaacatctttattttttgtcccgtgatttaggatggagtgattcgatgtataagtaaaaaaaatattcacatataatttgggggtaaactaattagaccccagtaacaccctccttatttatttttcctttttttttcttgcttgatgcactctctataagaaatcatcaaccgcaataatgcaattactacaagttaatgcaccatcaatttttatttacatcgacaataatacgaatactacaagatttgatcaactaatattgttcataatccaacaactacaagcacatgcaacatcaattttcatttatgtcgacagtaacttgattactacaagatttcaccaagcatggttgttgttaatccaattactacaggcacatccgcacatgcaccatcaatttcatttacatcgacagtaattcaattcctacaagatttggtctcagtttattgcacaccatattgtaactacctcgattggaaacagagataaaccaattacaatgattgttttcaaccgaccaccgattttacggatctgtaaatgatttacccgaatttaaatagaactaaaaaaacacgaatattagggaaggacctaatatcaaataattagaaggggtgaggcttcaaacccaggtcgtctagtccaccaccttgtggagctagccggaagacccctgggcgtttctcagaactaatctacacagatcgaacgtgggcaaccgaacaccagtttttgcggactctgggcgcgatgtgcggtgctcggaacaatattccgcgctctagcgctcggaatagcgctaccggtaaatattactatatttgtctacaaatttagccaaatttaaattattttgactttaatcaaggtcaaaacgatttgtaatttgatgcggaggaagtatttgtttggacttgattaaacttagaaaaaaatcctatttgttttactacgacgtggacgacgcggggtttggtggcaacgaggtagaggcgtagagctctcatccagggtctccaaggccactggctaggatggagatggacaaattcagctcgtcgtatcagccgtcgtggccaccagcgcaggccaccgtcgacgtcgtcgggtcggtggagacgtacgccgcgcgtcaggaagaagaggttctaggatgttcttgtcagctgcaagcagaaggttgaggccttggaggctatggagacgccggcgacggcgccgcttcgggaaggtgaaggtcaaggggttggtggtgacggtggcggtggccctgac

SEQ ID NO: 103203 - DNA, 692 bp, Oryza sativa
gattttgccttttatcttgcaatgagttcactaggacactatcggccaccacccctgtgcacgccgcccgcagcatgcctccgggctagtgaggatagtgaagagcaaagggaggatgactgtgtgagagataaggaaagagtttgctgctgacatgtggggcccacatgatacgatagttaagtagtctgcgtgtgagtaaatcagggtactatagcagtgagctacgacgcagggcaatcatctctccccaatgctatttattttggcgatcaatccctttctataactcctaaagtttaccacctgactggcgatctatacactatatttcagcaaattatcatgcttttaagatttctacgagcaaattaaagaagttacggtgtctatcggcaaagactaaaactagagatgttttgtatttgtgttgctagaatgattgcctcccctccctttacaatacaagtgacatgcatatataccgtgaaaaaaaaaaagatacaccgaagaatacgacgacggccgactcggtggcaggaagcggtgggtcctcctgaaacgcgagtgatcgcgggacggacgcatgcgcgatcagaaacggcaaaactgaggaagccccacgcacatgatcgagaccatgtgacccacgatcatgtccataccacttcacacacgtttttttatatatg

SEQ ID NO: 103204 - DNA, 668 bp, Oryza sativa
ccaattattctaacaatccccaccaagtttcatggctcataagaaatgcttctcaatgttgtgcctgtttgatataccagggttttggtggagactgttaagttgaacttccacctaggaaatgagctacatcagaccacaactgaacaatggactatgccttgaattgtcagttttgtgtgatcaggtttcactcagaaccttgactggtactgggctgccgttcgcatcccctctgtttggagcatataagtcaaactccaggcctttcatgagtatctagtgatcgcccaaacctcatagactgtgactagcagttgaactcatataggtgtgttccttctgagatgttctgcaggtcaacatctctgcttggagaagccactcggatcacattaaggcatgagccatcctaccatcctgctcggagtatctgatatttttgaagcagaaaacttcgttctcaaacagagactcaagttccatgaaatttcgtagtctctgtatcatcggactatctgatccaacatcggatactccgacacttagaaaaactcactcaaaagaattttttaaacaaagacagagagtgaagttctgtgaaaaatcggatagtccgatacatcggatagtctgatttcaaatcggatagtctgatgttgctcaag

SEQ ID NO: 103205 - DNA, 744 bp, Oryza sativa
ttgacagttcatctccatttctcagatgattaatgtggatatccatggcttcaaatggcctcgcacggttcatcacgacacagtcttcacttgcccttcaccaccggtttcggttcgtcggcgccaagccccttgcttgcccttcaccaccgcatggtccatcgcaactgagcgtcacttgcgcttcaccgtcttgccataggtagtcacttcatgcccgcatcttcaatatcttctctttaattctcatccatcgataagtccatttcctagtttcttcatcggactaatcacttgcttatacactccataagtgcattagtcccttaatcgtttgtcatcaataaaccaaaacccactaggggcatagatgctctttcaataacttgaaaataaatttatttgcttttttaagttacttttatatagattttttttttaaaaaaatgcattatttaacagtttgaaaaatgtgctaaaggaaaataagaaagttaaattttggagttgaggaaaaaatagacttgtcagggttatggataccacatacctaatagtagttgaaataaatctcggcaggacccgccacataccatgtcttatacgaaaacaactttgaatatagaaggagttccgcataaggaatgatgaatagagttctacatgaaaacgacaaggactacttgaattgtatccagtattggtttccctaattctacttggacaaggggacatctatgggta

SEQ ID NO: 103206 - DNA, 1812 bp, Oryza sativa
aaagtcaacggtgtcaaacattttgaaatggagggagtatattttttgtgtaaatgatggatgggtcccaaatatttttaattttaatgccacctaagcgccacgtgggatgaagacccggtcaacaccgccacgtcaggccacatcaacaaaaccgccatccaaaaccactggaggagacaaattgcaccggtttcaatagttcggggagtcgttcgggaccacctatacatttgtcgataaattttctcgtaaaaatttgacagatgtaattatagtacaatcatagtgtagttacactgtaacttatatgttattacactgtaacttacatgatactacagtgtaacttatatataactacagtgtaacttgtatgtaaatctcacataattttgaatcgttagatctattccaagattagttttggtgacgaagaaaaaaatcacagcacacacatgtgatagaatttgttcccacgacctccattttaccgaaataacatattacggagagatttttgaaagttatatataagttatattatagttacagtgtaattacatgcaagttacagtataattatactatgattgtactgtaattacatctgttaaatttttgggagaaaatttgtcgataaatatatagcaaaattgaaggagaagattccacgtgcgacatatcgtacgagtacgacacacccatctttatcacacagcatactttcagattaatttcatcccacaacacacatcttaattacctctggaacgcagtttgcttccagatcaacgaattttcgatgagaatttctcatgtatcacagcactctatcctgatccaaaatatagtgaaatatgtatacctcacaaatctgaacccatttcttagtgactgtcagccaccgaatacgaaatctctcaaacacaaattaacaacaaaaaaccaacatgtcaaaaacaacacaaaaccaccactaacatgtttctgctaatatcgccgcatgccaaaataacaaatgcagcattgagtataaatcgtagacttcatctgcgtgtaaacgttatcttctgataatgcacaaaaaaaatgtagcaccgaataaaaacctgcaggtattcactattcagcggtttcagtcagaaataaccaaaattacagtttcgaatttcgatcacacaagaatggatcgccgcttaataaccactacatctggtgcagtattcacagctcacacgcacaccaaagcattacatcaagacagtaaaaacagatatctataagaaacatacgtgcaaactgtccttccagttcagacaaaaaaataacagagagaagatgatacgagaaattacagaatgcagactcctacaatcctacagctctatcaggctcagagcagctctactataactagtaagatttgccagtaagtttctggtcactagaggatcaagaacacagttgaggagcgatctgatccgttgatgtggcaaaactgacggtgaggatggactaaggggaccgactgaactgatcagtgggaatggtcgaagctgaactccttgtgcacaccgcacttgcaggtcacgcgcaccaccagctcgccgccggtgcaggccgccgccgccgccggcgagctcggcctgggtgcctctctctccgcgctcgacacctcaacctctcgctcctgaaaggtacaaaatgttcaggtttcagaatgacagattgccgaatgacaatgacatgaaaagaagatgaatacaacagcaatcgccagtaacagaggagtccaggcaattgcagaga

SEQ ID NO: 103207 - DNA, 1696 bp, Oryza sativa
ctttcctataaaccggtggacccaacattttaaatcattagattattaattttcaccattaaatcttatcttccaaaaaaaatctgtacgttcccccactccgatcataagttcacgtaatacattttaaaacgaaaaaaaatgtgcacatgtatgtacgtactccctctctccccctctaaccctccccttccatatttcctatttttttggctaacaccaaatacgtgtagtataaaaattaattagatagctaataatctcttggtacatatgtttctatataaaaattataatacgtcacttggatgtatatacccttaattttcaggggtgaactcagaaaaaaaaatcgggacatcacttggatattatcagggacactacacatacaaattatttaattactgagtgatatgttaattaatatgacatgaattatctattattatatactaaaaatccattagatatcctacaaattctctcaagctaccacgtggcttcccataaacgttcctaatcaccacatgacgccctaatatatctttatataaaaaattttgagataaaaacatcttactcaaaccggtggaccttattttaaaatgttagatctatatcttaaaaataaaacctaccgatcgatcaggccgtcaaaatccatatgtacaatgcacatatccacttccctcctcacggatgagacgaacccactggctttcgcctcttttttcttccttacggcaattaagttaaccactgaataaaagaaaatcctaaaaaaaatttaataaaaatggtgggctcattactttataccattagacatctaacaaattctactaacttaattatatctctcaacatgtatacgaggtctatttacctatataaatatgtaaagctaaatcaatctacaaacgtacaaataaatccgtaaatccatctatgaatgaagctctttttaattactatgtctgtcctataatgaatcctaaaattttataggaattaaggaagaatgaaaaaatatactaagattcccctctctaaataagtatgtgaagagttagaagatggttagagtactgttggataaaaaatgaataatggatggttggatgggatgagtagtattaaaatcggataaaatttgaatcctttaatttatggatggaggtagtagaagcaaatagaagtatgtgattatgtctttaattagataaagaagtcatattaccatatttttaataggaaatttcttaaattaatatatcctaaaatctataaatgcatctttagtatacaagaaaaagtattacttaaaagtttaaattaagatgctaattttttttaaaaaaagaaacacatatagtataaatgatagtttcatatgaaccgtatccattgttgcgatatttttttctcataaatttaagatgacatgattcatgtaattttagtttacaatttgtaacaatccgttctctagaacaacacatcacagcctatttaaccggcactcccacttacatatatcaccccacttacactttcgttgtcgcttcatgtaaaatagtcaacacgaaaatgatatggttagagggacaatgccttacaagttagttgcactctttcttaactagcaagatggtactactgaagtgcacacaacacaaatcacatcctttaa

SEQ ID NO: 103208 - DNA, 1209 bp, Oryza sativa
tcataagttcacgatgtagattcacgattatgttgatgatatttggataaatcattgtgtttttattttaaaagaaatttaaaatttaaactactgtaataaaacatacaaacttcagatctactgtctgtacacacattgtatggtttagtttttttttccgaacaggcaaaatcatttggtttagttacgtactccctccgtctcactcagaactgtttaaatatttgaccaataaatattttattataaattgaattttatttcatgaagataatatcgttggattgtcatttcagtttacttttctataattataattttgttgctacaaacattgtagtttatgaaaaatttaaagtcaagggttaggtttaatattgtgctaagtttgaccgtgcattaatgagtgggacggagggagtatatgatatcgatcgctctctttgggtaccaaagcatcggatgtatgggtcgatacatatcgattctgatcctatgatggtttcacaactttgtttgaatttcgaagctctcaaaaataactaggttttgagtttcatcgatcaaacttcacgagatttcgcaaaattacgttcaagcagcaagccatgcaagctatacagcacacagttttggtccttatttataacttatgggcacgtacgcttctaaaaagtttgatttctataaagttttcttcatcagcatatttctgagaatactccctccatccatatatgtaagtacttatataatattcgacctcctcccagcgctaaatcaataaattctcgtccatccatatgcttcagccctcaacctcatccaatcagggaacacgagagagtgatgaagccaccatgtgttggttaccgagtgctagctattggtaatatcgtttccacatgtttttgtcacacgggagctttttggtctccggtaataactcattgactaagtggatcatatcatcacaaccttaaactgtattaaaaaaaatccgtgtcaaataaaacatgctatcgaaaataacatggaatctttggtttagttatcctaaaatataataataactaaaaccagattatgaaaatatcactctttagtttttattagcatgcgttttaattatcctaaaatttaataacaattaataaacataaaggtgtacgtgtactctcgatttagtaatatattttattgatt

SEQ ID NO: 103209 - DNA, 787 bp, Oryza sativa
agggaggacagcaacggcgatgtgggagcagggcaacgccgacggagggaggaggaggcgacgacgacgacgacggggagggctctccaacgctgcccgtgcgtgtgctcgcagctcgcctccgacgctgcctacgggcgctcaccgcctccggcaccgcccacacgtgctgaccgctcgcgcttagcactcatcggcgacgagaacggacgctgccgccttcaacgttcgccggtgctcccctccccctcccctctcttcctctctctccagggttggttttaaaacctctcaaagtggcaaaatatcctaattaaagataacctattgagtggcattttatgctttgcatcgtattgggtggtatttcgtcgaaacccaccaaatggaatggcgtattgtcctttttctcctttttacacggtctttagcgatatcctttaactattaatgtatttcatattatattattagcaactatataaattagtgtcacatgaaagaataatttcacaaagctacatattttatggtccaagttgcagaaaacaacacattttgacacttgacacttaactacatactctattttttttgtttgacgttccagttcatactcaaaaggtgtttttttttgtttgacgctcgcagttcagaagccctcctcccgtccgcaaatttcccctctcccccctgcagagacgaaacgtatcagtgcaaagggataagggtgaagggcaaacaagtcaattcacagcttccttaatttaatcgaaccggtcggcaa

SEQ ID NO: 103210 - DNA, 1756 bp, Oryza sativa
acaatgtgtcgaagtttatgtaatgacaacagttctccatgacagtgagtgttgtgttgacagcaattcttttttcaccgggacggcgaagatgccgaccgatgtaccacacccctctaaaatcttttatatttagatagggagtctatctagattcgtagtagtctaggatgtgtcacatcacattcctctaaaatctcttatatcttaggatggtggtagtaataaataggagtataacgaatttggatagaacatatcttctttctaaatatacagtactaaaacgtgtcgtattaggtttgtttttttagagactatgagctcgtgccagtaggacagacatatgaaatgagttggtgcgactgagtttttcatatttaatgcatgatgttacaagcctgagtatttctgtggtatgtcttcgtattcaacagtgatatgtcagtccttactcttgttcagaatttggcgatgaggcagccacgtcacacgtgatagaatagttagcattaaagaagtatacatctatacggttggccgttggcatgatgaataaggtcgtatccgcaggcattcatcaggtatgttctaaagtgtcgatgaatgatggatgaaattaagtgtataataattatttaaatgcacaaataaataaattaagaaaaaaatatactcatgtgttcatgagtttccgctcaatatgcttctaataataactaatcgatttcgctagaaatctgtcgcgtgattctttccgagcgatttcatggtatttttggccgcactatgtgtgcgccaagatttgtgcacgatggtggaggctacatgcatggtcagcgtagataaggccgtggttcgatccttgggcccggtttttttttcacggtaccaattttcgatttgcgtctgtttttttcttctctcgctaactttgcccggaatcactctttctttctcatacgttcttctctctaactaaaattacagtcctatttaactaaaattacatatgtaaattcagttgatatgatatataagtgcactgtaattttaataaaaatgatgtgcaagtaaatatgtatttgttattttaattaaaatacaaaattacagtcctgtataactaaaattacatttgtaaattcagtcgatatgacatgtaagtgcactgtaattttgataaaaatgttatatgtatttgttattttctttaaaatataaaattacagtcctatatagctaaaattacatttgtaaattcagttgatataacatgtaagtacactgtattttaataaaaataccgtgtaagtaaatatatatttgttattttcttttgtagtccgttggatgtaaatttaatggtagaaaaaatatgggtgatttcttgctagaaatcacccgatggatagtcagtttatctaatcccctatgtgcttctgagttttattttgatctcctttatacacattctgctaattgttcatgggctaactcttgacttttcatcaaaatgactatattgccatctcttatactcatgtactagcttattattatctaaaaaaaatgcaagcttattgagaaaagtacaatcctcgatataaaaaagattattttgtacgaaaaatgatggggatataattatttgacaaaaaaatttggaaatcggaatttatttcttttttaataaatttcaaatcagatttgatgaacatcatagaatattttcaccaaaatttaaatctaaata

SEQ ID NO: 103211 - DNA, 1545 bp, Oryza sativa
atcaacccattcagattgggtacaactaaagattgcacaagctgaatgcctgaataccagacttgaaggaagtttgtgcaaaatatgacttcttcaagcagagcaccgctttttattaccttcccagaagctagctgatttgtccacaagtttcaattatgccaaaagggtcctgtgaccgaatttaagctgtggagcaattaaaagtagaaggccgtagggttgaaattcttgttgaatagaaaaaaacaagagaaacagttgcttgtagctagcccagaagatctatttctaaaaggggatattgtgtacatgttcttaactatttgtaatttcgtcgtggtgtagtgtgaaacgtatgtactagtatattctttttcctatcctcacaattttgtatcagtttctcattcttactccaattttatgtatgcattacacatgtatctgtccttttaacttacccatatatattttctgtgcgtcacctgcatgctgattatattatttcactctcattgtgtgttggtgctggaaaatggggttctggggagggttcaccgtcaagatttcagaactggagaatccaactgtggtgatgatagtggaacagaacaaatgactcaatcactactatgctttccctctctattggtgcagcgtttatttagcagtactccctattcaaattttttttgcaaatataaaaaacgaaaagttgtgcttaaagtactgtagataataaagtaagtcacaaataaaataaataataatttcaaaattttttgaataagacgaatggtcaaacattacaagcaaaaactcaaaatcccttatattatgggacgtagggagtaatatattgatgtataatctttttgcgcattcgtgaaaaatcagtactatgctacaccttcctcgatcgtctctgtttgatcatgcatgggatcgatccactgccctctactcatctatcattcatgagtaaaaatgtccaagtaattaatcatatcgatgctctttgattaggattttgcatgtgtctaggctagctaaactaatccaattgagatccgcagtactgcctactggcatgtgggccagagggactgtggggcccacatgtcagtgagtagtactgcagacccgcatccaaactaatcatgcatggttatcaaactcaactctagttgaggtaaagatcaggtgttgctagcaggagtagtaattgtaattgcttcaagaaaaagaaaagagcttaggggtgtttacatccatggtgtaaaattttggcgtgtcacatcggatatacggacacacatttaaagtattaaacgtagactaataacaaaacaaattacagattccgcctgtaaactatgagacgaatttattaagcttaattaatccatcattagtaaatgtttactgtagctacacattatcaaatcatggcgcaataaggcttaaaagattcgtctcataatttacacgcaatctgtgtaattagttattttctcatttatatttaatacaccatgtata

SEQ ID NO: 103212 - DNA, 673 bp, Oryza sativa
tcctgcagcccaaaacaggttctattatacttgctcttatcgtgccacgtcacggcgtgtagcggttagtcctgcgtggacgaacgtggcactgcacgacagcacgagacagtcgtgggaacgtgaggtagtacttgttctcagctcatgttgggaacccttcctccccgacacagaaaacgaagtttgtttattgcatgattaattaagtataaactaattttttttaaaaaaatggattaatatgatttttctaaaaaactttcatatagaaagttttttataaatcacatcatttagcagtttgaaaaacgtgtgcgcggaaaacgagagaggtgggttgagaaaatgggggtaagggcatgtacaatggttgtcaatagtggtctcttagcgttgctaattaggaatacttgttgacatggaggaaagagaaagaggagagacaaaacatcgttgttatgcatgacaacggcttaacaacgactcttagtcactataatatggaaaaatggttgcatgaggataaacatatggaaagaatattaacaaaaggaatttttttgagttaatgattagagactttgttgtctcaactattgtaaagacatggtctctaaataatcttgtattatttaagagaccatatccgtctctaccattgaacatgccc

SEQ ID NO: 103213 - DNA, 739 bp, Oryza sativa
atcaccctacatctatgaactggaccggcatatccctttttttttagaccttttttttagaaacacagcatatcaccctacccctatgaactgaaccggcatatcatatcttgagattgacgaagtcaccacaggcgcctcgctgtcgacgggtatgtcgcctaccactaaaagaataattagccataaatgcgagcacccgtgttaaatctaggatttgaacctgggtgggctggttccaccacaagaaagctaaccagttgagttatgctcacttcgcggctacgatttgatttgaatccacacaagacacaactcgcagggtacgattttttaaattcaattggcataatttattaatggtagtcgttacaacaataataacatattcctatttattattaaaaacgtcaacggacaaagtccagtgaggtgagggcagttttggtctagtattaacccttgaattatttgacctcgttgccgtgagaaaaatacaacctcttactttgtgtatacctactccttacgtatgctggtcgacgcacgactctcccagtgtgaagtctaattaaatttctaagtttgagaattaagaaataaaaggttgtacttagtttagtcctaactatatttttattgatttaatagttttaaattgacaagtaccatatgacagtacaacaatcatgtttgttaacctttaactaactaattctttaaatcatagtaaactccg

SEQ ID NO: 103214 - DNA, 811 bp, Oryza sativa
tgacaatatataaaatttagttttttctaatttctttcatcatcatattgttattgacactgaatattaaattgatagttataattaattgacggccggctgagaatcgtctcctaagagatgctatccatatcaaccattatttacatcattatgtatgaaaacggaatttgatattttctagtccaataaaaccccttattgactctcataccttaattgattctcagcgtctagactgtttgcatacatttttcaatttaaagttttctttcaccaatatggtttctagatctattagtattatcatttcaacaataataacaaacaattaattgttaggtttaggttagactaggcacacaagtactcatatatacgactaaattattctttcagtgataagtgatatgctaaatagtaacacaatacaacgactttatcatcttaaagagatgggtctaatcttcggagacgtttatagatatagaatgcgcgtgtgcacgtcatgggtgagtgtgcacataaacacgtatatatgagagtgtgacctaaaccgtgttttaaaaataaacagcaaactgcataggaagatatgaacgcgattatatgatcgtctatgtacgaagatcaaagaaaagacctgtccatagtttaggtctagaatatgtatatttacggtcgatcgaatttgaccctgttgccgtgagccagcagatttcgaagaaaattcagccccatcttgcttgcttcttctacaagtatacatccttgtatatgaacatgtactcgcagtcatgggctgcaggaa

SEQ ID NO: 103215 - DNA, 817 bp, Oryza sativa
agaagaaagtactggattggctaggtacacacaaaaagtgcatccccatccaaaaaaaagaaaaacccactcttagatttaaatctgctcctaggtttgaatctggatatacactatccagatttaatcctaggagtcgttttttctgagacggagggagttgtagagaaaacaaattagtttttgctgcagtagataagctaataaaggggctaaggttgtatttgagaggagggaaaaagagaaggagaaggtgtataaaatgagataagccattagcacatgattaattgagtaataattattttaagtttgaaaaatatattactatgatcattaaagtaatttttatatagaaatttattgtaaaaacacataccatttagtagttcgggaaacacgcacgttgaaaatgagagactttctcgcgtgtcattcaaactaaggcaacctaaggctgtcttcaagagagccaaacaacctgagcttatgttggcatgaaaaacgaggagagtcattatcgcatgattgattaagcattagctattacaaacttaaaaatgaatttatttgaaatttttaaagaaacgtcttatttagatcgcactattcagtaattcgggtagcatactcacacagtaagcgaccggtagcctttttttttttaagataatgggttatattaaacccgacttctacagcttgtcaaggtgtacacagctagcccaacgacctgaagccatggccaacgtcgttttctttctcccggcgccatctccgcaaccatgccgagctaccgtgcttttgggcctgattg

SEQ ID NO: 103216 - DNA, 676 bp, Oryza sativa
gtttcccaatgtaagtcattttagcatttctcatattcatattgatgttaaatactccctccttccctaaatgtttgacgccgttgatttttttaaacatgtttgaccgttcgtcttattcaaaaacttttgtgaaatgtgtaaaactatatgtatacgtaaaagtatacttaacaataaatcaaatgataggaaaagaattaataattacttaaattttttgaataagacaaacggtcaaatatttttttaaaagtcaacggcgtcaaatattttatgatggaaggaatatatgtctagatttattaacatcaatataaatgtgagaaatgctagaatgacataaaatgaataacaataccgaatctaattataagtgcgatgaccaaaatatatactacggagtagatacgaattataatgccatactaatcgtctgaccaatttcctaagcaaaaaatgcagaccactaatcctcgacaaaatccagcttactatcgcactagagtgtatgtacctggggttgcattttcaaaatggggggtttagccggaaggggccgaaattgcaatcactgacctggagtggaagaattttgagggataaaaaggatataaaataatatctccgggtagcaatcaaggccttatttcttttgcaaattgcggggctgcag

SEQ ID NO: 103217 - DNA, 2067 bp, Oryza sativa
attcctgcagccccccctgcctccattttcagcccctttctccttgttggggtgtcgccgccgcctcgctcctcgccagatccggcctgaggctcaccgtatctagccttgggaggtggtggcagccggcaggtggtcgtggcactgctcaaccgagccaccggcggcggccactccgcaccctctcctcttcgaatctagccttgggaggcggcgacggcaaactcatgtcactcgtgtctccggcgagatcaggtggctggatttttgttcgattttgggttttttttttcttcgtttgccattttgcatattgtatttggggtctaattcgaggaagttttgtaatcaatttttgtaagctgtatatgtaagttattctagtgcaacacgaacttgtttaattttttgtgtgctatttgacccggaaacaagatgatttttgtgtgttggactcaggatgttgcggatgaaaaaatttaggtgaggacggatggaaattttcaccggaatccttacatacttttttattattaggtatagattaacaccatacaaaatgcttgtggtcctttgcatgcgcagtaaccttttgtttctttcacggaaagaaaggggcattaattttgtatacttgaatacgtattacatcctatatatcggtaagcatatatttatactgatttttatgtatataatataattatctttaatttttgaattaaaaatggttcattataagatttcagagtcaataaaaatctattgaagaaagaggtgcaatacatttgatttttcagcaatggaatgtgcatggtccgtgctagtggtgagagaaaaaatttgcgcgcaaatatgatttgacaggagggagggaaagtagacttattccagaagaggcccatagacacagtgcaagtaatagacacaggtgcaaaaatgagaggaacgttggaatcgaaccctggtcgccggggtgaaaactttcgcccttaaccaagtaggcattacatggaacaaaaatatattctctccattccaaattgaaaaatgatcatcatatttgtcattatttgtgcatggaagtaaagtgttttgatttactattaggtaaaaaatagtggggaatgtgcatgcattgagtttgttaccaaaataaatgtagtacgagagagttattatattttcttggtcttaatacacccatgtaatacgatgatcaatttaaaatagagggagtagtatataaacctcggttttcgagtggattgaaaaagatccgacccaactattaagcggattaaaacggatttagcgactcgtgtgggacgacggacaaaaaaaaacacccggaatccttacgtatttgtttttattattattaggtatagaaaaattaaaaaggttcaaaagaaattcctatcacacgtactacgtattctgctggcccgacgctcgtccaaaggtctgagaccatgaacgtaacggcctacgctatatgtacaccaacacgcacgcacgttcggtaacacaacaccaccgccgtggccgtcctcgacgggcgatagcctctaccgtcggcctcagcacaacccccaacggcaccgacttcgccgcgtccaaccgttcaacaacaacagctcctcgagccgcacgaccagcgccaagtgggcccattattttcaacttgggaattcaaaattgaatgagattaaaaaaaaactacaacccaaagtttaatggttgtataacactccatcccatactccctccgtctaaaaagaaaatggcaaaccttagaggatgtgacccttgattctgtccccagattcgttgtactatactaggaggggtcacatccctctaaggtttgcctttttttttttagaacagagggagtaaggggcagttgtagttttccgcgttcaacatttgaccatccgttttatttgaaattttcttatgatttgtatttttattgttattaggtgataaaacatgaataatactttatacgtgactttttaaaaaaaattaaataatatggacggttaaacattggttacg

SEQ ID NO: 103218 - DNA, 1451 bp, Oryza sativa
ctttttggaaaactgcatattggagtaacatttcaagaaaaaaataaagtggtgaggatccctgacatccctgaaagcacgcagccatggacatatagcctctgcaagagcagttgagcgctatgtgcctatgtttctcttccctctgaatccattattcaaattaggcatatctttttgttttggcctcaatatcttttaccaggcaccacaaacaataaccagtgaccagcaaataacagtcaaattggaccaaaatgttttctccaagatctatgcatgaatgcttattttctcgaaaacacaggagaactgcgctcattacaaatgaaatatatagacaacggaaggatccaaaggaccctcccataacaccacccccccctccccaaaataaataaataaataaataaatgtggtacacgactagaacaccccgcgacgactagctagccatccaaggcgagagaccttatgcatgaatgtgaaagagctatgcaaacaataggagcaatacaaaaaaaaaatgtgagtattaactatctcatagaaacagacaaatttgagaaaatataatattaaacctgcaaggaaaccttgattattatttgcttcaacatggtcacagtagtccaaatctagtacaaggcaactgtaatacatgcttgacagtacaggtggtctagatggaaatggtacttatttagctagagatgtgagaagcaaccaaattgttgtcaaggatgctctctgatgcatataaattaacaaacataacagccagtgagctcggatatttgggtagatcaaaagtgtttttgccactcaaaaaaatgatgtgccttatctatatttatcacaaatacgtgttgaattggaatttggacaactgtagtcttatcaaaatataacttgaccactaatttctattgtaattgtaatatattttaatatccaataaatttgtaatagtatgtcatggccaagcaacggccgaaggttatatgggtggaaggacggaggctgcggcctccgctgtcgtggttggtgaggctcggtggtggttctatatagaagaaagagaataggagaacggcagacaaaggagattggagatttattattttcttcgttgccatcacagttcgattacatctccttatatagccttaattctctaacaaactcaatctaacttgatcctgatttaactcaatctttaactgaccttaacctgatttatctctaagattacattaacaaaactcatctgtaaaataaaagtactttttgacacggatctgtgcatatgatttttaactatatccacctaaatacttaaaaattattgacacttgagtttcaaaagtttgaccagagatatatccatgatcctttgaggctctgagctactgctctttacttcatttcatactagctaaatgcccgtg

SEQ ID NO: 103219 - DNA, 1258 bp, Oryza sativa
ttcctgcagccctgtagacttgaaacctttaaaattttcttggagaagcaaattaaagctagctacaaattaataaagatatctataatgctgagactgacgtgcaaacacaaagaattaatttagaacactctatcagatcagaaacatgagtttgcaaagtgtttaggggaatcaaaagatattgaattcgaaatggatggcttgattgagctagggcccgtttggattgttcactgaaaggtagctgacaatggtgaactgagctaacaaataactatgaaaactaagctatagcttaattataaattagcttccatggacggtgttggcgtgcatgcaattccgttgtgccaagtacacattatgccagtaatataaaaatacaaggttttcacgtgtggaagacatgcttttaattttcttgataatataggatgacaaatgagtgtccatgagacgcaactggataaactatctctggaaacaactagtataagccacgtgtagcacaaggaattggaaaaggaatagatcgagatgttcattccacatgaatatactactaaagtagtaaaacgtagtacacgagaatagaaaggaagagagatgtgaaacatatatgaattaaaaacactagaaataaaaggaaaggaataatgttcggatcaaataaatgaaaaactcaaaattaaaaatcgatataggtaagaaagacttctatttgttaaaaaaaaagttagtttgaatctagtttattgaaacagtttcttaatgcgaactgacttgatttgaccggtaactaataaaattttaagtaaattacactttggtccacctttaattatcaaagtttcactttgggctattctagctaatattttcactttagactaggtaaggttacttttgttgtagtttagaccaccccaagtcacttttctagctgcatctaccctctagtcttgcaaagaatagtcaacatgtaagttggaagattagcagtttatgggtgtagatgtggcggttaaagtcatttatgtgctcgagaaaagtttttgggatggttcaaagtgaaacaaaggcaaactaatatagtccaaagagaaaagatgttttaacgggtagtccaaaatgaaactttggtgataaaagatgaccctaaacgcaatttactctaaaatttttcaaacttgtgcctagctcgatcacctcattctttttttactactccctccgtattttaatgtatgacgcc

SEQ ID NO: 103220 - DNA, 705 bp, Oryza sativa
atctagtacatttgaatcctcatattcagagacagtttgtctaatacaatttcacagcctttattcgatataggagatcattgaacttcttaaaatattttcaccattcaatttcgtatgttgttaaggaatgaattgattattcatgatgctctttttgtacaccagaaattgacaggtggtgtaatgctttcgaggaacaatgactttatggtcttctacagaggaaaggatttcttgtccccagaactcgcggagaaactgctagagagggaaagatgggcaaagtccttacaagatgaggagcaagcgcgattaaatgcagcgtcttccttttcttccagaactgaggcacctgtagagcctactgtggctggtacccttggagaaactcttgaggctaactctaaatatggaaataaactggatgagaattatgagaacaagatgactagaactgtagaagctgcaagacatgctgaccttgtaaggaagctagagtggaagctccaacttgtaagtgagagtttgagtagtaaggctattttgttaaatttatcagtccgctttgtaagatttcatcttctgaacagtccagtttttatagcaagattgcattttagatcagtttagatatctcaagataaatatagcaacttatatggtgtacagactagccttgcatcagaaaacaaaaccaacaca

SEQ ID NO: 103221 - DNA, 722 bp, Oryza sativa
  unsure (1)..(722): unsure at all n locations
gagaggcagtatccataagcatctcttagttcaataaataaaaaatcaggtttactttcaaatatctaaattaattgttaccaacagtctaaagagcatagcctcaggctgaacaatttttcagaagctgatctgtaataatttttcacaatctgaacctgcagaaagaacaagaggaagcactgaagctgctgaggaagagcctgacgttcaaggccacaccaatgccaagcttctaccacgaggctccttctcccaaggctgaatacaagaaggcaagaacactctcaacttcatcacatccaatcttcagaagaagaaacagaaaaagaacattgatctcacgactgtttctgcaccattttctctgcagctgccgacgacgcggcccaagtcgccaaagctggggaggaggaaggcctcgacggcggcggacgcctccaactcgtcggaggagagcgacagcacgccgcggccgtgctgccgcgccagccgcgacagcctcgacagcannnnnnnnnnnnnnnnnnnnnnnnnnnnnnnnnnnccgcagcaacctgcaaccgcgaagccggcagcctccaagaagcagcccaagccacacgcccacaagctctccgaccagagcgccatgaacatcgccgtccactagctgcttctctctctggctctctctttcttgcttggctgcatggatcaatcatggaggaagggaccaacca

SEQ ID NO: 103222 - DNA, 2775 bp, Oryza sativa
ccccctcccctctacccccaccagcccaccctcctccctatgctaggtatgtacgtatcccccttccctcctatccaattttctcatctctttctttcttttaagtctgttacaattaaaaataatatttttaaatcatttacatatagagaaataaccataaccttgcacataagtctattttatcattgttcattatcgtagtcatggtgattaattaaccaatcaaataccaataatagctactacattctttaactcataagaaatatttattttttatcatattctaaccttaggatgctattgaagctgtgaaaaaaaaagaaaaaacaacaatgtatattatatgatcatgtatcactttataaaacattcataaataaattaaatatgatagatatgacaaaaaataaaaaacacttaagtcatgagtaacattcgaaaaatagttcttccattactttaaatcatatccgaacctttcgtatgccatccaacaataaaaaaatattgtgtagaacaaagataatgtagatcatatcatcatatatcacttcacagtcatgcgtaattagattagctctataatatcaaaaaataaaaaataataattagttctggttagtggttagcactccacaaaaattcattgttctaaaatattgatatgttaaaataatattatttttcacaaaacaaagtaatgttagttaaatatttcagaaaaattgacgttatcataactttaatatttaaagcaacatacaatatcccaaactagaatactctaattgtgattagcactaaaaaaacattatctccattttaaaatatgaattatcacaacaatgtaaatctagaaatgtccagataaatattttgatataattatatctttagtatttcaaggactataaaaatgattaaatcaactagaaagcttaagttaatctgagtatatagtatataaagtccagtgtactcgactcatacatgtcttgcgttacgtgtcaattctatgttacacttaaacccttctatcaattctgtgtatgtactactatccaccaatcattgaggcaagaatattattatattctaaaatgccattgaacatcgtacaaatgctcctaagccgtcatgtgacccattatttttaaacattagtttagatgtattaaagtgatccctccatattaatctcccgtgtccataccacagaaaaaaatatgtactattcatcgaaaaaaacctagaaaaacatacctacacatgtatgattaaaaatattaatctttccctcctaatcctcaaatttaaaattaaaactttattatgtttgtacctagctacatacgatcattccatcgattcctctatgactcttttcactcttgctagtagaactcactagcctacttactaatacactttttgtaagtgtgtagaccatgagctaggtgttaaaatttatatataattttaatggttttctcttattaattgatagaagaggtatttaaaaatatttatacatttagacacaagtgagacatgtgcacttcggtataaaatggagatgattttttattgtattaatgatatattcagtttgttttttaataagcaattctatctattaaaaaggcacccggttctttcaagagaacaataatgagtagttgtgataggggagtttatatataaccaggtgattttttttaataccagagacattcttataactaaatttagtgtatcatcaaagtctatagtcaattttagggtagagataagataatctatggattttaaataaaatatggtaagataacatcttttaatattcttttaataaagaatatctaaattgcccgcgcatctgtgcgggcttactccctagtttagttaattgttggttagctccatagtagagacgtagaaggaggtattgcaaactaaaaataaatttaaaatttaaattttaataacaccatcaaacacctatttaagcgactataaaatcaccatttttatgccctagaataatttttttgcccctgaaaaaaagataattcaatatctatcacttaaaaattatttcctctgacgctattggattgaatttcacatctcttacacttgatgtcaacgtcacccgttgttgttaagaacgacattatattcgtcagatcttttgagaaatggcaatgtacacttgatgttctattcaatcctgcatcttctctcttcctgtggagcgagaaacactaaacactaaaataattcataagttagtactccctccttccctaaatgtttgacaccgttgacttttttaaacatgtttgaccgttcgttttattcaaaaatttttgtgatatgtgtaaaactatatgtatacataaaagtatatttaacaataaatcaaatgatagaaaaagaattaacaattacttaaatttttttaataggacgaacggtcaaatatttttaaaaaagtcaacggcgtcaaatattttgggatggaggtagtagatgataaaaatactaatatttcgaaatttcatatataaaagtaactgtaaacgtagtgcaaattttcaagctcaaggcaggccagggccctgcccgccctccctagctcggctcgtccagttcctgcctcccccagttcctctggcacgcatgcacttgttggcttaactctgctatattcccccacatgtggaacagacttggctcacatctgcttagctcctacctgctcaa

SEQ ID NO: 103223 - DNA, 2305 bp, Oryza sativa
tgcaaatatctcgcccaaaaattttattttttaaatattttttgtgaattcggtaaaaaatattattcaaatttactcaaaattttgtaaaattttaagcaacttcggtgctggaaagatccaaaattttggaaatattggtgaccacaaatttaaatttccagaacttttgtggaaaacgaaagtgtaaacctgcatcatacaaggtatcgagcgataatttattgatgcgatccgcgcgtgagcttggcagccagacgatgtgatactaaatgtttttgtccgtttatcaaatgacctggcacagtatatcgatatactactttgccacatggttactcatgtttgcttgctacaatggctagtaatggaccatcacaattagtgcagaacaaggtgcagagttggatggaacagtgatacctcgtgcttctcaaattcctcataccttccattccgactggctgtaaagagagccggtgcactgtgctgcaatgaatcgtgtacaaattaaaggatcaagaaaactggccaactgtttgcatatgtgtttgcttggaaacctagctggtgctttagggatcagtaaccatcttctgttttgtcaggtcaagcaatttcgtgatcagttgaatatttataacaatatctcatattattatatactgatggaaaaaagtatatatgtttgaacgaatttatcacaatactttgggcattgtatcaccatttgttgaaaaattgttttctcacttggacaataatttcaaactctttatgaaatgtttcaaaagatgcaacattatttaaaaaagttactaattgcaacactggtaaccattatatgaaacattgaacgccaataagtcaaacattgaaaccgtacaatgtatttattttgcagatacttgattttgttcaaacatttttatatcccacacatcgagctgtagctattgaagcatcacaatattttctgaaacatacaagcaatgcagggtgcaatagttgcaattgaacttgtgaaactatttattgaaacatctaaaaaatatacagtggatctaatgctaaaggatagatggatttgcctatcttctcaactcgatgaatcccttcatcctttaatgtagcaagttttacggatccaattttccctaaatgtatgaaattaggacatataaaagataattattgcctctaaattattcgtactatccttactattcgttggtttctattatagtctgggcctaatcctcacttatctcgagaacacaaataatctattatgtgcttcatctaaataattacatttggatggggaaagtattttctttttttatcgaaatacacagtgcgccaattcattgaatatataagaagtgttatttataggtaaatcaaaagaaataaatatttacagacaagaaggccacctaaggcaatatctccgctaggcgtttggctcccaccaatgcccaagatctggactcttcctcatctttcgcaaaaggagaaagtattttcaaggcatggatcgctgcaataactagtaatactgcaatgatgtccatctaaaaataggtgcagagctggagagtcgtgtcgtgcctctcaaatccctcgtgccatccattcccacaagctagaggtatatacgatgtacaatatattgtatcagaatgctcaagcagatcggccaatcagtgcaccataaatatttatcgtctaccaacctagtgaacttcccgactaactttcctattcaaccactctgtgaagtgtggtctgcatgcattacttccgtccaatttctgttctattggcttctccaattccttaatatttcagtggagtgtgagtacttgcatccttggctgagacgtagaatcacttcacgatgtatatctgaatctcctgatgccttctaattaatccttgaaagcagctattgtgtaacttgtctcccagattcttcctgttagttctgtctcctcaaacaggaatgttgcatgctactcatataatactgtgctatggtaaattgaatcggccatactggtacacaaaataattaggagagattttcaggaattaaatggggaatgaaggtgcatcgacattcgacggctagcttttcgcagaatcatagtgcaacgtgagtagttaatcctgtcgataagtttggtattagtgagcagcatgcatcaccagttcactgaagagtttaagccaatggagaataaagcatcagccagttcattcatgcaggatttaatatttccgtatgtagaaatctacc

SEQ ID NO: 103224 - DNA, 761 bp, Oryza sativa
ggacgtcgcgagcacgaatccgacggcgagagcaagcggcgaacggcggaaacggaggaggaaggcacggggagcaaatatatagcgccgggagggggagagcgcggccggagagggaggaatcggccgcggagatctcggctccattgaagacgccggcgacgattgcgggattcaaatcggacgaatccgagggagagagagagggaaaagagggggaaacgggagagggaatcacggggagtgatttccccctctttaatgcgcgcggggacggcgggatgcggcggaatccgcggcggcggcggcgctagggcacgggcggcggcgggcgcggcgcgaggacagggatgacaggtgggacccacccgtcagcgagggcggcgggcgggcccgcctgtcagcggcgcgcgcgcgcgggggaggccaatgggccgcgggggaagagagagagagagggagggactgggccgagccggcccaagaagggaaaaggggagggggaaaagacttttagggatttttctttttataaaacccttttaactttgtttatttcttttcaattattatttgtgctctgaaaattccactaaaatttatttacacattttaggcttttaggaaatatacaaaaatcctccaagcctcatttgacttttatctttgcacattttaattgttggaggctttcccatgaattttaattattctttgcacaatttcgaggatgaattttagagtcgttttgggacgcgaca

SEQ ID NO: 103225 - DNA, 9105 bp, Oryza sativa
aaaatagaagtgacactggctcacaaagacgtcatgagaggtaaattcatgcacctaaaatgactttcatatatgatatgtgaaatatagtactcattaacttgcgtatctaatatatatgtgctcatggcaggatccacagtgaaagagatgactatgatgcaaatgaagatggtacctgctgatgaagggttgattcctcgtaaaacatgaaggaatagtccattgcaattccaatttcagattgaaattttgttcaccataagttctagtgattgtttaattaggcatcatgttggtgctgtctgaataatttatctagttggatgcagtgaacattattattttgtatttgcaccgagtaaacaagtggctgctacaggacaactcaatgttatattcgttgtgctgttagacaaatgtgggaatcaatatattacaaggtgtggtcgtttaaactgatccgtgagtgttattgatgtattgctaatggtaacacattatgccatcgtgaataattatatgatgcattatcatggtcactaaaaaaattaggaggctacagtttctcggtagtctataaaataacaatggtatagtttcacggtcgttaataaaaatagcgacgacggaaaagcacggtcgttaaaggaaaaatgaaaaacgatcgcatattatcacggtcattaatgagattaacgatggcaggatatcaccgtcattaatgaaaacaacgatggcagaagaacaccgtcgttaataaaattaacgactggaaaaaaattggtcggtcgttaatactattaacgacaaaacctttaacgaccactgacgaccacacttctgtagtcgttaatgacctttaacgaccacatttggacttttaacgaccaaatttccggtcgttaatagtcgtttctccagtagtgccctcccgacgacgctgccacttcctcccttctcctcagtccgctcccgactcatttggagtgaagccaaggtcagtagcagctgccagtccagcgccatcccactaaggtttgtgagcttatcccaaaatcacaactggagacacaggattggatcatagggacgcttatatatatttgtcgacattacaaactattagtgcaataattcttgatgataaatgctcaagggctaagcttatataaattgtagttgcatgaatcatataatgtacctttcatgcaagaactcaagatgagttataatctataatgtaccttttggcttattagcttcatttggattttaattttataatgcaagctcattcatctaattagagctttatagttatatacggatatactaaaaattagagacaactgaactaggtttatttaggaagaactcaagatgttaacaatcttgtttatgtgcattttacatcactgtgctgatcgagctttgcatgaaagcttgtgggggtttgtatttaacatacaacaattggcaggagggttggtaagataatgcccaagaatttcagttttgtttaggcatgtgaacttttatttgacaggcaaactagatttgtgaaatatactcatctttctattcagtttgatattgtaaatatgcccaggattccaaccttaaacagtgttgatttttttcaggttttggcggcatacatcagaaaactaatgatgtattgtatgcatggttgttagctcttacatgttaatgtaagggttgtttgacaaaaatatctgtcgcaatgtgagctgggtcagtttgcattttgccaaggtgtgtgtttggaggctgcagtctctaggcatatgtaagctgtgatgtgaagttctgtgttgtatgtattttttttcaacttcttcagggttaaatgtgataatatgtatgactattattgtggtcaaaactgctcgtcatgggtgcccatgtatagagggaaggttatgccgaaatttttaataaattatggactttctgtaattgtgtggtttgctagctcttcatgcttgtgtgtaaaaaaaccatttaagcgcctatattaaccagcgatctctcttccccgtataagcgcattagttaactgatgatctctctatatgcacataagagcatatattaacagttggcctctcttatctacagaagagcatatattaactggcgatgatctctcttatccatgcaagaacatgcacaaaccgttggtcatctagcgtataagtaactagacgatctcttttacccacataagcgcatacattaacgaagaatctcccttaaacaaataagcgtcaaaggtaaccaacgatctttatttatctacataagtgggacccacaaatcagattcgtcttcctgctgatgtcaatcgccattggaggcttggagcaaggtaacctacatcccacctgccccgctgcaaccaaggaaaacaatcccaaaaaatttgttttcttcctcctttccattccctgaattcacttcaacaccagttgatgaggcagatttcaaggggaggcggtgagagggctcgaagaaattggttgctttagtgaatcggtgctaaggggaatgaacaattcctgtccttggaggcagtggggatcgtggaaatgccagcagagaggctgattgtggaatcccctagcagtgggaggggtggggatttggaatcgctcatctgcgatgcgcagcgggggaatagaggagatgggcagaggatccattgccgtggagcccggcgaccggcagggatgaatcgcaggggcgcgcgatgaggcaaagaatcgtaggtagcgtgaagagcaaatgaaacgctcgataggtataaacggcattaggcggcttcaattattctatttccaatcgtacccacgttagattcaacggttggatcttgtttggtacctgcaggtaccggtacgtggagccaccacctgctggaccgtagcaaagctctatgtaaaatgttagattggttgatgaattgatatgctatgggaattcagcatagttctttgagaaatcaatagagtaacctctgcttcagtgctagctgatatcgtcgaataacctcctataccagttgatctcattgagtgtagccatgtgacatttttccataatacccttatttagctgtgctagtggtgtacactctgaattggaactgtcaattttagtagtatatattggctatgaaccatggatcattagtaagacccgtcgaccaattaatataaggtaacatggtgccgaaatgaaatcacgggctttaactgcacatgaccaacctgagagaaggtataaaattggtcaaatatgacgcaaggtataaaattgcatcagagtctgtatatcacccaatgtatatatacttctatagtcctacatacctgcatagcttcttgaaatggcaggcatcagtgacttgagacgcactctgctgtgcatcagaagtaggaacctactgttctttgttcaagtgatgattgaaacctgttagtcaagttggttcttgtggccttgcacccgagaacactgtagcaaccggacgaatgagaagacgaataatcaaatcagccaaaaatttgttataataaaatcaaaagcatgatggctaggatagctgtaggatctaactagcagactgttgagatcaaatatgttaaatcgcattttgaactgaaagtatctgcagataactggaattgatgagaaaagagttcaaaggatgctcagtatgtctgtatttttggtatcatgtacttttgttccaatgtttgattgtactactgtagtctattggcgtataaataagaaataaaaattcagtcacataatgtgtaaacagaaaggctttgctagcaatgcacataatgatatgacaacttccttttccaaacactggcagcagatttcatttgagctaaggatatggctagctccagactgataacaagggagttttttcagacaatattaattcaatttatttatttaaagaggtggataataattaaataacacaataaacacctacaagaaaccgacaccactaaaccgttacgtcttagagaagatcattgagattcctataaaacagattccatatgcccatatcaatgcaaccctgatcaagaattctaaaacaaattccgcgttgtcctcatacaagtcagagtgctgaacaagatttaggctctaactggtaacggagttttttaccgagggacactactgcaaaaatgatttttcatggcgtcgccctataattttcactggcggtcatgcgcaaaaaccgccaccgccagcaaaaatcggttttcgcaggcggccacgctaagagacccgccataaaaaatagctctattttttttggtggcagttcaaaagggcctatcataaaaaatcgggatttcgttggcgtccgattttcgcttgcagcaaatgacagcaccgtcagtgaaataaaatttgacgctataaaagcaccgcccccacatcagtgaaaaccctatcctcttcgcctcatccttatcctgtctcctcctcctccctctctccctccaaatccacaggcacatgcacgaaggcagcggcgctcgggcgcagacgtggagggcggatccgccaccgctggaccatggggagggccgcaccgacatcgacgccatcgaccgtgctgcccatttccctcctctccgaccgtgttgctagatgtgattttttttgtgcatgttgttccagatgatgcacatgttttgatatgtgtaaatgatgtttgatctgtggacatatttcattttcaaatttcctctacacatctgtgggcatattcatttttagttttcatatttcctcttcgttggcagctagggcagctgcatgggtttgattttcactaacggttgatttaacacagccgctcgcgaaaataaattatcgttggcggtcggtgtaagacaacccctagcaaaaatggatctttgctggtggctggcataagacgatcgccagcgttcttcactggcctttgctttgtggcggctccaaattccgccagtgaaaaccttaaatggctgccatgaaagatagttttcgtagcagtgggatacgggtaacaatctagttttaggactggttgatcttaatactccgtgcagatgaatgagatggtcaatgagttgttcatgggtggccatttagtctttgaattgatggtgatcttaatactgcatgttatcctctctcattttttcttttttgagtgcggttgtgtgttcggctgtgtgtatcttagttatgcagagatcagaagtattcctagaaaaattatatctccttgatgtaattaaatggtttcaatgaaaacttccaatatctaaagaaaccatagggtagagggactccgtgcaaacgactacgtgcaagcctgtcatgaggacttcactgcatgtggccccaatcgcaaacctgagagtgatcataggtggttgaccaactatgacaaggggtaatgaattgtttgatccattgtggatacaatgtatgtacaccgatgaagtcataatccctgttaaagggtttagccgatatagcagcgtgacgattatcctttcttatcgtttttgctattgatcaactcaaataagtcatctgacgacacaagaatacattatatttgataacaaagttgaggcgaagcatatatccccattgttctgattatggtggttctcccctgttaacattacacctatatccgctacgagtacatgtcctcgccgccatcctcttcctacatgtctacgttacattgttatcaccatgtatggttacattcactactaccaaaataattcttcacagcaccatcctttattttcactagcagatttaatgaacaatcgcttgtaaaaatatctgagaggaattccagttaccaaacgctaatgaaaatcgattttcgcttgctgtcactgaagggcacggctagcaaaaaatattgccactctaaaaaaattgtcgacattaaaaaccatcgcccaccgcaacccaccgctagcgtcctccttctcgtctgctcctcctcctctccctctcccagaaccacccaccttgtaatttcactggccttaggttgctgtcagttgtgctagctacctgtgaaaatccattttggccacttgtgaaaattatttttgtagtagtgattgtgacgtctccatatctattgaaatagttgccgggttatacagttggactcaaactgcacctcctaccaactattacaactcaatttcaactgtaacctaatattccgtagtatatgtgatacctatattctaccacttagatagccttttgaaaaggaagcatgagggatatgagatgcactctactggtatctctacgaaaggcatcaatccacctgcacgggcacttccatccaagggtcaagaacaagaatgtgtttaggaatttgtatcagcacaatcattagtccttgcaattttgtggttagtcaatccttgtgattagaagctaggcatgagattctgccagatggcgtgtccccatcagaccgtgatgtcgttaggatcagaaacgatgaaccagagcacaaaaatgcctagctgtaaaactgtatcgcggtgcggcagaaattaatggattacagcacatcacattaggtgcaaagattaatcgataaaatctgctttatttcgacaaaatcaagtacatatataccttgtccaacatttttgttcatcattaatgatccgtagcaaatgtgctatgtgtgtgaggaccaaatatagaacaattatgtgccgaactagtaaatgaatacttcagtttgtccttacaaaaggactagtaatgaataaagatatgggatgacgtgacacaggaggcattgcaattcctcgacaactgagataattaagtagcaggcatctatttgagttgatcaggctcaaggcgttacactcgcagaatagagtaaggaaggaacgcaaagtgcatatagaaaaccaatgaatcaagatatatggtttcacgacaacaggaggacataaattgctttatgaactagtatacatccaatgtatgtatacttgcgtaactcatcggaatggaaggcatcagtgatttgagatgcactacgcaagcctctggtcttggtttcacaaactgagtcatggttcttcttctggtcaaccttttcatcagcacatcacaacaggagcgcgtccagcctttcgttatctctgttaccaccggaagctggccacaagattctgcaagatatcgggcatcatggtgctggttgtcgtcatcaggggatttgtatccggtgcagtccttagtgtgacagcgacataagcagtcacactaggaccttttgatgcaaatccaagggaccaaaatctacgaagtactgttcacatgtggaaaaaactgttgagctactgtagtggcaacactgtagcatcagatccagaccgttcactgaaaaaatggatggatgagattatgtaaagtttctaacatgcagtagcagttaggactacactggatctcaattgtgacggggtgctgcatcgatgtcttttctgcacactttgtcctcactcagatgtaagcgggcctggcctgggggaaggcgggacgttacaagtagtttattagaatctagtaagtctatgatataacacaatatttttcaagacaaatatgcagatactgttctaattttttcaaatatataataagcaacacaggcagagcaagcagccagacaaagcacgccattgtgcaagttagcttaaaaaattggagcccccgagcaactgaagaaaattgaagagttgctatttgcatgaatagctttgcgtgccctataggcgaggaggccaccaagcagagtaatcagtaagctaggattacaaagtgcagagtaagcaaggcgactgcaatgttagatgattgacaacagtttgaggtaaataactatggccttaagatggactagtcatcacgccttgagatgactagtccatatcaagctccataactagtccgtgcagttgtctcaaactataatggtacggaatggaatggaagacgtgaggaagttgagatggaccgcgcatgtctgcagaggctccagatttcatccatgggcagcttgacccaggtgtgattcatgatgctctgatttatgatgctcctcctcttggatattgcaatatgaagatctcggaacctggtaacaagtcatcatgctctcgctttccacgaggaaattttacacttttttttgctggttgttgtcgttagacgccaaaatgatgaaccacataacagagtgtaagttatttcacccaagtgtgtcaaatgatgaacctgacatgatgaacctctctgtctaatgttagtgtttgtaatgtttgtattatctatttaacagtcaaattattgagcaatcaccagcataagcagaaaatatggatcaactcactggatagtgtgataaacacactaatttaagacactaatccactacatgcagcttgcttttcaaaaagtcatagcattctaaaaatacatataaaaacaatctacacatgatttttatgttttcaaactagatacttgagagatattgatggttcttgttttaaaactttggcttaataaagtcaagaatgtaatatattttaatacaaagggagtataaacttttataagatcttatgatataaaagaaggccatccctgctggcctatcactcctgtacacatcgagttactgtctaaactttcaatgaacatgcaataatactagtgtatactactatagcttccagtcgatggcttgaactggcttttaaaaaaacatattcaacgagttcggccagtcgagccaggcgtatcggctcctaactcatagcacactatcatctctgtatcacctctccctcttccttcttgtactcacgcccccccctctctcctgctcgtcattagcttgatggcgcaagaacccatcccttagccatgctactgactttttctccctctcacagtgcc

SEQ ID NO: 103226 - DNA, 2769 bp, Oryza sativa
gctctttatgggcggccaaaattgcaattagccccttgccgccctctgtatgggcggcaagggcctaatcgcaattttggccgacggcggcagacggcgcggtcgacccaccgtctgccacgtcagcttgccgcccaccattagagcggcaggggctatttctgcaatttttttggtcgatagattatttctgtaaatattaaaaaaaaatcccaaatattgaggggccctgtgcaatcgccaccgtcgcacccctctatcgacggccctggcccgcataattcgccctcagtgcagcccagcttaactgtcctccagcatttcaacacaaagtgggctatttgttatttttccgtcaatgtctcgggttgaaaccggatattgaaaaacacattgcaactgcagcccatcttaactgtcatccagcatttcaacataaagtgggccatttttttttttcgtctgtgtctggttgaaaccggacgttgaaaaacaaattgcaagtggcagatgcacaataacaagtaaattataatgtttcaaatgcggaattccacattcgaaacaatataattttcttattatcaacatttaatttcattctcaaaagtattcaacttcacttaaataaaacaccttcaaacgcatcaaaaacatattgtctatggtttattcaaaactacagactgggaactcaatgagataaatgttggcgactatctttggaactagcccagtaccaacccagcaaggcctcggataatctttagaccaaacattctaatagcgtgattttaagctctatcttggtgtactcaaaatgctactcgacctatggcttgttctgtagccctctcatgcaaaatgaacatagcagctctgtccctagctaactttagaacacaatggagctaactacatggatatctttctacatggagcaaacctaaaggcaaaaactattatatccatgtgtatccactagtggatccaccgcctagtggccctgggcggccactcgggctcgccaactaatgatttattgaaattctttgtaattaaaaaaatacaaaattcaatggaaattttaactccacatcgcattatcctttagcattcaagatcataattttcagccataggttatttaaaaagaaaacaattattcttagcagcattgtactcctatccaaccaattgtgccttttgaacaatgaattgcgtgcaatccaatcatgctctcctctaatttttagatctaattcatccaattggtgtgagaaacctacagcccataacaaagatattccaaccactcaaaatacaatgaattatttttcctattattactctagctctggctcctacaatttattgtgtgaattcattgtactgaaattgacaaaacgatttcaatgttctgctcctcttcgtctagtactctattagtctattagaataaaacaaaccaaaaactagattagcaaaattgtaatcgactcaatattacacgatgcaaggtgaagatatgatctagatgttggtatttgatacgatcatagaaaattgcaacaaagccaacatactaaaatttctcggagaaactttgatatttgggggcactccttccggagcttcccctcactctctactaagccaacatactaaaaataaaactacaagtgagttgtactctaggctcaagtttgtgtgtgttgaagcgtggatgcatatatacctccttttagccagggcgataaccgggcgtaacagccattggggagtaatctgggacatccatgtggaaggccaggatgcgaggcaccagaggcggttcggccaaaccaggggttcagccaacccctgaccccacctcctggcctctcctttagtgaaatgagtcaagaagcacccatgaaaacgtgttattagctatcggataaatatttcttcaagcaatgtattctcaatatagagatcaagattggtgttaggaaatattcaaaaagtaaatttcaagtctgctcagagtggtatgtgggtttgcagcaagtatccattttactcgaattggcacataagtaaaccattaagatgggagctgattgtagtgaatccaatgttacatcccatattttcctctgattttggatctctcaatcacaacttggtgtaaagatattagacaataaaaagggattgtacaaatatgcaaatggaaaaataatgaatcatctcgttggaaatattccatattacgaccactagtcatgtcttttgactataacttcaatacttttttcatgcttaatgtgacactcataatgacagggatggaaatcttgggaaaatggtttagtagtctcaaatatccaattgaaaaagttcagaatcacattaccaagtaactcaatatgtgttatatgtgaacacaatgcatgtaatattgcaaaaaatagtaggattaccaagtacgatacaatagtttctgggacaaacctaggaatcttgtgtccataacataagaggtaaaatcatgtggtacataacacataaagtataaaaaggcatgatatatttaaacaaatatgttaattctgaactacaaaaaattaagtgactaatgaaacaattgtggtattataatcaaatttgtcatcaaaactcaatggaggttcagcatgtagcatagaaagaaaacacatgatgtgtattgacataagtttttaatgatgtatcacaaatgtatattcaacattttgtttatga

SEQ ID NO: 103227 - DNA, 699 bp, Oryza sativa
  unsure (1)..(699): unsure at all n locations
ctacatctgacggagctgctgcaccttgccttgcaaatccttcaccgaaccttccagagcatccaccctcttcttcacagctgggaaacgagattctaccgccgccttgagagccatgagnnctcagccctgctcttctcctctgaccgctccctctttctcactttcctcgcgcttcttctccacctcctccattttcttgaggaggtccagcttcccatcttggtccatgatcttcacgccctgcttggtgacgtagcgaggtttcttgtaggtacccgtggttgaaatctcgttctggatctcgctaacccagtcgagggagccgaagcttttgcggaatcagtcgccgaggcaacaattcccacctcttccgggaaaaattttgcagcaaaatccaggaagcgagagaatggcaaggctctgataccagattgttagaaccctaacccaactcctcaataacagtaagaacaagcaagaaacaagatagtttcaccaaatccaacaggattggtgcccgccgccttcgcctccagttcttacttcatcgatacgaaagaaagacagggtgctttgttcttattacagttcaactctctctcactctagacttactagtgggctcggttggtactcatttggtacaatccggcccacacacacgcgtattacacttacggactcttgctcctctcc

SEQ ID NO: 103228 - DNA, 724 bp, Oryza sativa
ttgttttgtaaaatttcaggcataacattttatttgattcccaacttatgatggtgtgtactctaaaagaaatgcatgactttttttgttttgtggggaaaaagaaatgcatgacttcaatacaaagttaacaatgcagtccaaaactcaaaagttacgatttaatttatagtattacaatgaaactgattggagcaatgcatgctatatcatatatacttgcagccacaaaaaaaaagtattacacagggctggcttggaacctaccaccagatcgacatagttccatcaccctcaacttcctttttgaaagaggaaacataaattaacactgaaaagtttggtaacttctgatagctgtaaaataaccgtaaactcttctagcaattatagaagggtaagattgcaatataaatgtttgacctactgtaccttttgtaattattggctctccagtgttgaggaacggaaaggacaaaaaaaaaaataaacgaaaatgctgccgctcggtcgctcgggggagggggagaaaatcgggcgctcccccctccacaacgtgtcgacgtgcttctactggggccccaccatgtgtccctactacttgccacatatcttcaccatatactctattacaacaaaaaaaaatcacatattttagaaaccccctattaagggaattcggtttattttttgtttcacaaaaaatgtttcacccagtgtactc

SEQ ID NO: 103229 - DNA, 693 bp, Oryza sativa
tcgggggtcgatggacattctccagggcaaatgaaggctacacgagctgcggcccggtagtcgagatgtcatggcagagggttggtgccctgctgctagggggctcagtcctgcctgcctgtcccgggtcccggccgtaggaggattgggtcggtactcttgtttatggctaggatgggttgggaactatgtcacgtcttccgtccgtataccgtggtggtatgtggcacgtggttgcacgcgaggaagatgtgtcttgtgggtaaagatgtacacctctgatcagagtataatctattcgaatagccgcgccctcggatatgggcaagccgagcaatgtacccaagtcagtgttttaattcttaaaatttgctcaacaactaaaatttggaatggttggcctgggttggcttgggacgagctggaacccaggtcgggttgccagttcggtccgaatcatcgtaggccttgggttaaggcaggttcgtgagggttcacggccttgtttaataatattgtatagctctaggatcgtctttacaaaatagctttgggcaactaagtgacttttaaatgccgtttactgcaaaacttaacccctatattattattcccttgtacctcccttgcattaattatgcatccgccggtgtggcttgctgagtactgtggttgtactcattcttgctcaat

SEQ ID NO: 103230 - DNA, 582 bp, Oryza sativa
ccattaaaaatggttttgtttcctgtttcagtacttatagcatgttttgcttgtgtgctttgtttgtcgcgtaggtttcggccgtttcgtcgatccgcagtttctcgaagacgttgctgaggtctcatcagtgcgagagcaaggcaagtcatacattgcaattgatcatattgtacccaatttacaaatgtcccgcatttctattaaatattgcattgttttacaatatcatgtgggattggtcctattactcagctatatgttgtttcccttacgccattgataacttgggtattaaaatgactagatgttggttcaggagatgcttagccatgcttagttcaactagtgcacaaaaggggatcacattaaagcatagactttgtttattggcatagctttggattggtgccaccgcatgggtgtcgttaattaaaatacactgaatggtgggctgtgggtgcatggttttgctggtcgcacccatggcaattaaggaccggttcacgggaaaccctgggagacttaccgtgcttaccacaagcgggagtgggtactgcttgatctgaagtatagctcgac

SEQ ID NO: 103231 - DNA, 837 bp, Oryza sativa
tttgtgaccaagtttgtggagagttgaaacaggaaatcaggtcagcagttctgatgcagaaaccacaggatctggattcagcttgctcattggccttcttgcaggacgaaatcttggaaggttccaagtctgtcagtcataaaaagtctgataagcctattttagtcaagaactctttgaagtctctctctcctcaaagccattctaattctgttgttaagggcaatgcatcacctccatcagaggacaggagagggtctgacaataccagggctagagatgacaggctagccgctctgagatcatatagaagatccaaggtgctgtgttttacttgtggggagcgttggagtaaggaacacaaatgtgccaactctgttcaacttcatatttgtcacgcccggaagtttccccctctccttgctttaaaaattggctaaataaatcgtccgaagaaattatcttaaataacctagagctaattccctaattaataaatgcaattaataattgaattcggcgtggtggaatttttcttgagttccccatgctccaatgcattaacaagatttttagtggaattttcagagccttggaaataatttttaaccaattaaaaatgagcaagtgcaatttttaatcccaggaaaatcctttcttctttttctttttcctttttcctcctttttcctcttcttgggccgtcggcccactccctcccgcgctcggcctcttttcctttgggccggcccgttcccctttcccctccccgaagtcctccctccctccctctctccttcgggcgccgacaggtggggcccacctgccggtcgtctt

SEQ ID NO: 103232 - DNA, 1570 bp, Oryza sativa
caatgcatatcaatgttgtttactagcgcatcggcttgtattagggtgtgattttcatgatctctcaccaatagggagagacgatatgttcagttatcaatattcaatattgaggggaaaaaatgttctaggatgtgctctattgaggtatactagtattgtaaagtgctaaagtgccctgatattgtcgaatgcgtgaagcatggatcttctttccctttttctcaacagtttttatgctagtcgctttggcagttcgtgcttcaatcattggaagaatattttggagttggacgtggtgtgcactgtatttttttagacacgcaattgtatttgtacgcacaaaaaacattatgaaacgacaaatttctggagagatttgagctaaatccctgacccatttattaccacagcgttgtatttgtagttggaactagctataggacagaaattttcttcaatgtagttttgtactaccacagttcttcgtcgattagcctcgacgtccattccttccaatcacaaagagctctcaggcaggatatttggttggcctacagatgtactcctatacagcagtacagggctgtgaagctgtagaaatgcatctaccgaggaatgaattctgaatttgagattggagtagaggtaagatcccaggtgattgctagctcattgtgaatctgatctacgaaatcttttcaattccgttttctcatcccctctctaatggatcttaagctagctaagatgtgcttgttaagagactatgtttgccaggcacgtgttgccgctatttattaacaaaattcgtcaaactttcgtttaaggttaggtgcctattattttgtcacatatcttgtagtagttttccaagtctgtgacctatgagacctagttcattggaagcaaatcttgctataatcgtggctgcaaccagatagctgtcaaatttggtcaaacttacttaaacggaacaaacttatagctggcaaccaaacatgtcctaaatttgcagttgagcaatcattgagcatggtgtgacaacagagaacaaaggtaacagtgagcagcatgacagccaaaactagtgcgagatcgatcgaaaagaaagtgatgcagctgctgcctcatcttttcagctcaatcagcctttttcctctgaatcatttgcactcactgaccatgcaatcatgcaacgctgcagctccacaaaaatgacacatgaaaggtcagattcgatcgcccaatcaacgtcaagatcacacaaaggacacacaaaaaaaatggcgacgattgatgagagagctatacgaatgaatgatttgccctccgaggagcatcaattcggggcctgattgatccgatgatcctgttcaacggaaatgtgtccaaaggaagaagctttaacactgtatctgcttttggactcatctctgcatttcgtcagagctcatcgaattcttcagcaacaatagaaggcaacagctacatactagctcagctcacttgcaattatattggagtaaatcgtgttcatgaatactaagcacacatgaatgatctctaa

SEQ ID NO: 103233 - DNA, 1675 bp, Oryza sativa
attaacatctatataaatatgggcgatgctagaaagtcttacgttgtgaaatggagggagtagtagagaagagcgtttgactttgtaaagaaaaaaaaataaaagaagatttgtgctcatgtgctaatatgcccatgacactaaattgaggcataggtatataattcacgataatttgctccctcgcttttaaattagttgttgctttaactttatcctaagataaacattttaacttttgattattaatttttataatgctatataggctaacatgttaactgtacataaaaacattactcatgatgaatctaaaaatatataaatattataaagtttaactgcatggattattcaaatcaacgataaatatttgactcatgacaaagctaaatcggcatgcaattgtggtcttatctctactactacaagggtgtgtgcacggaaaacggagcggttcattagtgcgcgattaattaagtattagctatgcttttttaaaaaagatcaatatgattttttaagcaactttcgtatataaactttttgcaaaaaacacatcatttagcagtttaaaaagtgtgcgcgtgaaaaacgagagggaaaagttaggaaccagtagtgccgaacacacctaaaagaggtagccttcatccttctgcccccctcctcctaaaaccacttccttccataaaaatcgatttctctaagaaaacctgaccataattaaaaaaaaaaacctaagcaaccaaacctatccaaattcttccactaaactaaactaaataaatagaccattgcaacgcactgctatataactagtttctccaaacaacaacaacaaaaaaaacaaaacaaagaactcaatccttgaaaatgttatataatctgatggagcttagttcacctatggtatttgaatctgatgaaaataaaaattaagttgacgcacgtaaaatgaaaaagccattagcacataactaattgagtttttagttattacaaacttgacaaatagagatatgttgatattttaaagcaactcctgtatagagagtttctgcacagaactgtttagtagtttaaaaagcgttataagtaaaatgatcttaggccctgtttttttctccaacaagggttagatgaagattaagattttcatagcaaaaacgcttttcaaactgctaaatggtgcgtttcgtgcggaaactttctatatgaaagttgctctaaaatatcatattaatctattttttaagtttgtaataattaaaactcaaccaatcatacgttaatatcatatcgtttcgctaaaaaacttaatttgcatctccatcttacaccaccttattcagaaacgtatctctctccgatttttctttttctgaacacatgcaaaccactaattacaattgtaagcacgcaaaaattggaattctacttctaagcaaaactgcccacgtcaccaccataaatctgattggcctggtgataactgtccacgatatgggctacctatttgtttaaggaataagtctatacacgtccctaatttcttatccggttggcaattttgctgtcttgtttttaatcaagaacatacaagtatttttgtttctttctcgtatctggctatattcatataatactgagataagaattgcatagttatatt

SEQ ID NO: 103234 - DNA, 716 bp, Oryza sativa
aaaatgtatcataatctcttcattcaactactgggatggcagaccaaagttgtaagttttgtcattttgagttgtgtactgactgtatatgtgttgtggctagtgaccgctttctggggcatgcacagtctgttgatacaatgctgaaggttagagcctaaaccttgtgacaattcttattgtagcctactatttgttgttatatgcaatcctttgtaagccaaatgtcttctttttttcttttagctggatgaagaaactctaatatctggtgcatcggatggtgtgatcaggtttggtgccttgcttccctttaccctgccccagttcccaataatatgtattgctgttttaacatgatgcccatgttttcctttcagattagtgggtatcttacctaacaggatcattcagccactcgctgagcattcagaatatccaattgaggcccttggtacgttctgatcatttgctgcctgcttaaaatacgtgtaaaaagtacatatgttctaactagttacttacctttgcatcacagctttctcaaatgacagaaattatctaggcagcatttcacacgataaaatgttgaaggtgatctctcttttcccatcccccccatagcgcaccatatttttagtctaaataactgtatcctatctaggaagcatttcacacaataaaatgttgaaggtgatatctcttttcccattccc

SEQ ID NO: 103235 - DNA, 1229 bp, Oryza sativa
cggcgacggcgcccctcctcccgcgagcggcggcggcagcaccctcccccaccaccggcggcggatctagcgggtggggaggcgccccgcgagcggcggtgacggtgcccctcctccctcgagcggcggcggcggtggagtcctcccccaccaccgacggtggcggcggcgctctcccccaccaccggagagtgccctctgccgccgccgccggcggatctagcgggaggggaggcggcggcggcggtgctctcccctccaccggatccacagcgacagcgacggcggcggttcggcaacgacggcgacggcgacggcaacggcggcagcggcggcgacccccttcgatctaattttttgtttttatttggatatatgtgtgctggcggcgacccccttggatctaattttttgtttttttgcaaagtgctataaggctgcatgtgattctttgttatgtgctatgatttttttatactatgtaaatatgcacttgttctcctggtgatgctaaccgaataggacttggtataattcaaaccaagtcctattcgcccaaacagaaacaaagtcctaatcagctcaaacgaaaacagatgggagtttgttttctatttttgtggaatcggacatattcttttaccgcgttgatgaatcggattcgttccggttttttttcacccggtttttttgacggacgatggaagcacctcttattttttaagtactagcaaaagtgcccgtgcgttgcaccgggtgattacagagtgtgtatattgaccaaaagtgttgtttggtttagcaaaagtgcccgtgcgttgcaccgggaagtttacagatcagaaaaatatgcaattaattaaaatacaaattcgctgaaatatttagtatttttaagtaggtatgtgtataattaaataaatttacaagtaaaattctccattctccatggttaaataaaatgacatggttaaatttaattttattaaattctccataattagttatgctctttggaattttattggaattttcagagcttaattgctaattttattaatacaaacatcatttaacaattatttaattggaaaaagaaagaaaatactttcttataggtttgcttcgaaataaacatattcaatagaactataattgtaatgcttctgaaaaaatgagcactaaaaatgtacttattctctttttttcggctcgagggaccaacaata

SEQ ID NO: 103236 - DNA, 671 bp, Oryza sativa
agcggaggaagtagagaagactgtcacaaaaaggtaatgcaaatgttcacaaacacacagctactataagcctatcaagttcaaggagggactggtgtgttacataagcttttgctagtccaatactgataattaattgagcaagaatattcttgttgaggaaatacaatgaactaaaaatgtgagtgaaagataaatgaatggtttcaacatacctgatctttacttctttgtcacaatggccacaaagcccaaggacttgcttttttgctttttctaggagatcatcaaatcctgatttttttggctttgggggtttcaagtcaatcatcttctttggaaggtgatcaatatctttctttttcagtaagcgagttaatgctttagcttcatatgccttcaaaagactcagagggagatgtccttcacttaaccagtatctgttcctctcattagagggttcgtcaagtttttttccatgtttagcaataactggaggaatattctccctcttcccaaaatcaagtaaatattccacatttgttccatctacacgctttctgcgaactatactttcttgaaaagacgtgctattttctgggtttcctttgttgcaaggctagcagggagagtgctcaatatctcagtccacctgatattgaatccaagct

SEQ ID NO: 103237 - DNA, 1784 bp, Oryza sativa
tggtacgtcatcaccaacatccaaaaatattagttacttaaaaagaatccagaaataatgtccattaatttcactaagattggagacacagatcatccaacctcacacaaaagtccctgcaaatcacgacttcatgcatgtgaaacatccacgaggaaaattaattaaagtcaacaaaattgacaagtttctattcgaactaacgtatctggctagttaattttgttgtcctttcgatggctgcactccaaagttgacatgaacaaggaacatgattcaattgggtagctaggccacgtattacttcactcgaaatatgcatatgcacgtcaagcacggctaacattttccaaacccatgtacctactacttataagaagatacaaatttcggcgtaacgagttttgaataagaacaagtatgaatctaaaaaaaggaatcagaatggatacagttagagtgcatatctgccaccggaatgatgtactccctccctccctccattccaaattacaggactctttatttttttagaaaattaaacctactaacttttaattaataaccacactaataatatataactatatatatatatatatatcccaagtattatgttacttatcattagattcatattttaaaatagtttcatatgatactaattttataatcattgatatcgtaatataaaataaatgaatgatcaatgtatattattgaaaactatatacttataatttaagatagggagtattacatatgcacaaattgtcttatcaaatctggctatatttcggataatattatataattgagggtttgttgaaaccatgcaaattaagttgttttcatatatatataagcgtagatatactgtatgacaatatcaatattgtattctcattatttatatatttaaccatatactcccattatgttggtattagttggtcttttagaaagttctcaagaaaaacgccaaatatgacgaaaatacctagcaagatcaagctagcaagaaacgtacaagaggagcttacaagtcgttttcgcctcactaattttctgggcggcactccaaagttgactccataacacgtaatctaaattaacgaatcagaaggtatgacacgtcgacggtatgataataaataaattatacacagttagcaaactgatgggtttcatcgtagaaagcgaaccagtaatttaaaatcaagtcaagggcaaggtcaagctcacacggccgactggtcattttatttattgttgtcttttctggaactcaattgttaattatttcatttgggcaccatctccaatgttagcatccactttcaacaaataactataaaatgggttcattttgccgagtgatcatccatgatctctggttattaactcctgtttttttagcctacttcattcgtcccataataaatttattttttactcttttatttgtttacaataagtttagtttaagtaattattaaatcaaaatttatagaagtagaagataaatgtgggagtaggtagagtaggaaataattgcactgtgatatgataaagtagggtattgtatttttttattgatatgtgtagaaggagtaaaaaaatgaagtgtgtagtaaaaaaattaaagtgagtaggtaaaaaaggagcacgcgttattgcacgattaattatgtattaacttttttttaaaaaaaagattaatgtgattttttaaaacaacttttgtataagaaatttttttgcaaaaaacacaccgtctagca

SEQ ID NO: 103238 - DNA, 942 bp, Oryza sativa
cagtggaagttgtagtgtgcattgacctaaccgaccacaaattctgatcagttcagtgatccagtggtgtctgtcttgccttgggtggacagatttgaaggattccttggtcacatcgattcaagaatactaaatcactgatgctagcgcccacatattgacccaaattaaagggaaatctacgtttgaggtccacgtttagggtgtatttagttgaggaaatgaaaatttttaggtgtcacattggacgtttgaccggatgtcggaaggggttttcggatacgaatgaaaaaactaatttcataactcgcctgtaaaccgcaagacgaatcttttgagcctaattaatctatcattagcacatgtaagttactatagcacttatggctaatcatggcctaattagtctcaaaaagattcgtctcacgatttacatgcaaattgtgcaattagtttttcttcttatctatatttaatgctccatatatgtgcctaaagattcgatgtgatgtttttgagaaaaaaattttgggaactaaacagggccataatttggtcatatcctgtcaaactatataaatcgagcatcaatgcagaaatgctcgtactgtatataaaatttaatacttcctctgtttcagattataaaactttctagtattgctcacattcatatatatgttaataaatttagacacaacacacatatatatatatacctagattatcatatatatgaatatagacaatgctagaaagtcttataacctgaaatggaggtagtagaatttaaatcttaaaaaaatatattttataactaagggagtaataagtttatgatattacaacagtatcatttaagacatatctactcatacttttttcttttttaaactaagcgtttggaaaattattaagtggcacatgggagtaagaaccttt

SEQ ID NO: 103239 - DNA, 708 bp, Oryza sativa
gcatgctgtttacttgcacatatgagtatgctacagtattaaggatgtttgatgattgttggaaccaaattgtcccaacaatgatagaaattcttatgctgaaaagaaccaaaatcagctggtgcaaagtttccattccagttgtctttaccaatataatggtcttcactcttccaacaagacaaaacttatatcatgatatcagcagaggcaaaggaaaaatcatatcatggtgaagcaatatttaactacagagtgttacaaacaaaaaggcacaattgaatagcgaagagtaccatatcaaggatgaatgaatacaaacctaattggcccaaatattctatacctcctaccactcaatttgattttgactgtattaagaaaaatggacctaattggcattttatccatagcacaatcttgatactataaactgtttatgaaaaccaactacaaaagaatataaaagaaaattaatataagacaagtccaagtcaacaatctatgaaaaagcctctgcaaacatgagataacatgccctatttttgacaataccagtctttaaaaccctaaaccatgcaatgtttcaaggattgcacattatatgcaaaacattcaagtggatcatagcaagacatcatgacttgaatttttatgttcttaaactaaacatttagaagttattgatggtcagtgttggggggcagg

SEQ ID NO: 103240 - DNA, 779 bp, Oryza sativa
ttagagagatatgtcgtcgttgacatgtactccctctatcccataaaaaaacaacctagtactacgaatctggacataattttatcaaaaacattatactagagtatgttacatctaattatagattcgttttttatgagagagagggagtactacttattgttcttcaaactacatgtcagtaactacgtcgttgggaagtttgtggtagtaaaactacttctgttttgttgtatacttatacttaggaacgaattgaagaatatgcatccatgtgacacgcttcttgaactattaaaaacggaattgaagaatgatccatgtgacactcttcatgaactattaaaatagtgtgctcttaaaatactttatatatatatatatatgattttttaactaaaatattaaatctattttcaactttatagtattttatagtagttaactcaaataatttgtaaaaaaaaaaccaggcctgaccccttttctctataaataatcatgcatatatttctctatagatagaaccttgcatatcccggttaaatctctaatttctggttttatgtaccatattttgttaaaaaaaaacaccacctgactcgtataaaaggaagtactcaaaccatgacgacagccaaaacacgtaagctcacggaatcaattccatatcatatcatattccgatgaacctcagcgcgtcttgggttgctacagggcaacagttcctgcttgcttctgcgccgcttgatctgctcatctcggttggatccatccgt

SEQ ID NO: 103241 - DNA, 2729 bp, Oryza sativa
ccaaccagcccctaatcggcgaggtacctcgagtcccaagacactcgagaagcgccgcacgctccccgtgtggcagctgaaggacgatttcctcgctgtcctccacgacaaccaggccctcatcctcgtcggagaaaccggaagcggcaagcactcaggtattgaatctgcacctttgcctgtacatctccacattgaactgtaaaagtattttagattagtcattattggttgtttattaggggattttttttccttctagatggaatcgcaccacagtacctcgacccccaaatccatcgatccgccgccatcggttcaggggagtggcactccggtaggccgctcatcgagttatcttgatttcccgagcctccgctcatccgccaccacgcgtgttcggggttctctgcgccatcgtcgccttcatcctcctgtttgcacgctgccgccaatctactgactctggtatgcaagtcctaaatcgatcttcttctccattgttgtcatccttgcttctatcctctgcatcgatcgatttgggtgacctatgttgtgggtctgtgattagggtttcaatacggagtggacaaagtgttccagccattgccctagtcgccttccatggggcatgagctcttctgttggggttcagtactgagtggagaaagtgtgttccggccactgccgtcattgccttccacgggacagtaagctccagcaagcggatataggtaagcttctatgccaccattatcttctctctggattaggccataaatcttgattccgatgcgtgcctacactcttccaactgctcccggtcacggataaagcttggccacttccccgctgctgaagcatcattagtttcaggcattaatatctaacatttgattcttttccttgtagatctgcatttccatccgcaacagctcttcatctggtctgcctctattcattttgttgtcaattggttggtttcaccatcctttactctacaacagatgatttgcatggccattgtttcatgcgcaggaaattcatggacggtttacaatgtaaatttgatgttggatggtgtcttatctcgaccaaagtttgtcaaattcgcttgcctgttgctgcgttgtataacttgcaacctatttttcttatagccatgccataagcttagatgcaccttctactcgttgcctcatgtatgcagccgtgttttgatatatatggtgcagtgactttgtgagcagctcagtttaatagaaccaaggtacgttctcttctccttttgttttaatatatttgcagattttcagaattcttcagtagcttaatttgattttctttacaatcttataggtaagatggttgatctcgatcattgtttcaaattgattgcctacaactctttgaaatagaaggtaagttaaccagacattcatctactatatatgtttgtgtatgtcatatacttgatgaaatgcttgatggacttagcccgtcgatatgcattattggttaagtactcaaaactgcacactgctgtcacttaattttagatttctcattacgttcagttatattagattcaggccttaagggatatggcagctattaactgtataatattttgacccaaatgattcagttctagagcacttaaagatggctattgcaggtattataggccagcacaaagtttgttgttgttatctctttgttgcttgcagtatactcatatcacattgaagccaagttatgctatgtattacgttgatttggtcatgaaacgtttctctctattcaggaagcatttttattcaacaatgtatgcgccttctttgctaaactactatgcagtggatgtgttcatgattgttttcttctgatcctagcacattccctgagatatccttcaaatatgatgacttcaaagtcatcgtgtgccttttttcctctcatatttacattgttatgcctaggacaatagcttcagtttaacagtgcaccttcgctgcttgataattgcgatgggtaagatactatcagtcaactgtgaatgtattatgtactaatgttgtttcacctctacaaagccaaaaaatgaagttctccctagacacacccaaaccttccaagtagagcaataattttattagcaaccattatttccacatatctatcgcctctttgatttaaatagtcatccaagataaaggagttaacgcaataaactaaatgggctgctcattttgtttaatgtccatagatttgcaagcaggaatccctcaatctatattttctttgcttggcaggagttacatttttttagatgacatccagtagggattcaggccattggagcttgagggatacacaccattcagtagtttgagaaattgatgtttcaacttcgcctaaatttataggttaaatatgatactaattagttgtgcttgtcgtttttagtaatcagtgccacatataaaatgtagctcaagccatttttttgtgcttttacctctcctatcaaggtaggactgatgttggcatttgggaacgccttttcattttctttatgtaatgaggattaatgtatttccaactcctaattagtaaatcacaacaagaggaaagcaataaggatataattaccctttctaaattgaggtgatgtatgcaagaaactagccaattgaaataaccaggctatgaatgtaatatgaaaa

SEQ ID NO: 103242 - DNA, 761 bp, Oryza sativa
ccctagccatataccatatattcatgttctgcttgatttctactctgtggttgagcaaaatcctgtgtataatacttatgcatcttgcattgcacttcagcttaatttttgtagaggccaccctgtgcagctttctcaatttcatccataacaaaacaaggggcattttacatactcttaggtaattgcttgggtacattgtattttgatatccttcaggtctactatttgaactcatcaattagtgagtaggatgaatagatatttacttaggcttgatgttgctacttccctaaagagattttctattggttctatcaactataaataatttattccttcatattctgccagtgtctctttcagtgtgatacgtgaattcagtatgcatatgctctattaacctaggtgctactttcattatgtcatgataaattgagttatgcccatttcagatatatgatctctacttttatttagctcataaaggtagattgtttctcctttggcagttcaaaccggtatgctccgtttgtatcaagtaaaacagttacggagttgctagaaatatggcgccatatactacagtcgattttttttcagccacttacacagtagttacacctcatttacaccccacttacatatgtaattagtatataattttcgaatttacatatgtaattttagtacttacatatgtaattttgagacttacattgtaaatacactaaaattacatatgtaatttagggacttac

SEQ ID NO: 103243 - DNA, 716 bp, Oryza sativa
attgtaatattttgatttgacgtacagtccaaacatgaccagctacgtaaattatttcagataaacaccaaatggttcagttcattttggtgagtgaatggtgatagactgatgcatctacaaatatgggtagtccatttcggacgctacacttcgtctcgcataatcatcttgaccagaaaatggtcggagcgaaaaaaaaaagagcgagaacgttatttgcaatgctaaatatgggataataacacgataattttctgaatgtatcaatcttctatttagtagttatcttcctgtaaatcggcatgcagcaggtagcgtgatctcttcttgcaacaatcatctggaattcttgatgctaccatccagtggaggaaacaaggcgtggtcgcagaaagaagtttctgagttgctctgacaatggaggagcagctttcagtatacatggccacggaatgacaaaatgccactggctcttcaagttacttcaaaaattgcagagaatctgacactgttctgttgtgccaagagaaagaaaggatggtgatggagacatagcttaccagaaagctttgcttccaaatactaaatcagagtggaagtgcagcaccgattcagctccagtgtttacttcagtgaaccaggtgtacacaaacattgcagcagagggaaatggttatgcactgttgtcaggtcgaagtgtcgaaccagcaacc

SEQ ID NO: 103244 - DNA, 712 bp, Oryza sativa
tcctgcagccctcagtccccttttgtcagaactctcagaaacaatgttccagcgttcactggatttgcagctgctacctgactagaagtctagaacctgaagatcatactacctccatatggatctagaggaggataactaagcaatatatattctgaaaaatgtcaatgttgctgtcctgtgctttagcaatacaaatttactatgttctcagtttctttcggtgctatatatatatatatatatatatatatatatatatatatatatatatttgcgcggtttcggtgctatatatttgacagtatccagttattgatcaagatgttttgacacaatgaagcatataatagcgtgtgaaatgaactgctcttcatctgttttgttgatgaactgaaccacctaaattttgtctagaacttttatatgacaatggtcatgtttggtttgcatgccaatttttaaagggagtctctgcaagctgctactaccctactcccttcccacaaaaaaaaaaaactcatcgctacaaatctggttgagtagttttttttctaggttgaagggagtactactctatatgctgcagcctctcaaccaatgatagagcagatgatgaaggcacggtcatctttgtcctcagctgccgctgttacctttttataataaaagatacaatcatattgagaatactctcgtctcccggtatata

SEQ ID NO: 103245 - DNA, 3189 bp, Oryza sativa
attaaaagtattgtcacaattttcaagcaattgcagccctacattaaaaattcaaatataaaaggtaaatttaatcaagtaaaagaagataaagtctattcaacataagttatttttatgtgtagaaatacactggatcatctcatctactctatgacaaaaccataaacccatgttttggcatactagcttgtccgttgtcccttcagcgtaacaattattgatgtcgcgccttacatggtacactcttaatccatcacacacagaaaaaaaaaacaactctattgtcgtcataaaactacatccttttcaatggtaggttggaattctacgtaataataatttatgtgtaaaaattttaacattgttgttatttttataaaatgcaaaaaaagctagtaagttattaaatgaacctttataaaattgaacttactggaagttttatctttgaaattttattaaaaaagattcaaaactaaacataatcagtaatgtcaattctcttttttaaggtcaatgatttcttgtcctcaagtccaaggacacattgaaaattatgtaggtgctaccgtaaagcataatcagtaaggtcaaaactaaacataatcagtaaggtcaattctctttagtgaaaatcgatgttgatggtgcatttatcaagagggtctacagtgagcattggttatgatcatgaggacagattgtgcaatttcaaggttgccttcatcatcaggttggtacgtcacatttatcaaagtcatcgtcagctaaagctcatgctttacattaaattgttacgacttatgctgaccaaattgaattggtaactcataagaattttgattctaatcgatctcaaatagaagaggatagatattttgtatagttcttcagtgatcctcgagaattaagtagaagctaaagctgtatcaaacaaagcactaggaatttgtgctttgcttcctctttacccaagctaatgtaacgtgaataggcccatctcgttggaattctgcgtgaaacccattccagcaatccagtccacaaaggcttccccttgcgagtcgtcgcggtggcgagcaggtggcggtggcgccatggatggccagcaggaggagcagcacgcggggcggcggcagctgaagcccgggaaagacaaaaatatccctccacaaatatttttttttaacaaaaatatccctccacaattctacaaccaaagtgtgatggtagtagaaatagatctgaaccctatgatcaaatgagatcaacggttcagattattttctacttcaaaaatttagtttcgtttgttcaaaagagagattttctttcaatcatatagaaaacgcctcacctatagaaactattacatacttaacatctcaggagagagaatgtgtttgttcatcataagaatggatgaggacattagcatgaattttctcgcgtttgatgttttttttttctttcgcgtgggaacaaataaagaaacgggggaaacactagtggtggtgtggtggtagagtcgtgggtgcatgactctatccaccagggttcaaatcctggtgcccatgaatattacacatatgcaggtgggttttcaacaagagaagcgtatgaatgtgccactggtttccgtctcttagagcatgtgttaggtgacacattcgcggaggttgacgcattcgcaaagaacaagagaagcgcatgaatatgccacttgtttccggctcttagagcatgtgttaggtgacgcattcacggaggtgtgagtgtagtggtcatttcgcggaggtgtctcttagggcatgtgttaatgcgtcaacctccgctcttagagcatgtgttaggtgacgcattcgtggaggtgcaggggcgtcccggttaaatcgggtccccgtgcaaaatattaaaatggggccctagtagtctagtaattttttatagtaaaatttaaaaaggacgtagcgatcagccgatcatcagtgatgaagtagaagtggaggccggaggggattggggagaggagacaaagcggctgcggcgccgggacttcggcgatacgcgacgacgcggatgcctggacaggagtacgatgaaagatggatcggttcaccttctgtagcgttttgggccttgttttactactatttggactaaaaattaacaaaattaaaacctctaatattattatatatataggacatacttaattaaaatttaggggccctgttcggtcgaacagcccgcacgggtctaaggacgcccctgggaggtgtgagtgtagtggtcatttcgcggaggtgtctcttagagcatgtgttagggaacgcattcgcagaggtgtgagtgtggtggtcatttcgcagaggtgtgagtgtagtggtcatgtgggggttttcaacaagagaagcgtatgaatgtgccactggtttccgtctcttagagcatgtgttaggtgacgcattcgcggaggtgcgagtgtagtggtgtgtgtgcgtatgtcgtgtaaatgtaatctcaaaaataaaaaagaaacaaagaaacgaaaaacgctgtcacgattcatctgtccgatagaggaaattatgtgattttccagggacctgtccgcaaatatgtcttctcgtctttcccccttctcctgtagcggcgatcaccgcctcaccggcgaacgggaagatgacgcggggggtaccctggccttcgccgtggcagaagctagcggcggcggcggcggcggtggccgccgcaaccgtcgagatgtgggcgccgccgtcaccgggctttccgctctcgtgcgctcaatctccggtgctgcacgtgagctgttcgatgtaatggccgtgtgatgcgccgacaagcaccgtcgccggaggtcacctcctcctcctctttctgatggaatattcgccatcgcgcctgtctagaagaaggtatatctcgatttctttgacttaagcaaacccggtaaaagaaaatccattggatggagaaaatcaagtaaaagggtcaacttgcaagttgcaaacaacacatccttcagcttactgattattcaagctcatttctttcctaacttagttgcttcagtcggtgtatcaatatgtccacattttgactgtttcttcatgccggaagtactcctatgctgcataagagacttcaccatttctttagtga

SEQ ID NO: 103246 - DNA, 968 bp, Oryza sativa
acaccaaggaccacaagtgggcttgggtcaggtccatcaccaatcagcccgactttatccgggccggtccgacgagctagcccaacagcccaccgtatctacttaatctttttggtttgggttgaaccagtcaataattagcactcaatatgtatactatcttatatattattccttccgataaaaaaaattccaatctatggttaaaatgggatataatttaatacaacgaatttaaatgggagtctgtccagattcattgtactacccctatttcaaaatataacaagttttagctatgaatctagacacagttgtccagattcatagcttaaaatgcttactttggattttatagtagtacggagggagtaattttatgcttactttgaaggctacctaatttggctttgcaagaagaaaaatgctttcaagtttgaaagaatgaaagatgattggtgtttaggccataaatgataaatcaatgcgtaagaacaaacccagttgaaacatgtagagcgaattctgaaagttctgttttagtgatgattctagggggaaatcatgaagatacaatttgtggatcatatatgtataagagaagaaaaccctgaacccaaagatagtctgcattgttaaaaaaaaaaattgaacatgactacataactgaaagtttcagttgcagatcagcaagtctgtcaccacatggtgcatgacgccattgacagaaactaaaatgcgaacctttagtctgaacttggaacaaaacaattctctctacactccactgaaaaagaaaactctggagaaatgtaatctcaaagagatagtcacaggtagtagaagtgattatgcagaaacaaatccacacttcctccttgaaacaaaaagaaaaacctagtatttccaatgggtctgcaatgtgcatgcagatcaacacgttttttcattgactaacacaccatcat

SEQ ID NO: 103247 - DNA, 517 bp, Oryza sativa
gccctccctctctctcccgcctcgcgtccgcggtaggaggagccgtcgtctccccttctcccgcgtcggccatcgccggccgccgccaccccaacatcggtcgccctcccatccacctcgcgcccgtgctaggaggagccatcgtctcaccttctcccgcgtcggccgccccgccgccggccgccctccctctctctcgcctcgcgcccgcgggttcggcctgacctaaggagtaacctagtagagagaggaggagagatgggaaaaaggagtgatgacgtggacacactgacatgtgggcctcatgctgactcagcagccacgtaggataaaaccgggatcaaaaccccgagggaactagtgtgaccggttttgtatagttaagggatctcgcatattcggttttgcggttcgaggacgttttttatcccgatgacaagttgagggaccttcggtgtactttttccttcccctgaaacaatggaaaagatggtagatagcccatctggatgggccg

SEQ ID NO: 103248 - DNA, 673 bp, Oryza sativa
caacgcgttgtatcttatcaagttgttacactccgcatggtgcgtaatgatatatagtggtaagatgggagatgatataaaccccatagaacgttagtacttggatgggagatgatataaaccccatcaagatagtaacatgtggtggagcagagtgtaatgtgctgaaataagagaagtgtgttgtactctaaatattacaaatacgcgacttgtaatatatagagtgaatatgggtacagtgatacaagcctgcgcagtgctcaactaaatcgtgattcacgcctgtctcttggattagaggctacgggagcctattgcggttctttctcactatacaagtgattagttgtttttcttataaattaaatatggacttctcttacaagaatcatttttttaaaaaggaattataattgagaattgatgacttgatatgatttatgaaattgcatgtcatatatccttgctattaatattgcttgctgagtacttgtactcacccttgctattaaccctccttgtttagatgcaaacatttatgggcaagccagtgagttaagtggtgggttggaggatcagtactatgccccttggtgtgctgaaaatcaaggggatgttgtttatgactatgacatgtattatggaggatgggatgagtagatgtatgcat

SEQ ID NO: 103249 - DNA, 711 bp, Oryza sativa
gaaaatgcaacaaggacctagagggaaaggttcgtcgcaccttggaccatctcctctcttgtggttataaccaggatagtcttctatatggaaatcaactttctcaaccataataagtgaagattcagaggctagtttctcgatctcccagttttcatacacctttcctctcttgtgactaacatggatttcaccggaaggccgaagcaggcatcttgcattgcggaagaatcctctgaccagatccttgtgcaagctaacagtcagagaaaatggttaataaaaagttaaccaataaacaggatatccaaaagcagcagcctgtttaagcattacggcattctaaacaggttcctgccttcaccaaatgcaacaagaaggccatcagctaaaaaaataatgaccatcatctatgaaaaggttattttgctggccagagcctcccacacatcataactacaacctaagaggctaagatccattccagtgtttttatggtttatgctattagcagtgagcaaaactgactagaattaaacttggaaaagagaactgcttcctagagattatatctaaagccatttgcatccgtgaatacttcttctcaacaaaatcaacataacagcataactccttgtactgccgtacaagacatatacactttctctataacacaaattgtgaaacgactgattcatatggcaaacaaca

SEQ ID NO: 103250 - DNA, 686 bp, Oryza sativa
taacaggatgttcttatctgacagaaaccagcctgcttgtggtagtaaaagagtactgctagtctgctacacatacttttttttttacaaaaaaaaaagagtatttacaaacaaagctttcaaccgtttgatttacaaacaaaacacatactaccagtaaccaccactaggagactaggagcattgcttgtggtaatttggctttcttgatctatgattgtaggtaccctcaaagaggtgacaaaatgtgagacactcatttttaccccctgttcatagatgtcttaactgttttgatttcggagaatgtgactaaaatagctatatataatagtgaattagtagctttaacaatgtacaatagcttagcttagctagatgcttcaatattttggtggctactcctagcattccataggcactgccttttgcaaacaggaaatgactgaatgtgaaaactgaagtaaaaaagacgcattatgtctgaagcaacatttttttaactgtttcaacctttcggtgacagaatgttcttaaccgacaatcaattctaattaccttttgacagtgcatccagatgcattctccgattggatctatccgcgtaagctcgatgcaactgtgaaaagaaattagaaaaaaaaagttgttgaagtaacagacggcatatgatcagatcttggcgg

SEQ ID NO: 103251 - DNA, 1339 bp, Oryza sativa
gcaatgtgctatgttgttgctgctgctgcttcttgattgtaatttttcagttttgtaaaaaccatccgcaaggaaatttcgaagtgtaatttggttcaaattaacagatagaaaaatagttaaaagtgcagcaattgattgaaaccacaatgcagagaagatggtgaaataattggatccaccaagcaggggtgagaaaaaaactttttttttcaagaattgtgctttggattataaagttgtaactttgatgttgaaatggtaatcactcaaaccccacagagatttaccagccgtagtgatggtgctaggtcgagatcgaccgatcaatttaactaatgacaaaagtaaaggattttgacaaatgggtattaaactgaacaaatgttatcttaatatcttattcctcattgtcccttccactcaaagacatgtacatgttcttgctgaaaatttttcagttttttttatcagctagcatctaatctttctaggttactttacagcggttagccaactattcacatgggtaagttgctaatttttttttgacatgagtatggcactaagcttcacctccctttactgtcatgtgcaacataaggttcctctcttattcccctctgccttgctgctttaatttaaccaggaagcctctctctgatgcccatgatgagttcacagcaagtaattaggactgattacctgttcttgtatcatcctagtgttctttttcagaaacttagccatgtgacatgagcatgctttctgaacctgaacacacctattaggaagctgcagaaagaataatttcggatcagaggacggattggtggtgaacattaactgaaaaagcacttgaaattttgaattaaagaagcgcctaaacattaactgaaatcttgtacatgtgaaatgagttagttttgtcaaagtaagtaacctaaattgtcacatactagcataatcatatattttatggtggaattctgagcaagagaactaaatgaattttgaagaagagaaaatacttatgctgaattggcagtaaggtaagtatgtttattttcttgttggtgtagtgctaatggggcagcactacaattcaacttgcacttttttacagttgtacttacctcactgtcactgtaaagtactagtagttaatcttcagtaccaccgtcttgcaaagataagagccgtaaagcaacactgaaacattcagaaggtttacacgcagaaaagaagcatgcatgcatgcatgcaaaaaagattaaaagagcagtaacagccactgtcaacccctggagcataaaacacagcagcacagggctgcagg

SEQ ID NO: 103252 - DNA, 1534 bp, Oryza sativa
gaccaatggacatggactagcgttgcggaagaggcgacgaaacggacacacatggcggtggcgccgccggaggtagggcccgccgcggcggcggcggtcgccggcgggaagaaggaggtgcgcgcattggatggagcatcggcgatcggtgaagaagaggaggtggaggtggaggtggaggaagaggaagaagcggaggaagagagagaggatgaagaggagggggaggaggatgggggcgatgaagaagaggaggaggaggagggggtgaagtggctgaagcattactcctcgatgcaaagcatcttggtcgtcggcgacggggatttctccttctcgcgggcgctcgccgtcgcattctgctccggcgagaacctcgtctccacgtctcttgattcctatggtatcttcgattgcttcttctctcaactctagcctctcacttccccttactcaattgattcggattttgttgcggatgccgccatttttccgcgcttagtagaatagtacactactatgagtgcgatatgcctttcttgccttgtatgccttgagattttggcctgataaaaaaaaaagaaggcgaactttactccatcaagaacttagtttaccttaaattggtgcgtgtgcaaacgtaggaataacaattttagcaggctagataatactagggtatacctgtatgaaatttatgtgtcgacatccacaaacatggggttgtcctaaaccttttgccccaaaacctaggttccttgagaagaacccgggttttccgttaaacttggggttctatgaaatgtattcattctgttaattatttgtgggataccttcatgtgttcttggttttggaaataagctttgctagttggtacattttactgaggataattataaagaaaaatgttctctactgttagagttgcatgttattgaaggaacactcatattgagcacactatttctatcttcaaggtattctgctctctgttgttgttggaacacaaacactgtaaaattgtgacttacagccgtatggttcaaaagttctaggtcggattatcatttcatattggtaatggcgtccatttattttattttttttgacgcaagcgtccatttatctgtttctctgatcagtttttaggcgtaacctctatgttaccttcatatatcatttttgcgcctgccagcacgatattattatgttgtgtttaatcatcatctttgtttcaagtttgctttaaggtacagacatcaaagcaatcgctaaggggctaaatggaaacatatgtgaaccagttaaaacattgttattcaacagagaaaatatatcaggaataggatgtttcataattcttttttttttaaaaaaaatgtatgcattgagctgccactgcttacccgcttacattacatgccaaaagggactttattgtttgatttttgtgctcatttgtatttcatgtgagtaccctgttgtccagaggctttgagggggaagtatgccaatgcagagtcaaatataa

SEQ ID NO: 103253 - DNA, 584 bp, Oryza sativa
tttggtgtggactatttagtcatgtggattttttttcttatatcgaggaggtttttttatataaattatcatgttttatgttcgtgtttattgttattccaccactgatgtactaattgaccctcaagttcatgataagatgagtggtcgatagtgtagaatatatatgtttgtggattggtggattacattttatatagtgtgctagttgttcggtccaaatagatgtagaaaggggtcacaccaagagtaaggacatgtaatttggtctgtaattttttcagaccttagtggtagtagaaggaagagaatatacaaaatttgcaccaaattccaaccaaaatgaaaaaaacaaggagttttaacttcaaatgaaatttgatcaaatttttggttgtcaaccagggatcagaaatcaaaatttgatcatatcttgtccttttgccgaaatttcggcgaagaggagtgttagcacgaattcttgaacaatcctagcacagctcaggatatatgtaaaaaacaagtgatctcccatgcaaatcagagagaagtgatcgtgcatatgaaccaacacaaactttttc

SEQ ID NO: 103254 - DNA, 535 bp, Oryza sativa
ctggttacagatttcctggttgtgccgtacaaatcattgtgtgcaacgttcctgtatggaaatttagttttgtctcagtatgtttttttttttctctcgcaaacatgtctcggcatgaattatgccggacacagatgctctggaatgtaataactcaatatgttaataacatgtatgcaactcacagttcatccaaggtggtgacaagacgagaaaggattccaatggcacggtgccagtcagcatattgtcattcaaatctctggacataaatataaaacatatcgttcagtttatttgagaacaattacacatcaaagctgtatacttcaaggtttttaatacagaattgtaactttataagctttcgttcgcttcttagttcttataccagagtctcctctagtagcatttctatcaacatttctgcaactttataatctctttaaagttttattagtttttcattcaaacgaatattatttcaagttaaaaacatcttgcaagttcttttttttttttttgaggaggagat

SEQ ID NO: 103255 - DNA, 724 bp, Oryza sativa
tcctgcacccctttattatctctttagatttgtccgatcgatcagtcacactgaaccatgtttaatctctctcttatcagacatacattacagttctttctcttgctgcattttccatcaggtattgcatatgaccctggtcaagcagatggagatgatggagaccttggaagctatgcaacatcactaccaatcttccagtgtcagggtgagtcaatcacaaaccttcattttcatttatgcatgttaatagaacttgccttgtgatattatcctggctacttttgcagaggagattgtgctgttcataagtaaaagactgctcttgtctggctggccttgagcgaccatgaagactgaagctgtagcctgaaaaccttctgcaagtgccatttttgactcggagatcttcagccctgtgcagaggaaagatcatcgctcgctcagctctgtcgctggcttgctgcatcgcagcttgtgaatccgttttggtagctgttaatctcaacaataatcccttttttgcctccctgaacattaccaatagcaagatcagtgatgcatctgtcagctgctgtagctctctgctctgaattggaggattgaagggagaatctgttgttacattgtctgaatttttgtgatccatatgctgaaaggacgtttcatggcggctgtgcttcttcctttgctaatctccaggcaagttcttgtttttctgcaa

SEQ ID NO: 103256 - DNA, 4282 bp, Oryza sativa
aaagggggggctagagttttctttttctcacctttactatgtgaggcaattcaccattgattaagaaataaatcaatagctcataaaagttagttttttgggctacagtggaagctctacgtagagggaatttagcccaacaattaacatcacacaccatcctccaattaactagcattgtcaagttcatcactcacaaattacccaatcctaccatttcaggtgtctcgtgcctttgagaggttgtttgattgaaagccctaacttgccatgtcacaccttcttagtaatgcgtttggcttattgtcgcaattatgacttgtcacgctttcttagcgtcttcgctcacttgtcatagactcaaatcacttgtttaacttcccacaatgatgacttacaattcgtttgccacacgaagtatgtcaggccacacttgactggtgagttgtggcaatgttacatataaacacactgttgtattgaacttaatggaccggattttttttattgaaaaaactggatgggaataacagaagttgtaaaacctatccaaaacagggaaaggggtttgatgcaggccttttctcctctttcccacaacaatgcagatccatgtctccactgtgtgctgattaaaatgagacagttaagagaggttcagagacacaacttttcagttttcagtcactaacactatatccgcaaccatcctgctgaattttctgctaaacctcagtcaaatcaaaccgatcttttggctgatcactggcaataaataaacttgtggcagtaaatcaatcaatcaatcaaactctctaaagccagcttaattacctcctgtatctgtcagctacacgtccatggagcattcgagagtgggctgaaacctgaaagttttctgaaactttctgaaactctgaagagctcgtggtggctttgcaccgccatgaatagggttttgactgcttgcgacaccggggcatatggatccattaacaagatgacaaggtggtagtagaaaaagcagcagaggcaggcagaaaaggagaaatcagagagaaagctttcatgtaactgatgatcttatgcctgaatacggacctgaaaaggaggagaggtcaccaaccaaaagatgctactgtgcttcctgtccttccaacagtcgcaacgtggagtgtgaaatactgatgatccatgattgatgaatagccgcagtagctgctttgaaaattttcagatcctaattccggttcttgtaaaatcctatatttttttcccattcatttaaaaatctcagaactttttccaagtagtagtaggagtatgaagtttctgttccataagaagctcgcatatacaatactgtatttagagagtgaaagatccatttttcgcaagcagtcaaaacaatagtttaatttcattattcataccgatattgcttagacaactttttctagtcctacttgttagcttttacgatgctatttaattcgtccatatgagtaaatctttttcacagactatcggtactccttccgtcccataaaaaaccaatctcgaatctggacataatgtatgtctaaattcgtagtgctgggttgtgtcacatccgattctatattcattttttatgggacggagggagtaggcttttagcatggagaaaaataattaaaagtcttttgcaatggagaaaatctgtggaaactttgtgaaagaaagccctaaccaaagtatcgtgatggcactgtatcatcgttgaagctaagattggcgcgtagggatggtgaattttgtaatgaggagtggagagagagacgacagagagcactgtggccgtcacgggaacacgcggtaacacgacaaaactccggggacagaaaccacgttacaacgccagtccaaaactacttactcctccattaatttaatcaatccgagctcccataaacccaataaacccctgcaaaatccgggcccaatctacccctaaaccagggtggtcaatggcgtgagtcatcacgaacctgcatctctcagtctgtggtctctcttgttcgtcctcctcgtgacaaaggacagcatgcgcggccatggcggccggcgacgacggagcacgcgtgcgttttttttttttttttgacggcgagatgtggctgtggccagtggcggagccagcaatgtcatcaagcccaaacgattagaagtatttttcggtgatcgattaagttttataaacattaatggctatcgacagtgaagatagcagcgacgaagcccgagcgattgtacggccggcatggaggtggctccgcgcactggcttcggcgaccggccggccatgcatggtgctcgatcgctttgctctgcctgaggtcgatgcagtttgcttctatgctttttgccttttttttttgtttatgtactagctagctactcccttcgttctataaaatggatgtgacatattatattatgatgaatatgagtaaactcctgcccagatttattatactataaacccagattcattgtactagaacatatcacattcacattcagtcataggtttgttttttatgagacgacgggagtagctggttgtgttactcctatattggttggaaaacatgcatgtaacgatttatcgttgatttttttaaaaaaattatgagtgaaacttttatatgcttcctccgtaaaaaaacacaaattatgataaaaatagccttaaaatcaattttaaaattaaattttaaattagacaaaggcaaaggacagagttctgctgtagtttggtttggaacaatttagagctgtgcacattgctaggactccattacaatctagacagaggacgtgtttaatccgatcctgcttattaggtctgttttgttcccacgcaaaaacttttcatcctactttttatcctgttacatcgaatgtttggacacatgcatatagtattaaatatagacaaagaaaaactaattacacatattatgtgtaaattgcgagacgaatcttttaaacctaattgtttaatgatttgacaatatattgctacagtaaacatttgctaatgacggattaattatgcttaataaatttgtctcgcagtttacaggcggaatctataatttgttttgttattagtctatgtttaatacttaaaatgtgtatccgtatattcaatgtgacacgctaaaactttctacccctggaactaaacatggccttatattttggaatggatgtagtactccatcctttccatcataaaagggattttgggtagacgtgacatatcctagtataatggatctggacaaaccgtttgtccatattcattgtactaggatgtttcatctatccaaaatcgcttatattatgggatggagtgagcacctaactagttggctagttgcagtactgtagtaactacagttacctctttctaatcaactgtaaccctacagttgttttgttctaatcaactgcaaacagttggaagggaaaattgaccacattcatctgacagtggactgcttgagcactgggaatgagtaatcaatcaatttgctgctaagtctcctaaacaaattaacaatcctgacatttgggtggaatggcgtgccgtgagctgcctaggttttcatacttccacgcctcatgttccatcatcgtttcaaccaaaaagatgccatgttttttcagcccaaactacaatgtaggtgaggtgatgaactgcagaagtggtcctcctaccgacacatccgtatatctacaggtatatatatacagactatacacacaagttttccgtgtgcactccgtacataccaattaacaaatatcacaaaaattctaaaaaatgacacataattccaatagtattacacctacatgcctcaaaactgtcagattttttatttttcttgctacaactaaaatataatgaatttgaatatgagattttgcatatatgtgtaataccgttagtagtaaatgtccattttttatagaatttttggtgatatttattagttggagtgcacgaagtgtgtacaggaagcttgtgtgtataggatatgttaccggtatatacactgctccatactgtatgccacgtcccgtaagaatacatgacatgtgtatcatacataattaaagaagtgttctactactagtactatatatgatcagttatttagttgatcaccggccactcttcttcctgatctgcagagctgcagtctcagtctgtcctgccgtccat

SEQ ID NO: 103257 - DNA, 953 bp, Oryza sativa
gaatgtgcaggcatgtatcgtaggttgggtttgagaagcatataaggatagaatatcaccggagaaaatctaccacactttaaaagtacgacatattcacatttttttgttagtatttcttatataattttaacctattagttacctttataccatatcatattcaaataatttctataagcaattatttataatcatcttcatcatctaaataataggtatacttattttgtttagaaaacatgcctaccaaattaaatgtaaagtaagcaaggtgcttttttgtttttaatttggattactgatgttagcttggccgcccattatttattgacagatgtattgggtacaacatgaggctacactacattcatgggtttgtaatatgattgcatagtttgagagacaatccatctgtgagcatttcatttagagtgtgtgcgaggctccacatagcctattatgaatgcgattggatggttaaatataattgtgtaataattatttttggcatgcgatgtatcataaatacatggttgtataatatatgtatgaggaggacccgtaagatataatatgatataatagtaaagcaaattgttgatttgattaaaaaaaactaaagctgctcaagtgtatcttaaattaaatttgtagatcgtctaaaataattgtttatttatagcaccaagatcactcctattgtaaatccctagctcttgcacgttcacaactaaatcagtctccatgagaaatagatctaataatttatgatgataaattatggtgtacatgtatatcgtgtatttagaaaaaataatcaggaactggatgcatgcatcaatcgagcacaccgaggccatatataattatcctgcctaatgtcgatgataaatcaagcaatcaaataaataaacgttgcagctaccagatgtaattgtccacgtacatgc

SEQ ID NO: 103258 - DNA, 781 bp, Oryza sativa
agttattcataatttatattcccaagatttgacttaaacattgtcctaaacgacttccttcacgagtatggagggagtatgcgtttgtgttcggcactcacttttcccaacccctcctcctctttttcagcacgcacgtttttcaaacggctaaacggtgcgttttttattaaaaagttacatacgaaagtttcttaaaaaaatcaaattaatctatttttttaaaaaaattaactaatacttaattaatcacgcgctaatgaatcgctctgtttccgcgcatactattccggttgggaacgtggaccagcgaacacacccaacttgcgaacgaagatcgagaccggtctaccgttgtatttccggccgaaatcctcctagagagtttgtagtgcgcaaggagatgtatcatcatttcttgggtggtgtagcacaagtgatagatctgctcgtttgcacgtcgtcgtctttggaattaaatttgaaaatatactgtttatctaatttttttcaggaatattcgggatgaaaattttttttacaaatataccatcgatctcgcgcaatcgttgtgcgaaaatgacgtggacatgatgtcaccagcggtatcgcgcaatgaaaacgcgagaccgtgcgatatcgcgcggtagcggcgcgagaccgcacggtctcgcggaagcaaagagcgagtccgctcggtatcgctggttgaagcagcgacaccggcatggctgtcccggccgtcaatggttaattacctaattaactattaactaataat

SEQ ID NO: 103259 - DNA, 578 bp, Oryza sativa
atgaactgaaaaaacaagaaatatttgtaacataggaccaaatctaaagtttaatagcttatggagtctgttaaagaaacttttgcacagtagagtaccgtagcatacatgtgaatggtgatatgtgaactttcgaaatgctaccttctagacaagctgtgcccattcttcaagtgacacgagagaattgggatatattgcgtttgcaaacaaacttccaatttgtctcaaatacaaatcaaactagggaaagttgcgtcacaaaacaactgaaaatgaaattaaaaaaacagggaatttactaatcggaagaacatattaaaataaaggcatttcaggaagactcttggttgaaaaattcaaaacaattttggcatgttgagacattttccttgcacataaattgtttgagctaatcggagatacaccttacatgacaaaataagaacaaggaggtcagagaaggcagtacctatgtgcaccctggcaatatgggagatattattccattcagggctttcatatactccaaccttctcctccagttctttgcagcagcaagtgatatcgagcttctg

SEQ ID NO: 103260 - DNA, 632 bp, Oryza sativa
tcattttacatcattccgtaaacatgcatagctaaattaaaccaatagtatccaataaaaattacaagtgaactgtctacattttattattgaggtggaatacccctgcccttttacatgtcatttgaattgccataaaagaattttgaaatgatctaacaacacaggttgcatcatcatatgttgtttttgcaaacacgtgtagctaaattagatatacactatctaagaaaatagaactaactataaaatatgaatagtccaaagaaaatccaattccttaaagaaaaccgtaaacaaccagtttagctaggtcttacgttttcaccaatggacccaaaacattcaactaacaaaagaaaaaaatgactttctttgaatttatacttaatttatttaacatgttttataaacaaactaagtcttaaatgatgatgaagattatatataattgcttatacagttaaattaaatattatatgtaatataggttagagaaattatcaaagcgatacggacgatgaatatttgtcgaggaaacatactctcaaaacattgcagaggctattcgattatatgatccattctcaaacgctgctcacgatgcatgcccgcgtgaatacgcgggctat

SEQ ID NO: 103261 - DNA, 690 bp, Oryza sativa
tagaagtagagcaagaattatatttgtttttcacatgcttttcatccaggaacaagctgaacaagtacggggaccgtgtgcttgcaaccatagaggatttcctcgccagatatccaaatgcgaccaggaaaaccagcagcgcggcagcaacgagcacagcgaggcggtcaagaagcgaagaggcttctccgtcaccaacacctctaccaactgtgacgactttgaggaacgcacggtccagtccaagaaacgcgctgcaaagacacgtacaaggcaggaaatatctgatgctgccagcatcgtccaggacgtccgctacatagatcttgagctagatggttgtgaacaagtcaatgaagtgccatacagtgtacaaaagcctgtggcttctggtagggttttacctgcgtggcagtccgccagaatagcctagggttaacaccccctagtagtttctaatttatgtgaagaatttatatgcattaagtaggatcctaggctaaccccattgagctttatgtaggccttgggccaactacttgtaagatggcaccaaccagaccacatgttaggttgcttctgaacatatatggtagtagtccttttcagtatagttcccgtagcgcatgtaactaacatgatattactatggcaaattttgatgtcaacagcttcaggaagtgcacatcg

SEQ ID NO: 103262 - DNA, 726 bp, Oryza sativa
acaaaacatgttctgtgaaattagatgtgaagtgagtcatgacaaatggaaaaacatgagcaaagaaacatacctcaataaagaaaatagttaaaagaagaattgaatagacctgttctccaataccaattgcaaccctaacaatagcatgtcaacatgcagaacatgtaaaacaacaagcaatcaacgagttttcatgtgaacctactcatcaaacccttcaggtttctctgttgattcagatatggtgtgagcatccaatgctttagttgcatctaggctctttcttttcacaacatccaaagcatgcttagcaatgtcattatacctgacgtgagatggccaatgttacaaaaggtacaattgggcccaccactgtttagtatatgaaatacgggaatcttgaggatggtaaaacaatagtccatacctgtaataatgtaacaatgcagaaaaaaaaaatcaagaattgagctttccatagagaaattgtaaatatgtgcctatgagtaaatcgaagtttagattttattcatcacaatttagtgttgaaacccaaggactgcaacacagagaactcacttaagatttagagaaatgaaagcataaagagagtaattacatctgcatgttgcaaaaatataggagttacaaacccatctaaatattttcaagctatgttgctaatacaaatgtctatacaagattacagtaacacttttgatt

SEQ ID NO: 103263 - DNA, 1369 bp, Oryza sativa
gcgcgcgggcgtcttggggatgcctgggcggtgctcccaggagaagggcacggcggaggcgccgaccggaaagagaaacggtggtggaaccgcgagggcgccggcgagaagggagcaacgggaaggagaggctgacgacgacgacgacgacgacgacgatgacgacgacgtcgaggtcgaggagaccgaggggttcggggacgtgaggaggcgacggcgccggcggcgagcggcggaaggtggcgccggaggaaggagcggcgacggcgacgaggcggcggcggcggcggcggcgtcggtgggcatggcgacggtgtgggtgggtgggtggagttttggaggcgtaggcgtgagttcgcttgggtttttatggagtagtcgagtagagaggtcgcggtgaccacgtgggatcggggagttgcgtgacgtggatgctgagctggcatgctctgtacacgtcagcagaggagtatgaggatctgtcacttgagatggtaatgtaatccttcgcagcataggtaaacatatgtgaatctttcaagcgtgtataccaatgaagagtcccagttttattaggcatatttttaaagtgggttcgtggtgttttgtagcaaaatttgccgattattagtacgccgttatcatgaggtatcaaattatatactactcgctccgttccatactgattatcatatcatataaccttaatcctttattttgatgtgcaacattatcgtaatctatgcatttagaagtagttaaacacttgtttcctgtgtatatggagaatgtttattgattctttcttaccacatactcatattaaataaaatatacggtagttaagtctttcttgttcctaatgaaaaactttatatgatgattaatactctataagcttatcaaccgctaccaaaaatttaattttatagttgattttaatgtttcttgttgtaatttatttttcatcactagcttttaagtcactaatacatcacatataaaattacctataaattatttcttgttccctaataagtgttacggcctatagtcagctgtaggaaaaaatgatgggactgaattcaaaatatacggaaagaaacaactacagttagaagaggatatctcaatgagctgaggccatatattcaactgaaaatttagttctccttttaacgtaaataccagttgacacgagaaataaacgcatttgtcatatcaaatggaacatatgcatgcataagccaatttcaattccaggaaactttagttaccaacttgatgtactataaaaaaacatttgtcaataaattagatgtggattagacacggggaggtaacgacggaaccaagtaaaacagagttg

SEQ ID NO: 103264 - DNA, 638 bp, Oryza sativa
tgtgtcagctctgtttgttgtgtgtatgagacgaggatggtctgtgccgcggtccttctgtgtcttggcttgaacgagggctcgtgcccaggtcccagcctcaaatggcgcgggtcggggctagtgcctggggagatccgcgtgtcgagactggccaggccgggaacgtggtgaccgagggttatggatgacccgattgtgggcctttgccgattctcccccggagttcaccacgccccggggcacggctcggttctgggccccgtttggcgattttagccggcccgggccaccgagggcaggatcgagcacgagcatgctaattcaagccaagattcttcgaaaggaaacaatggcacagacacagtccttaggaaatcgaaaatgcttttattgaaatacggaagaaaaaaatataagcttatgcatgtggaagcccccggccaaccctgcacgcccgggggggtgcggggttggcccgagcccgagacctgacacccgacccccactaggggtagaagcgacgaaggtgttcgatgttccacggattaggcagctctgtgccgtcacccgtggctagccgaacggagcccggccggggaacgccgatcactcgatacggacccttccacattggt

SEQ ID NO: 103265 - DNA, 729 bp, Oryza sativa
taggcatatatgaggttcaaacaaagaaaggattttacacacacctgaaggaccatccgaatcaggtcagacttcagagacagagatatgtcgttgattttgtcttggctggagatggtttgatccagctaggattagctgctgttgcagggtcggcagatgtggcatctatcgacacagatttatatcggaagcaacagagagaggaaaaaaaaggtcattgctagctaatttaatttgttgttgaatctccagcttccttgcaagctaccgtctactcctagctcacatggatacacgcctgcaagtaatccaaggaatctgggaacctctgcaggtctgcaatcctttgctcccgacaacgggttcctcttcctcctttggtcagggcaaaaacttgggaactcactgagaatgagtataataatacagtaagttaattatagttgggaaaactgatccaaccactagaagggaagaactgattcagatggaccagatattgttggcctcatcagtttgttgttgttttttctgtgtgtttatttttttaaaaaaaaactgttgtggaaacaaaaacacatcactgaacatgtttgtcagagatgcatacaaagactggcacacataaacaaaaaaaatgctggaggaaattccaaatttacactaaaacaaacatggcagataaattttactacttccaaccaaaaattaccatgtttatccggg

SEQ ID NO: 103266 - DNA, 656 bp, Oryza sativa
ccttttaaaaacggtgaaaatagtagtggccacctcttgagcaggtcgggtgaccatccgagctccgccactgccgtcttcactattagagtgtgtttagttcacgcgaaaattgaaagtttggttgaaattaaaatgatgtgatgaaaaagttgaaagttcgaagaaaaagtttgaaactaaacaaggccttagtagctcgggtttgatagtgtcactggcttcaccattgagtgtaaatcgagtcacttaacgttgcattagctaaaacagctctcatcacgtcactaaacaaaactatgtttcaattcgcatcggtttcactaaacaaagtagactcgattcgcatgggttttagaaattaagggaaactctagcgacacgaatgaatactaaacctctagtagatagagggatcctgagtagacttattcgttcggtgaaatgctcgggctcgtttcattgcgtcaaccgaaatagcccgggattgggaacgttcaaggtcacggcctagttaccccgacttcagcagaattgcacaggacaacccatgggcctaactaacagttgctacttgtctgccacggccgacgggcctggcctatattcccccatcactaagacccaaacagatcgcgtattgcctaacatttcaa

SEQ ID NO: 103267 - DNA, 1113 bp, Oryza sativa
taaattgacggccggttgaaattagaaagagagagagaaaaaaaggccagtcatctcttatttcctcatcccttccagcatgtggccacgcctgagatatgggtgcgtcgccatctttggcggggcggccgatcgatggcaaacgtacgatgcgggtgcgcaccagggttcatgattccaacgaaaaccggtcgaattccgcaaaattttgaggtttcgataaggctcgaaagtaaaagctgtctgagatttcgatgagtttcatccaaattcaaatttaaattgataaataaaagaaaaaaaatcaaataaaatcttataaatagtataatattcataaaatctattggatataaattttcaaaaaaaaaattgatgtattccgtgtatttactgaaatttgaagtaggaaataaaagaataacgaacttaaaaaaagaaaaacaatttcagtttatctctttttctagttaatgattgaaatttcgatgatttcgctcagaatttcgtcaaagccgaccgattttcgcgagcttatcggtaaactcaaggaatctgtattcaaattttggtttatgaaatttgtttggaatctaccggctttttatcggatttcacagaaaccgtcgttctgccagagccctgaaatggaaggccatcttagaaatcgtaaaccctggtgcgcactgctctcccctgcgaagccgcggccatgcatccggcaggcggcagctggaaattcgcgaaagcgaagcgaagggcaagccgcacgatgcacgcagcacgcggtggtgtccgtcaaagacgtacgtggaacccacactggtggtggggattggggggcggaatggccgatgcacgggccgcgcgggcgtacgtacgcgcgtcggccgtttgccttgcgcgcgcgcgcggcctttccgttctcgggaacgcgcggggtgggtgggtggcatggccttcgagttcgagccaagctacggtgtctagctgcgtccgtgtgtgcccggccctgtcacccgcgcgctctctagtctctcccagtggccgacacacgcgcgacgtacgtagcgtaggccgatgcggcgcgcggtgcgaatcgaaaatcgacgt

SEQ ID NO: 103268 - DNA, 941 bp, Oryza sativa
cttttaatattttattatcggtgtctcattttagatcattctttaaccaatattttcatatgaatgatttcgagtatgtcggctcctatttatcactgaactccaataatacatttaaactattgttctgacatatgacaagtggatgcatatacataaaatactttagggtggtccaaaataaaataaaggtaagataacccaatctaaagtaaaaatattagttaaaagacagtacaaaacaaaacaacggtaataaaaagttacgcaaagtgaaattttccgaaaagttgtacttctacgagtacagatattggtgtggccatgatgaattgcagatgaaatccaatttcttgataatttgtactagaatctggacattgtcaatactccctccgtccaaaaaaaaaaggcaaaccctgagtttccgtgttcaattttgattgtccgtcttatattaaatttttttataattcgtatttttattgttgttaaatgataaaacataattaatattttatgcgtgacttgtcttttcaattatttttataattttttcaaataagacggacgatcaaacgttgagtattttatgtgtgacttgtctttttttttttaaaggacggagggagtacgcaataactcttttttttttcttaaaagaaaaggactagcaagtactcctactcatcatcattacttcatcagactggcagagcgtctcccttgagcaaatgactactagtacgactaccaaatgacttgagaggctcactccaatcccttggtcctttcagagaccgtcctgtgccaaccacaacctggaatgtagcgagtttctaaagaacgcatgtatcaaatgttcaaatccttcatggtgcaagccaagaacaccatgactacttccattgctttttaaatgcaggaagccagaacagagc

SEQ ID NO: 103269 - DNA, 1467 bp, Oryza sativa
aagtatcaaatgtcacttgacagaaacgtgattacatcggatgcagaagctgaagagcaatttggcacgtcattacctgttatcgcagacaaatcaggtgcattgtccgtgcacataatttgacaacttaattatatgagcaattttggactacaaagccatttctgcaatgtaccagatatattattatcatacggcccactacaggtgtacatatggaaattcattatttgcatccgcaaatcatttgatcggcatgtaagtccagaaccctactgctgatccgcaaataaaaatggtactattgatctacagagtaatgaatgtgaatggatgctagtagtagtagcagcacagccaaacctttggcttctcccacgccctaccgctttgatggagctgtttgatgaaccagcaaacacaagcacctcttctttatgagtccacacaaatccaacagagcctactgattgttaaggtgacatgtagaaaatcacagggtcttataaaacaaccatgccatttaaggacaccaaagctaaatatcaaatttatttgacacaataccatgtgatcagaaaagagtaggcataaatggacagtactatttgatcaatttgagcagaggatcaattagtgctccagcatttcttactaaatccctgaccaccatttttttactaaagacctgaaaagcataatcatgcataaaactataaatcccttaagattgcagagaacgccatcatgttgtgtagattaacagagcaaacaatgtaattaaccatgcataaatgcataagtgtgatttagcttgcacacaaacatgtatcttcaatggcacagtacctatcttcagaggcaagaatgaaatgaaaagatgaccgatgcttagctcatactgcaaatcagtaatataccatctaaacatagacagcaaacgctacgagtttaagaatccaaaacctgcaatacaagaaaagatgatatcaaaataaagtaatattccttttgttcaaaaatattgttctgtaaaggtaaaagaaatccaatccaattatgcatggcacccctatagttagttacaggcccttcctgcatcctctatatatgcaagtcatcgagatgacacggcgaggtcgatgacatactattcgtttagcaaacaaggaatgactgatgacaaaaaaaaaacaatatattttgagacgtatcttatatttttacacaaagaggaaaagaggaaggaagattaaaaaaaagggcaaaaataaccccctacacgcatagtagaaaatcattggatttaatcggaatcgattgcagttttacatttgcatactaacatgggtccttgatagccaatcggagattttcctttgggagtgcaaagctagaaagcataaaaacttggaatctacctaatcagatttgtaatttaaatttggtggataatgcatgttggaa

SEQ ID NO: 103270 - DNA, 919 bp, Oryza sativa
acacacatcctgtgatcctgtcttggtgttcgtctcttctttctttttctaactcgtgtcctgtataaatgtgtctggttctctgctaataaccctgccacaacagtctgatttatctccggctaagctaaccatactatctctgagctgatccgattagggtccttcaggtgtgcaaatcttttctttgtttgtttgtactttacaccaattgggtctgctaaatgtgtatactgactgaaaatcatttatatatgccaatgattcagcctgatagaatatatacattttgttatgctgggtgcagtaatggcatagggtgatgagtaggtttattgttagggttcctaattcatttatattgtattgtattccatgaaagtattgcaattactgggcatgttccgctatgcgaactgtcacaaccgctgcagctactgcatttgtaaatggttgtcaattgcagctagtttgaactgctgcagccgctgcatgctatggcagcttgcacatcccatttcggtagaatcatcacaaacatagactccctccattacaaaataaatcaacttctaaagtttgaatttgtactaaaataaatcaactcctaccttcttatctaccgtcagaccgtagatcgagaaattttgttcctttaatacccctcacctaacttctctattaattagggatatttggtccattatctttctcactaattctcattgggaagctaggtttgacacttctctattaattagggatattttggtccattatctttctcactaattctacattgggaagctagggtttgatttattgtaggatagagggagtatgtactaaaaaaatcacatgttttcagaattcattttatccttttagttttgatgcaaaagattcattttatctagct

SEQ ID NO: 103271 - DNA, 728 bp, Oryza sativa
cttggtgcctgcaggcagatggctactgttcttctccatagtaccactttcagtcgtctgatgcatactttcctgggtgggattcctatttctggacacactgtccattttgttaacattatatgaagaacttgtcccataagtatgagcatggtcgctatcacaatctttcacttttccagataaaccaggtcttaaataattcttccgtgcaacctgagtgttgcgtagagaacgccaggcctgccataagaatgttcttagaataccaaaaagctcacagaagtaaacaagaatgtattaaaaacagtgagttttaggttaatgctttcttaacaaaggggtaaagataaaagaatgagaccaactaggatttgagtttctgataacgcgtcaagggttaactggacctattatatggaatgttagatgatacacctttggtggacagtttacaaggttataatgcaattatcctacctgatagctccagattggagttaggggaacccatcttttcaacaggatttattatgatggagcacatatatggttgcaaaggaaactgaataattagctaaacttacaagttcaatgataagtgacttgcaactatctcatttttatgcaagtgatgacaaataccatgtacagtattactgtcgtaactcataccttctcaatggatggagcttgaagacgctctaggccttgaattctgcaagcag

SEQ ID NO: 103272 - DNA, 1652 bp, Oryza sativa
ccggcaccccctccgcgctagggcacaaggccaaaacgtgccacagaattagcccgaaaaatcacccaaaaaacaaaaaaccccagccatcaagggcgcgccgcgactggaccagagactagggaatcacctgagagaccgaccaagctggcgccgccgggaggaggacgcccgcgcggcagccgccgcagcagcagagacgcggcggtggccggcgaggaagacggggagttggggtttggggattttgggggtttctgcggaaatggacgaggccaatattattttggttcgtgagcgggagaggaggggattaaaacttgaaaaaacccccgcttggagggaaaccaatcgcggtttcgggctgatcagggagccggccgtcggatctgcctcgagattcgcgccgggtcttcccaaatcgcaacaagagccccgccctccccctccaacgggtagaaagaacagtggaagtggcaggtcccctttttggttccacgtggcccgtgggccatggcacacttttcattcagaaccaaaagttttgcttcttttgggttttacgtatagttgtcgtagtagtctctttcttttttttcttggtttttcttgtttttctcttttctctcttcatttggtataaatcggtttggttaattatgtgtgtaaataaactctcttctcctttcatctaatattgacgtgcaattctttttcgctttcgcgaaaaaaaaaagttttggagttttgaatcccttcgaaatagcactcgcatcctttgtaacggaaagaatttgactgcttttttttacaggatctgagctgaaatcctgcaaaattcatgcaagagtcatgcaagagaagcattgctcggaccctgtttagatgggactatccctatcacatcggatgtttggaaattaattataaatataaacgtagactattataaaacacatccataattttggactaattcgcgagacgaatctattgagcctaattattccatgattagcctatgtgatactacagtaaacattctctaattatagattaattatgcttaaaaattttgtctcgcaaattagctttaatttatgtaattagttttgtaagtagtttatttttaatactctaaattaatgtctaaatataaagaataaagttaagtccatggaccaaacaccaccttggtctccggtcattcatgtcagttaccagtaggaaatctgagacagattcaggacattcaagaatgttcagcgacaccgagtcaacattgagaagttcaggttctcgtcggcgacagtagatcagagttcacagacggcgcactagtcgctaacggccactagcatccaacaggcctttcatacaaggtactagctgaatttacagtagttttgccaagacgacgacgattttcacaggacgaattgatcttcaaactccgcagctcgtcggcgaggctgtccactgcacaagaaaccggcgagcgatcctcaaacggcctctgctgtccagcatccgcagccgtcaccgccaccgaccgatcgacgaacgcgagattctccttgctaccaccaccaccaccaccaccacccgctgtgattcatctcatttggcaaatgtcatgttcagaattaccg

SEQ ID NO: 103273 - DNA, 642 bp, Oryza sativa
tatttacaattaattaaataattaaagatccattatagctgtattttactatacaaaaattaaaatactctgcatggaaactaaatgacaatggaacattataatttaaaagatcaaaatatgtactatgtcatattaaatcattctacataataaaaccaattaaacagcctttagatcacacttaagtcaccatatgtcacgtcttaaaattacaaaatatttcaattaaatcaatgaccaattatttttaactattagatctaattttaaaaaaaaaacttacgctgccacgtattatgtcctaaaaatcataaataatcttagaaattatgagaaaaataatgaaacctatcattattggttttaagttacattatttagaaaaggttagaaaaataaatcccatccacctcttcaccccaatcacatgcgcacatcattgcatgtcccctccctatatttagctattaaaatataagagaaataatcaataattttagatattaaaacaaccataacttttaagttacacatcttatttcctatatacaaaatatcgcatttagccatattcgacccatgcgctttgcataccatccaaatataatcgaaatacctcaaacaaattgactgcatata

SEQ ID NO: 103274 - DNA, 709 bp, Oryza sativa
tcctgcagcccactcactcttcctccgtagggtttaacttgctgtcagtattctatttacttacccaatagagtgtggaccacgataaattcttattccaaattttgaattcaaaattttgacctccacgcggtaatgcacggtaagccgtttcgttcaattagatagtatctataagaccaaagcatgcatgtattgttttatttatcaaatgttttgtgttcaatatttgcataccttgttgtttgtatgatatattcagatatgacaattaatattgggagcttcctgtgtaattgaactttgcattctggcatgcaaaggcattgatttagggtatttcagtcaattttatttcagacattactagtattgtattaatcagaattattagaactatttagattggctgtataaaaccatatgtatgattcagatgaaacatggatggcgtctttgggggattttgtccagcgtctgaactttgaagggagttgtattggtgcattgttactttgttacgccagtttatcccttttttgggggaatgcaagaactctgtcagaaattcagaatactgtttagcctagtttagttcaggttagcagaattggctttgaaaatggtttattaattcaaagtttggaatccggttttttttattaattccccaatttatattggttgggtatattcactttctaatatt

SEQ ID NO: 103275 - DNA, 535 bp, Oryza sativa
tgaataggtgctacagtttggtggttaaatacctccaaagatgagagaccaactggagaaaatctttgttcaggtatatccatagctgtcgacggactatctgtgaatgtggcatccccacagtcaggaccggggatcaccagagaatgtgattcagcagtacctggaggctatataaattgtaggtaggttagaacattgcaattctgagccacaatggatgcaacaatcatgttctatttctgttcaaggaaaatgcaattattgtgctcgaaattgtttagatctgccgagcagaatttcctaatattttctgttcatgaatagtttgacaactgtctaaattagaaggcaaacaacatgaggttgtgcagtagaagaaaattcctccacaggctttaggcgaaatcgcaagcaacatgtttcaaggcatgtaagctgtgaggaattctataaatggtcgttctttgcaatttatacacttaaaagggcagtaatgaagccacctgttataatctagactcttaaaacaagc

SEQ ID NO: 103276 - DNA, 1008 bp, Oryza sativa
taactccttgaaggtaatccatatatggtggcgttgatgtatttggtgagttttctactggtacttcgcaatgaatgtcaaggttgatcctcttatcatctggaatctgaggtaaagttttctggaaagtttcctctgatcttttcaatccattgaacccaccagaaaaaatggtttcagatgaaaacctgtttttctgatctatatttggttgaatggaattgggagagttgagccgtgccttctgtgaacgtttcttggtcataaattttatgtaggaactctcgtacagggcttccatgcatgaccgcggcaatcttgttgattcttgtgaagtattcttctcaagatccataacagaaagaaaggaattcctgcggactcgggccgatcgcttctttttaataccacaagcttggtaaactgctagcatctcagctgcagttctcatgataatggagctctgtgtgccagctagggaggactcacctccataatgtcgtttttggttcttgtccatttttgataccttagtcatacggccctttgtggagtccatttctggtaacaaactagccgagcaatacatctgaaaaccatttgtgttagaatagttcaggtctaagtcctttttgttctgtttcgttgtgatcagaccactcctttcgttgtgatcatgaatgtgtctcacatcatcttgtttccttgctagttcctcgctaacatgaccagaagtagccagtgggatttcctctgaaggttttggtgcggcctctggcaaatgtatgtactcatctaaaattttgttcagtttggagttgatgccaaaaaacaacccttctggtgaattttccatgtgtaattcctgcccatgttcaacctgcacggatgatttagtcactgagcacaaagaactctcagcatttacaggtttctcctggtttcggtaccatgaattggtccttgatgattggtccctctgcaccccatgctccccgaactcaaatt

SEQ ID NO: 103277 - DNA, 2344 bp, Oryza sativa
catctctcccaatcgacagagaaaggagatgtagcttagagactactagagaggacaactaattctcatgtagctttcaccacaggaaaaataagggcttagatgatgctgaaaccgttgtctgtatgtatattaggcaggtagatgagggtcacattgacgagctctctagcccgattttgccttgttagtggattgaagagaatgctaatttcttgggctgaggatgtaattacgtgcgcatcgacacctctcccagggccaggaccaagttgtaatattgtagagctaactggtttataatttggtggtatttgttattgatgggttggcttaaccattggttccaagaaaatcaattggtacagatcgatgacgctgtatttaaaccctccatatctaattgtaagttgtcttatgcttctcaacctttttctaaaatgtaagttattagagcacttatttttctcaaatgaatgctatttgtgattgtgaaccatcttttgcagtatagtataaatgaaagataacaaaattgtttgcaatattactttattagtcctcatgcataaatttaaagtggctatttagattttagaatcagagggagtaagcaagaagcttacgcttacgctagagctgggatagggcttagtttggaccaaccttttttccccccgatttaatggaagcagcatacacacggacacgatgccacgtatacatacaaatgcaaagaaaaacaggacacctctggctgaacctactataatttcttcgaacaaaggaagaaatcgcctccaagccgctgctgaaagaacagaagaaccgacagcagtattgctccacatggtatggcaatgtcccatgcgaggctgaagagatcatcgcgagggttttcatacctggaagatggtctcaagctgggtacaaaatgtaaaatcatgtatggctcttccaatgtaaaatcccggggaaagtaccttcactttggaattggagcctgcgccgtttaaaataacctgagggagcaattaagaacccgtcgagtattaatcccccatgtgacaccatgatcccggctaatgcaccaagaagggagcgtccaaaagcggcacgggggcacccaggcaagctgcctatgatacctgtacagcaaactcttctatatatgatctgttcgttcgacagatgaaccgtttggacggctgcgatgatcaggacggcgtatacgtgacgatgtgacctaacctatagcgagctatgtatgtatttcggcgcgagctttgatgtagcagcggccggcatacattaccaaaaacattttcccaggcagccaaaatgactctatgcaggcgatcaaacacgctgattgcaactgaaggcatgcaaaaatatgatattttttcagacggacatccgactatcgagaaaaatagattttcgcaggcgggtcaattaagacacccacctttgaaaatgttagcgtcaaatttaaaattccacatcaaatttgatattaggtttttcaattaaaatattacaattattattgagataatacatacatacatacatacatacatatatatatatatatacatatatatatatatatatatatatatatatgcgcaaactttgggtgagtgtttgtgcgggctgcatggggtgggggtgggtggggtgtacgtgaggggagcgttttagttatagcgcaccctggatgcggtttagcgcatccctacatacatacatatatatatatatatatatatatacacacacacacacacacacacacacacacacacacacacacacacacacacacacacacacacacacacacacagagagagatacacacatgtcccttcggttccggccattaatatttacaacaattaatatcagggactatacattaatctcgagaagaaggcttcgcaccagacatctgcttagtgtgctttgtactggcaaaagtcatggtcaaaccttgtgccgacccaaaaaaaagtccgaggttcgaccctggccctagcccgacaacgacataaaagtccaggcctgagcctcagtgggctttctttggcttttctcattttctttcttgggccaaaccatgtgactgactgggccggaggccaccaccgcctggcacttcacctggacgtaggggtgtaagtgagtacgcggtttattttagtgggtaatggggttagctacttacacctctagctaaacaccgtccgtaccttgttcgtttaaccaacaacgcacggatcaatgacgatggccttgaattaagctgccggaccgtaagcatggttaccatgac

SEQ ID NO: 103278 - DNA, 1385 bp, Oryza sativa
agaatattttccctaagggttaaggaaataaggaatatctgcaactctgtaatacagcctgaacagagagagacaaatgtaaaactttcaagaaaaatatcaactctattaaatcctagcaatttttctaacctaaggttaatacaggcatacaacttaatgagaaaggaaaagtttattccaataaaatatcaagtagtgcaaacctagaaaatcatgagcagtgttcaattggtaacctatcaagaactagtacctggatacgctctgctaagacattattcattcctcgttctcgaatggcatgagaaattctttgtacatctgcacaccttactgcttcccaatcaacagaatctcttcggtcaaaaattctttctttcatctgataattaccacaagcctgtcttcgcaatttatcccagtcaaaattctcactgttctttttacttgtggttcttgatttctttggttttgatgcctgtgctgctgtatctggcaatccattgaaggaagcaaaaccagattttaaggttgaatcatctgctttggttgctgtttctggtatcactccaccagtggcatacagtgattcatggtcctgaaactctgatgcttcataacaactccttttgccacaatgtaataatttgactgcatgggcatccagtttttgtcaagcagctaacatataaataataagagaccttttacagtgtttgcgaggtacttagaggtattgagaagtgaaacaatgtgaaccattgattgaaagaggggcaagtatggaataaaattatcataactaatagtaatagagtaattaactactaaaagatgagcattttgattgaatcgaatacctgggtccaatcaccagaattgttaggtagaaaacaaagtaaatctttcgaacaatttaatgcatcgatcgatctgcagttctgcaccagaaaaaaagagattgacgcctcctttgttcgaccccttggctttgttcttgttctaaggtttgaattggtccactagaaggagacaaagggagaaatatcggcacggttgagggttcaagatgggccggctaggcgcaagcgcatcgggttagatctcctctgctcctatactatttacacaagggaccacctatacatttgtcgataaattttcttctaaaaatttgacagatgtaattataatacaatcgtagtgtaattacactgtaacttgtatgtaattacactgtaacttgcatataactgtagtgtaacttgtatctaagtttcacgtaattttgaatcgttagatctattacaagattttgttctggtgaggaagaaaaaaatcatagcacacacatatgtgaaaggatttgttcacacgacctc

SEQ ID NO: 103279 - DNA, 4393 bp, Oryza sativa
gagaggaagtaggagccggtgaaatcgccggcgtggcggaaggcgtcgacgaggaagcgggagcccgggatgagcgccgtgggcggcacggaggcggggacgggagagagcggcgatgcggcggaggcggaagggggctcgctgtggggggaagggagggaggcgagcgacgataggaacagggtggaggtggcgacggagagcgatttggagtccggggaggagaagaggtacgccattgggtgcggcggccggcggtgggtttagggtttgggcgccgcggcggcggcgatggaggacatgacggtgccgccgtggcgggggtggcgcgagagggaacgagtggggaagggggaaaggaagaaaagaaaaggtgcgagcaaatcagcgaatcacgacggtggcacggtgccgtcgatgagagaacaccgatacttttttttttattgtcaaatttgatttgagttttttttaaaacgattttgctatatctcactcaaaagattttttttcttatctctcactcgattttctcattcaaatttacagtgtattttattataagttacagtgtaatttatgaaacttacatggtaacttttgtaagttataatataatttttgaatcgtcgcatataagctttgaaatttatattggatttggtctttttcttgaagatatgatagtttagtgtccattacggtatttcttagttgctttttatcttttactgtgtctattggattttaatccaaaaattaaaaatttatgtgatatgatcataaaaatcttttgaaaaatgcataggtactccctttttaaaattgtattagcggtacataaacttcttaggtgcatgcaatttagtgtataaacttgtaaaatactcattttggtacatgaacatgtctaatacgtgcaaaatagaataaaatggcatgacaagaacgatttttctatgttgaacattataaattacaaattagtagatgacttgcgtgtatatagtagaaaggttatatttgtatacttagattccactttatctttttttgtttatgtaccttgcattattactcggattttttttatgcaatcattatgccttattatatgtttatccttcttagattaatgtttatatagagtttaaatcaacaacaaaatcagtaagattaatcttgcggtgcgattttgaccttgttcgcacgcacaaaacaagttcgtgcaccaaaacgaacgttttacaagtttatgtattagattgcacccatctgacaagttcgtgtaccatcgatgcaatttactcatttttaatactactaaatttgattattttgtcactctttagattgttactactaacctattacaaagttacaacggcatgtgggattgtgagtataggatggcaaaccatcaaatctcgtctctaaggctgagtgagttatgggtgagaacttctcgtttatcgttagtatattttccgaactactgtatttttttttaaaaaaaagtatagttgtttttttaaaaaaaatcaaataaatcaatttcttatatttatgttagttaatacttaattaatcaatgtgttaacaattcattatgttttcgaatcacaaacaactttagccgaaacatagttttgatctcagcctaaggagcagcaaatcatcaaacgctaaaaaagagtttcaattatatactaaacaatttgagaaagtttagataagcctaaagaggttatggccaacttagggagaaagaacttgacaggatcatcatgggaataaataatatcataagtgaagacaacaatgcagtgtttgcagcacgtgcgggtgcacaagataaagagcgatccaaatagaatagatcatgttctagctcaactcacaattagttcatgggcttgcatagagtagagattatgtgcttcgtaggacttcttgagatgttgggggtgtaaccccttattcaggcattaatagtaatctctttaccctaaaaaataacacattatgcgaaagatggtactctacattgaggtgatctcgatgaatttcgaacttaaaatatatttgtcttgtaaatagctaactgatttggatcttccacacgctaaatgtgtttgctatgtaataatatgaagtttcaacacaacgtcaaatgtttatccaagcatcccatattttctgcatctgtctttcatcatatgctagttggctcggtttgctgctaaattttgtgtttttgaaacttaggggtgtgtttgaactggacattcggttggtctaattcgtttcacgcaaaatgagatggatcatttgcgaatggttaagtgagtgctgactattacaatcttaaaaatggatttccttgattttacaaaataacttatatatatatatatatatatatatatatatttgcataaaatgtattgtttagtagtttggaagcgtgaaaatgtattgtttagtagtttggaagcgtgcctatggaaaatgatgcaagttgttgaatcaaacccaacattaggcatcgttctaaaacaactagttggtttagctacttttcactttcgtgagcatgcttcccaattttcgcaaatgatttatacatagaccttcttttatataggatcaaataaatctatttttaagtttgcaatagctaatgtttaattaatcttacgctagtgacctttatcattccatgtgacctagataatctcgtatcttcggctctttcaaacatagttttaattttgaagttgattttaagtttttttaatcaaggtctatagttatcattgttgatgggttggacccgacaacggtattttagggacatagggtacatatactagtgtatatgtaagatcagaagtaagagcacagtggagatatttttatactagtttaggctatgagatgggtaatagccttgatccaatttatatttatagctatagaatgtatcacaccaattggggggagggggaagctacatattagaatagtaccaactagtattcgatgagaactaattcgacaacttatagtcgacggctagcttttaggctttctcctaggtggtattcaacgtgccttgtagttatgacttatgatgtgatgctctccccctaattggggctttgtgtttatatagatagaaaatccatcgttcaaatagaactcggggactccgagtaagctatgggcagataagaccttatattacccagatcggatgctgacattctttcttactgggaaaggaaatccaatcttatttgtagaattaaccaaacttgaatacaccctttcatataattttagatatacggtatttccggtggatatgaatacaattacaggaggtataccttatcaataacacaaagcattgacttttaaaccgttaagaacacatgcatagtggtggatatcgagcaggctcggctcggctcgctctatctcgttatcagctcggctcgactcagttgtaagctcgagctagcttgcttagctcgcgagctggatctggacgacgcacgcgcagagtagagatggatttggaagggcgagcgaacgacggacctccatggccgacaagtcaagaaggagcaccacatagaggcgccgcccagacctcgtcggagtggtggactccacgacgaccaacaaatcgagcaggaggggggcacatggctagtggcgcggtggcgccggccagacctcgtcggagcaacgtacgccgcggccgacgaattgaccacacgcggatgggaggtgatgccggcaatgcaacggaaggagatggggagtcgtctatttgccttgccaaggcggcggcatatggcacaccgccaaggtcacaaatcagaacaaggttggagcaggagaagtgtggttaggtgtgagctgtggatggtgttgagtgctcgacgagctcctgcttctacgggcggccggctggccgatgaagacaatggccacaggtgaatgtgaggcacatgcatggtagagcaacgggcggagtgtgtgaccggtgagagagcagcaatagatcgaggggactggggaatgtactggagatcgaactacaactacgatagagaaaattctaaaaaaatacggtagagaagatggtcctttttcttgtcctttttcttattgcgctgctcagttgctgtgtttggctcgtgagcagctagctcgttataaataacgagctaaaacgctgagccgagtgagcttttcgtccagccctacacatgcatgaaaaatttgccatattttttattgctttatttatttatctacaacttatattctttttcttagcaaacatccctgttcagttttgacaggagcaatttct

SEQ ID NO: 103280 - DNA, 943 bp, Oryza sativa
tgtgtgtgcgcgcgtggggggggtggatatttcaggtttaaaactggcagaatgcaatcatggtgtggttatataccatgggggttaaaagattaaaatctcttagagagcaatgaacatacttgtactcacaggtaaatgctctaccattaaacaatttcagtgattgagtcaacccgttagtaattctgcaaaagaaggaacgcagccatgaaaatcttacagtagaactgtagaaaataaatgaataaaaatggttgtattgaattttttactggacatgttataccttgcaagcataggtgggataggggtgccagttatcattgctaaggacgaggctgaaaatgcagtgtcttctctcaggagagagggaataagcaaatcctgataaataatgtcactaaacaggtaaatgcctttttgattgagtttatccaatcattatctgatgtaaagagttcacaatattagtattttttccaattctgtagaatatccaggccataacatgcatcaatctctataagcacatggattggctaatgatcactatgttgtcaagtactaaagggagataataacttcaaaaagacaccacattattaccttttaaaaaagtcagggtgcaaggaccaagtactacagagggaaattcaataatataatcttgtgtttcaatattctaatgcacatactgcggaaaattgttgttgccattacttattaatttgataaatccacaaacttcatttatggagggtctaattttctggcaatgaaagctagatatcgacagatttgagaaggatagaagccagtaattagatcatgcaccatgatatatcaaatgaaataggcttgattactcacaagattaggaatgacattgtatgcttcagcaacttcagttgaaagttcctgccaaaagggctgcaggaat

SEQ ID NO: 103281 - DNA, 693 bp, Oryza sativa
cctccgtctcacaatgtaagactttctatcattgcccatgtacatatagatgttaatgaatctaaacacatacatatatctagattcattaacatctaaatgaatatggataatgttgtaaagtcttatattgtgaaacggaggaagtattctactatatccgtttcacaatataagtcattctagcatttcccacattcatattgatgttaatgaatctagatatcctctccctagaatctttaccaacaatctggatattggagacaccagaataccgcatcttgcgcaacggatgaacctaccatatacggcgatggacaagccaggacatccaccgcaaactggtgaaactggaagaaaaaatttccttcgtcactgctagccagggtttgaaaaccattttccgcccaacaaattttgcgtgtgtgaatttgtttaaagtcactcaaaatttattcacattgttcgacccaaaattctggtctcgcctatagaaatgtgcaaaacgaaataggaaacactgcgctgctagctaaagcctggagtggatatgcatgagatctccgctaactaatcagcagatggctctgacctgagaaataaaatccctcaccattctccattgcaacttgttctgcatgccagtgaactccaagcaattatgtgggggttaggctggagggactaaag

SEQ ID NO: 103282 - DNA, 1060 bp, Oryza sativa
taaccttaagtaaccagttttcatagacaatgtttagtttctgccacaactctattttgcataactcttagccaactggctcacatgccataaacactattttcttttctaactttgcctaagcttagtttgtcattttgtttgtcacaaaacgtgacaaaactaagtttagtcgtcttagtagaaaaaatatatgtggtaatattagttttcagtcagacaggctagaaatattttaggatgggcggagcaatatctatatcatccatgtcatcttgcaagtagtatcattatcatacccaactcttccaatgcatattctactactctcatcatatcttggatatcgtgtaaaaatcaactcatgtagaatcgagtttcatcatttttcttccatttaatatgagtatatgacgtcatatcatattttcatttaatcattgcaagagatgattcgaggggatgggagataggcgatcatgtgcggaagaaaagcatctcgtcactctttgctcttctagcaagaaatgcattattcaaagcacagcatttctctactttaaggcttctctctactaatgctatacttgcattggctgctactcttctgctcctacaagagggaagggaaggcatgtgttgaacaacttagaagcacacacgaaaacactcgttaggaaattgacgccattcctgaggattttctttttcgtgacagttagccgaagcactcgtgttcacaaggtaggtgtgaatattatatttcagtttttttttcccttccagaaatgagttcttttaggactgggaaattattttgaaataaagatatctcaatttgttaagtgcagtactaattcttctccgtgcatctaggaatggagtactgtagtggaagaagtgctatatctatatatatatatatatatatagaatatatagtatttttacctgtgaaatattttcttgctggtgtagcagtttagcgatttttgctgatgctaagcaagctaacggaatattgttttatggtcttaaagaaacgatgaagctcccgagg

SEQ ID NO: 103283 - DNA, 640 bp, Oryza sativa
ttatgcacacttcttccatgcacaatacatggaggtagtacaacattatttcaaagaacaataagtatgtttcagatagttgtgcttgcctaattgtttggcacactgtttaacaaccatgcatatgtatgtatattctgtgtcctacagaaaaaagcttccaaatagcaaaggaatgctacaaaagtttgtggtagtacttactcctattcttcatgcatgcacactttcacctaggagtactatgaatgaaaatgttttttgataatcttgtgagcaggcattcagcagatggatgatcaggagcaaacatttgcaggaggcatgcaaatttggacagatatgcagctgcaggatcatcatcatgagtgcaatggaccctattgcagatgccactcctcatcaaaacatgcaaagggctcactgctgctgctacaccaccaccaccagcagcaacagctgcaaaggtcactgcctttttttcttttttggcccttttccggaagaggattttgatccctgtttgcatgtcactcaaatggatataaaaaaatttgaaaaaatttaagaatatgtattaatatgtgatatatcactccacaaatatgcaagtaaaaattcaacttctatatctcgcaac

SEQ ID NO: 103284 - DNA, 611 bp, Oryza sativa
ttttaaaaaaactaggaaggtggcccgcgcgcatgcgcgggcacttataatattaaaaggtaagatttttattgtttgtttaaaaattttgtctcataaattaagggaaaactaaagtttggatacttttattttgcaatattttttgtaataatttaagggttatattttttaaggtatcttgaaaatccattcacaaacttttgagtaggagatggattaagtacttacgacttttgaatcatgttttctttctcgagtaaataataaattattgcttgtagtatggttacaaatgaaaaatacgggagcaagatactcaaaatttttgtgattaaatcatctcatgaagacgcatgacataataagaaagggagggaagcatatacatggagaaaaaaataaagggaaaaatgaaaatgtggaggagaagcgtaggtacccacgtacgtagtgcgtaccgaaggtggagaggtgggacctcgtagtatttagtttgttataagatcaatttaatctaatggtttataatattggacccaccgatttaagtaaaaatcaagtaatacatactttgttttttttcccttagaatttctaatattttctct

SEQ ID NO: 103285 - DNA, 3239 bp, Oryza sativa
ttgggtgaaagaccgaaagtacattttgcgtccgttaattatcggcctgttgcttcttgcttgtaaacccagttgtaattggctggctacttgttggagtcagtctcagtccgcacagtttatattgccactacactgtgatctgacagtccatgtttggttcctttctccaatttttcatcagtgattgatcttccggccgggctactttaatttgtatattgcctgcatttttgttggctttagaggataagattcgtgcgatcaccatgggtcaatatggtcgatcgatttcctctgcagaatttcctgttatagtattcgtttggtgagccatgcatgcgttaggtgagctaagttaacactgctttgatttcgattacgtttgagcgtcgccaaacacaggtttattgtcatggggctgttgttaccttgggtgtggcacaaacggacaggatctctcactattgtgatctgtaatctgagtaatctcaatgaagcaccacgtgttcagtgggaccagggctataaatttttcttggacccgagcgcggttcattcaatcagaacaaaaacgttaaaagtactgtagtactacgctaacctacctaaactattcacagaatcacagttacacaggttactggtaacctgctgtcagagtttcaagagttagtgaaccagaaaggtcccaagccagcacagcgaaggtccattccttccatggtccacatcattaagagctcatctcagagctccacgaattgccaccatttcctctgcatggattattaatccatggttgcagagttcagagggaggcgtaaattttgggtggcattcctgctggactggctactccgctatgcacacagctccctgcttaaacagttaaactcgcaaagtgtgttaattaagctaaacacgagcctaccaaccgctaatccactgtagattgcttagagcagacgctgccgagtacggaaccacgggcccaacttactgtacgtactcgatatgctccactacgttcttctcctttctctctttccgggctgttaagctcgatcgaatcgacgatcgcctgactccacgtgaaaccgaataatgtacgtacgagtagtgcatactaataccatctcaaaaaagaaagtgaaaagaataatgtactacaagtacagttacgggccgttcgagcagatcgcgtttattttctcgttttctcaccgcttgtgagaacgagaggcgcatgagccggtgacaatgtggagggatctgggtggttctgcgcatttgttcttcgtgcttaaccgaaagcgcggcggcgcctccggtgtgaatcctggagtagcttattgtcgggccgtgcaggcatcccatgcgggatgcggctagaggtcaaagacgagagacaggggctagttgggggttcgtgccttttgtaggcgggaaagagcggcggtgacggacgggaacagcggctttacgcgcgcgttccgtgttatgaggcgtgccggatgcggtgtggcagggaggccggatcgaacgcaaagccgcaaattgactggccgggctttcctctcaaagggtttctgtgcagaaagggtttcgctttcgtggctcatatcatatgcatacacttttggatacaaaagggactctacaaaagatgatttataggatacgaagaacttgcgcaccacaataagaaaaaaatggcccacggcccaagcctggtaacgagcctgtcactaggaatttttgggctaaaagctagggtagatccatttacccactaaacctttcgtaaatttatcctaatgaatttttaaggttgctctaaaaatataaattgaccaaacgactcaaaccattagaacataggtttaaggggttcgacccaaaatgactttatatatataaatgtttcaatttgtactaagttgcttctctatataataaatcattcctacaaaattcaaaatttaacaattttttagagtgtgaaggcgagtttaaaaattttgagaccgagttttacacacatgtaactataatttttggatcttagtaatgcatcgtgggccacgcatgtctaaatggcttaaaatttgaacgaagttgcttctccatataataaatcatctctacaaaatttaataaaatttgataagtttttataatgtgaatgtgagtttaaaaatttcaggcctgagttttccatacatgtaatacgagtttttttgtctaccaataatatagttgaaccatttggatatccatagataatctattgatataacatattcttgatggattgaccctattaaatcatggatcaataaacttacttaaaacggtttaggttagatccatatcctaaccattcccatcctgagtaagtctggcagtctgctgggccaaagttgcggcctctagactgatttcgatgtgtcaaaccttgttggtagcagaactgcaagttcttgttaggtttgggcctaaatgctcttttacgggctggactcgagaaaaggaagtccgtggctcatgggccaaatttatctcatgtctcgtgtaatttacacttgcacatgtgcaaaactgcaaatgaactgctaattcgtcagttcatctgcgtatcaccatcacggagatgctcccggagcaccgcaagtacatctccgaagctcacgactccggttagcgcgccgctgacctcgtcgacgacccagacgtacccgactcggtgcgcaagagcctgcgccatgactgccaccagcgagctcccagcatggcatgcggcgacgtccttcgtcgacctccacctgaagcttcccgacgacgacctccttgcgcgccgcgcacgcccaaaaggtgagtcctcgtcggacgatgccgacgaggaagacgatggggataacggcagagacgaggcagcgtcgtccgcggcgtccatgaggtcggccatggcgtccatgcccctgcccttgagctgcgccctgatggagcgaagcaagaactccggcggagacaacgagcagtctatgtacgtcatgacgtcgccggcggagagcgcggcgaaggccgcggacgccgactcgatgtcgcacgagccgagaactccggggcagatctcgccgaccagggcgtcgtcatcggcgacgacggccacggcggtgccgtccgcgatggatctccgcaggagcgggatggcgtcgagcgcgtcgtcgtctgcg

SEQ ID NO: 103286 - DNA, 1088 bp, Oryza sativa
cgatgtttggaacgctgttgcatgtgtactactgtggagtaacagttttcacagctaccccacccatctgcatctgtacagaatgggaggtaggacgcctgatctacgaccaggaagttccatggaaagtgatagactgatagataagcgagccgagccgcgctattcggcggcatcttgcggcgccgtgcatcatctcctcgtcgcgtagcgatacggccccaaccgccgcaatgtgatctgccatcgtccgtctcgataggtacggcgcgtcgacgcgacaacagctgtgtttttcttttttttaactcgtataatagctgtgtttttggcacggcaggtcgacgtgttcttcttctaattaaaaccacggggctatatgactagattatactcatactttgcgtctcctgaacagcttgttcacgggctgtgccccagtgtccgcgttctgaaaagaattggatctgtgaatctgtatgagaaatattttgatattttgagatttggacgctactgcgtcgtacggggacaggacgcatctttctctgaattcgccatcgcgtccgccgtggcagctgatcaggtaaatagtccaaccatgcatgtgtgccttttcttgcacagctgatcaggtgactgagtccaaccatgtgcggcttttcttgcatccacctgcttggctgcttgctatagcgaaagacaaattgaacaagtattggtactagtagtatgtttgccacaagcccacaacagagtggttgaaggttgaaactccaacgaattatctcaaagaccatcgtgcttgcctagttgcctttgctttcacagtttggctagtcaaatgtaacaagtgctaatacatgactgagatctctcccttcagtcaactgacaggagggatgatacatcaatctaatttccacgagggcattggatttgctctctgttggggaagcccatgcaacttttgcatggatcagtttttggcccaactggattttgtttcattcacgattatatttgggtgaccaccaaactgctaaatggcttgtgcctaatccaatcagtaaagttgtaggcccaat

SEQ ID NO: 103287 - DNA, 616 bp, Oryza sativa
ccccgaattgacgtggtgggataaccgtaggccgtagccgcgtccatctcgccctcgccccaccacctccaaaattgatggacaccaaaataaatccgcccccctcctctcttcccccaatccgatccgatcagacgcctagtttagggtttcagagctttctccccacctctcccctcccctcccccccctctctctgtcgtcctcttcctcccgctcgcgtccgccattgacgcggcgcggcgcacgagctccccctcagatctgaccaatccacaccgcgaaccctctcacctgacgcaaccccgaatcttgcctggaacggcgaagaattcgaacacaaatctgaagcacaccgtcgtcactaagaccacacactacatctgatttttttttgtttctccacaccctgattgtttctagatttttttttattctcgtttcggacgcttcataagaacagatctgcgagcgagttcgcggatcttatctatctgtgtgagaaccaagacccttttgttgcctgtggacacgatccgaacgaactttgacctgaggattcgtttgagatctgtttgctgctggtctcgagagaatgatcaggtcgatggtatat

SEQ ID NO: 103288 - DNA, 639 bp, Oryza sativa
aaaacaaaaagttagaaaaatttatgtatagaaatactatatataaaaaatttgaattcaaatttgaatcggctatgtaaactcttgacttataaactttggatctataaactttaggtgtataaactttatatgtatagaaatactatatatagaaaatatttgaattcaaattcaaatttgaattgtgtatgtaaacttttgacttataaacttcaggtctataaactttaggtgtataaactttagatgtatagaaatactatatataaaaaatatttgaattcaaatttgaatcagatataattcaaattcaaatttgaaacgggtatataaacttttgacttataaactttgggtcaataaactttaggtatataaactttagatgtatagaaatactatatatgaaaaatatttgaattcaaattcaaatttgaatcggatatataaacttttgacttataaacttttggtctctaaactttagttgtgtaaacttgaggcgtataaactttcgcaaaatctaaatcgagagcgctctcgatttagtcataacgagcgacgctagccattgtccagatatgtgtcttgaagaatcttaatttactacagtactaattgatcaagcaagtagaa

SEQ ID NO: 103289 - DNA, 1320 bp, Oryza sativa
agtgccgaacgccgaattgcctatggggatgatgagatgactggtgtcccaaacaaatactagtatcaaatgacccaaccatgagtgtgtttaggtcacgttaaaattgaaattttggttgaaattaaaatgatgtgatggaaaagttgaaaatttatatacgtagaaaagttttgatgtgatggaaaagttaaaagtttgaagaaaaagtttgtaataaaccaggctcatatactactactacaggtctctcctcattccaatcttgaaattttcgggacgatcgggcggatcgcggctccaccgcaatctggtatcgtgtcatttcaagctgtttgtggtcctcgtccatccagctttttatgcatatacagctctggagttgtatgacaaatcaagccactgtttcataaattccgaccttctccggcgtcctcgatcgccggcaccggcttctctgcatgcatgtaccagtacccttcctaccaccaaattaagccttgtcagttgtcacacaagaattgatagtttcaattgattaatctgtaagaagaagaagccaataaacaaattatggcttctgctatcagctgagatccaacgacttataatttcaactgcctgatgcagcaacactactgcttataacaagtatatataatcgcagcacgcaggcagaaggaaacaagggaaccaacataaatatctcattcaacagagcacatgtagacatacagtacatatccagcacacacgccatatatgcacacaaagatgaaagctgagaaaagcagcggatccgtgaaatgacgcgcccctacatactgcgtcatggcaccacaccaagacagtgccacatgatcagcacacagtccatctgccaaaaaaaaaaaaaaaacgttggactctgcatcacagattaaaaaccaggagtagtactccaccagctacccgccacccaagccagcgatgagcgatggatacaggggttgttgaccccagcgaaagaaacaactgttcaatattgcaagcggatcttgttgcaccagtaggccccgtgccatgccacctgcagcaatgacatgatcagccggaaaaatagcagttcgcttaacagtgcattgtttaatttgtagcgcagttacaccgtattttagatgcttgtaacctgtagccagggcccagtggtggtagtagatctaaggcacgtggtgcatcggtgagccgaacacctgaaaagattgttgcagggctgaggaaaatagtagaaaatcatggggacgcagtgtttggttgttctaaagaagataaaaggaaggg

SEQ ID NO: 103290 - DNA, 917 bp, Oryza sativa
actatccacgcaaattgctcacatgcaccggtccgttgatctagttcagttcggcctggaccatcgcaagctcgcaacctgctggtatcgaatgtactgcgggccaacctgcacatatatactatcttattaagaggagccttcaaatgctcgcagtgctagctcgatcctacgtacggtacgtcaaaaagcattgaaaatttcttcccgtacatttgtctacatggttattgagcggattgttattcgtttcagtaaaccggtaaataatctgagaagaatgaagaagaatcagcagctcgcgtgcacgctcctacgtcgtcttcactgtggtggatggacggcgtcctggtagtttccgtcggatgcacgaagcatctactactcctctctccacctctccttttttctgtaacttttgatacagctgcgtcttttttgttgttagctgtttctgcacagtgacgatactccaaacggtcagtggaatttcactttcagttatttggaattagatcctccaaattatttctccttgcccttcagaattaactaaacgtcagcactatagtgcccgcatattattggttaatttcactggatctagaatagtgaatatcaattccatttttcattttgtctcatcgccaggcttcaatgtttagtcatgagggtgtgtttttcattgggtaaaactagaagccaggagagtttgagcaggtcttgaagaggaggacttgtgatcaagcccattcttcagaggcctttttgggcccagtgagtaaaatgtttccaaatgaatgcccgcccaacacttctacctacgtagtatagtccagcattttgcaattttgggaatgttcactttgatgccacaaaacaaccttattggcaagttatcaaaattttagcatagt

SEQ ID NO: 103291 - DNA, 786 bp, Oryza sativa
cgtgcactccaaactccgaaatacgaggaaggccgtgctagaattttgctactgcaacgtatacgagtcattttcaacccaagacagcgttaaaccaatagttttggccatttgttatgtcgaacactaccaacctcagttttagttttggacccttttcatgtcccggccagtagatggtagtctgtcttcatccgacagtaacgcgatgtctaagtatatatgattgatacagaaaagatatgtagatatgttttcgttgagtggttggccaagatcggaggtttggggccatactagattcgcaacctattcagagttgcaaaacccctactggattggcctatgccctgagtccctgatttgtatatggcgcccagtcagagctctcacactgaaaaggccaagactgcaggaactgccggtcgccgtctcaccccccgacataatcacgcagtttgcttagcagcggcagagcgatctagacactggacctgctagagcgtgcgctgcatgtggacgagtcatgagcgagcgaacgatcagcaaaggctagatcacacataaagcaaaaaataactaaactaaactaaaaatgcacagctcagttttgtagctgaatcagcagtgacacaaacggcaacgggggagttcagccgggaccagagcccaccatgacctgtcggcaatttgcaataatcttttgcactgtctcgatgctaattggcagcagggagcagccatgcacgcacatcctttccactggaacgcacaaacctacccaaa

SEQ ID NO: 103292 - DNA, 887 bp, Oryza sativa
ttcctgcagcccatacaattaggaaataactgaaattcggaattaaaaataaggaatattagaagaggagactagagtccatatagaaatacaattaggaaataaaataaattaggaatattagaagaggatactagagtccatatagaaatacaatttagaaatagcttaaattcggaattaaaaaataaggaatattagaagaggatactagagtccacatagaaatacaattaggaaataactgaaattcagaattaaaaataaggaatattagaagaagagactagagtccatatagaaatacaataaggaaataatataaatttggaattaaaaataaggaatattagaagtagagtataaagtccatatagaaattcagaattaaaaaataagaaatattacaagtagagtataaagtccatatatgaatttaaaactaactaaaattcagaataaacataataaaattaaaagtagggtttagagttcgtataaaaatacaatttacaaataactaaaattctaaattaagaaaaacatgggaagaagtgtttaaagtcaatatagtaatacaatttagaagtaactgaaattttaaattttaaatttaaaattaaagaatattgaaagatgagtttaaagtccacatacaaatacaattagaaataataaaaaatcagaattaaaaaaaatattaaaatacaattctagagtccatataggaatatatataatttacaaataacaaaaactggatattaaaaataattaataactaacacttatataaaatacaatatgaatattacacattagtagtttcgtaatttaaaattatattgttattggaatatattttaataatataatgagaaaacata

SEQ ID NO: 103293 - DNA, 1546 bp, Oryza sativa
gctttgctatccttaatgatgttgacaccgcgcgattagagactagctaacatcaacgtcacaatcaaccagttcgaaattaatttgattggatgacgctggtatatgcatgttggcatccacatgatcgactcactatagcaatacgtacaaataatcaactcctgaaggtatacgagctgttcgaattcgatcggatgaattcaggatgggcaacagtttgttcacgttgctccagcgcagtgcgttatttctaaatatgaatgcaatgcaattggctccctttcacggggtacagttaggataagattggaacgctctgcatggtgtgccaggtagcacacgctgcgcgcctatcgaaatccaaaacgtgtgtttgtgctttgcccgttttatcgagaagacgagtactcgtgtgcacaaaaatatatatattcaagacgtgtgggtctagctccagctaaaggggtagtactatcttaagctgctgttttaatccggagttacgtactaaattataccatatcgtgtccacgtgtaccatttggtgcgttatcaattttagtacgtactcctcaattcacgtggccagcactgtgctctgcgaacctgcgatggggcacttgtggaggcatgtctcagttgtggcgttagctgatgacatacttgatgaccgcagcttagtgagagaatcatctcacacgcgaaactaattgaaacggagtagtgttaattactccatccggactgataatacttttttttagacgagagtaggattaaactttaaaatatttaattgtaaatcatttttaaaatatttaccttttaaatctggtgactatactcttgtctaaaataatactctctccgtttcacaatgtaaatcattttagcatttaccatatacatattgatgttaataaatctagacatatatatctatctagattcattaatatcaatataaatgtgacaaatgttaaaatgacttacattgtgaaacatagaaagtaagtattatcaacccggagggagtatcaacaagccgaagaaaatggaggggagtaagggaatatcgaaagtagaagtgattagtaaaaaaaaaatgcagttgggtactctgggacagctagctgctttacagagagagaaggggttttgacgtcatgctggcatatgtgcttctataaaaaaaatacgtacttttatttttcgaaattagcatatgtactaatgtacgtccccgtggatgcagcgcgacggtgacgtccgcaaaactcaataagcttacactggaactattcaagtttgatattatatcagcacacagatttttcaggagattttgtaggtgcaccatatttactagggtaaggagtagcttaactcaattataagttcttgtgactttattaatattaaaatatttttgtaaagtctttcaaaggtacttatataaaataaattacgtgtttatagagattagtgtacgagagtgtacatgatggtggcgtacgttgtgtgttttaaaagaagaaaacgg

SEQ ID NO: 103294 - DNA, 797 bp, Oryza sativa
ttcctgcagcccttatcagtgtgtccaatatttaataattcctccgtcccataaaaattaaaattctacctaatttaagacattaggagaataaataaatgaccataataaccttatttaaagaacctaatacacacacacattccacgtataaattgattaaaataaattttgagacaattaacccacataattagtagtacatatgtactctagcgttaaatagatttgactaaaaatggtaggtagatggatttggaaaacattttactaaggaaaactacaagacaggttataacaaaaaatattttacacaaaatactggggggagtggtacaatatttcaccatcaaacttctggaagactaaaattgattacgtaaacagtgccacctggaagaagcacttcgcagatatttgtatggggctaacgaggacacatggaattgtttagcaactctttcagtaaggtggtgtttgtatcaggaacttgactttagtctacactaatttagagtattaaatatatactacttactaaactaattatataaataaaagctaatttacgagataattttttaaagcctaattaatccataattagataatgtttactgtaacatcacataggctaatcatggattaattatgctcaatagattcgtctcgtgaattagtttaagattatggatgtactttattaatagtctacgtttaatatttataattagtgtctaaacattcgatgtgataggtacttaaaagttttaatctcatctaaataagtggcatgg

SEQ ID NO: 103295 - DNA, 729 bp, Oryza sativa
ccttagcggcatctctcttgtgtacacctccaggactgcaatcaggagcagatgtctccaaggtacaaagataagaaatgcagatgcagcaagaaatgccactgcgaccatttcagttgtctgcataaaacaaaaggagattagcagttggtggattaatctcctgtaaaattcaaaactacttcatttacaacgctgtggagtaatccgtaaaaacggttgagaaggtacaaataaatttcaaaggtcagagcttcaggaacaagttcttaaacagttcatgtctgatgaatcaaatgatagttcatcatttgtgtcaaattggacaacaaactataggaagtgcatcttagatgtaaagaaatttttgaaccgaaggaaagcaaatatactaaacaacaaaagagatacctttggaacagctgcaaacaagacagctctgaactttagaagaacaatatttacagactgtagagtttcttccaacttggatatagcatcctgcaaggtcaagatttgctcaacaggatttttacttggaggagttcttacttcaagcactcccaataattgctcccttccattgtacttatgccagagcataacaacagcaaatgccaaaaaaaatgagggcaacatgtaagcaataaatcccctacataacaaaaaggaatatgttaggcaatgagatatttctaagcatactttctaagatccaaagggctgcag

SEQ ID NO: 103296 - DNA, 561 bp, Oryza sativa
ttgcacctcgtgattaaggaaagaacagtgcaaaaggatggtcagtgttcctaggggttcccatgggtcattgtgtttcctagattacttactactactggttgctgattgataagttggtcactttatcttgaaagtgccaatctctagctagtagtagtatatagctttatatgagttattgggaattatatacttggttacatattagaatattgccccaaaaaatgattgcttagctctgaactgaaattgagccaccagtttctgaataaaaggcttcttcagtgaactggtagtggggatcgaaccctgatcttggccaatggatggattgttcacgaccgtgaccatgtgttgattctgtgtaagcttcttgcgtagttgacttgtattcctttaaagttcaacctgatgatttagactttcagatgtcttcaaattcctacatgtacctttaatcgtagtgcataccgtcacggcttcgttggttaatctttctgcccattggtatgtgattccttggttgaaagatgcagcaaggaactattgagtgtgcct

SEQ ID NO: 103297 - DNA, 647 bp, Oryza sativa
ttttttgtccgttcctgaagattagttgatatatatatttcttgaccaagccacacaacctaggtcggtttaactatatatatttcaaaaagactactactaagctaggattgtgcacgcattcaaagtataaattatccattaaagaattacctcggtctaagtataattgtagagactaaatatcacacttcagaagtaaggtacttactagttaagtatagctagtactacaatatttgacactatttctttgtcatgaacatgttgctaggtttatttttctatttccgcttggtttagaactaatgtactctatacgttttaaatcacttgtcattttagttttgtcccaaatcaaacatgtatcatcaatttctattaaaaatataatttaataacatgtgaattatatatattataaaaataattatcaaagatgaatcttaaaaacgaaatattatgatgttaaactgtataaacttcgagaattgatgataaatctataaatattttatttagattaacctggccttgatttaccagtaatatgacgttgggtcttgtgagtcctttaacacaacggccaggttaatctaacaaacatggagtgattccatgtagaaattaattaatttgccactagt

SEQ ID NO: 103298 - DNA, 683 bp, Oryza sativa
attcctgcagcccgtcccctccctcacgccccccgtccccgcgcatggtggcccgtgacatgtgagagatgagacggccggttttacagctcgacctacccctagccacgtacaccggcgcgcgaatcggcggccaccgcgggcctctcgcgggtcggtcgtacgcgcgcacggtccagaccgctggcaaaggggccagccgcggccgaacgcgagggagctagcgtgtaccaggggctcgcggcgccggatcgtcgtcggacgccgataattttgcgcgcgtggctggacgtgtgttgctttggcgtgggacgtcattcgaggggcacgagacacggccggatccaacgtcggctcgcgctgtgtggtgtacgtgtctcgagcgtacacatacgtaccggtgagtttccgaagggattcttttatttttctttttctcaacttcggtagcttttgtgtggtcctcgtacgtgacgcgcatgtggggcgcgcgtatgatgtgtttttcctctttacgtacgtgcttggtgtgctgccgtgctggcatgcacggcctaattttagcttgcatttttttatatataaataatgacgtattagcttgcttgctagctcctcccctccaaaaaatacaagcatgtctacatttgcaattttccatggtgtttttttagagcaatgct

SEQ ID NO: 103299 - DNA, 1095 bp, Oryza sativa
aaaaaaggatagtgcatatgctacctttggtgctcatatggaggaaagatcacgtaaaaaagcgcggcataattaggctgtgttctcatatgtgggttgggaacttattgtctccgtacgaaaaacggagtggtccattagcacgtgattaattaagtattagttaatcttctatctatctatctattatatactaaaagtccattaaacttcctacaatcgctctcaagttgccacgtggcgctctaataaattagagaaattcctagaaattctaataaaaaagcaaaacatctagcccttaattttcatttaaattggtgggtccaatattataccccgttagataaaattgatcataaaacaaacaaaatactatgggtcccacctctcatctttcccccgtggtcacgtacgtacatgtgggtatgtagtacgtacggctccctccatttgttttcttttttcttcttttttccatttatacaattgatatatatattaaataatcataattttacaaacaaagaatataccatcatataactcttataaacacaggtaactaaaatttacaccattatatgtttacccattaaattaataatataagataatttttacttaaatcggtgtactcattactttgtattattattctcaaataatgcactgttttaaaataaagtctacaccattatagtgtgcacccattaaattaacaatttaaaatctatattaactaatttacatttccactagaaccggtggacccattatttaaatcatcatcggatctattgttaataaataaagtgtccaaagttttcgttttttggcttgctgcacaatgcacgtttgcacctttgcctttcgcactttgtgacaaagcatcgtgtctgaggcatctaaggtgatcacgactgctgcagtgctaccgctttgccacgtatcaaattgtatatggagatgattaattttgttaataacataaaaataaaattaaaggtgtgatgcaataagagaagaattaagcaccgtgggttgagtttttctagcacttagctctatttaacctgaaagggctgcaggaat

SEQ ID NO: 103300 - DNA, 697 bp, Oryza sativa
ccccaaagcgcttcatggcgggctctatctccggcggcagcgagtacgacaagtaatcgctcgacagcttcatcaactcgctggcgacgctcaagctgttcaggagtgagcgatgtaaaataagggcggtgcggcgcaaccagctgtgtctccggcggtggagaagatggtcggccgccgccaccgcgcacgcgttcgtggtgagcgtcttcgctggtgtgttggcagtcaaggcagcgtacgtatagctgcaacaggcgcaacacccctacgacgccaaggagatacaatcagcggatgcagcgatggtcgccgagctcaccaagctctccgaccacaactggaggttcgccaaggatcccgtcgacacagccaagagcgtggtggtcgggtccgcggttctcgcggagcacgctgacgagcagcacaactgtcgcccagggaagaaataagagagataatttttagataatggaatgaaacatcctggcctttactcaagagctacaaccaattattacaatgttcacataaaagcaaactcacacagcgagtatgtagcgttagttataaacccaaaagtagaaataaactaataaaaaccgaactaggtaaagcccccgcaccactgaattctattggtgaatctccactcgaagttggcaaatagctgcatgatagtcgactcaagtttaca

SEQ ID NO: 103301 - DNA, 541 bp, Oryza sativa
aatgaaggagggtatctctagcttaatttactctacttatatcaaatttaagttgatgcatatgcctaagttagtattgagggagatgcgcacatggcaaaaatcggtaagttattactaaaaattttcttgaccaggtttctgagcacccctcccatactctacctccgccccctgaccaatagtatagctaaatggagtggtagtatataaaggtctaaacccttaaataaaactaaatttacgatttagattgatttctgctattagtagagagcacagtagcagaactcgtgtaatagtgcgcgtgcacagttgattcgtaccagtcagcggcatggctagctgtctggcaatcacgatacatatatcgtggttgtagcaacagagatgcggcaggaggatacaccagaatcggagggcgattggcgagatcgggagcttgcggccataggtgactgaactagtacatgagtactatcttttccgaagatcggttacagagaaaagctaggcaaatcaatcagaaggcgcacaacgt

SEQ ID NO: 103302 - DNA, 735 bp, Oryza sativa
taagactaatgcaagatataaacattctttgtttttgcccagtttgtgagatcatccaaactagaactgctcatcatactagttagagtgcttcatgacatatgtttttgtacacatgatcgattaattaattactaaaagaattagtgcttttctgcaagtgtaaggggagtaaatattattataaactcctttcacaattatgcaattaacaaccttaaatacttctggtcacacgccaacactaactttttagacaccatgtgttagtccaacgttcagatatcttggaagattaggcataagacatgactttttcttggcatagcaactgtttattaagcaagtctaaagaagtttttagattaccctaaagtagtactatactagcttaaataagtttaaacagtttgaaaaaattgaggaacttttatgtgatcccctaattaagaaaaccacccaactactaaagtaagatattcgaatttcgcgacaatcaattatgtgaatggaattcctttaggaaaaatcaaaatatcccatcattatgagatccctataagctggaggtagcttaacttcaccttccattaactattggccattagtttaactgagtggagtcaaattccttgttagtggcaagcaccctttgggcccctccatgaagctcactttgtaatggctttaatcaccaccttctttttgccatactatctttcctagctatagata

SEQ ID NO: 103303 - DNA, 1535 bp, Oryza sativa
tagctatacatgtttcaaaacatgatatcatgcatggtgtgacctgcattgttgaattatttctttttctattgacaaattgaatatgtattttttatttctatttcaatactatagatttaatttagctatgcatgtttgtagaatgtagaatgattcatattgatataatatttattggaagactttaatatttagatagcctgcaaagtgcacaggtgaactgtgcccaaatgctataattatatagcaaaatatcagcatatgtatcttatattgttattttagttataacgagagaacagttagacataaatttattagagctagttgttttagtgaaaatcaaagctagttgtttttttatctaatttattagaacgtcacgtagcgttataggagcatttatatgagcgtcacatggtatttagttgcgtttataggaaatttaatggacttttactgtgcaatagatagattggatatcgtggatataatttagtaacatctgtttgtagaattatttaaagtaaagtaatatatgttttaactttttttagttaaaaaatacttccttgttatatttggttgccatataaagcatatggcgcatagaacagcatatatcttatattatttatttagttaaaaataaaataacaataaaaagatatgtggcttaaattggagattggatattaggaaaggaaaaacaagatgaggcgagaaggagttatgtacgtacgtaccaaccaaaggatgggagatgggtatatgtggagaggggaattttgttttttattagatctaatggctaacaatattgaacccaccaatttaaagaaaaatcaacggttagattttgtagtgccacttggcggtttaggagcgtttgtaggagcgacacatggcagcttagaagcgtttgtaggaagtttcatggatttttattatataatagataatagatagatagttctaaaaaattaacccaaggtacgtatttttgttatttcagaagctacgtagttttgtccacaaagctaccacaccttagtatcatggaaaacaatagtcatcaaattaaatgtctcggttttggaagaaagaaaatcataaagctagttagggcatcaccaatctatatttgccaactggtaaataatgtgggacctaacaaaagtaagtatccgtatgttaaaagctcaacaatacacccgcaataatataaaatttagtagagccaatagcttgaaggaagagggggtgaatataaatacctaccaaaagaataaatgtttttttaattcttactaccaagttgtactgctattgcttggtaataggctaatagctatttgggtaatttggaaccgtgccattataattttataaaatttaagatatgccatcggtatctcaatgacatgtaggacccacatgagtcaatgacatgtaggtcaggatggcatatctcaaattttacaaaattctaacagcatggttctaatttttccttaccgggggtactggtt

SEQ ID NO: 103304 - DNA, 626 bp, Oryza sativa
ccagatcctgaagaagaagattgtacatcaacatttcatgtgttcgttttgataggcaaaataatagtagtagcactaccagagtttcaaaagattatgtggccgccttttgaaaaaaagattatgtgacccacctatgtaaaagtcaggcatgtatccgttatgaaacaaaatcatgtagcaattgcttatgttatgtatgccatgaattagctgttggcagtccatcacatgcactgccatcatgcacacacaccatgtgcttgcttgtttcagtgagaacacgataagaacacaacaggtaaaaaagacaaaggatgcagctatagtagacccacttctggccacattgccacagggctcatcaaaccatctataaaaaactgtcaatcaaataagatgtttagtatatggtcaggcctaaatcatcacattaaaaattttggctatgatcctatattcctatggcaataggggcggagccaggaattttcctgatcctgggaaagtctaccaatgacttataatgcgcaaagatctttcacacatgtaaggttcaccactaaaagtttcagcattgttgcttgtatcaactaagcaccacatcattctgcaatttgagcaag

SEQ ID NO: 103305 - DNA, 543 bp, Oryza sativa
atgtcaccaaatcctaatccatagtgctgtggccactggctagtggtctaatctgcattcttgtgcattttatttgcgcgcggaatgcgttacactctctgtttgtttttctgtttataaggttgtgtgtttagttcacgctaaaattgtaagtttagttgaaattataacgttgtgatgaaaaagttgaaagtttacgtagtttggatgtgatggaaaagttggaagtttaaaaaaatatttcggaactaaacactgagtaactgcatgcgtgtagggaataattatacggtcgaccgtctgtgctaatgattgcaagtttgtaacatactgtactgtttgtagcagaaggccctatgattttgtaaggtggtgtttggatctaaggacttaactttagtctctatatttagacactaatttagagtattaaatatagactacttacaaaactaattacataaataaaagctaatttgcgagataaattttttaagcctaattaatccataattagagaatgtttactgtagcatcacataa

SEQ ID NO: 103306 - DNA, 568 bp, Oryza sativa
cctagtgggggtcgggtgtcaggtctcgggctcgggccaaccccgcaccccctcgggcgtgcagggttggccgggggctaccacatatgcatatacttatcttttttctcttccgtatttcaataaaagctttttcgatttcctaaggactgtgtctgtgccattgtttccttttgaagagttttggcttgaattagcacgctcgtgctcgaccctgccctcggtggcccgggccggcggaaatcgccaaacggggcccagaaccgagccgtgccccggggagtggtgaactccgggggggaatcggcaaaggcccacaatcgggtccccataaccctcagtcaccacgctcccggcctggctagtctcgacacgtgcatctccccaggcactagccccgacccgcgccgtttgaggctgggacctgggcacgagcccttgttcaagccaagacacagaaggaccgcggcacagaccatcctcgtctcatacacacaacaaataaaattgacacagaaatttcttctttatttgattgcagattaaattagtttatacaagaagcggg

SEQ ID NO: 103307 - DNA, 1667 bp, Oryza sativa
atgaccatcatatatttttctcgatcgatctgaatcccgtcctatagctagctttcctgtgacaagacatatgcattgctatttatatagctcaggccggtgcatatatatgtttagtcgtactcttgccgtatctgttctaggtggttgtataatgttaatatggctgcggatgagaagagcatcaattcttggcctcccctttcccatcatttgcattaaccttttggttgatttggtaatattagatcattagcatatgtgcctgcaatggtcgtgtgctgcgctagttttatgcttctctctaaatcattatatatgcctagttatatatgtatgaacaagtgacacaaaattatatatgccaggctgaggtatatatctaacatgcatgcttgcccagctggaattaattaatttgtagaggcaatatacgaaaaagtcatcacacactttgcacaactaatttgaagtgcacgccttcagattaactagcatggtagcatcgttatattttttttctcatataatagcttaaatatttttatatttattattaagatatattaaaaataacaacacaattttgaatttctattgtattgatagttatttattactttctaatttcgaattttacttatttctaaattatattcctatatggactctagactcttctcccaatcatgcttatttttaaaattttgatttgaagcttagttatttataaattgtatttctgtatggactctaaattctacttttaattttttttaattatgactttcagttagttcaaattcctatatgaaccttatattcttatttcaatattcttattttttaatttcgaatttatgtttttataaattatattcctatatggactctaagtttttttccaatattctttttttaattccaaaataattatattcttatatggactctagactcttattccaatattgcttatttttaatttttaatttttaattttaattatttctaaattatttttctatatggactctaaactctacttttattgtttttcttaatttcgactttcagtttgttctaaattcctatatgaactctagaatcttctttcaatattccttttttaatttccaaattttcgttgtttctaattgtatttctatatggactctaaactcatcttttaatatttttttattttttaattccgaattttattcttttctaaattatattctatatgggctatataatcttctttcaatatttcttattaattgtatttctatagggactctgacctctagttttagttttcctattttttaattctgaatttcaaacagttcaaaattgtataccggtatggactctagtctcttttttctatattccttatttaaaattccgagtttcagctgtttttaaattgtattcctatatggactctgttttttctttttccccgattaatgtgagaatttctaagctgtgagagtgaacgtgaaggctccttttactattcctttaataagttataatagatttgtccgatccctttactcaaggttccccatgtactatataagtacttagtactagtatatagaggaggcgggagaaaaatctattttgtggtgttctagagaccacccttagaa

SEQ ID NO: 103308 - DNA, 1173 bp, Oryza sativa
aatgggtggacgcggtgatggatcatggtctcatggatgtatgcatcgagcatcgacgtgagtttgccagacggtttctgtaggtatttcattttgcatgctaatcgaatcgatccgtgacgcagccagacaaaatgattgccagtatggagcatacatacgtgtccctttcgtcccaacaaaaacttaacatatgagaaatctctcctattacaataaatctagataagccttaatctagataacttctcctaggttgagttttgtcttctgaaggttgagtttttatttttttttatacaaagggagtaccatagagctaataaaaaatgtttaggtaaaacagttgaagaatgcctgtagtcccagcaaaagttggtacctacatgccactataattacgttgtcagttgaaatgaatattacactccttgtcataagattgaagtatctctggagacttttatggaaattaaggaagttggtgaaaataactgaggatgttgcgattgattgagatgaggggcggtgaagaaaatattttgttttttaaaaagaaaaatgagtaatagaaatagttttattttggagcggagaaagtaatccctttatttgcacaatagctttttacagtatagtattattctttaagcatgatttgtttcataatatattatcagtaattatgaaattggcattatattgtataaaaatacctttaaatacaaatcaaatgatattgcaggcataaaactgaacacatatattgttagatcaattattaagacatatttccttcctttccaaaataaataaacaaatcttgtacgagatgtggcctattatgaaatgtgacatctaattaatttgggacagggagtatagtgtaagatcaattatgaataatttattttctaaatgttgttttttttccttcgaaaaacgagaatgcctttattttagaacaaagagagtaagttagaaaaatgtcaattcaaacccttaccatatgccaagcaattactttcttgcccctcagttttcttccttcttcctccagtagtcccgtcacaactgagctccccatgagaaagagaattgcgtgcaccagtacacagcaaacttgaaggaaggaaaaatctatatgtggtgagcattaaggtaataccaaaa

SEQ ID NO: 103309 - DNA, 2326 bp, Oryza sativa
cataaactgactcaaatccgaagacagcgagcagacccactctgttctgactacagataaatcataaatgtggatgaaatccttccatatcgtagtttctgcaacaggagcagcgcgagaatcctaatgagcaatcgctcgcgtgagagagtggagagcgatccgtcctcgtcacgggctggtgggttctctccccacgttgctttcttcttctttttttcaccgcattactcttctggtttagtaagtttatacatcttaagtttactcatataaagtttatacatctaaattttgtattgttaaagtttatacacataaagtttatacgatgaaaatttatatacccgatttaaatttgaatttgaattcaaatttaaataccttaagtttactcatctaaagtttatacttctaaagtttgtattttaaagtttatacacataaagtttatatagtgaaagtttatatacccgatttaaatttaaattcaaatttaaatatatttaaaatatttatatacatatagtatatatgtacaaagttagcaatgtatatgtttatatataaaaagtctatgtacatgaatagattttagtgtaatatatttttttattctctttctttttttcacacttattttcaaattgattttaaatttatgaaaaacccacatcgaatgtagacagtcacgagcgaggttgagaaaagaaaaaacgtgtagtactccttgatctgttcgcgtgacgtgacccctagcgactaatcgcgtattagacggggacccttcagaaacttggcaaatggttgaactacggctggctatgtgtagcaacattaatcattattcggcaaactatgaaccatttgtgcatgatgtcagctagctatatactccatccgtttcaaaatatttgacaccgttgactttttagcacatgtttaaccgttcgtcttattaaaaaaaatttgtgaagtatgtaaaactatatgtatatatgaaagtatatttaacaataaattaaatgatatgaaaagaataaataattacttaaatttttttgaataagacgaatggtcaaacacatactaaaaagtcaacggtgtcaaacattttgaaacggagggagtatacagtaatacagatcgtacattatttatgttctagcagcagtcgttagggcatgaacaatgcaccgacgatgcgagtagttctaggcttccagctacctaagatttgctccggttcaataaaaaatacatcgagatatcaatatctcatggtaccaaagtgtttttatagttggatctaacaatgtccatcctgctcaactagatccaacgatcgaaaacaatttagcaccgtgaggtactgatattccgaggtacttttcgttagatcggagcaaatctctttattattgggacagagggagtatatagctgctccatacagtacggcatcaatccgaattgtacgcggacacgtcgtcgatcgacctgaaaaatacagatactggcacgcgaacgtgagtatacgtactgatccctgaaccgtgcatgcacatgtgtgcaacacacggctagcgattgattaatgaaacagctgtcagtatcggccatggctacgtacttccgttcattggctttgtttggatctttcgggctattaaatatctctctggaatcttgctatttaagattattaaatatagattactgacaaaactcattccataacccctaggctatttaatatacctcgttagattcgtctcgcaaaatagcctagggattatgaattggttttatcaataatctacgtttaatactccgaaataacaaagattccggaggggatccaaacatacccattatatccttgccagatctagaaagcggctagtgattgatatgttggggggcagactgatggcagtgcatcaatgcacgatgccacgatcgatcaagttcgtccaagcttcagctcattcatgcataaaccatgctcaaaatgctgcttctgtatgttccatgttaatagacgtaaccactacttctatctgtactcgcagtgggtaatcacaaatcatgtcggtcgtacgagagattgggtataaagattgttcacgttattttcaatctaatctcattcctgtctgatttagattattaagcagtttgtcgttacggattatctattttactaaggaatgaatcagatatctattatattattaaaggaatagaaaaaggagcctccacgttcgctctcatggcttggaaattcttacattaatcagagaaagaaaaaacagagtctata

SEQ ID NO: 103310 - DNA, 672 bp, Oryza sativa
atttatagataactattgtatgaattggttattaaatagactatggctgtactcactattcatggttgggaacttggaatagtacgcacggaaaaaggagcggtccattaggacaacaacaatgtatatggcaaaagtagtctataaagatgggacccatatatatgaactttagctattgtaaccttcacaatgtatatggatagtaaatagtattagtaggagagaatagatagagacaaataatatattgtattctctatgggcagcccatatgcttatgggtagtttttgttatttctttcctatggactagttccacaatattgctaggtggctgaatcaaatactatattgcttatggaccacttttgaaatacatggtggatgcccttagcacgtgattaatcaagtattacctattttttcaacgatggattaatttgatttttttaagcaactttcgatagaaacttttttaaaaaagcaccatttagcagtttataaagcatgcgtgcggaaacgagggagaggggttgggaaaagggataccgaatacaccctataaataattttgagttaatagttggctatactattaaacttctctaacttgactatcttcagcccgtgccatgattacgatttttcgagtgtcttgagtacacaaaa

SEQ ID NO: 103311 - DNA, 727 bp, Oryza sativa
tcctgcagccctactaatctatttttcaagttggttttagttaatactacctccatattttaatgtatgacaccgttgatttgttatctaacgtttgaccgttcgtcttattcaaaaaatttatgtaattatcatttatttcgttgtgacttaattcatcatcaaatgttttttaagcatgacataaatattttcatatttgcacaaaaaatttgaataaaacgaatagtcaaacgttggtcaaaaagtcaacggcgtcatacattaaaatacggagggagtacttaattaattatgtgttaatgagctgctccattttcgtgttggagggaaaggttcccaaccaagactaactctgctaaatttttaagcagcatccatgtctgataggactatacaagttctcattgggcctccttttgggaaaaagtttgaaattttacataaattgaactaattttgagggttttttttctaggaagtccttcatatgtcaaatccaaattttcacaaccatctagcccatcaaatgatcttatgaaattatcaaccatgttatgaaaacatgtttgatgagaaacaaaagctctccaagagtttaaaaaaaagaaattgagtttcctagtttatgcatttggttggctaagcctaagccgagacatataatgaaacccttgaaaaaaaatttatgagtaagaatttaatatttcgttagcaaatactattg

SEQ ID NO: 103312 - DNA, 621 bp, Oryza sativa
tagaagacactaaaagagacaaaaatcagtgaaacatctctaatctcattaaattcatataaaaagcacatttacgtatactaattttatgggcatcagaatttaaacattaatgcgtgaagaagtcatgcacttcatacttcaccacatgtgctcttcctcaccatacatttgatcttatcaagatgcggtggcggtggcttcaaatactcgccagcttatacaaaaaaataggagtaatagaaaagctaaggaatagttaattactcggtgatcagcatatctctgaacttttgcaaatgtctaaaatttatccctgaactttaaaaccgaacaattactatctttaaacaacacttagtcatttttcattctttaaccagattcaaagtgattctggattacatggtattgcgatttaaggttgaaaaatcttttggttcttaaaaatcagtgcatgataaatccataaaattccttaaaagtataacttactttttacgacatgaataacatattttttttaaccatgtaaatataataatttggctgcacaaaatagttttgtaatatatttaaaatcaatttttttcttggaataatatttattttggaatggac

SEQ ID NO: 103313 - DNA, 1518 bp, Oryza sativa
tgcacttccttagttggtgtacatgatgaagaagatgtgggtcgtcagcattgacatcataaccaagaccgtggtgtcattttatccgtatatcaataggaaggagggccttcaacaccgactttatctgtataaagtcccaatgtccacacccatttctcccctccgactttttcaaatttatgaatgaaggtataataattcttatctatctatcatctaagttatgaatgacaagaggtataataattcttatatatctatcatctacttatagattcttctgcatcggctgcatatgttcatttctgcatacctgcaaactttttatctttttaatcagcatgtcttcttgtactaagataacacccttaaataatacagcctgtaatatggtaaacatttgacccttcaagctgaagtgaaatatagcctgcatagtgacagagttttcaatatgctctctcgtatgaatctatattgttgaaaaatattaccatttgcaagtaaagtatatatgcttattttggaaactggttgggtgcccgtgcgttgcaacgggaaatgaaataacatcagctctaacttacactatgatgtcaaaagagtttaaaatgtgatgattatcaatgtcaacataccttccaatttttacaaaatatttcaccctcgcagatcccatatatacagcaactatcttctaattcactaacactacaatagctacatgttggaagaaaaacgctgcttggcatactatggaaaacacacatgatgtttcctcctcaacagttaataaaaatatttgacatatcggagggttcatttagtacccttcaattacaggttcatttacttgtgcattgcagcggctattaaataaacaacacagaaacatctagagtttgtatttaataataccaaatccaatacatccagatggcataggaacaaatttgactgtttaaagtaaaatgtataatatttttctcaataaaatatttggcttaacaactataaatttatatcttttcgatcttaatttaaaaataaaataatcttagaaatttgatatgttaaaccgtcattagttgattggctcgctacttttttagagaacaggtcagagatccggcttttcactgaaagccataacggcaggttcagctggggttgccagcatacaggaaagttcaacgatcaacagatcgacaaaaaaatcaaacaactctagaaatgcctaaacagctctaatgacaacaaaaggatagcccacatctcccaaggggattcagaattaagctaaaaacagcagcatatcagtctgcggacacaaacccagaaattagcctatcccagttcttgtcggtctcagatttgccactgcatctttcatcttctgcaccatcgattctaacttgcacagatcttcacatcgaaacagttttctccactgcatgagattagaagtaacaaggaaagggacagttagtggagaataaaccagcttttccttaa

SEQ ID NO: 103314 - DNA, 610 bp, Oryza sativa
gcacggattgatgcattaatttggttgcaatgtagatgtgagacttggagttgaagaacaggtagcgctgcgtgagggtgaagagagctgtcacccacaaccacaaggtgagaactccttttccttggctcgatcctttcatagtattcctgactctgatactaagttaatgtatttagtccacgattaatccacgtacataccaggtgattgtgcaaaaaggaggtgactttatcaagagttttgtaagtagagtgctctctcaccttttcttcactttatgggcatcattttcagatcgatgtttgggcacccaaaattgaatcaggatattttactttcgcctttgctctgaaaattatattctgagtgtccccctcagatgtcatttgtcggataaaatatatactctaatttttcagcagtaacattccactagatcgaggagcaattaggtatgcagatagcattagcattcccccccgggatgaacgagagccatcgcttttttcattttttttttggaggaatatcaataagtggagggacagggctatctatgcagcagcatgcgtgtgtgtgggtatatatagtccatgagcagagtgtg

SEQ ID NO: 103315 - DNA, 629 bp, Oryza sativa
agttactacctccgctcttctctagatcccattcaggacattgaaacattctccaatgcacatgtttggtcattacttcttgcactcacatattcgtaaaagttaataaaaaatataactacatggaagtatttttcatgacagatatactaaagtcattttcacatataaagtcttaatatttttttcactatttggtgagttaagatttcaagggttgactgtacgcatatctagaacatcatctacttgaaaacagatggagtatcttttatagatagatacctgcctttatgctcaatcctgttgctaatagtaagttcttgactttgttgcaggtggcaaatccaataaccaaatatccttggtgcatcagatttctttaatgagatctaatatcaaaacaaattaacctagaatagttatatttctgtagctatttgtgcaaatgaaatacacactttatagcagctataattttcaggatactagaaattggcctaattactaagcaccctctagcttgcaatatgcatggtttcagttaaatatttgatgacaagaggtattatgctgcatctaaacaatatcaatgttggtgtgttactataattaaattgatcaccgtc

SEQ ID NO: 103316 - DNA, 692 bp, Oryza sativa
  unsure (1)..(692): unsure at all n locations
tttccataccagattttacattattggaaccaaacccaccctctgaggtntgtgctgcccgctgactagagctaattctgtgtgccccagcatcaacattttgcatgttttcaccgtagttgcccgggttcgatttcgaccaactcaactcccttctagagcctctatcatgtgcatctttctgcatggaaaattcattggagacgtaagcaggagcgttgtccatttgatctgagatggccccatttccacaatcatttgtctcatctccactatcggcagtaacagttgacaattcagaggcattcttgcgggcacctttgcctacatcttctatggccttgctagctttctttccagctttctttgttgcaaacttcacatgcctaacaataacgtatgcatgcttcgagtccaaatgtgggccactttccactatgcagacatcttgtatctgttcaatttacgacatcatataaaaagatcattttacggacagctccgaaaatgtaaccaggacatcaaacagttgtcaaacagaatttgctgacattggttgcaagcaacatgaaaataataaggagcagagcactcacaagtcctaacaaccgagatagtggccctcctaaatcttcttcttcattacctgagggcatcgccatgcactgccaaataggaacgggctgcaggaa

SEQ ID NO: 103317 - DNA, 591 bp, Oryza sativa
ttattcaagaagtaataccctactcctgtccggggatgattccgccgagtatgttattgatcgtatgatttgggaaaaagagaatcatcccgagaggaacccggacccctccttatataggggaagggatccgtttacaaaatacagtccatatccctaacggaatatgcgattacagataaaatacaatcgtaaccgactaagatctcgggtatttccttgacatataagttagaaactaacccgagtcctcataaagatattctatctatatttggtaccgtatatccgactaaattataactgtcatgttgatatggggtatccataatctccacagtagcccccgagaccttcgcagttgacaaaatagccttctcgaaacaaaaaacagtaatccgagtgcttcaatttaacttgctctagcttgccgagtgctaaaagactgtgaagggcaaaaataaaacatggtgcatcgagtagatgcacctacttaggtgtagcccctgactatgtgattagttgaaaaactaaacatgtagtcaagaaccgagtggttttataaccaagcatgcatggtactcaataaaa

SEQ ID NO: 103318 - DNA, 1122 bp, Oryza sativa
agaacaagagagggatttgggtcacactgagccaggagagattgggagtgacctactttgtgtgggacccactagaatgaaagttctcttggttttgggtcaggcactgtggttcggggcaggcgcaggaaggggaaccggagggagaacaagagagggatttgggtcacactaagccaggagagattgggagtgacctactttgtgtgggacccactaggatgaaagttctcttggttttgggtcgggcactgtggagagcgtgtccttcctgccaatttctttgcttcattcacttttctaagaccgaagacacgctatacgtgtcttgcactactactgcccttatgataaggcagtgatgtgacatctattatttggcttggcattgacgaggttcgcctgctagcctgccacaatgtttaggaccatcaggcatttttttttcaaccccaaagattcgactgacaatgggagcgcaagttgacgataatgggcgtgtatagttccccgtccaaattttctttatcgtatacggacaacgtagactaataacaaaacaaattataaattttacctgtaaactgcaagacgaatctattaagcctaattaatccgtcattagcaaatgtttactatagcaccatattgtcaaatcatggtgtaattaggttcaaaagattcgtctcacaatttacatgcaaactgtgcaattgattttttttcgtccacatttaatgctccatgcatgtgtctaaacatttgatgtgacgaaaaagttgaaagtttaaagggaaccatacacagccttaatcaagaaatttgatgttgcgctacagtaaacatttgctaataacagattaattaggcttaataaattcgtcttgtatcctgacagaatttataatttgttttattattagactacgtttaatattttaaatgtgtaccgaatatccaatgtgactacaaacccaaaaattttcccaaaccatacaaggcctacgtactgaacgtcacctacttcgtcgatttcagaatgcagatgttaccccgatgaaagaaataagcttttaaaaaaatctaccttgcctccaagcattaaccattagatcaatgtgt

SEQ ID NO: 103319 - DNA, 734 bp, Oryza sativa
  unsure (1)..(734): unsure at all n locations
aatggcctccaatacctctccagaatgatagctattatgttgctctttattttgctgatacagtctctgagagttcaaggacctttaatgtatatataaatgattacagcttctatgaaggcctaacagtaacatcagctggtctttctgtctttgcaacacaatggattctctcaggcttgaccagagttattttggctcctatttctggccttcctccacttatcaatgctggtgaagtctttggacttttcccactaggaggatacacatttcctcgggatggtatgtcagtcgctacatatattttttcttccatttgtatcttttttcgtaataggttaaactaaatgactaaaattctgngcagtatgatccaatacaagctgttgctaaccaaataatcaacttatgtattatgcctttggtggcacttatgtggccaacaaatcatcattatatatgtagcagcaggtcatcaaaatatgttttatggaaatttgttgctgcatatcaggtcatgggactcgcaaaaaaaagggccacagtacatttcactttgtaactctgtgaggtgttaatgttgtagcatcacctatatttagataatggaagtattatttccagcctttgcaccaactaggatccatacatccatatttgtggacaccagaatttgaaccttggtgggtggattcatgcacccatgactccaccaccacaacaatggtgct

SEQ ID NO: 103320 - DNA, 1151 bp, Oryza sativa
ctggcttcttctgctgctgaagaaacactgacaggcagctttaatccagtccaagagcgcagaagggcacgtgagaaggaacttatggatgcatggggaggagtgggtctagggaactccatgaagcctcatctctcgaaaattgagaaggacaaggtaattctgtattactcatgcattatatgaagttactaacctatcatctataaagtataaacatgtcaaaagaaccatggctcacaatgtctccactggatttctcaggttgcgtggagaaaagctgaggaggaacagaagcagatgtgtgctgcaaatgagctataaccatagctcacaatatttctactggattttactgtatgtactgtttgttgtttcacatatacacttccagctcggaggagagagcatgccgtcgtcatattctctatgcctgtatattctactactggtaaagtgaacgttaattctgggatcttcatatcagaaaacaagaagatcagcaactttctgccaaacatttgtatctttgatatttctctccttagcttctatacacccactatgtcgtgcactagcttggcatatcttgcgtgcttatccgcggaagcatatgcgagggatcaacatccagggattacaggctttctctcccaacgccgcaaagtttgacgttgtcatcatctgatcatcaggttaatagatgggtaccctgtccctgttagatatgatctagcctattctatctctttatctctgcttgctgtcttgtagtccacaattactgctatttttcatgctctgtttttcttgctgcaatgcatggacaagggacaatttcacatgaaattgactatgtttgagataaggatgctaaggtgatatataaaagctacagtcactattgtgggtgatatagatatttgtttatcgatcactgtcgtatagattctgtttattattgaatgtctggttcctttagttgagcataagtaaaccgatacttatttcttgcgtattcgtatgcttcatcagagatagggacgaatcagctgccaaatgaacctccatttatttatgtgtgttatctccatttccattctctctttgagattcttcgcgttgacaactgttttcatccttttgattca

SEQ ID NO: 103321 - DNA, 1046 bp, Oryza sativa
ctttctcacatcaaccaatcgcaacactatcttatctgattttatcactcaccttaaccttaaggtctgtttggtagagctccaactcctaaatttaacttcagaagttgggtctggagtggagttatgtagcagcataaacccaacttcatctctctagttcattttgtgatagggttttatccagtttcactaccattttaggtggagcttaaactatttggctgaactccaactccaaaagaggtatagctagagctgtgctaaacagacccttaatatctaaaatccatatatcattatgttattggaggagaagggggggaggggaaggggggtgggagggtatattctttcatcaattttattttctttgtggagttgggaagggagaagccgagtaataatagtcacacccatatatcttagatctgttaataaatttaaggctgtgtgtgttttataacagaagtcgaaaatgtaattttttttcattatctaaaatataccatagatctataactattaggaaggatgagttgggttctttgctagatggaataaagaagatgcacaggcgatgattttgcattttaatctcaaagtacagcttccctgcttctgacgcctaaggattgtttaatgatgtttttgccatatgagaggcaatcaataaactcatgcataagcttgcttgaatcactatcaagctgagagaaccaccctgctaatattttttttcaaataatattcctatttatgctaaatatgactcttccttgagctttgtaggagttctaaactttcacaaattttgacaatttgactctttacaaaaactaattatacaaatgaaccgtggccaaaacttatttcaaaaataaccctttttattcagcgctaaaatcccatggcgctaaacttagacgcctcagcgccacgtcaacttgcgctgaatgtcgtgccaccgtggatgggagtctgagtcggcgtgccaactcatattcagcgcaacgttatttggtgctgaggtgtctaacttcagc

SEQ ID NO: 103322 - DNA, 896 bp, Oryza sativa
tcctgcagccccatttggcagagcagaaaaaaagaaggcagagcatcataggtaggaaagcactgaaaagaatttgacaagccaatggtcaaggaagaaactgaaaccttctggcatgtaaacataccttttcttcctctactttaatgcattaggcagcactcttgccataattaaaaaattgtttgtgattattgatagttagtactaaaaagttaaaaagtgggtgtaaagttttgtgtatataggtgctcctttatgttgtcggtgcttttttaattatcccgtgagtgcactatttccacggtatcccgtggggtagcagccctcattgaaaaaactgcagaactgggcgttctccgaataattaagtgctacttatcttttcccgatttttcaacggtctggttgaaaaaaatatactcccttcgacgccttcgtcccataatacaagggattgattttgacattttgcttgcactgtgccaccactcatcttattttttaaaaaatggaattattatttattttatttgtgacttattttattatccaaagtactttgagcacaacttttatttattttatttgtgacttattttattattcaaagtactttaagcacaactttttatgtttatatttacacaaaatttttaaataagacgagtggtcaaacagtacaagcaaaaagttaaaattccttatattaaaatatataagacagagggagtattaattttagccgtacgagatttatcaactccgtcgaaaagttaatcaagtacatttagtactccgaatctctcacggaccagaatttgtaccagcaggtgtccctttaaaaaaaagtggtatcaaattttactatttatttctcgtcaaaatctggtgtt

SEQ ID NO: 103323 - DNA, 629 bp, Oryza sativa
gcaatctctctctctctctctctctctctcgttagttctctgtatgcgcgtgtctttcttcaggctcgtgtttgggcggccggttggttctctgctcctgctgatagtgcttgttcttgtgctactacggtttgattttgcgagttttgctcggtggcaaaagctagtcgtctgttcgttttctacgggcaggctagtggctgtgaattggttttgctcgaggtagagcgtcaaccgacggaattgttcattgtctcgaaaagaaacaacagaattgttagagcaaacatgtctttgtgtatatgtgttctgctcaaagtaactcgcctttttttttctagctttggttttatcgtgctgctctgcttggccgaagtgctttcttggccattgagagtgcgacaaatacgtgatatctttgcagttgttcattttagagaacttcttattagatagaaagatctggttgtggttactgacttacccggctaggaaaattgtttgttatcttcgagctgaacatggaggaggtgccgagaggtacgatcgcaaatcacgcctccagactcttggacgagcacactcgattagatcttgatctgcagttcgtagcagtacctgttgattat

SEQ ID NO: 103324 - DNA, 617 bp, Oryza sativa
agtcaagttggagatagcttgtactcggaacatggttttttgccacatggacgataacatggctaaattttctttttccctttttttattcccatctttttctctccttcctcacctcgcgtggagaaaaatgtggcagatgggagaggaaggaggcaaagtggagcaaaaagaagggatgagaagggagaaaacaagaaggaagaagggagaaaaaaataaaaaaaaatctatatcatcgtctacgtagcatgccacgtaggcaagatcacggtcaaacgagattttggaccgggatgatccattaaaccaagtttatggatctcgacttgcgttttgcaagttcgtggacctaagtaaaactttgttacaagtttaagaaccgctagtggaatttactctatagatattatgcaagctctcttgaatacgcatgtagcacatatgttacataataattagaactactggaaaaggatgttggtgtgttattattttatattcttttccacagttgatgtttgtgctattaatttataaatggaaaggatgttgatgtgttattaattcatatgcacaacctcatctaatactcctatataaaaaagaacagtcct

SEQ ID NO: 103325 - DNA, 595 bp, Oryza sativa
aaaaaacccatctttgctcagggaaaaaaaacttagcaatatacaacaaggagtaagattaacactgacgagaatggagaaaaagcagcaaccaaatcaagtgaatctgcagcttgaaccagagccaatctcggtgccctcctcctcaaaatctccccccacagctctccttttccccacccaagagtagaaatttgaaaaacacaaaagaaagaaagcaaaaggacacagatgcggtaggtgaggtggggttttgctctatccccagcaaaatgatgcgagatccgttaacccctggaggcaaaagcaagaagaggacacaagcagctcagccaaaaccaccccaaaacttagggccagccaaaaacaccagcatacaaaaaagaaggggaaaatgaagaaaaagaacaaagatttgtgcctattagatgcggggttttgccctggagaaacttaccggcaggagaaccgcggtggcggcggcgacgggactagggtttagctggagcgccgccgacgagtaggacaaggaggcggagctggagagagagaagggaagaaatgttgggttttcctttggagaagagttgaaacg

SEQ ID NO: 103326 - DNA, 680 bp, Oryza sativa
ccaggaatatcagtgacgatcctgccagggtcaatatattaattatgttaaactaaagcgcatactttatcagattgagcgctattttatgagtagctgagcatatattatattagtgatggccatttgtgttggttcaggtaggaacttgcagtggttgtctaccggagggtgtttcgctaggtaagaagttaattattatctacactgtacttcctccggtcatgaaaatatgttgtcttaattagatatgtttcatgtcaaactttaaattgagtctggacatccatatataatttttaaaatatttatattggatgcatgaaaattatattaattgtgtgtagattgtcctaaaaaggtacttctataaaattatgagttcatattgtttttcaatgttttgtaatacaaattaacaaggctgtgtaaatgtccaaaacataatgtttttttaccggaaggagtagcatcaatgacctagctaatttagccatgtatctgcagatcacttctggtttatattttttcatggatatttgatactcatgaggtttattcatgttttaacaataggagccatctatggcctcagcggggattaattacttgtaaaataatgatatatatttaccagtggaggtgctccctcaggtacggatcactaggccctggcacgt

SEQ ID NO: 103327 - DNA, 2041 bp, Oryza sativa
aaacccgtttaaaatgagacggagggagtaatcaccaggaacaggtacgaattacagatcaagatctacgcgagtactcgtccaagagcctggaggcgtggtttgcgatcgcacctctcggcacctcctccttgttcaaatgttcagcccgaagcccgaaggtaacctaaacaattctcttagccggccagccgggcaaccgaatctttcaagggaaaaaaaactaaaatgaacaagtacaaaggtatcacgttcgctctctcaataacaaagaaagcacttaaggccaagaagagcaacacgataaaaacaaaagggcgcaacaaaaaggtgagcaactttgagcagaacaaatactccctctgacctctgttcttaaacaaaatcatgcctagcatcccccgaggcaacttagtagtagaaaggaaaaaaaagtcttccattaatagaaaattgggtgggtgggaagtaaatattataccagagataaaattttcgattcatacactgatagagatgaaattactccctccatcctaaaatatagcaacttctctgctactttttttccctcaatcaattacaatcattcccggtatactttctcatctcaattgatcataacaatttattttcaaatctcaatttcttaactccacgtaaaatttcaaaactacttgtatttgggattaatttattttgaaacaaaatttaaacttcaaaaatcccttactttggacagatggagtatataaaaaaagacatgttttgctaaactcaaaatacgccctctgctctaacagttctgttggttgaagctctactcctctacctcgagcaaaaccaattcacagccactagctgcccgtaagaaacgatcgaacggatgactagctttgctaccgaacaaactgtggcaaaatcaaaccgtagcaaaccacaaaagcaagcacgagcaggcgcagagatccaacaatcgtccgcacagacacgagccaggagaaagacgcatacagagagctaacgccggagagaccgatcgagagagagagagagagagagagggggttgcacgtaccgccggaggaggccggggccggccgcggtggccgcttcacgccagacgccgccatggatcccctgcagcggcggcgaggggcgaggagcgagttccgcgagtgggaggagaagaaactccagctgaagctaactccgcgcgagccagcaacaaacgacggcagtggctttatgaacttcccgctgtgtgccgacctgcacggcgctcacgttgggttaaaaccccagcatagtccactgtatggggcccacgagacagggcccagagaaatcgcgtgggggccactggcgttaatgccgagaagtcgttgtctctgctgtattttatggtgtgagcacaggaaaaggaaccgtggcagaagcaaacagcagctcggcgacggcgtcagcagctcagtatcgacaatgtttcagaaaatctttttttttcactttaaaaaaatggttctgagtcaaaattacgtggccaacctgatagacttgtaggtgcatcagtttcagtttcagtggtgttcatttctactgaaaacagagataaagttaagaaaaaaaaattaaaaaatattattaaatgattaattgaattttaatttttataaacttataaagtaaatttatctgatatttcaaagcaatttttctataaaaagttttcacacgaaatgtaacgtttagcaattaaaaaatatgctaaagaaaaccaaggtaaaacctatcataattagaaaaaagaccatctgcccatgccaaatccagcgtttggtacgcaggctagcagcaattcatagctcatggccctcgtcatctccgagtggcaaacaacggcagccaccggcacgatgccgctgggaatgccatcggcgaccaaggaggcaaggagcaggtgggcggccgtgtgaagttcgtgatggacatgtttagtaactaagcggttgcctgattacttggaaatggacatgacctc

SEQ ID NO: 103328 - DNA, 1082 bp, Oryza sativa
atggatgaagtgatgaacttgtgcttgaaaatgacactccaagttgatattgtttattttgttttgctctaaactctcttacatgctgataaaatgatactccaagtcctatggttaatcttttttggaacatctttatcccaacatcattttctttgcgggagccgtcatcatgctttcagactctactaattaatctgcaaagtgtttttacaattatccctcgctacaatattttaaagtcatttttttagataatgaaatattaaattcactttcctttcgatgttctttttattacatttttttagcagtacatatttctgccactgtcagctttatcaatcttggtgaccatgtattttctttacagatatgtatcgaagaagtcataagtagatttttttgctatttccaaaggaagaaattagctgtgtgtttagttcatgctaaaattggaagtttggttgaaattggaacgatgtgacggaaaagttagaagtttgtgtgtgtagaaaagtttgatgtgataaaaaagttgaaagtttgaataaatagtttggatctaaacaaggcctggtgtgttcttcttgacattttctcagctgtagaggtacaaaaggtgtgcgcttttgactctagaactgaactgaatgatccatgcagttgattgtgacttgataggatagtgaattatgaaaggggtgtacattttagtcttcggactgaccacatgataactctgtacctagccgttcatttatagtctcgcctgatttttttttttttgatccgtcactgagcagactatctctctgttagtatttagacaacatgtatgcgtcatattagaagaagatttaattttttttgttacgctgctttgttgtggaatgaaaaaaacgttgtagaatatatcactatactcttgttgcatatggaacgttcaagcctatattaattatttaatccacgtggggggatttatttgactatggatgaagatgaacgtgagctatagactgacaaagtccgagctcacatgatgtccatgttacgttgcttgtccttctctatttatc

SEQ ID NO: 103329 - DNA, 672 bp, Oryza sativa
tgcaacctgcggcggcgacggcgactgtgacctgcagcaacgacgactgcagctccacgtggaggccacagcggcgacgcctagaggcggggctgtgccaatcccggcaccaagtggcggcggcggcggctgtgttgggcggaagctgcaccaatccctccctcccatacttgtccattcttccccaagctgcaaacgtgacggttgtgccgaagacggcggggactgctgggctgcacaaatctctccccattcttgtctaattttcctaacaagatatgtgcaagatttttatatgattctcggatattgaatgtggtatggaactattgaatgtaatatcaagtgtctttgactctttgaactgtatgagaattgcaaaatttatgttagtttttccaaaacagctaatgggcttagctgccgctatagccagctatagctggtcgtagctgatggaaagcctagcagctaaagggcatatccggagattttaatccttgtttgtcatacctgatacctcattacctttagctgtctagtaagaagtcgtcagaaattggcaatcgacgctatagtctgccattggctctggtaagtggcaatctcaagaaaaagaaagcaggattataccattgtggttgtatcttcactcaatttttcatctgattg

SEQ ID NO: 103330 - DNA, 573 bp, Oryza sativa
cccgccagcgcatgcacgcgagacgagaaggcggcagcggcggcgacgcggacgccaactccgccgcctcgccctgctgctcggcctcctcgctttcctcctcttcctgcgccggcgccggctcatgcggcgtcgacgaagacgccgggtcgacgtcctcgtcgtcggggagtaggcgctacaccaggctgcacgcgcgcagggtgtgtgcaccggccgtgcgtggctgcgggagcgcgccacccggtgcgcgaggtggccggtgtcggcgcgccccggcggcgagccggcgaccccgtcccgtcgtgtgtcatggccgccaagccggcatatgtactactaatgttgacaatttagtagtgtacacagacgttcacaatttgacacaatgtaagattgaccaatacttttttgtcacatactgtctctaattgttattctagcttctggtttctctgattgatctgatatgctgtttatgcattggttcaagttcaatgaagggtttccaaaaccgccggttcgcgtggttaccgtagagtacagtaagagaaaaaccgtggtaacctcctt

SEQ ID NO: 103331 - DNA, 1526 bp, Oryza sativa
taaacgccgtacttgtcttctcataaacacaagcagtacacagtacactccttaccatctgcattagtttctcgctccggttaatttccagcacagtgggcggtgaaatttttggtgatcaatctctttgcacggtctctcgcgccctgtccgacagttctgttttagtggtcaatccaaatccggcccgctcgtatgcatgcaggtaatctctctttgtgttagtatttaacaccgtgaaaggaccacgcaaaaaggcagagtttcgacagaaaaaactctagctggttaatggcgtgtgtgacgcctcacctatgcgtggctgtacacgagaaaattagtgccacccttttcaatctataggtaagctacaagtaacgttaggtgatgtactgatgtgcccgtgttgacctgcgtggcatgaaaatcactgctaacaactggtctaccacatatataccgaagcgaattatggcctagctagcgagatagatgctgtaagtaattaacaagaaataaaatggattagttagtacctatatagtctagagatattacgacgttggccgtgccaatctcctgtgttactgtgtgcgcccgtccaaacttgccacgctcgagctgagcagatgatctgctgatgatgatgagagctgatgagctgtagagaagctagaggcaggcacggcgccgtggaacacgtcgatacttctcctcgcggagacgaaggatgcattgcgtccgctgtacacgcccatgcgctgtcccccggtagtagcagcggatcgtgacatcgtgttgaaccggcagaaacatccaaaacgaactgatactactagcagcagctagtactagtattattagacgagagggccccggcaccagtcactgcaggttaagcgcacacggcctcgcgagtctctgtagatatgcacgatccgtcttatctcttctctgctcctgaggccggccgtgagaggtttaacgggattccttcgttggtgtagtagtagacgtgtagtcctgtttgcctcgcggtcgcgggctagccaaaaaaaaaaaaaaaaagccttggatacctccgcggcggcatgtggcacccgccccacctgcgagcgcgcgtgatacgcgtatttgtgtgtcgcgccttgtccgcatccatccgacgatttccgatccgatgcagcgagcgaccgcgcgcgcgctccgccccgcggcccgcgccaacgtgtgcagctgcgtttccgtgcgcccagccccggttgcgctagccgctgttgctgccgtgctacgggcctacggcgtactccttcgtccaaaaaaaaatcaaattctgaatttatgtgtctaactttaaccatccgtcttatatcaaattgttttataatttgtattttcattgttgttagatgatactccctccattccaaattgatctacatatagttttttaagttattcctaaatgatctatatatttgtgtttatttattaagtctattcgttatttgtgcattggagtaaat

SEQ ID NO: 103332 - DNA, 582 bp, Oryza sativa
ctaagacccaaaaattctagttacatgtaaaactcggatccaaaatttttaaacttgcgttcacactttaaaaacttgttaaatttagttgaattttgtaggaatgaattattatatagcgaagcaactttgtacaaatttttgaaacatttatacatgtgaagtcattttagatcgaaccccttgaaccttaggttctaatggtttgatccgtttgatccatttatatttttggagcaaccctacaaatccgttaggacaaattgatccgtttgatccatttatatttttggagcgaccctacaaatccgttatgacaaatttacggataggtttagtgcataaatggatcgaccctaaccattcccatccttactcaagcttataagtaggagattctcagccacgtcaatattttctgtgaccaaactaagaacgcgtgaccaaactaagacacatgttattcataaaaaattggcagcatcgttaaggcagcccacactcgtcgctagggaaaggagagagggaggaaagaaagctcggcttgtctcgacgactagggagggagaccgtcaacgggga

SEQ ID NO: 103333 - DNA, 521 bp, Oryza sativa
aaagtgttcttataattattctcactacaatattttaaggggcaattatgtttctgcccttgctttacgatttaattgtgattttacccttgttttttagggtttgtgattttgcccctgcttttttgaaatgaagcagtcgtctgcccctggttttgacagaagtttggtgggcccgaaattttagaattaaatggtgaaacaaaatgttattatcatttgtgaatgaccattctacccttcaatgaaagaggcaaatccccaatccatgtcccgaactcccgatttccactccaaacgctatagctgggttgcaagcggcggcggcggcggcagcgcggggcagctgccgcgggccagcgcgcggcggagtcggtggagtcgggcgcgggcagggaggcgcggcggcggaccggcgggcgcgcggggcagggaggcgtggcgccccccgcggccagcgcgcagggatgcgcgacgcggctgccacgcgcagggaggcgcggcggccagcgcacggcgga

SEQ ID NO: 103334 - DNA, 550 bp, Oryza sativa
aattaaaggatttatgtaaaaattttatatgatttaaattctgtaggaaattttcttatttggccttttgttttaaaggattgaggcccctttgaattagagtaaaaatggagaaaaaaataaaggaattgaaatcctacactattcatgactttgattcgtagaaatgagaaaaggaaaaatatatgtaactttcatgttcttacgattctataggaaaaacgtagaaaatttaacatccactctaagagcccctttgatttgtaggaaaaatgtaggaaatttaaaggatttcaatcctatgaaaaaaaattcctatgaaagcctttgaaacaaaggattgaattctatactatcctttaaaattcctatggaatgtataatcctatagagattttggaggaaagttagcaagaggtccaacctcttggaaaatttcctttgagtctatctctctcatccgatttctgcgtttttcctgtggttcaatcgaatagtcattcttatgtttttcctgtattttccaatcctctgttttacatctgcattc

SEQ ID NO: 103335 - DNA, 757 bp, Oryza sativa
ccgcgtcgagcgcgaccttcacccggacggagctccggcagggggaacaccttggcgctgctcgtgtacagcgcgacgagacggtagatctgctcgtgcccgtccatgtgcttgatcatgtcgacgaacttctcccgctgcaccgcttgatgatctcagcctgcaacgcgagcgtctcagtgaagaagcaggtaatcaccatggttgttgatcgagagttcgagctcatgaggcgtacaccccgggtggttgtggtggtgtgggtgatgccgcggctgcggccgaggcggaggcgggtggccggagttgccgaggaaggcgaagcgaatgagggtctcgccggacttgagcaggctgcagaagttgtcggcgacggtggggattgtctttggcctagcatccgacggcggcgcaggcaactgacatgtgggcccaataatatgtttttattgttttactcactgacatgtgggtcccatttacatttgtttttattttagtgctacgtaagcgccacgtcgatgccacatggaagtcaacccgccacgtaagtgccacgtaggacaaaaccgcctccgaaaccgccgagggaggtgatttgctctggttttcagagaagaatgaggcgttatacccggttttccggttgagggatgttattcacataagcacaagagatgagggaggttaaatggacttattcctataaagtataccgccatttcgatgtctggtccctgaaggccctggacggctg

SEQ ID NO: 103336 - DNA, 698 bp, Oryza sativa
cttctcttcttgaagacgtcgttttggtataccctagggggcgatctcggctgtgtacctttgttggtctagtggcagccggtcacgcttagcggcggtcggtccggtgctagccttttcttgggcttgtgtgttggcgatgtcggtatgtgggtggtggtatttttttcttttcttggttatgaccctccaaggttgtaatcttgtaattttttccttctctatcaatagaacttcgccccgtctcgcgcgagtcgttccaaaaaaaagattaattaagaagaggttatcttataagtagtaggaaaccggcagcgaaggctcaacccagttactcactaattaggtccatcactatagctatgtctgtaaatagaggggaggatgagctattctacactactccctccgtcctaaaatataagcatttttagcatagtgacatgtcaaatattttttaactttgaccattaataggaaaaaaattaaaaagaccaatcatgtaaaactgatgttactagatttatcattaaacaaaggaagaagaaactatcataatatgtaactctttttgtttagaacatcttaactttatagatattgttggtcaaagtggcatctcggagatcagtaacacacaaaaaatgattatattttgggacagagagagtcgtcagaatgaaggaatgaatgatatg

SEQ ID NO: 103337 - DNA, 666 bp, Oryza sativa
ctctgtcatatactcataaatataaacccctctaccttaaaaaaatgcacattttgggacggaaaaagtttcgtgtgtattgtatcaggaccaatgagacagagcccaccctgacaccttgctagggcggaggcgtactgacgttgccacgcagttgcaccaactcatggacccttgtcgaggattagagcattagcagttggccaccacattttgccgaacctaacgtgccatgtgagcaaagaataatgttagctacatgtttcacagcaagtcacttatagtgggtcccactaatatcaccttttttcacttttcatctcccctttttcctatcttcctctccccaatggcggataaagcgaggcgaggtcaaggcgacaacgccggcgaagcggcccacgcgtcgagggcgatgacgttaggtggagtggcaaggtcggtggcgcgggagcagttgacgagcgaccagatccatccctcgccttgtccccaaaagcagtggcaaggttggcggcacgggagcgagggatggcgaggtcggcggtgctcctcctctttgcattttccatggtggaggaagtgaggcggccgcggccggtttggcgacggcaccacctctcctcctccgactggcagggtacggcactgcaagagcttggtggc

SEQ ID NO: 103338 - DNA, 540 bp, Oryza sativa
tttggcttaatagtgttatagtggtttatggctttaaaaagtcaaacgaaaaagctacttgtttatttagatttagactttttggcttataagcctaaacaaagagggccttagagggtatccgatttttttttataaaaaaaaacattgagagggaatccgaagctgctgtagtttttagtgctacactgccattttgtggtaccaaaatttgcattggcatctccttattaagaactgtaaaatatctttacatagtaatatggagaaatgctgcaaatacttaacgtttgcttgtgaaagtcccaaagttgccatccacacccttattgcaagtacttgtggcaaaggatttttttttcatcgctatctttatactgctagctagtaagtttctaaaagcttggtattattagaatgtattaaagtggatgtaagtggggatgacaatgaaccacgtagagctttccacggaaatggaacagactgttcattactaccaacttcaacttgatacgtgatgcgtcatgcacctttgat

SEQ ID NO: 103339 - DNA, 709 bp, Oryza sativa
ctactacattgattgttgacagtatatctgttcttttattcttttatatccaatagtacattccccatattaggatgttgcgtggctggacatcttcaaggttcccattggagtctagaatgttgcgcattccttgtgttgtttgactctttaataggtatttactggaggcagtttttattttttacttgcaccctttgtttctctttctgagtacggatggatgtttcgtgattcgcagttccttgtggatcaatagggcctgctaatagtaattagcgtgagcacgtaacgtgctaatctgaaatagtttcagaatgcaattttgatgggtgaaatagaaatataaccaagaaatgtgtttcaagtgcacatcaaattttggtagggttataatattttatttaggttacacatagatgcaatcattcaaaaggaaataataaattcccacgtgccgtatcctctttgtcttataagagcagatatgctcataaaaataatatgaatgcaaacaaatggtggctggcaatggcaatttagatttttataaaaaatggcagaagctatggcagactaatctttcatatttggtggaatagctggaaggagagaaatagaagtatctttcaaagtttttccaccgatccattccaggtttcttatctcattaacaataaggttcttccgtactactagcttgaagaga

SEQ ID NO: 103340 - DNA, 5809 bp, Oryza sativa
ccccaccataatatatatcggtgtgtgtgcgtgtgtcgtggtgtgagtgcagtgtgtgttagtgtgcgtcctgagttgtacccttctaaaaaaagaatatatatctcgatttccattggttcttgccttcttggctgatgttcttcttcgatctaataactcaaaaggtcggagcaaagtttgccgcaagttggatagcgcaactcccggtctccttttcagaaatacgcgcgcgtgcagtattttggctgcacataacacacaaatttctcgttggtataaccacaagcagagtgagctatacgcagagcacgcagctgttctcacttctcaagtcgtcgatcgatcgctacggcatcgatatattcatctgcaagagaagttatgcagaaataagatcctttcccaagagaacaaacagtacaaggttacacggatctgtggatatactgatggcatattggcatatgctaagcgattttgctaaaaatctggcgacaaatttttggcacgaaatcactcggatttacttcccttgtggattagtctgtgcatgatttaattagcggctgtgatgcgtttccttcccacgcacgcatgaggccagcaacatctagcttggcacataattgatgagtacatacattgcacgtcgttgcagctaggtgaagagattgaagaaataaaatataaagttacagtcctatataactaaaattacattcgtaaattcagttgatatgacatgtaagtgcactataattttggtaaaaatgttgtgtaagtaaatatgtacttgttatttcctttaaaatataaaattacaatcctatataactaaaattatatttgtaagtttagttgatatgacatgtaagtgcactgtaatttcactatagttacagtgtaactatactatagtgaaattacactgtaactatagtgtaattacactgtaacttttagtagatgggttggtgatatatttttttcaatgtaaagatctaacaaataaaatatatgcaatatatataattaatatatgttgatacatgtatagactcttctaatcaagtgatcaaatgagcataatccaactaatctaaaatctgtgtgatttggacccaaaaatctgtcgtgtgatggatagctagtcccgggtttcctggaccgtcagatcgtctggatagcatccccgtcgtatcggacggctgcgaggagctcacctttcggccttgattgtgactgcacggacgactccagccaatcagccaattgtccgggaaactatttttccacgcaagtaggcggtcaacgtatacttatgtagttatatagatcctcgtgtttaaatttgtaggcaactttagaaaaattttaaggattagcatgacacggagaagctgcggtcgataaaaagaaggaaataaagcgggatgtcaaatcgagcaccgtccaggtttatctcttctactaggcactgaactccaaagagcaagagagaccaatccaactctgaactctaaagaattggagatcaatcaaacgagtaacgacgtatgccaagaaacacctaaattatataaatgccaaaatattatagttgtaattattagctcgcatttttttcggggaaattattgatttgataatactttatatgttttcggataattgtcgcaactcccctatttaaatttgactaataacaattttgttctgtgggttaatagaatcacggtatgagatttatctcacgttatattgctttcgtaatatgcagagttatgggtagttacaggcgaagtcagatagatcccaagcctagagctcacatgcgggccattatatattttcaaacgttatacggtagattcatataatcctaagggtttttttttggtttaggttattggcttgaacttttgacctaagtttttcttatatgttttattagccaatggctttagagcactaagtttaatggtgaagtcatacatgtcatagttatggataacacatacccaataataatcgactaagctcggcagagtccaccatatactaagtcttatacggaatcatacctcgtatatagaaggagttccggataaggaaggataagcaaagttctacacggaaatgcttaccatcggccgtccggccaaaaataaaaaatcggacgtctcaatctaaaagaacaacagtgtaggtgcatggtgaaacagttggttaggtgtactgataagccaacggagcatgcatgcaaacatgtttcaaaatttaaatgattttttctcttaaactatttgtctgaatttcaatctaattatatcattggattcgttacaattaaatctttataacaagatatcacatgactacattccgacgacttttaattttactttttaaatgttgcacacattgttactgaaatgttccaacaagcatttgttgatgtttcactaatgcattagcaatgtttcatgatgtctttttttatatgtttcagcaaatatattttttatgtttcaacaataattataattcgatgtttcaatctaaatataaaaaaatgtttcattagtcgggacttaatgtttcatgtaataatgattattgttgccatcaatactttttatatgttgtacttctttggaacaatttgtgaagtgggttgaaacatctccacaagtgatgaaagaattatttttaaatagttcaacacaagtttgtttttttctagaacacatatatatttttatcaaaatatatttatgtgagatcttgttataaattatagattgggtatatattttagaataaaattttgtttaaagtttgattaagagagagaaagtaatagtgcctcgggccaccttggcaacttgctctactcctgcattcatgatgcatgcatgcgacaacctcgctcctccaacgtgtccctgcatacagatgaggagcagcattcaatatttgaaaaaaatattgaatgtatgatttgtagcgtccgatttaaaaatatttcaacataattaagtatttgtgcaaaaatctaatggtataattgaaatttagatcagatatataattttggagaaaaatatttacaatttgaggaaaaaattagacacgtgtaatagaagggagagggagagagagtatgcaagcagcagcgcaagcaacacatgtagggcaggcaagcaacgcggcatggaagcaacgtgggcgtgcggcagtgcgggggtgagcgttgaccaacaagtgaaacattaagttatatatggtgaaacaaagaaaacaacaactgaaacatttaaatatttttatgaaacatggtgaagatacacgttgaaacatgttgttgtcacatatgaaacaacaagtattgacggattgaaacatatgtttttcttttatcaaaatataatcatgcgatatcttgttgtaaagatttaattacaacgaatccaacggtatgatcggatcatagattgaattagtaatttaaaagaaaaatcattttgaagcttgctaaaatacatgcatgtatgcatgcatgaggtggagagagagtagtagcagttaatttcaggaattttgtgaaacacaccgaagacacatattgaaacctatcactatcacgtatgaaacattttattctaacagtttgaaacacatgtttttcttttgacataatataattatgtgatatcttattgtaaaaatttaattgcaatgaatacaacggtgtgatcggatcataggtcagataagtaatttaggagaaaaactatttaaagagaggaggaaagaatgaaaagaaacagttagacacatacggagtacgttacaggacaaggttcgttctcacatgcgctcgtttagacgtccgatttttggtgtgatgccggacgtctgagccgtagcgctctccgagttctacatggaaactataaggactactcggatcgtatccatattagtcttcctagttctatttggacaaagggacatctatgggtataaatacaagaccccttagaaggagaagagacacacaaaccaagacaagtcagaacaaaccaatacgtcgccagatatcgacatcagagattagcctagacagactcaatctggtgcccgcggaggccgacaagagggatctaacgccgtctctgatctcgtctcgacgagctcgtattcgaggggggaagactaccctatcgtcgactatgtgttggtgatccatgccgccaagtcaacgacagctagataagttatcccaaatattgtacttgtttgattctgatgaataagagcaagaccggtttcggccaacaggagtaggattgttaccctcctatgaagaggcccgaacctgtataaaaatatttgtttctgtctcttttacctcaatctcgcatataccctggtaccaacgattcccataccatacaaataccgtagtcgtgacctaaaacgttgacaatacccaacttcaaataagaggaaaaaaaacttctccagcctaacttttaattttaacagtgtgagagtggctttagcttgaaaagccaaatgtaaaaactactcgtttgtttaagtttagtttttttttgtctcacaagctggcttataagtctaaagaaaaatagtctaaataggattatagacttatacctatgattcgtacatttatagtttagttgtcgatgatgccacatatatagtttataagcagtcaagcaggggcggagctagtgttatagcaatggtgtcacatgacaccagtggtctttggcctattccatgtactcccttctattcttccatggatgacaccaatgaatattgtctattgacactaatactcagccataattggcccattcttcgcacaattgctcaacccataaacaacatctgagtaactaacacgggcaacagctaacaagcttgttatttacaacccaaaactagtacggattgaaacaagtggatacattttgttaccacatgtatgaatatgatggaaacaattcttgaaaagaaaattaccacgtgttaatgaaacgactagtacagataaaatgtatcaaacattaatattactagagagtgtggattaatacacaagttcatcgaaattagttggtctctttaaatttgttactcgtcactattttttatgatttttgcatacatcatttgcaacatatgattgttagatagtcgactataacaccttatcgacctaaaatcctagctccaccatgcaatcaagtactaatcataagccttcagaacattctagctacctgctgccggtttccgtcgtaatcgtgaacttaaactacatagctaggacaaaaaagaaagtatagtttaataaatagaatagtgatcctccgaactaacagatttgtttcgtaggttacgcaagagtttagaagaatgcttaagaaatcgatccggtgctaatttaagtttttttttccaactatatcgcactgaaacatactccttattatcaattatatatcctcttctgataatgtttggtagtaaggtgactaacttagtaacgtacccctaaactctgcaaaagatgaggatagagctaactgtccattcaatcattttttttcctacctgacatactgatgatattcgagatcttgaaggcaaaatcaaattcatcaaggccataatcaaaaataaaatatacatatgagatggcacaaatgaaaaaacataaggccattctcagtgaagcgtcatttttgtattttcaaaggtg

SEQ ID NO: 103341 - DNA, 770 bp, Oryza sativa
ttcaaatttttggaccaaatcttgtcctaaatgacagatatttatgactggagggagtatctgtctatcagtgatgtatgtatagaaactagagggtgcagaatagaaaactaggatttattgatttatttgcttgattattagaaaaataacaatatactgtaaaacttctccacactattgaaattattgccatgtttctcttaccgctagctaagtaacgatttgctttggagttgtatatggagttaccacaaatcaatagtgtcccaactaaggccccgtttggcaagtcctaaatccccacccatccctggggatgggccaggaaatctgatggtgtgaggattaagatccatcagtttttttaatgaaatcactatcgcctctttctatgatctcaaatttaagccatacaggattaaacactactactacttgttttgtggaacatttaaagacccatgcaaaataaacaacttacatgtgccgatggccacataatagccaaactgattatataactcttgtataagactttacagtaaaactgacttacatgctaataggtggattggtgaaaatgttgcattctaatgttgtaaatgaaaaaacaacttcgcgaacagttttctctaaatgtaggacaattgtgccaatgtattctcatgccatcagcactgttttaaaacacagagttcatgggacaaagcgtgcagtggagattgacagcccacaacaaatgtctcctgatcaaccatccgatctac

SEQ ID NO: 103342 - DNA, 3480 bp, Oryza sativa
tttcaaccttctagttctggtgcaagacaccttattgaaaattgaaccaagagctcattgactaatgactagaatctcggaacagttcaacttctcataacatctggtgaactaacagcccccatcccctttcatgcgcacttcgatcctacttcctccgtttcacaatgtaagtcattctagtattttctatattcatattgatgttaatgaatctaaatagatatatatgtctagatttattaacttcaatatgaatgtgggaaatgctagaatgacttacgttgtgaaacggagggagtactattttgtttttcccatccatccttaatcaacactaacaaatgtgtgagctccacggcattaaaaatctaacatgcaccattaacccgaagaagaacggcaggcccttgacgcaattgaagttgagaacgaaaactaattgctggtctcgaatatgatagcggagtgctcaaagtgcgacttgtaatgtgaatcccccggtcattggggataggtcaacgaagccgatagacaaaagacatgttcgacgaaacgcgggcaagggagtcgagcggatcgaacggagcggagcgtaccatcttacggagaacccggtcgtagtgggagaaaggtgagcgagggcgaggagcgccgcggcgccgccaccggcaagcgcgcgcttgaggaggaggtgcagggcgaaggccccgggcgcctcgacgcggtcctccaccaccaccacgcgcgctccggagcccattgcctcgctcaggaggtccccgcccccgtactcctccatcggggccttggagggctggaccctgatcgccgcctcctcgctggcctccgccgccgtcttcaaaggccccgccgcaccttccctgctcccttcaccgtcccgttgtgctcgccgccggtccgccgccgccgccgaatgacagaggaaaacctaccgcgagcgcgaggactccacgccgccaacacgatggcccaggcacgagacgggcacgcctcagtagacgggccgttccggcccacgtgctcggcaagcagcccaagcacggcccaagagcttcaccggccgggccgtgtcgacctgggcacgacgggccaaaagcagcacggcagcccgtttagcccgcaaaatatatatttattgtaataataaaagaaaagacaaaaacggaaggtaaaagaataaaaaatgagggcgaatgggaaaaaaattgggagaaattggaaaacacgggaaaagagaagatatagaaaaaatagataaaaaatatactcccgttataaaaaaaacttaaggatgaatataaacatacatatgcccatattcatttataggaatagactctttttttttttgaaacataggaaatagttcagatttttttaatggagggtgtacatccctatgatcatagaggggtactaaataatatatagtgggctagtagtgaattaggatcgttatagtagcttaaaagggatcgcagacactatattctgatattatgatagaggatgaaagaagtactcggattttttagtttattgtgtatatatcatgagttcaaattctattaagtccaaattcaatgtagaaggtagaaataggcatgtatgtaatactgtaattaatatttagatcttgttgattcttataccaaccaatatttgtgcattgatgagagtcagctgcggaaaaaaaacatttaactttagctttcaattttcaactctagtaaaaataacgatttttataacgtcgtattgaataatcgttactgttattattaagctaccgtagcatttgtaacattacaagtcgttatttggaagtttttttacaatagcggtagcatccttacggatgctattgttgatataataagtcatctttatccccactatttagtattattcacgtgattggtattactactgcaagtgataaaaaggagttggagaggagcaattttttttattctctctcatccgtcaacattttttaagactaccggtatccttcgatattgctgcacctttgcactgaacaccccccaacctctctctctctctctctctctctctctctctctctctctctctcttcccccgtcttcttccatcgctgccgcaacggcgcgcgcttgcgcgtcaggaggagaagtcggcggcggccatggggagctgctctcatcggagggcggcaacgagagcaggaaggagtccgcggagaggccacagatcacaccggacgagacggccgcctcaggtaattaatgctacggcctacgggctctcctccccttgctcttgacaccctctgcttccgcgaacgtggcatcggttcttggccatagcattgcttcggaatctgatttcggcgctaattaatttcttggtttcgagtttcgacccgtttatgggcgatgactggtcgagcttcgtggttttctgacttcctatgcgagggttcttgactcccttcttggattcaccgggcgggcgatggttgctggctctcgcgcgatcaccgtggttttggattcctccccttatctttgcttcatcggttatgacttgtgatgttcttaaacgtatattgagatttttgctcgttagcatcaaggcatggacctgaattctttttatttctggaagttggaacttgggatgctttgaaccttctaaaaaacagttcagaaggcaccatgatttttctattttctaatccgtgctatgtcgcaagtaatcagattttttttttggaaatttagatagtccgtttaattttcttgccgatggtgtaactaatgtcgtggaacgtgattctgggcattgaattgccctttctttcatattatggtttgcctgtgctgttctgattttctttgaaaggtgttgaaactctttacttgatttcttgccagtggagtattgatttcgtaaagaaatggtgtttgggcattggcatgattttgtcctgatctcctgagtaaggttctccgcttgggtgtttcttgtcagctttcactggcttttcttggaacggtgggagtaatatcacaaaatacgcgtgttttacttttttgtctgtattgctttcggttgttttgataacaatactagtagaaatacttttactttgtcttatatatgttaatgttattaccttatgttctgcaatcttacaatggtttggtttaatttgtcttctttctcttgttgaatttaaatagctgacaccattgcattagtgtgcctcatgctcatctgttatcattgtttctgcagagatggatgtgaatttaaataccacaaatgctgattccatctcgaaccatggtatggagaggcttattcatggccagtcattcacctacggggagctgtatgcggcgacagggggcttcagtgacgatcgctttctaggagagggcgggtttggccaggtgtatagggggg

SEQ ID NO: 103343 - DNA, 690 bp, Oryza sativa
attggtggaatttttcccaaaccttgaaactgacttccgtaatccacagacgttgactttgctttgacttgctcttgattcaaaccacaagtattttcaagaaactggcttgatctgtcccatgtctggattgcagctgttcctgatgctgcttctctaggctgaattgttgacctacttcatggatgtatcttagaattgaatctgtcgacttgagattggggtaactctgctaatggctcgcagctgactcctttaattactaaccaatctactacactggttgttccctcaagtaaaacgatgacgagttaaaccaaaattcatctctgcgacctacccccccttacagtgggtagttatactttcgcctgactgggaactattgaactattctccttggaaaaaaaatcaccgacacttctcgaattacgaagagccctgactttgaaaattgaaaacttgaccagtcaatcaaaatgaagcaatgacggtgctctttcatcccggcaagacctggaacttaacccttagctgaggataggaaattccacataaaggcgactctcacttagctcatgagcatactgactcttaactgactttcccatcagttctaactgctggcatgactgtccttcttctgacctgacttcggtgtcgtccacctaaatgggttgtgtagttgat

SEQ ID NO: 103344 - DNA, 611 bp, Oryza sativa
acatcggctcaaatttagcacaaaaccgataccacttattaccaatatataatttgatatactagttctctgtggatcattgccctttaatttcgtcctctaattctagttcactgtggatcgttgtagcaccctagtttccaaaacacattgcagttggaatattaattaatctaccctcttctaattaactggcaccaaagataagtcaatcacagacaaactatgatggcgtgacgtgaacttgaatagaaaatgacagattaactaactagctggaggaactgcctagccatgccaaaaatatgatagtgtattatgccatcctgaaaatgacttaataatacaacatatactctttaagcacagcagctgtactctaatgtcgttggcatatttagctaacttaatttaggcgaagagtacaaatttcacatcatataataagtacaacatcatgtttgcactactggagaagtgctcatctctcccggttcgcaacccctttactcccgggtagcgaaccgggaggaagaatccgggactaaagatgagatggcggtctttagtcccggttcaaatacccgggagtaaatctccatctttagttc

SEQ ID NO: 103345 - DNA, 2109 bp, Oryza sativa
gctttgcgggcacgagaccgcgcgttgtcgcgctttgcgcgcgcgggaccgcgggctgtctcgctctacgcgtgcacgagggcgagggtatcgagggagcggcagtgggctcggtctcgcggtacgcatgcgcgagaccgccctcggtatcgcgctccacatgcgcgagagcgaggagcgcagtggggcagcgctgtcgcgctttgcgggcacgagaccgcgcgttgtcgcgctttgcgcgcgcgggaccgcgggctgtctcgctctacgtgtgcacgagggcgagggtatcgagggagcggcagtgggctcggtctcgcggtacgcatgcgcaagaccgccctcggtatcgcgctccacatgcgcgagagcgaggagcgcagtggggcagcgctgtcgcgctttgcgggcacgagaccgcgcgttgtcgcgctttgcgcgcgtaggaccgtgagctgtctcgctctacgcgtgcacgagagcgagggtatcgagggagcggcagtgggctcggtctcgcggtacgcatgcgcgagaccgccctcggtatcgcgctccacatgcgcgagagcggcggcgcttttcgcatccgacagcaccgacacctttatttcccatctctatttctttttgctttttgcacgggttctagccatctaccttagctttttagggagaggtggaagagctttgtgcactctcttatcagtttattgttgtagtcacgtcatgccggccatttgtaaccgctgtagcgttcgaatccaatgcgctcacggggttaaattgagaggagaggagatggtcctcatagagaaagacagaagggaatgaactaactgaggaggagaggaagagcaagagaagagaggaggcagtgcatgcagtggagagaaggaaaaaaagacacgtaagttgattagttttctattagcacaaattcgtacaatgaggatttagaaaatattagttcacgtagttaatatttgtttttaattatgttacagaaaaatttaggtatgtattagttactactacaatatattttgttaggtcgtatgtaaaaatagaaatgtagaaatttaatagagtagattcaggttaaaaaataggtagacataattaatttataaggtacaaaagtataatataagttataattaatttgtacgtagtagtaattataagttataattaattagtagttcatgtgatgtttaattttatatatacggccaatattatatgtaacaaatgaaaaaaactgaaatattaatagttatatttgtagttattgatattgatattaatagtattgataattattaaatgtggtacaaatattaaattaaagttgtaattaatttgtagtaatttaaagttacaattacttagtagttcatgcagttatttattttgtaagaaatggaaaaggtataaatatttgttaagtagcgggaaatatatgatgtgcttaaagacatgcttaacattgtaggtagttacgaatgaacaaagaaatgcagtagtacgaagaactttgaaattgggacttttatatgagcaaattggttgaaaagaagaaggcaatagaaggatggtactataatggagacagtttgtaattaatagacagtttgtaatttatttggtattgtaattaaagtgcagttaaatatatttatgtcgctgcaactagttttatactataataaattggtagttatgattaatttgattatgtaattaatcaagtgaagttgaacttagttctattaatttatcatgttatgattaatttatagataattttgtactaactgatagttacaaatatttcgtatttaagtaaagtttcggtccgttagataattaatagttaaagttgtaatatattaaatgtactcatccaaatttgcaatagtagtattgtttcagaggtcatatctaagtaggtacaaacagtccgtagcaaagaagatgatgcggctcaatgagtgtcattgtcctagataaagaatagaaagaggtaaccaaaatgatttttaacttagcttccgtcaatgttttttcggtacaggtagtcatttgttgtattaaaattaattg

SEQ ID NO: 103346 - DNA, 640 bp, Oryza sativa
cactataccatccaaatcctgacacccttaccatgcccgaagtttggtactggttaacatgcacattttctttagatccgggtatatatagtgttaacatgagggttatgtggagccgatcggccaacaacataagatgggagttaaaaaatgtgacacggagtaaggcctggcaggattggctcgctggctgtaggagacggggatatgaatatgtcatgctggttcaagcatgtcaaggaagagtccccacgaagagcgcagcggggcaatccagcaatcgtgaggagttggggtatagttcacacgaagaagatgaagttgtagctccccatcgtggtggcgatgttggtcctgacattcaaaatctatccatacaaggagatgaagtggtcaaccgccattctactggtgaagccgatgaaggggaggacatacctgctatagttgaagaaattgagagggtggaccgacatgcagtcaaagatgaggaaaacctcggtgctaaagagaatgatgacgaagatgaacaagaagttgaggaagtacctatgcctgcttcgtggaaccttgaagaccctagttatattgcagtaaactcttgtcatgattcaatatggttctacggggatggccaaat

SEQ ID NO: 103347 - DNA, 1100 bp, Oryza sativa
aaaatcatgcaggaacatcagattccagtttgtcgacattacaataaacaactttcagttccaaaccttatattaggctttttcagggatattacgttctgactatatgttggagatgtatgagaataaaatctgccctgtaatgcaatgggatataagattaatcaagcaaatacctctagatggcatgcataagcaaatgcaccagcaataatagcttttcttactgcctgcagaatatcgagatgataatgtgtttagcatatgcaaatcaaagcttcagtaagttatggacttatggtattagtaacatggaggaaaagaattgtaaacagaacttaataaaataaccagctctaagattgaaacaaactaacaaagatgtgggccaatggtagttgtgttagtacaaatagtggtttgctcaggatatccccacttaatacatgtatttacatatactctttgcatttggatatattctgtgttaacataggattacattattaatgaatcacctaaatagtcaaaactaatattttacaccccaaactatccaagtataaatgcattaagtattaaaatgaggaaaaattatgttggctagaatagaataactgccacagtgacattatcgaaagatgtacgagacattgggataagcaaaataatggcttcaataataacaccgtagaaaagagactataagtgatttctcaaagagctgcttagaggagagggtgcatctatagctgtagcgaaagacgtgagagttaattcatctgaatgttccaaggggaaccctaacttcaatttaaagataagagtgcaatctgattttgtgcctaagggtattcttcaggtgaatattatcacatgaacagttcctccctgtacattacagtggaattagagaatacatttgagagctaatgttctctaagtaccaaagcaaattaatgaaaacgtgaatcctgtaagtaccaatacaaattaatggaaatgtgaaacaatacctccatatctctatcacatgatgttagtggtatgccaaacctcttgataatcctgacaagctgctccctgatgtcaataacctt

SEQ ID NO: 103348 - DNA, 1789 bp, Oryza sativa
ttccccaagtcgatcgtactagctagctatagcctgcagctgcagtgtgattaaaaaggtggactggagagatggggaaagtttggacgggtgaaaattggccaaaccggagttcagttcctagtgtacggtaaacgtctcaccattcacgtcacttttaattatggtcggacttttcatctgcctttagttcttggtcattcaattaaaaaaatgtatagtagtagtacataattttaccatgcatggacccaaattagagtgatttggacgatgcaacatttagagcatcaccaacctcctattccatccctaaaaccaatttgaagggattttagttaaaaaaaaaccacttcaagaaatcccctactccttcccttcccgaaatcttctcactgttgatatgcgggagagcgcgcccccttgcccactcccaatctcaccgctcccagtccctcctctctttcccgcacgtcagatggaggatctcgtgcccaattccacgcgttagatggatgaaaacaagagaattttgttggtagtttaacagaagatagtttgtcacgtttaagatttgataaaatttaatcaacttgttaggtgtttggttataatcatagttgtgtcaagattctgttccaacaaattggatctcatgtgttaataacttataaaagtgtgaaaaaaatactttaggcttagtaagttatggctaagaatttgatatcatattttaatgacttaaaaagatgtggtaagattcctttagtcttagtaattaagttgcggctaagaatttgatcgtctcaccttagatgaagtgtggtaactgacggtaaagtgtggctgagaaccaaacagaccctatgtaacgtacctgaattctaggattaaggaatttccatcaaaactagttgaaagggaagttcttcaattttgtaaaccaaaaatttctattttaaacctaggtggagttgatccaactcttgcaagaataaaatttgagaaaaaattaaaaactttttcacctttaacctaggacttggatgcaacccaagtgaaagcatgcatacttgcataaatcatattttgacttgagtccttcatatgcatttggattttcgatttgcatttcataataggtctcatgaatataattgcaatctagacaaacaactaaaccattagggcctagtgctaactaatggaaaataatacacagaaaccatacaccttaaaaaaaatcaacatggctaatgtcaagcctcacaaaactaatttggacatccatctgaagacatgtcatgaacatgaaagtgaacaaataaattatatcatatagggtatattctattttaatcatctctataagcattctcttaatttaatactaaagtaaacttatgcataaatagggaaggagcttatgacatgtgtaaggtaaactgtaattctaacatatcaacatcacctcatgttaatgagagtccaaatataacttttataaacattttcatgcatttaggaaagggaaacacatataagacataagtcctgcgaattatctaaaataattcatgcaagataaaatcatgggaaaattcatgtaggctctactcaacacatacaactcactgtaattttggtataatttaataactaaatttggtacctcaaataaattagtcaaactaataaaaactagattaactgtagttcttaatcggctcaaaccatactttgtctaaaaggcatttaactgcataaaagtgtataagtaaaataattt

SEQ ID NO: 103349 - DNA, 1399 bp, Oryza sativa
gcagcttacaatctgatcagtattaattggtcaccggccagttatgactgtggaacagctcggatgcagttgatcccttagagcaaatacaatagcagactataagttagctataaaaatataaaaaaggagagataagagcagcgggctacagatttgtagccagctgtagcacagaccccaagatgtatgcgtgtatgataggtgggaccagacattaattatatagtacatatttatatgtaactattgtatgaaattagctattaaattgacaatagatgatttggagccaatagttggttatactattaaacttgctcttatgcgcataaaaatgtactacctccgtcctaaaaaaatttgcatttctagctctaaggctttgtcccacaaaaattgtatttctagccatgtggggcccagcaaattgattcatctagataagtttccttaagttctctcagcttgtaatttaagtatgctaattatatgggttaattctctcaaacttccttttaatcatttgtatatatgaaatgtgtgcatgcaattggttcattaaataaggtcattgtggtcattttttaatcctactgttttgtcctaaattagctagaaatgtaatttttatgggacggagggagtatgaaaaatattcatatataagcatgaaacatgtcatattgtttgggtggaattcagcatgaaaatacaataattcacaaacaagatatgcaatctaaagcgaaaacaaacaagcacgcacaatatctttactcaaatgcaaaatagtcattcatatattttttttccatgttttaatcttttattttgtacttacattcatatcaaaattagttttttaaaatattcatacattttctaaatcttacttccccaataagctagatacaagtttggaaatcaagatgacaagacattctgatctctagaaagcatacactgtttgccatgaatggatactccctttagcaggtcagtaccatgcaattgacatagtagctatcagttatatgagcagtgaggttcagaaacaagaaaaggtaccatgcatctgtgtctagtgaacagtgtacaccatatgtatgtgccacatctatctatctataataaaagctaacaaaatacggatgagatctagcccgtatcacttgatatgagatgtacttgatagtgcagtggtaagaggtgtgtggttttaatcccaaggtcctgtgttcaaatcataacatacatgctcataatttcttattaaatttttttcggaggaacgtctctccctccaaatctcatttttttaagttgatgcctttagctatagactccttcggcccataaatataaaggattctaaagagattaaggataagaaaga

SEQ ID NO: 103350 - DNA, 1045 bp, Oryza sativa
actctctacctaattctaatgtacaaaagttactatagagcctcttgtaattcagcttaaagttgtgtgttgtgaatgagtgagaggagctctatttatagcctccatatgacggttacagctatgggaaatgaccaaaacaccctcaaccgtcattgggaatgcatcagaagcatacacgtggaaggccgggatgaaaggagcttgtggtggttcgaccgaaccctgggccccacctcctggattcttctttggcaaggtcactgactggtgggccctgttggcggttatggcaattatgacccgttccatgacggttgcacctgtcttgtgggccctccaatccatgtgctcgcgtctaattggtcggaagtgtgtttcctcgcatgattgttgtgttttctccttaaaatacctacatacgcatatttcaccaacattagtagaaatgattaataataatcccttccactaagttggataccatgttttatttcattatatgcaagtattgacggtcaaatattatgatttaaggaccgtcaacaacacccccacacttaacctttgcttgtcccgagtgaaggctatggactctacaatatggttatgacttccttactaataatcatgcaagcaaattattcaaaaccatacttctacttgtggatctttgtagtgtttaccatgcgatcttgggcaattgagaaatggaacaatcttgactcaagtcaccctaactttttatgaagaacaacttgggaggtttttttttcaagtaacacaaaattataactttgctttgctcctcaattgattctcttgatcactcaaggtgtatgattcctcacaaaggtataagattgtgcccttttcttttcctaccatctagtaaggcttatgtggagttcagggtatcaaaaagagtagagcattacttgcatcacatatattgcaaagtcaaataatggatccacggaaatacaagacatactttctggtcaagaatgtgcatgtgtatgtgtaatttgtgggtggaaaatgg

SEQ ID NO: 103351 - DNA, 1565 bp, Oryza sativa
ctctcattggttgtggtgaactgatatgcttataatgttgtcccaggaaacctgcattggttcctttttaggtatggtatatgacaattaaacataataagatgatccaagaaatcctaaacaatttaatgaatactagcatattgcccatgcgttgcaactggattttaattaattaaaggaaattatcattaacctgttattaccatctcttaattgctgtatatatttgttattgacatgtggaccctttagtcccacactatcctttttccttcctataaaaagtagagagttggtggaagtggttgacatgtgggtcctctagccccacatgccatttttcctctaaaagaaaattgggagttggtggtggggttggtggcagaagaacatcaccactactaccttttataaggagtatagattgctatatgtgggaggacataaaaaggataaatgggaccaaaatatatgctttcagcctcctatttctatctcatgtcctaaatggctaaatgtcattccatacgattgcaagttttctggaagtacatgtgacttaacgtgttccacacagagttattttagaaactttggaaatttctaatgccccaactgttataataattgaggatactgttatgggcagggatcaaaaggattgccaggcagtctgtctactggctgctagagatgagaaataggttggggtgtagggaaggtgatgtcaaatagtagtgaggataatcaggcaaagagtagtgaacggccaaatatattttttcttggtactatttttcgcctgtttatctcccctacatagtttgtggagtggttctcatgattttactaaattgatgcttttcagctaatatttcccacaacattcccccataaaataatggttcagatttgtactgtatatgttttcgctttatgtggagttggttttggaacaaaatcatgacacaggaatagttgattaagtgctgagtggttaactatggtccggtttgttgtctcttctaggaaacttatttctcagcttcttgaaacacaattgttgcttcatgtgaacattaccttccaaatggatcggaaaatgggtgtatacctgtatgcaaggtttttttaataattttacaccaaaatggttgcatgcaatgtgaatatcagtattaaaagcaaacctatttattccctgtcccaagcaatatctgtactggtttgacctgcattatgtgtatgttgtttctttcacttctttttatttgtttgtgcgagtgttcctaaaccatgtcatgccatgtggtgtgtttttcaatgttctgaatattttattcagctgacacatggttttgctatttaacttatgattggaatcgatcctcccctttacttttgatggaatgatggctaaccatttgataattgtgttgtgaaaggtacttgagacaggtgatgacttaggagaggttacagaaactgttgattactttgttcaagcaagcaccattgctgctggcaacttgtttgggagggtatacaactgctaatatttc

SEQ ID NO: 103352 - DNA, 795 bp, Oryza sativa
caaacacgaattgctttcgttgttatttgttttttatttgtccaaacttcggtcaaacttcaaaattctagtccaccagtatatacttatcgcatgcaatttgtcatattgtcaagtagtttggaggaagtaatgctagaaaaaaaaagaatccttttgaggaagtagagatcaaataagcatatgatggtgaagtgcaatacctattttgctttcatatggctttagaggacacagacatgtgatgatttcctgatagatgaagatagaagttagcaatctggtgctttgtatgtttaggactaagctggtgcatagaactgtgttttaactattgggactgattcttatttcagttctagcctatgaacttgtgtgagatttggatggattaggtttaggaaaggcttttggaagtaaatttgatatggccagctagacgagttgtatatgtcatcttaattgcacatcaccaattactgaaataattaaatacatgtcttttttgtttcgtcgtgcagattattgtacttgtactctttctgtgaatgctcccagtatatttattagctcaagtgagcgaatcgctgcctgtacactttatcgtgacagaggtcctgaaccatggctgacaaagacacgtagtgatgcatggttatctactggtattgcggaggcaattgatggcaatggtacttcatctcatgatcaatctgatatatattgtatcatttgctatgaaagcggtaaactggaaatttttgaagtgcctagtttccgatgtgttttctctgt

SEQ ID NO: 103353 - DNA, 1880 bp, Oryza sativa
ggtacgttcgtggcaaaaaataacttcgtcattcgcgcggcgaacttttgtcaattaatgccaatagtggcacgtgtgggtgcgatgtttttgaccgaaatgaaaaagttcaaaaagcaccaaaacctgatttttggacatattggagtgtattgggtgcgtttgtggcacaaaatcaattcgtgattcgtgcggcgaacttgtgtcaataattgccaatattggcacccgtgggtgcgatgttttttaccgtaatgaaaaagttaaaaaagcaccaaaacatgatttttggatatactggagtgtcttgggtaggtttgtggcaaaaaattacttcgtgattcgcgcggcgaacttgtgtcaattaatgccaatattggcacacgtgggtccgatgtttttgaccggaacgaaaaagttcaaaaagcaccaaaacatgatttttggacatattggagtgtattaggtgcgttcgtggcaaaaaatcacatcgtgattcgcacggcgatcttttgtcaattaatgccaatagtggcacatctgggtgcgatgtttttgaccggaatgaaaaagttaaaaaagcaccaaaacatgatttttggacatactggagtgtgttgggtacgttcgtggcaaaaaataacttcgtcattcgcgcggcgaacttttgtcaatttatgccaatattggcacacgtgggtacgatgtttttaccggaatgaaaaagttcaaaaataccaaaacatgatttttggacatactagagtatgttgggttcgtttgtggcacaaaatcacttcgtgattcgcgcggcgaacttgtgtcaattaatgccaatattggcacacgtgggtgcgatgtttttgaccgtaatgaaaaagttaaaaaagcaccaaaacaagatttttggacatattggagtgtcttgggtacgtttgtggcaaaaaattacttcgtgattcacgcggcgaacttgtgtcaattaatgccaatattggcacacgtgggtacgatgtttttaccagaatgaaaaagttaaaaaagcaccaaacatgattttgggacatactggagtgtattgggtacgttcgtggcaaaaaataacttcgtcattcgcgcggcgaacttttgtcaattaatgccaatagtggcacatgtgggtgcgatgtttttgaccggaatgaaaaagttcaaaaagcaccaaaacatgatttttggacatattggagtgtattgggtacgttcgtggcaaaaaatcacttcgtcattcgcgcggcgaacttttgtcaattaatgccaatattggcacacgtgggtgcgatgtttttgaccggaatgaaaaagttcaaaaagcaccaaaacatgatttttggacatactggagtgtattgggtacgttcgtggcaaaaaatcactttgtgattcgcgcggcgaacttttgtcaattaatgccaatattggcacacgtgggtgcgatgtttttgaccggaatgaaaaagttcaaaaagcaccaaaacatgatttttggacagattggagtgtattgggtacgttcgtagcaaaaactcacttcgtcattcgcgcggcgaacttttgtcaattaatgccaatattggcataattgcacacgtgggtgcgatgtttttgaccggaatgaaaaagttcaaaaagcaccaaaacatgatttttggacatattggagtgtattgggatgcgttcgtggcaaaaaatcacttcgtgattcgcgcggcgaacttttgtcaattaatgccaatattggcacacgtgggtgcgaagtttttcaccggaatgaaatagttcaaaaccaccaaaacatgattttggatatattggagtgtattgggtttgttcgtagcaaa

SEQ ID NO: 103354 - DNA, 603 bp, Oryza sativa
attccggtcaaaaacatcacacccacgtgtgtataccaatattggcattaattgacaaaagatcgccgcgcgaatcacgaagtaactttttgcaacaattgtacccaatacactccaatatgtgcaaaaatcttgttttggtgctttttgaacttttccattccggtcaaagagatcgcacccacgtgtgtatccaaatactgccattaattgacaaaagatcgccgcgcgaatcacgaagtgactttttgccacgaacgcacccaataaactccaatatgtccaaaaatcatattttggtggtttatgaacttttgcattccggtgaaaaacttcgcacccacgtgtgccaatatatgccaatattggcatcaattgaccaaagttcgtcgcgcgaatcacgaagtgattttttggtaggaacgcacccaatacactccaatatgtctaaaaatcatgttttggtgctttctaaactttttcgttccggtcaaaaacatcgcacccacgtgtgccaatattggcattaattgacaaaatatcgccgcgcgaatcacgaagtgactttttgccacgaacgcacccaatacacttagaatatgt

SEQ ID NO: 103355 - DNA, 1610 bp, Oryza sativa
agtgtgttgggtccgttcgttgcaaaaaatcacttcgtgtttcgcgcgtggaacttttgtcaactaatgccaaaattgatatatgttggcacacgtgggtgcgaatttttcaccggaatacaaaagttcaaaaagaaccaaaacctgatttttggacatattggagtgtattgggtgcgttcgttgcaaaaaatcactacgtatttcgcgcgtcgaactatggtcaattaatgccaatattggcacacgtgggtgcgaagtttttcaccggaataaaaaagttcaaaaagcaccaaaacaagatttttggacaaattggagtgtattgggtgtgttcgtggcaaaaaaaatcacttcgtgattcgcgcggcaaacttttgtcaattaatgccaatattggcacacatgggtgcgaagtttttcaccggaatgaaaaagttcaaaaagcaccaaaacaagatttttggacaaattggagtgtactgggtgtgttcgtggcaaaaaatcatttcgtgattcgcgcggcgaacttttgtcaattaatgccaatattggcacacgtgtgtgcgatggttttcaccggaatgcaaaagttcgaaacgtactaaaacattatttttagacatattggagtgtattgggtgcgttcgtggcaaaaaatcacttcgtcattcgcgcggcgaacatttgtcaattaatgccaatactggcacacgtgggtgcgatgtttttgaccggactgaaaaagatcaaaaagcaccaaaacatgattcttggacatattggagtgtattgggtgcattcgtggcaaaaaaaatcacttcgtgattcgtgcggcgaacttttatcaattaatgccaatattggcacatgtgggtgcgaagtttttcaccagaatgcaaaagttcaaaaagctcaaaaacatgatttttttgaacatattggagtgtattgggtacattcgtagcaaaaactcacttcgtgattcgcgtggcgaacctttgtcaattattgccaatattggcatatcttggcacacgtgggtacgaagtttttgaccggaatgcgaaatttcagaaaccaccaaaacatgatttttggacatactggagtgtattgggtgcgttcgtggcaaagaaatcacttcatgattcgcgcggcgaagttttgtcaattaatgcaaaaaatgttatatattggcacacgtgggtgcgaatttttcaccggaatgcaaaagttcgaaaagcaccaaaacctgctttttggacatattggagtgtgttgggtccgttcgttgcaaaaaatcacttcgtgtttcgcgcgtcgaacttttgtcaactaatgccaaaattgatatatgttggcacacgtgggtgcgaatttttcaccggaatacaaaagttcaaaaagaaccaaaacctgatttttggacatattggagtgtattgggtgcgttcgttgcaaaaaatcactacgtatttcgcgcgtcgaactatggtcaattaatgccaatattggcacacgtgggtgccaagtttttcaccggaataaaaaagttcaaaaagcaccaaaacaagattttggacaaactggactgtattgggtgtgtt

SEQ ID NO: 103356 - DNA, 572 bp, Oryza sativa
ccaatattggcacacgtgggtgcgaagattttcactggaatgaaaaagttcaataagcaccaaaacatgattttttggacgtattggcgattatcgggtgcgttcgtagcaaaaaatcactttgtgattcacacggcgaacttttgtcaattaatgccaataatggcacacgtgggtgtgatgtttttgaccggaatgaaaaagttcaaaaagcaccaaaacatgatttttggatatattggagtgtattgggtgcgttcgtgacaaaaaatcaccccgtgattcgcgcggcgaacttttgtcaattaatgccaatattggcacaggtgggtgtgatgtttttcaccggaatgcaaaagtttaaaaagcagaaaaacatgattttttgacatattaaagtatattgggtgcgttcgtggcaaaaaatcacttcgtgattcgtgcggcgaacctttgtcaattaatgccaatattggcacacgtgggtgcgatgtttttcaccggaatgaaaaagttcaagaagcaccaaaacattgttttggacatattggagtgtattgggtgcgtttgtg

SEQ ID NO: 103357 - DNA, 1033 bp, Oryza sativa
aaaaatatcaaaaagcaccaaaacatgattcttggacatattggagtgtattgggtgcgttcgtggcaaaaaaaatcacttcgtgattcgcgcggcgaacatttgtcaattaatgctaatactggcacacgtgggtgcgatgtttttgaccggaatgaaaaatatcaaaaagcaccaaaacatgatttttggacatattggagtgtattgggtgcgttagtggcaaaaaataatttcgtgattcgcgcggcgaacttttgttaattaatgcaaatattgtcacacgtgggtgcgatgttttcgacaggaaagaaaaagttcaaaaggctacaaaacatgattttggacatattggagtgtattgggtacgttcgtggcaaaaaataacttcgtgattcacgcggcgaacttttgtcacttaaagccaatattggcacgcgtgggtgcgaagtttttcaccagaatgcaaaagttcaaaaagcacaaaaacattatttttggacatattggagtgtattgggtgcgttcgtagaaaaaactcgcttcgtgattcgcgtggcgaagctttatcaattaatgctaatattggcatatattggcacacgtgggtgcgatgtttttgaccggaatgaaaaggttcaaaaagcaccaaaacaagatttttggaaaatttggagtgtattcgagtgcgttcgtggcaaaaaaaatcacttcgtgattcgcgcggcgaacttttttcaattaatgctaatattggcacacgtgggtgcgatgtttttcaccggaatgcaaaagttcaaaaagcaccaaaacatgatttttggacatatcggagtgtattgggtgtgtttgtggcaaaaaaaatcactgcgtgattcgcgcggcgaacttttgtcaatttatgccaatattggcatacgtgggtgcgaagtttttcaccagaatgcaaaagttcaaaaagcaccaaaacatgaattttggacatattggagtgtgttgtcgaaacgacaaccgcataagtcgaaagacgtgg

SEQ ID NO: 103358 - DNA, 700 bp, Oryza sativa
cacatcaatattggagtgtgttaggtgtattcgtggcaaaaaatcacttcgtgattcgcgcgacgaacttttgtcaattaatgccaacattagcacacgtggaacgatgtttttgaccggaatgaaaaagttcaaaaagcaccaaaacatgatttttggacatattggagtgtattgggtgcgttcatggcaaaaaatcaccacgtgattcgcacggcgaacttttgtcaattaatgccaatattggcacacgtgggtgcgatgtttttcaccggaatgaaaaagttcaagaagcaccaaaaacattgtttttggacatattggagtgtattgggtgtgtttgtggcaaaaaaatcattttgtgattcgcgcggtgaactattgtcaattaatgccaatattggcatatattggcacacgtgtgtgtgatgtttttcaccagaatgcaaaagttcaaaaaacaccaaaacatgatttttggacatattggagtgtattgggtgcgttcgtggaaaaaaaatcacttcgtgactcgcgcggcgaacttttgacaattaatgccaatattggcacacgtgggtgcgaagattttcactggaatgaaaaagttcaataagcaccaaaacatgattttttggacgtattggcgattatcgggtgcgttcgtagcaaaaaatcactttgtgattcacacggcgaa

SEQ ID NO: 103359 - DNA, 761 bp, Oryza sativa
cagccaactgccttacctgtatgtgatacatacataatgatgcagcaagccagcaatacagtgtattgccaaagtgttggttaaatttcgaaaataatgagaacaattagtggtaattcactaatacattgtgtgatacgtttttcaatacacattcctgtcctgcttcttccatagcaagggaatcctctcctcgctgcttttcgcgatgtctttgcgtcatgcctgtgaacagcaggggatgaagctgattctgggcagtaatgaggggatgtcacactggatggacagttgaagctggagtttgatgagtatcctaaagtgaaaatcaagaggaagaagagaggtggtcgtggtgcttcatgcacatgaaagaggggttaggtcaagcagcctctattgctgtgctggtgggttgattgggctgcaagggcataacatgcctgttggtcgatacaatgggcaaaagtgccctatctctttcctcctttaccttttccttttcttatgatggcataatggatcttctgcgccttcttgtatgcggcataacatatatcatgctgcaattatattttaacatatatgtactcaaatcttgcccctccttttattttgaaaattgtgtatcactgtcttatgtatctatataactgatatgtgatactcaggttataatgcaggaaatttagcaatttctattatttcattattgttgagtcttttttctgtttttttttgcaggcggcgtgtcatacagg

SEQ ID NO: 103360 - DNA, 1424 bp, Oryza sativa
gggaatccagcggagcgggtagggtctcggatgtccagaattgtgggattcccctcgattgcgactgattgatttgatttgattcttctcctcccctcgtgctgggagacgtggagtggagctggagaagtcagcgccgtggatgtgggatcgatggggatgggtctcgtgctctcgtctcaccgaggattaaaagaaattgtggcgcgcgtgtggcttcgacgacggcgagaggtgagcggcgcgaggtagacgacgtaatggctcacgcactcttcggttcggtttggttttcttcggttcttcgagattctggttttttttttattcacaggagaaaaatataagccggattaatttctgttggaaaaaacaaagaaaaaccacgcaggcgttgctgcagtgcagagggaaggggatggaagtaaaagatggaagttgggaacggccaaggtgaagtacgacaagtctacaacctgagtttatctagtttttttttcccttgagtactctctcctccatttcataggctgtgtttgcatccctatgttcccagcccatctccctcgttttccaggcgcacgcaacacacactactgggccattaaacccttgcaaaaaattcctataccccagttgcttaaaacatccaattaatctatttttttaaaatagctaatcaaatttgcttaaaaaatcaaatttgcttaaaaaaatagctaatacttaattaatcacgcgctcccatcactagactccgaacacagcgtggagtactatacactttaattttttttctttaattaaattttaggcttgactaaaatttaggtcatcatcatcgattgctcatattctgtaataaatcaaaacggtttactagaaaataaaaataatttattaaaaattattaaaagtcaatacttaaaaagaaactacgttaaaaatatttaacatcttattcgttaaaaaaagttaagtgttttatagtattaattataaacgaagggagcacttaagaaagaaaactaaataaacgaaaaaaaatgttcaattattattccttatagtttttcggtttatttctgaccacctacaggacgcttccgtagattaatgacgttgaaactgtttcttaaacatgtaaaaggacatgcaaacacgtatgccacatgcgccacctacggcgtgctgcgtgcacgtctcacacatatgcttatcaagtgcgtcaaaattgatttgcaaattgcaacattcaaggacacgcacgccccatttgtcccgttggcagtgacgtgatttcgcagcgttctatcgtaaatgccagaaaactagtaatttaattttgatctgattaatgtcaacgaaaaaaaatgtgtcttatgataaaaattttcttagcatatgtttggtttcgggactaa

SEQ ID NO: 103361 - DNA, 1745 bp, Oryza sativa
catatattgccgcataaattcaaatgcactgaaactgaacaaatggagtatggacacatcaaatatttcgtaaggaacgaaacagtaaaacactgatggcttcttaataaggtaaaaaacatacttacatgaaacaccttcttccatcacatctgccatcttgcaagaaaatgacataatcttcaccgtaagtttgtccatgataagaacctaggagttacaaaacaattttatgcgtatcacattctccccttttgctgcaaggtgctataaaattattttctggcaatataaaaaacttgaacgccatatctcaaagaacaccttccatgccgattttgagctcttcttcgttgatctcaacatttcaaataataaacctatataggtgccacaatcataaacaaataaaacagtcagatagtaaaacggcagggatgtcaacaagaaccaaagaacacagtaaagaacatgtttaatctgtagcatgttgtatgtatgttcctcagttcacttgcactatgactttcaagtgccttgcttttgttatttctaattacccagtcaaactcaatagccattccatacaatgagtttttttgttatgcttgaaattcaggctatttcatgcacaaaaaacaagaaaagtcaaattgtttcaatgctggagaccatcctatgcaaagagaatcttttaaaggaaaaaatatctattatatgatggtgttgcaggttgtttggggtgatgtagcatcctatgtcatgcgtgcactgatgtcaataatgattcacaaaaagaaaactatgttagatttttactaacgagatgatgtggatgccatgtgtaaaaagaaaaaaaaatgatatatgcacgatgatacagatctaatattctcatgatagcagtgtctgccagttttgattgggccatgtggtgccccttactttccaaataaatcacagaaggaatgactaggaattaatctagaagaaaccagaaggctctaaaaatattttgaacaaaggagcaaatatctagcatagatcaacgaagcccacatgcaagttggttatcccatagtacctatcaatcatagattttattccgtcatgggcataggttttatggcatgaattccactcatcgagcataaatttataaacaaaacccaatacacctttaaaaatatcatcacctattttatcatttgatagacgatccaattataactatacacaacacatgaacactaaataatacccaagaaaagataattaaggatttttaaaactaaaggaaattaaactaattctataaaaaattacaaaaattatacttcttagtaacacatggaaacaatttgcatgtgctataacacaagcgtgccaaaaaaaacacgctgattttataattttaactcaaaacatgttaccagaaaaattaatacagaaaggacaaattaatctatgaaactagtgccagttttaatagttcagagctgaaactaaacaatattatattgaagttcagagggtaaataaaccagagaagaagctaactgctagcaagtataatagtaggctataagctggctaaatgctgagttggaggaaagaagagaggagagaggagaagcgggctgtaaacttacagccggcttggacaaaagaaccaagaaactccgtgagagagacaagtgggcactgtattaattgtgaagagctaactattgtataggtaggct

SEQ ID NO: 103362 - DNA, 738 bp, Oryza sativa
  unsure (1)..(738): unsure at all n locations
tccaggaagtcatataaaccagaatcgccagaattttctgctgatgactgtaaagagatgaaagttcaaactggtcattaaaaaaantgtgtgcacgataagagtggtgttgagaagtcaagttatcaaagtagcattttgtcttcgttccaaaggagctaactctgtttttaaatatttgatctttttttcataaactcactaatgcatatcactaatacgagggaaattgtaagtgaatagtgaatgaagataaataatggtttgagagagagatagagggtgaactaaccaatatatcccaactgcatacaatcatcaagggcaatgcgtgcatgagtgatagaaatcatggcagcaagtatcattattgtgatcacattctgcatggagaaatgtattttttccaagaatataagcccattcctctgctagtaaagttcccatgtcaacctattttactttaaaaccaaagaaactgtaaataaaaaaacgagatagagatttgcaattcactgggtacaaaagttagatgcacttctttaacattttagcagattgcttccaacatatgacatcaacttcccagtcagttggttattttacaatcttgaaaagcaatatttttctatcagtccaactaatttgagaaaaaaaattctgaatgagatatgtcaagagcagttgtgaggctgaattgttcagggatgtatggaaagcaagcttgtgtttgacgca

SEQ ID NO: 103363 - DNA, 711 bp, Oryza sativa
gaacttttgcaatccggtgaaaaacatcgcatccacgtgtgccaatatatgccaatattggcattaattgataaaagttcgccgcgcgaatcacaaagtgagtttttgccacgaacgcacctaatacactccaatatgtccaaaaatcatgttttggtgctttttgaacttttgcattccggtcgaaaacatcgcacccatgtgtgccaatattggcatcaattaacaaaagttcaccgcgcgaatcacgaagtgattttttgccacgaacgcacccaatacactccaatatgtcaaaaaatcatgtttcggtgctttttgaacttttgcaatccggtgaaaaacatcgcatccacgtgtgccaatatatgccaatattggcattaattgataaaagttcgccgcgcgaatcacgaagtgagtttttgccacgaacgcacccaatacactccaatatgtccaaaaatcatgttttggtgctttttgaactttttcattccggtcgaaaacatcgcacccatgtgtgccaatattggcatcaattaacaaaagttcaccgcgcgaatcacgaagtgattttttgccacgaacgcacccaatacactccaatatgtcaaaaaatcatgtttcggtgctttttgaacttttgcaatccggtgaaaaacatcgcatccacgtgtgccaatatatgccaaaagacatgatcagcaa

SEQ ID NO: 103364 - DNA, 701 bp, Oryza sativa
tgaacttttgcattccggtgaaaaacttcgcaaccacgtgtgacattattggcattaattgacaaaagttcgccgcgcaaatcatgaagtgattttttgccactaacgcacccaatacactccaatatgtccaaaaatcaggttttggtgcttttcgaacttttgcattctggtgaaaaacttcgcacccacgtatgccaatattggcataaatagacaaaagttcgccgcgggaatcacgaagtgattttttttgccacgaacacacccaatacactatacactcctatttgtccaaaaatcatgttttggtgctttttaaacttttgcattccggtgaaaaacatcgcacccacgtgtgccaattttggcattaattgaaaaaagttcgccgcgcgaattgcgaagtgattttttttgccacgaacgcacccaatacactccaaattttccaaaaatcttattttggtgctttttgaaccttttcattccgatcaaaaacttcgcacccacgtgtgccaatatatgccagtattggcattaattgacaaatgttcaccgcgcggatcacgaagttattttttgccacgaacgcacccaattcactccatttgtccaaaaatcttgttttgaagcttttggaacttttttattccggtcaaaaacttcgcacccacgtgtgccaatattggcattaattg

SEQ ID NO: 103365 - DNA, 1509 bp, Oryza sativa
gtggttgcggtgtttttgactggaatgcaaaagttcaaaaatcaccaaaacatgatttttgaacatattggagtgtattgggtgcgttcgtggcaaaaaatcacttcgtgattcacgcgacgaacttttgtcaattaatgccaataatgtcacacgtgggtgtgatgttttcgaccggaatcaaaaagttcaaaaagcaacaaaacatgatttttggacatattggagtgtattgggaacgttcgttgcaaaaaattacttcgtgattcgtgcgtcgaacttttgacaattaatgccaatattggcacacgtgggtgcgaagtttttcactggaatacaaaagttcaaaaagcaccaaaacatgatttttggacatattggagtgtattgggtgcgttggtggctaaaaaatcacttcgtgattcgcgcggcgtacttttgtcaattaatgccaatagtggcacacgtgggtgcgatgtttttgaccggaatgcaaaagttcaaaaagcacaaaaacctgatttttggacatattggagtgtattgggggagttcgtggcaaaaaatcacggcacacgtgggtgcgatgttttttatcggaatgcaaaagttcaaaaagcaccaaaacctgatttttggacatattggagtttattgggtgcgttcgtggcaaaaaatcactttgtgattcgcgcgtcgaacttttgtcaattaatgccaatactggcacacgtgggtgcgatgttttttaccggattgaaaaagctcaaaaagcaccaaaacctgatttttggacatattggagtgtattgggtgcgttcgtggcaaaaactcacttcgtgattcttgtggtgaactattgtcaattaatgccaatcttggcacacgtggttgcgaagtttttcatcggaatgcaaaagttcaaaaagcaacaaaacatgatttttggacatattggagtgtattgggtacgttcgtggcaaaaaatcatttcgtgattcgcgcggcgaatatttgtcaattaatgccaatattggcacatatgggtgcaaagtttttgactggaataaaaaagttccaaaagctccaaaacaagatttttggacaaattggagtgaattgggtgcgttcgtggcaaaaaataacttcgtgattcgcgcggtgaacatttgtcaattaatgccaatactggcatatattggcacacgtgggtgcgaagtttttgaccggaatgaaaaggttcaaaaagcaccaaaacaagatttttggaaaatttggagtgtattgggtgctttcgtggcaaaaaaaatcacttcgcaattcgcgcggcgaacttttttcaattaatgccaaaattggcacacgtgggtgcgatgtttttcaccggaatgcaaaagttcaaaaatcaccaaaacaagattttcggacaaataggagtgtatagtgtattgggtgtgttcgtggcaaaaaaaatcacttcgtgattcgcgcggtgaacttttgtcaatt

SEQ ID NO: 103366 - DNA, 987 bp, Oryza sativa
caatgcatatacaagttagaataataatattccactagtattaggtttactaaccttttgaagagaataaccataaagtggaggagaatcgacatcaactcagatgataaatcaatcggacgatgtcaagaatcagacttatgcatgaatggaccaagaactcagaattgacacgatgaattgggccaaaattcaccagtctatgaagtgaagcaacggaggaggccgccagccaaaacttgggctggttgggccggcccctggttcggccgaacaagggggttcggctgaacctccctcgtcgccgttggatgcagggcttcttctggacggttgggattgatccccaatgacggttggagggtattaccgaccattccaaccatcacaaccgtcattacctgcctataaaaggacttcctcttctcacttcactcacacacctcaagcaagagctctctcatattctctcaagttagtttagtattcttaagctagtggaataggaacagagtagaaatcaggagtccggaagccttcggaagagttcaggtatggctctaggagctcttctcctctcttttgtaagctttgtactttatttagaatactcttctatatacatttatggtattgaaatactttccgagtatatgaatacctactttatattatgttcatgttatattgaatatactgctagcttatctgggagatgctttggtgcgggtataatgtttgcttatgcaattactctatgtcatgacgatgatattagagtagtatctggtagtttagacgtggtgtctagattacggatatcattatttggggttatatgctgcggatgagaggtgggccgctgatggtgacagcttagtacggggtattccccacgcatgtatatagtcctaagttcattccctagggagggtattcctccgtatttagccccggttgtatggtcatgacgggctgtcgtaggaa

SEQ ID NO: 103367 - DNA, 675 bp, Oryza sativa
cccttccttatacaatttgatatcaaattttgcgaaattgataaattaatgtatcatgatttattttcgctaagttgtttcaatttatgagaaacttaatcttggattagggtgtgggtccctccctcctctcgcatcatcatagtattgattcgctataaaaaaaacataatataacacgatctatttctcctaatttgtaggcatgtaggggtgggtccatcctccttccccactctctatgtgtcaaatgaagttagaaatttcacaaagtaaaattttgtaatttattttctataatttgttttattttcagtagtagtaagacaatatttaaatggaactaaaacttttaagtccctgttacatcggatgtttggacattaattataaatattaaacgtagactattaataaaacccatccataatcttggactaattcacgagacgaatctattgagcctaattaatccatgattagtctatgtgatgctacagtaaacattctctaaatatgtattaattaggcttaaaaaatttgtctcgcaaattagcttttatttatgtaattagttttgtaagtagtctatatttaatactaaagttaagtctctagatccaaacaccaccttaagacttgaatccaacgagattagagttgagacatctattc

SEQ ID NO: 103368 - DNA, 671 bp, Oryza sativa
aatgataggacgacttccaaaatcactgcaaaatggtactactctaccctatgttcgtttctttcaaaaaaaaaaaacaagttatgtctccaccctccagtgtttgcatatgtttatatttataaactaaaatttaaattttaaaacttaattttgaagttgattttgtgattttttttaccatagtttattttatagtagtattttcttttaaatagttaaggatatgtatataaaagatttatctattaactaatttttggttcataataagtcataaggatttggtgaggcctagtaagccatacgggtaaacatatgcataagcaaaatgacgaggcctaattggctgcacaaacccaacttgagaaataaaaactgaaccgtgagactaaaaaagaacgttaaccatgtgggtcattagtagaccaacatcattaataaatggcgatttccctaatgattactcccaacggaatgtcatggccacacattccgagaaggctaacgcgcgattgatcgccgctagcgatcgtttttttttctttttctcttttaataagtttatttatacgtctaagtttatccacctaaagtttgtaaatcaaatgtttataagtcaaaagtttatatacccgattcagattcaaatttaaattcgaattcaaata

SEQ ID NO: 103369 - DNA, 647 bp, Oryza sativa
ccttgtcccaggaggcaaggtacaccaaaagttgatacatttcagagtttatcaagtggaagcgtaaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgagtttgggaaaaattgagcaagactgagtacaaccaccgtactcaacaagacacacccacaagtgcaggataaatgcaagggagtacaaggaggttataatataaagggttagagtttgtagtaaacagcattaaaagacacttagttgctcaaagctattttgtaaacacgattccagagctatacaatattattagtcaaggccgtgaacccacacgaacctgccttaacccaaggcctacgatgattcagaccgaactagcaacccgaccctgggtcccagctcgtcccaagcaaacccaggccaaccattccacattttagttgttaagcatgttttaagaattaaaacactaacttgggtacattgctcggcttgcccataaccgagggcgcggctattcaaatagattatactctgatcagaggtg

SEQ ID NO: 103370 - DNA, 651 bp, Oryza sativa
cctgcagcccaaacatgtagatcatgatttcagatgaatttagagacttgaacggcctcattccgacttcatatgaattagatatgaattttacaagatttaattccaattaaacctataaagaaaagactattccaaattaattaaaccatttacaaatgatttataactgagagaaaagattaaacaacctccagaaaagattagattatatttggtagatgacatatattaaaaagaaataatatgccattgaaaagagagaacggatagaagtctcaccgaaccaaagcgatcggagaggaagggatgatgacaatgttccgacagcaacacacggagatgacaacgctagaccaatcacgaattagattatattgaattaagaccctagggataaactacaccggtgaacgacataggagcggcggttaccggcgaaccacgacacaacaatgcaaacggagggcaccgggaggtagagaaggcgacggcgattcttaccaacacttacgacgtgatgacagacagcgacggaagacggccgacgacgagatcgagatggcggcgaggtactgtccacttcgcagctgcgaatccaatggaggcggcggcgaagcttggcgatgacgggaggagcagcagagcctc

SEQ ID NO: 103371 - DNA, 1147 bp, Oryza sativa
gctgtgatggctagctaaatcaatccgtcaaaggtgagtcacttgtgatgggcttcaatgcagatacatacatgtgatcatctgtgacgggccatcaacttcggacccgtcaaagatgtgtcacctgtgacgggttgcaaccatgagtgacttgaggggggccctcgcctgtgacggcccagaaagtgcaggaccatcagaggtgatgctcatttctgacggtctgccacccgtcaaaggtgattggagtcaccagcgatctttattcagtgaccaaggccataaccgtcaaatgtcaccgtcacatgtagggtgatctggtgtagtgagaatcatctctattttttataataggtaaagatttcacgaggatttcatgtatatgaaataacttttaggctgactgtatcttacttaccaggcctgtcataagaaaaaaaaaatctttacaacggggacaattacaatggtgatactggaagttgtaatatgaaactcttccgagaaagaattcggttcaaaagtactctttggagaaagaagagtaaaaaatctaattaaaggcacaataaataagcccaggaattgaaatcttgagccacatacctaattttctactcatcatatatgatactcgtaaccctgctgtactcatcgtcagatttcatctgtcgtcgtggtagtagtagtcatcgtattccatattttttttggcgtaatagtcgtcgtattcgtcattgtcggaatagcccggcttgttgtccattgggctccggtggcagctcatgcagcggaaagatttggagattgccgcgccgcaatactggcattttcccctggtcggtgatggtcgcttcactaccggtggcggcggcagaatcgtcggccgctgttgttttgccggagcaagccgacgcatctgcacgacctgaggtcgcttcggtgcgctcggttgcggctttggcggaggacctggtggttgttgcctctgcgtcgtcttcggtggcggttcaggaggcctcttggccgccggtggcgtcgccggcgcggcggctgtaggcttggtacgaaacaggtcttctgcccgcatcggaagcgtacacaccgaagcggcggcggcggtggcccccggcgggggatgcctggt

SEQ ID NO: 103372 - DNA, 609 bp, Oryza sativa
attcctgcagcccggagagatagggaaaaaaggctccaatatccatttctcacccaattcctccctccaccctatctttcatctaggaaacatctccatggaccacttgacagccattatacctagtttgggtgatgtaggtgaggttgcaacgccctaaactcagccaccatcttaaaaacgtgtatattccatattgacacctagcatgtcattgtcttcactttcaccatttagtgagccacttcgccactgaattcatctatcatcctaatcttgttccatagaaataaacttcaagaactcccatgtattgccaagaatgttctcttctttctttccatcgaagatgtttgatcggtcgcaaatcttctctggtgagcttcgccgcattccaaccatggaaatgtgattcaattcccctacctgatcaatcatgtctcttaacaccttgtgccaagctcgacgccgctctcagtgtccagagcgccgccgtcggccacttcgccgttccggtcgactcgagcctccgctgaccaagccattgcgccaccgacgtcgcctaggtccctggagaaggacgcgtaaagaagatcgagctaaaacgcc

SEQ ID NO: 103373 - DNA, 769 bp, Oryza sativa
agaagagaaggggtggacggccttcccaaggtccttgcgaaaccaacggaggagacagcaaggtccggcgatgacgggtggtgaagcggcaaggcttcgccggagatcaaaacaaggcggcgagctcggccttcatggtgagggtggcttgcggggttcggcgcaggggagcgaatgtcaggggtggagcttggccttgcggagccgagggaggtggcggcgcaggttggtgacggccgaggcgacggcgaacgacggctggagttggtggcggcgacggagagagacggagctcgcttggagaggtggctaaggcatgggaggctcgggtaaaagagggaaaagggagaggaggtccggggctagcaatttatagcctcaggaagaaaagatcggatcgggtttgagaggaatcaatgatggaaaagctatggttcaccggataaacgatgctcgaaatcgtgtagaatccacgcaattttattcgggaatcaaggtggtttcttggggataaggtacagcagatcaagacgattccattctcgcaaccaacttgtgaaaaagagtaatggggaggctggatttgacggaggacgcggcgtcggctagagtacacgggcactgcacgggctctgtccaagctggaaaacgacactgtagcaggagggaatgagtttaaacttttctttctttcttggaccggatgaaagagggaggccaattggactttggccgagagatggagagggctgcaggctcggattgggcc

SEQ ID NO: 103374 - DNA, 670 bp, Oryza sativa
cccgatcttttgaaaaaggagtacataaaatttaacatgaaatctggagaggttttggatgattatattgctagatttaataagattttgagtgattttagatctgttgatactgcttatgacactcattactcacaatctgaaatttctcgtcactttttgaatggtcttgatatgtctatttggaagatgaaagttacatctattcaagagtctgttgatatgtccactttgacttttgattcactttacacaaaacttaaaactcatgagatgaatattctttctcgcaaaattgattctaagtctagtgctttggtttctccctcgactactttggatgttggtgcttctttgtcaaattataccgctcttgcttctattaatgtcatgtctgatgatcaacttgaataattcgatgaggaggacttggctttggctattaacaagttgtctcgagctgtgaacaatgtcaggttcaggaaaagaggaggtcgaactcattgcttcgagtgtggagagcttgatcacatcggtcagaccgacgggaacacagcggttagaccggcggcggtggtaggaggcaaaggcgactgcagggctgttagaccgggcaagcaacaccgttcagaccggcggcataggcgcggtcataccggcgggccaactt

SEQ ID NO: 103375 - DNA, 550 bp, Oryza sativa
tccacgtgcagaggatcctcatggataatctcgacctccgggatggcttcgctttggctgaaagaatcattctctaagatcatatccaagagttcatttccttcggcggttgtcttatgtgcgaatgatcctctggcggaaatattgagatattcaacagactctttgtctaacccgtatcgaaaatgttgtaacaacatatggtcgggtaaagacaagtctaggccagactgagttaacagtgagaacctggcccaggctacaccgagagattccttcttgttctgtcggaaagagaggatgtctaatcaaagattaatgacacgagttaatggaaagaaagcagggcagaatttgcactttagctcctcccgttcatcatggaatttcttgacagacagagtgtaccattgcttcgctttatctataagagaaaaaggaaacaacttctactttagagtttcatgtttcatgcctacgatggaaaggcatgaacacactagctcaaattcccgaagatggaggtacgggttttcaccgatactactag

SEQ ID NO: 103376 - DNA, 688 bp, Oryza sativa
attcctgcagcccagagcacgttaattacaaactaagcgacgaacccgcacctatgagaatatatctcacttaagtaaattaattagataacataaaagaatctcgaataaaagacagcaaacaccgaggtacaagcaagaagaaggccgacaatcccggcgcttcaccgaaactctgttggaagaatgtcaacaattacagcactcctccgtaaaattctcgaagaaaactctgatatacgggccctccttatggagcttcccctcactctcttcctaaacccacatactaaagtaaagtataaattgtaaaagtgagttgtactctactttgttgtgcatattccaagtgagtcaagatctatgacggttgaggatggcgtttactcctccacaaccatcattgggagagcatcaggagcctacatgtgtgaggtggagatgagggaggccagtggcagttcggccaaacttgtgggccctacctctctccaccgcctttctccaatgccttacaggtggacccggttgaggacggtttggccccactttaagtaggttttgactatcagatgggcccttcaatccttgtgctcatgtgtgattggccggagattcattttcatcgcatggtgggtgtattttctccttaaattacctacatacatatatttaccaaagctagtgg

SEQ ID NO: 103377 - DNA, 1330 bp, Oryza sativa
aaccaatcctataaccatgatcaagcttgtgcacttatatttggatggaagtggaaaatgtataaaaatgggaaattggatggtgattcatttttgtatggccctcctcattatactttattttagaatgactacattactatctctcttttttttcatcatgctcaataatactttgtttcattctcttttgggcattgttttcatttttttaagctcgtgtctcatttggcatggatcataggaggagagaccattagtatcaagagtttttatttattggatgaagatggtggatgctgatttctagtatagaagtttagcgtatgataggtggatggaataccttgcaaatcctctattgtacagggagagcaatatattttagtgaataagttcacaagactttgatcatgagaatatgaaaagaatctaacaagggttacaaccatttgataacactcaaattgatggcaagcagcatatgttcaaggtttatcattaagatcgacatatagctttggtacgaatgaaacatcaatgaggagtatgtaatgttatttcattttattttattttctaaaattcctaagggttcaacattaagaacaaagttcataccattgggcaatatctcattcatcaataactcagataacatgtgatacaatgaatatgattcacaagcaacatgtgatgttcagagattaaaaagcatgtaagtccttgttgcaagcaagtcctatacactaattgatcatgtcaatactcatttttcattattgacttaatttttatttggcagaattaatcctactcaaagattaaggagaataaggataaacgtgcaaagcgacgctcatatgtgagtgtgatgacgagcagccgtgtgtgcgatggatgctacgtttcatctcgtgaatgtgcaagcattatggtgtagcacggatatgggtgatcttgtatgtgaatgtgtcgtgtgatcacaagatcacccccacacttgtttttgtacctgtggtgcttcaaatacacaaaggacaaaacaaagtgaaagcaaaaaggattcacccggtgaaagcatctccccttcaagatggaaagtgcagtttgaaccggtgagggagatcaaagtctttcccgacatgatttttagatggagtttgagggaaatgattagggttcaaggggagacggagcgaaggaggaagaggagaacgacagacgaagagaaattagaaaattgggacatcgcaatcgctggcttcttttttctctgcgagaccatcgagactaacaaggagggtccaccagaagccacagagtgagg

SEQ ID NO: 103378 - DNA, 568 bp, Oryza sativa
ccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattataattattgtatgactgtcattatgtaagaataattatttgtgtacggtttttttgactcatgt

SEQ ID NO: 103379 - DNA, 622 bp, Oryza sativa
tttgaaactagacgacaactagagctatgtcaacaagcttaccaacgtaaataggtagtggcgttcatactaagtacaaggataatcgttgcaacaattctaactaaataaaaaaatggagtccttattgcctagaagcacattcacatcatcgtcacaaaataaagttctttgatataattatagttagcatagaacacttgtcaaatttaagaagaaatcaacttgttccaactaattcagtggagcagaaagactgaaatttgaataaaaaaaaggaatgtagaaatcctaaatttgaaaaaaaaattggggggcccaaatttttgggagccttgtgcgatcgcacagcaagcacatgcccagggaccctttcccttcctatggcaatcacactagctacaaagacaacagacacaagatatacggtagagctctctcttatactaggtaatatatgttaaacatgatagaaattatgtgttgagatattgtgaaaataatgcgatgaagatgattcgacatactggtatgttgagctctatttatattctagattatgtgtaatagttgcatgagatttaagatactctataaattgttaatggatatatcatacttg

SEQ ID NO: 103380 - DNA, 663 bp, Oryza sativa
cgcatgacttgcaaaaaggagctttattaattattaccaattcctcgaggtctcccatattgggtgaccttcccttgttacatccaatccaaatataggaatgtaaggcatcagctaaagttatagcagatgctgatgttagtcacgccgctccttctctgttctttagaggaaagaacattgaattggactgctgtagtctgggtccatgatctacttgttcattgcgcacaaagatattcgatcatggaggacaggttttttgtcatttgttttcactgcatgcatgctgtacatcttagttacaagacagttgtagtgtaaatacttagtaatatcattacatgtcttgtgccctctagaactctaaacggcagttctatggtcttgatttccagctaagttaggtatgggaggcatcaagaaattgagaatgaatggccactcaaggatgatgaataagaaccccccatactagtagtcagcttggtgcatgttttcggttgcaaacatcttacctgtagcttgcatgctggatgttgctatattggcctctttggtaggctgaatcactagcagaaatacatgaatataatgatgcatgcaagggaaatgttatttcctcactatgcaaatgagcgatgatcaagcaaggctgcagga

SEQ ID NO: 103381 - DNA, 1781 bp, Oryza sativa
acttgaagatattgaataattcaaggaaagttaattggattggaagagagaagaaagcacatgtttatgtaaatagtgaaaatgaaaagctgagttctcagtactggtttctgaccagctcaagtttgcaagcttggggggaaattgagacagcctttgccctttcccatttaatctgattttgccaatcttccttttacctgcattttcttgaaattcatcagacaacttacatatgattgcaaacatcacattttaggcctcgtttggctgtttgtgtttcgatgtggaacaggccccaaacccgcccttcgtggaatgcagcccacgcctggatcaattcccacatctggcccaaatgtgcattggctgttcgtgtattgctgtgattgcggctcgatccatgccgacccacggatgagagaataatcctcacccgaggcctggaactttctcgcgtgcacgccgcagctcgcggctcctcctgcaccgccaccgctttctccaagccatccaccgcctcctcgccatcctgctgcgccgccggcgccgccgccttctccgagctatccaccacgtcctcaccatcctcctatgccgccgacgccgctgccttctccgagccgtccaccgcctcctcgtcggcctccgtcgtctgtcgcctcatcgccagcgtcgccccggcagcctactcgcttgatcaaggttcaaagtcctctcctccttctcctccttcatctcatctcattttctttgcccatcttctttcatccacttgttttgctgctaggaccttcaagatccggaaagtacagccatcctgctagggtttgacgatctgcaagagaaatattggagacgaggtatgtcaatgcttggagatatgcaaagtacagccatcctgaagggaataaaacacagtagggaatcactagcttcgatcttgtgtcagtgcaaagagattttgagcagaaataaactacaactagtagttctcctctacacactgctgagactgtaccaccaccactacatgatatacaaatgtatagcaagcagcacacattacagtattttacactaacaccattgaatgcacaaaagagcatactagcatagtagtatagcacttctattaaacaaagtgagtgttcagttcatacacatgcataattagctttaattatttatgaacatatatagtgttgaaactaaaaactagagtgctgaaaccttttttttcttttgctaactgcggtcatcttaaatattcagtattccttctagttagaaggtatgaattcgctaattaggaagagaagagatgaggaggatgaggagattattatgttctggttgcctgccctatatcttttaactagtaatggagggatagagaaaagagtaaggcatacttcaagtcagtacggtgaagaacaactcagaaatattttagagggacatgaaaagaattgccttgttgcattccgcatggagcctaacatatttagagcaatagcgacatatcttcgaacagaacatctcctacgtgacacagaggtattacggtagaggagaaacttggatttttttctttacatgatatctcacaatgcgagctatgaagatctacaacatgaattccatcatagtggagaaacgattcaccggcatattatggcggtttaaaatgtaatcccactttgacctatagatttatcgagcaacctactggagttgaaactcactggaagattagcacagatcaacagttctttcct

SEQ ID NO: 103382 - DNA, 732 bp, Oryza sativa
attcctgcagcccaggaatttattaatttatcttgtcattactcatgcatagataattgtattattgatgagaacaaagtcccaatacatttaaaaggagaaaaaagaaaatttcttggttgcattttaatttgcacattttttggaaattcaagttttgttagacaaacatcattcagaacagtttcatggaatattttaggaccaaaattttgttttgttgtccttagaccagagaagttttgattatccgatattttgaactctgtttttttaatctttctggcttttgcaacaagattttcatgttgggatggctgcttgagaacctggcagaagataaataatttcgatgaaccatgtaactcttgacaccctgaagaactactatggctaacactaatacttttaagctagattttcaaaactgcaactcaactagcagaatttaaagtagttaatacttaatagtcctgattgaactgccagaaaataaaatagtttctgttcttgtttcacatatcacaaagccacaactggttgaaggataactgtaaagaaacctactgttttgtcacctccccagtttagttgactgataacttgtaagatgaggtgatttgtatgaggtcgcatgctcaggtgctagttttatgtgccctttcagctgtacgctgtaagggagagagccacctgaggctggtgattgagtcagtctatctagtttttttt

SEQ ID NO: 103383 - DNA, 999 bp, Oryza sativa
tagctagctattctgaaaactccttgccacttttctctagttatcagcataataactatattggcattaaatattgtgaaattactaattgtttcttacatatttaatcatttctgttttggaaatggatacacaacttatatacaaattgttaagagaatttcgtgatacgctatatgtatagatatataattttctgtgtgaccgttctagatcatctgttgatgatactatgttgatactcaatcattgactaataccattattttaaaaaaggaatatagctatcacctgcgtttatatagttccagtccaaacgttggaaagcttgaaaatccacaaccactgcctgaagaatagaaccattggaatatagaccaagaaaaactaccaaaaaatactttgaaaatagtcataacctgcattctgttgacataaaaatattagtgcaaaaaatatgaatatgtagttaaatgaaattcagtgttttaattttcactaaaaagacaagacttcattactttgctatataagcaccttcaggagtgtgaaagctattaataaggtgtcctatgaccgatcctgttgggaatagtaattggtagtcgataatcatgatctacagtagaacgaaacaactcataaattatatttaagaatgagaataatgcaaaactattaagaatgataatatataaatacaaaactatactattagaaatggatatccctctcattgcattaagaatttagacatgcttgtaacatcactttacaggcctacatattaattaagtactaaatgagtaaaaatatagcaattaatagggaatgctaacttcatgtaacgtattgatgggtgtactgaccaaacaggactaaatgcatgttgaattttatagaaataactaagttaagttgattcagggggtgtttagatatatgggtgtaaagttttggcgtgtcacatcggatatacgaacacacatttgaagtatt

SEQ ID NO: 103384 - DNA, 503 bp, Oryza sativa
ctatcttaagttcctaatcctatctatcactgtctgtgtttattatgaaccgataaggatgccgactgaatagacataagagcctctctcgtctaaggcccgaagcgaaccactcgatctcactgctctattacttgtgctctctgttcccttcaacctttctgcccaccaccaacactacccgctccatctccctcagtttgatcccacacaataccgccagtaagatatatatactaatatacatatattttttttcaacaattcgtgtcacgaggaaacaaaccttgagagacaacgctggtatgcaagccatatcagtgtatgtactgcatattttggctatctagaaattttgagcagaaaaaatatagaggatgacgcaggcatatatagcttgtcgaaaacgaacagggatgttttgttttaactaattaaaccaatgtctttctgatcccatgcatcatcctatccttttcattcctgtactacttacctgttgg

SEQ ID NO: 103385 - DNA, 667 bp, Oryza sativa
aattaagagaatgcttatcgagatgattaagatagaatataccctatatgagttaatttatttgttcacttccatgtacatgacttgtcttcagatggatgaccaaattagttttgtggggcttgacattggccttgttgatatattttaaggtgtatggtttctattttaacttcctctagctagcactaggccttaatggtttggttgtttatctagatcttagttatcattcatgagatctattatgaaatgcaaaacaaacatccaaatgcataagaaggacttaagtcaaaacatgatgtaagcgagtatgcatgctttcacttgtttttgcatctatggtataggttaaagatgaaaatgttttaatttgttctcaaattttacttcagtataagttagatcaacttcacctaggttttaaaatggaaatttttggttcacaaaattgaagaactttcctttcaactagttttgaagaaaattccttaatcctagaatttgggtatgttacagttggcttgtggctttgtggctttgtggctttgtgcccttgtggcctctcccctatcctcctagggtggcttgtatttatacccatagataaccccttgtccaagtaagaatacggagataaatatggatatgatctgagtagtcctgt

SEQ ID NO: 103386 - DNA, 703 bp, Oryza sativa
cccataattagagatcccttttcagtattttctacttaatacatcaactatttgtaagtaatattttggaagcagagatcatgaaatatgaaagggtaaacaccatgtggctcttaaatttaatcagcctctggagcttcatttggttgattttctctttggcacttccagttcttgtctgaatagatgaatggatgatagatttatctgattttgtgataatatttgaggttacaaatgaaacctgggaagtgcgcccatgataatgtaaaaaaggaacagggcgtaaactagttgccactgaaattcaatcacacaatctacacatcatttagaggagtaataaataaggaaatggttcagtgttttgttaatccacagcttcaattcagaccatcattctaaccaaaggaattgcatttttgttctaagcacaggaagcccttttttaaaataaataaataaattctttcattcacataagtaagatcaagctcacaaggctaacaagaatttcacaaagtactctttgacatacatccatcaacacataaaaggataaaacaccaaaagcagacaattaactctgaagaaaacacacaaactgcaaactgtacaccatcccacaatcccatgcacatcattcttcagtctccaagaacacacacacaaaaacaaaaaaacaaaaaaaatccacatcatt

SEQ ID NO: 103387 - DNA, 760 bp, Oryza sativa
tgtatatatatatatatatatgtatgtgtatatatatatacactagaaaaaatatccatacgttataacgggtaaatgttattttgtgtttgttattgttatacggtttagctagggtaaaattcactgtgggaatttaattgtatatttttttcagaaaatcataagctgtaattaggagtccgtattttatctgaagttagcatgcgagtgttctcaaaagatttcttatacgactcattttatacttccaataggaaacaaacttaaaatccaactcaaacacggttctgtatttccaaaagcaaacgaacttaaaaacctactcaaatacggatgacgtactaaaattctggcaaaaacatcttcaatttttataatagtagagatatatcaagcacataacaattatgttgtccatgcaaaccatatcgtagaagctagctagaaatactagtgtagaacatcgtgggggtgacagcgccactatgattacttgatgtgggaacttgtacgttgtaatatgccgggggttccttagggacgtccagggcctccgtgttgctcagcatcgcgacgatcttgtctatgttcggccgatgctcggggttggcctgcacgcagagaagggccatctggacgtacctgattaacacagcgtcctcaatgttttctcctgctgatattaacgagcggtccacaaggtccttgtatctttgcgcatcccacagttgccatgcctgccaggggctgcaggaat

SEQ ID NO: 103388 - DNA, 586 bp, Oryza sativa
aaggaagttcatgtacaagtattagagtagtaattaataacttagacgtggtgtctaggttagaggttacccttgtttgttgtgtatccaccggatttggcagaggtaggcggcaggtggtgacaaccctgaatcccatcctagtaatcctccatgttcggatacatcatagagctatagccggaaccacgctggcagaccagcaggggtcggtgcccgaagcaacaaatagggaattaccttacttatcgtagataattaaaatatatagaaagtcctctctagcctagcctacctatgatcagttgttgtccttggatagtcttagccttaggtagattacacacgttccctgagttcgatatccttttgggggtcacccgaaggtgaagtgctacagcggtattccatgcgcttgcggatttatctgtggtcgtaagaaataccaacacacccgtgcaatgacggcggcgatgccacgtcccagagaagtttgcacgatgttgtgcggttttctagtgagaatagcgcttctagtatggtaagaatccgaactaataacttaatttctgatttggatttgatt

SEQ ID NO: 103389 - DNA, 659 bp, Oryza sativa
gagcttagctcttatactaattgggaatgggattatggatcacagtgaattggcgtgcatgacaggtaattcgtacagtagtttacacagtacatggtttttgatcttgcatgcctcttagtgcctatatataaatactgcacttgcattgttatgtaagtatatatataacaagcacgcatatgcattaataaatatttgaacacttgattgcttgctccgtacgtccacaagtccacaacctcagtcgatcgacgttcagatcagttcgttgtttaactgcattatggctacgtagagtggcggaatcaaattcttctaagcctaatactcaactaatgtaatttacataactttacctttaattaatcttctatttttgaagttttataatacaattctaatgtataattagaatgaggagtagggctgcagccctaattaactgccctactcctgtctccggcgcccctaataaatctgatctcggaagcaggtgacatgaaactgattaacctaagcctcggaaacttttgaccttgcactgacatgaatttcctgatatatatggcccccagcacaaaagtcgtctctctaagccgatcgatcgcgatcgaataacttgaattgtgagctgtcttccatcaataattagcata

SEQ ID NO: 103390 - DNA, 1650 bp, Oryza sativa
ttagcgctctcgagaactttttcaggttaagcaccccagccctctataagctattggtatacaagttcttgttcagttgactttacatttttcgctcatgatgttatcagctcttgtccagaggaaccgtttgtttgccaagcacttcttttgagagaattgtttgagcccgaaatgctttgtttgagagagtttatcgttgggttataggacaattacccactatcaattgtttatacacactacctcttttgagtatttttcttgtttccaaaaacaaaattggtgctatgtatgcagttttttatgagctaaaagattcccttcgaatcatgtatatatcacatctggtatgatgagacatatatatatatatatagtagaaggatataatttctataggaccataatgggacatcacttataacatgttaagaaaccacagactacgtactaatggaccgctccgttttccatgcacatgagatgggttcccaacccatagaaacaaacacagccgaaatttgtgtggaacctagcttttttcagaaaaaaaatgaacgcacgagatatagtgcaaagtttcataattaatataacaaaaaaaacaagattacaactttgggatattagaactgggaagaaaaaaacaaagcaaacgcatcaccgtcgtacattgacacctcctcacataacccagcagaaggcgctagtgccaagccgtccaccggtatacctatagaaggttcgaagatgcccctcctctcccccctcctccccagacactgactccacgcaaaagatcatcgacgagttttcagttatcctctcgtagaagggctaaggagagcgagagggcgagagagaaggagatccactcgtccctcgcgccaatctgatgatgacaaccaagaaccaccggtgaccaaaccgagagaaggcgataaaggcagggacaagacctcaaggcaaggttatgacactttaggtgctactgtcgcccgtccatctagactaggttttcacctagatagtcctaccagggagacgaagggtggccgctcaataatgccccaagaggggcgagggggagggggttgttatggtgtcttatgacatcgtcgttgctgactcaagaaaacccaagctaggctttcaccaacagcgccctctcaacctgtcattgccactctaaagttcagccacccaaacaactctaccaactcgcagctccactgccgaccaccctagacccgcctttgtcaggtcttttgtgccgccaacgctgcctcccgtagcccatgccaccgtcacccacaccggccaccatctcagtcagcaacctcctcctttcatatcaacctcaccagcacccatcacttgccgttgccgccatgccgtgaactccttgctatccgcgattgctgtcctttcactaccattgctccgctactccagccaaatccggcacgggggcaccgaatccagttgcaggggaggtggggttgaatatttggccacaacggcgctggttccaccgccgtgcaccgcgtgtccatcaccagcagctcccgccgcatcacctccacgggtgcacctcgccgacttgttcgtcgcgtcgtctctaccggtcgccttgctacctcgatt

SEQ ID NO: 103391 - DNA, 5707 bp, Oryza sativa
ctaacctagacaccatgtctaagttattaattactactctaatacttgtacaggaacttccttctttatccagagtcctagtactagagcacttagtataaatactaaacaatgaacccgcaaagatggaaatatatcttacttaaacaaagtaattaaataacataagaaataaacacgaatgcttactttatagaagaagttctccgaacccggagcagagtgtaccgacagctctggtactcctctcaaattcctcctaggaagctacactcgtcgagggagaagtcggatgagcgccaaacttccgggcactcctccagagcttcccctcactctctaccttattctaatatacaaaagatacaatagagtctcttataattcagctcaaagttgtgtgtctcggaaatgagaaggtgacctccttatataggctccaaatgacggctaggggtatgggaaatgaacaaaacacactgcaaccgccttaggggagaaatccgagccgtccaggtgaaagcagatggcgggaagggctaggattggttcggccgaactggtgggttcggtcgaactggtgggttcggccgtacccaaaaactctcctcccggcctctccttcggccgggaggttgcttattgggtccccaacaacctgggctatgttttggcccaattctaaatggtttttattgatttattgggcctctaatccgtttaaacgtgtcctagatgtgcagagatgcattttgtcgcatgacgcatgtgttttctcctcaaattatctgcatacacatatttcaccaacactagtggaaatgattagtaataatacctaccactaagttgaataccatgttttatttcattatatgcaggtattgacggtcagatattatgatttaagaaccgtcaacagggtgatgaggacacaactagctcagatataaccatgactaccttatgtattaataaactaaaggtgaatatgttctatattagatttacttattatatatttgaacaaacgttgctacacaatgagtttcatgtgtttttgtttgcagaggtacttgcttgggcgaaagaaaagagaccgagtgtaaggaatacatggataattgaagaagttgattgggaccaaaccaataccttctccaagtcttcttttatctcaccacgtcacttttggtccatagaagacaagagataaagttctacacgttttggattcggattcgggcctcctgacagcatcaacttcaaatggacctagccgctgatctagaaggaatttcagggcccatgagtacttgttggaaagcttatggagtctactttcaaatggttttggtcccatgtcaaaattcctaccgagctgccgggaatctgcaaaacaagccacgtacctcatccagtccgaatgtgatttgggttttgggccttgtaattgtgtcatgggcttagcccatgggggtgtgcgccctagggcaaccctaggacgtccctaattatacttaatccgttgccgtcatcgtttagagttgggttttgcttagattattctattaaggacagtttcaccgctagatcggtttgtggaaccccaaattcgtgtactaaatcattcatatgcaatttggttgcaatctatgttgttcttgcttgtgttattcgattcgcatgcagggattagccttctcggcgaggtcaaccgggtttcggcacgtttgataaccagaggagacgtggtgctacgattgcggggctcagtagcatgtttgttcagaagccggatcgagttgtgtcacgactccgtccaaatcgactgtttatcattacctattggaagatcgggacctaactccctcattaacgggcttgcctacgcatgcgcttgccttctccttctcatggtcacgccggttcctccatgcccgcgccatcatggagcttccccatcatcactacttcgccgggacgggaaggttcggcttggctccatcccctagccgacaaactccagagttgcacggtgcatgactgtcgcttgtgcgctcccacttcttcaggctgtcgatgccacctaagctacacagctcagcgccgcccttgaactgtggcccccagccacgaagatggagcaccacggcggaatcaactccgctagcgtgcgcactgctcgccggaccaccgttgccgctatcgtcgtcgttccgctcgctcgccggttctttggatgggaggagagagaggggatcaagagagtgattagggttaggatttctcacgcacctcgttggtcacttcatcggcgcggagcaaatccgagacatccatcagatcagccccgcattgggctgccaccaccgatgggccacagaagatcactgggccacgctcgccaccgcactcggctcgcgcttaaactggccggcccggtttttgggccagtttttagaagtaatgggctgaattgaattttttttattttaacccgccgattaaatgtttaatatttcaagaattttggttatatccctcttagctaatttaaactgctaaaaattattttgattagtaagtaaattatttctagttaaatgaaaccatgagagaagtttagctacaaaggaataatgatatgaaattattttttgaccaaagtaattatagttttatgtcaattatatttgttgttctattccttagttattttctgcccaacggtgttttgacaatgaaaattctaagggtgtgtttcggcactgctggttcccaactttctcctctcgtttttcacgcgcacgcttttcaaactgctaaacggtgtgtttttttgcaaaaagtttctatacgaaagttgcttaaaaaatcatattgatccatttttgaaaaaaaaaactaatacttaattagtcacgcgctaatggaccgctccgttttctgcccgcactgttcctagttgggcctccagtagcgaacacaccctaagtttattttatatgtaattgattaagccaacataaattagttatatgcattattttcagcaatgggacaacttaagaatggaagaacaatattgtcaattcccttgatggatctacagtctcaaaacatgttttggcttatgcttatgagccaaaatttgaatattcaaccttaaatttagagttgaatttaggttttttttttctcttttagatcgctaagaacacgtatatataaattatatttacatattacttttcgtttgcaaaaatatcatttcgcttattccgtcgataagcgaaaccatagagtccctaatttcactgaatggaagaacaatacggttttgaatttagccatgttagattttgaccagcgagagctacagtgccgcgctgcactgtgctgctgctcgctgcattgcggcgctgctgctgcttgctcacatgggccggccaaggcccaaggcctgctgctgctgttgggctgctagctagcttgttctctgggctgggctgcagctgcagctttgctctttttctttttctcttttgttttttctccctcattctctttttcttctaattatttgtggggcatcacacttggccctaagagaggatcctcctgaggaactcaatagagctgaggaagaatatgaacatctcaagtggacttacaatgaaaagttagctacttggggaaagttcaacatgatgtctttgatgtacattaagagccacatcgctcaagaaattattggaggaatcattgattctaacaacgcaaagacatacttagctaatattgaagagaatttcaaattctcatataagatttatgctagtacaatcattaacaagacgattactagcaactataatagcaaaggaagcatcagaaaacacatccttgaggtgactcatatggcacataaatttaaatctattgatatggatctatatgaaggtttcttagtgcatttcatcatgagctcttttggttctaaatttggtccatttaagatcaattagaacactcagaaagaaaatggattatacagagctaatttcatactcggtggaataggaagagcatcatagagctgaaaaacaaaagcttaaaaaccaacccaacctcgctaatgccaaccataaaggcgaaagaaagatgtatcaaggagaacgctctaacagcaacaagaacaagtcaaacaactctcagaagccaagtgggagtaagcaagatagttcaggctctcaaactaaagatgccccttttaagactccacactgccctttctgcgaggtagatggatattggcaaaggaattgctcatgtttcaaagtgtggttagctaagaaaggtaaccataattttgaagaaatatctaatgttaatgaattcctttatgttgaattttcccttaatacttggtgggttgactcatgtgacattgtgcatgtttctaacttattacagggattcaataccgtttagaaagtagcaaaagaggagcaaagcctaacagagtggctgacaaactagccaaggaagctataatgcctagaagtgttcattcaatgtgtgcttgtcaaaaccgcatcttgcttaccctaacagaaaaagctttgtaagttctctgaaaatcacttcagatcggaaaattgtatgatcgaacatgtctatatttctagttgaaataaaatcctggtttaaaaaaagaccagtactggacatgtctggaaataataatggtctatattggaattaattacatagcattcattgatccttcagtttcagcacaagtaatgtattgtcagttgtcaccaatgaagttagtcctgttgtgctactatgtgcataaatgcatttgtgtctctaaatatcgtcaactagttgagatggtcattatctgcgcaaaacgttctaatctttcgaatagacagctggaaatgtttgttgatacattcatctgctcattagagattagttgagattagccggctatcaatgttttgtatcgacaataataaaaggggtagtgtatgaggtctaaattggatggatgcggagataaagatttagataagttcaagtcctcttgatgagaggtagttccctattttagtttgaggattgtatcctctagagttgtattgatttaacgatattgtttgtgacttatacccttgtaggctcctcgccctcctttataggttgaggggcaaaggtacaggtaggaaacctagccggattcgacatcagttacctttagtacttcaagaggaaagacctagtcggggcttagggcactaccttaactggtaaagaaactctagtgacttagttttctacaattataattatcttagttatggtccacctcctaataccagtcaggtatcaggtcgtgtgggtatttggtacttataatctccacaccggctaaccacaacacaagttatccgtggatcgcttcgattcatgtatcatgttttttcatccatcgatctcagttcttgcgcttgaataagttcagtccatgtgaaaaacttgaataagttaagtcgatgtgaagaataatttttctttaaaggattcagataataaaaattgaacaagtcaacaaatgctcaatatatttcccaaaaggctcggatcatgaaaaaactcagttttcaaagaaagtggactgattaattag

SEQ ID NO: 103392 - DNA, 808 bp, Oryza sativa
tgttgaaaatgtggaatatattcttatcacttagccctctttcaaaattcaccacagtgaaatcataactcttctgcttcttcctttctatcagactgttcatcatggcttgctctacacataatagtttttcccaaatttttacaccattataactcactcaaatcgacaggtcaaagacatcaagtgattcaaaatcaggacttcccttctcttttcaactcctcacttccagacttccagtaggacttgagcccttgacacctcatgccccacctgaaagcctaatcgatctatccacccaagaaaaaccaaccagcgtccgcacctttcccctctcccccccccccctgtaaaacatgtggtgcgcatcttcttttggagtagagaacaaccctgcacgactattcaccaggccaagtcgagccttctccgtgaagactagcccttagcagccattgcaagtgggcctacccatcatctacctcacaccattctccaaaattatcatgccccgaccaaatctcctcctccattattttttctgaaaaggaagcaaagcccctgaaatgccctgccgtcccgttccatcgctgggctgctcgagaagacagagacaacacaaggccctgcaccccgtccatggaccacgcacaagagcccaccatttaacctcccatttttccacaaaaacctcttgctcgcccctcgttctatagtgcccagttgcacgggctaaactctgttgggttgctaggaacatgcacgcccatgacgaggccgacgagctgacaacgccacgaaagtt

SEQ ID NO: 103393 - DNA, 1197 bp, Oryza sativa
aatatgtccctgcttcctcaaaaaaactcacttggttttaaccaattaggcatctactagtactccctctgtcccatttttgtcccattttaagtgcagtcatgagtttatgtatccaagtgtccaacatttgatcatctattttatttgaaaattttatgaacttttttttaaaaaaagtcctacataaagtactattcatgctttatcatctaataacaataaaattactaatcataaaataatttcaaataaaacagacggtcaaatgttgaatacaaaaacccacagctgcgcttaaaatgggactgagggagtatctaactatgctcttgtgtttctaggacagcaatggaatcctatcagtcagcctccttttccttctcagtgttctttctgctgttcttaatctagttggccaatacgccactaaaagggacatcatccataccaaggagatgtgccctgctactcaattcatacagctgatagaagcaagacctgtgacacttgtcacatgccttaccacaataggacgcgatgctgctctaaagtgacgatcgcttccctgcaattggagaacctacaagatcaggtggcacagatagagcagaactgctgtgcaatgctgcatacaaggcaaaccaaaaccgcttggagatcctcctactgcacagtgccatcaaattatcaggtttcctatggaatccatcctatcggtgtcagggtggcatggtcgcatcagtattgtatggattttattttgggtccggttcagctgaaacgatgtgaaatgcgcatcacaaagaatgaggagattgttgaagtcctgtccaacttcctagagtgagcttgcctggacatagtgggaccacacaatatgggcctgccatggctagatctgggcgtcctaactggtcacttgggcaaggaagaacaggatgcttgctgaagatagcaagagcaagaaagaggaacgagcaagaaacagtgagttaggttaaccatataagtaggatccaaggtggactcatgtgatacaaaacaaggtctattggttagacggacatgtttttcttggttttcagatttgagggacgaaatttagctggttttggaactgaggcacaaaaataaacaggtctaaagttgagggacaagaaataagatgcacctcttcttcattgcaaggcaagt

SEQ ID NO: 103394 - DNA, 1926 bp, Oryza sativa
ggttggtcccacacatattttttttataatattctctctgttgagacttgagagacagaggaggcttaatcttttgcactgctcggttcatgtttctctagttcactaggagggcgatcctcgcttcctcgcttctacgttgctaatgatattatggacctattttgggggagtttttaagcggccgcagctttttccagctagaatcagaaattccctcgaataattcagcttctggtctagattctgataagctgtagttgtaaatttcagaaaataaactagaggccagaagctggaaaacttagcttttttagattgttagaagctggctaccgcaaccaactgtttctcgcaatcttaagctcctcaaacagaccctatataattgtccacgtcaactaagttactactacttcacattgctccaacaaaagataaaatcggtaatttatctcgaaattactggctcagaaaattgcattttttttactgatttcatgtagacgatggtagtacggtactattgtcggcacagctcatacatgctagacgcgtggatactggataacgccatgcatgtgtgagctgcaattatctttctttgtttttttggcccgtatcatatgtacatgtcgtacgcgaaatttgaggggtcgtgagcgtctctgtggacatcgggtgatatggccttatctagaagcaaaacaagtactctctcggttccataatataaaggattttaactttttatttaactatttgaccactcgtcttatttaataaaacttatgcaaatataaaaacgtaaagttgtgcttaaaatactttgtataataaagtatgacataaataaaataaataataatttcaaaatttctgaataagacgaatggtcaaacagtatacgtaaaaagttaaaatcccttatattatgggacggatggcgtactttgtaacgaggagaggcaaaacaatcatttcatagatattccctctttcctcaatagacgaaatatgataaaagatggatacaatgtctatgaatagagagtcacactttgaaactgtgttttcctaaatattcatttatataatattttagagctaaaaccgtaaaatcagcatgtcctacaacaaataacaaattttgttatgaaaatgttgcttatatgatactaaaaacatatgttgttagcttaatatttactcaaaatttcaagtgtcgttgattcttcttaaaacaaggtcgtcttatattttacgatgcagggagcagtgtgtatgtcgctattggtctgttgtctagcattttgcgcgataccagtgactactaaatattgaaacatgtgctagtgtgcaatttgaaggtgttgtgtacatacgagtatgtgaacagatgcatgaatagattataaaagaataagcaaaatgagagtaagcttgtcggtgaatgaacgtataaagtaggcctctcctgatatttttttccccagaacacatatgcagctttagcactttaattcatacagtgtcactcaaactttagccagatgtcatccgtgtggctaaaagtgaaaccaagctacttcggttgataataataaggatacagtcttaaacacatgtttcaatcactattttctattataatatatataaaaatatcaacaaatatataattttattgacatcagacttgtccaaaataataagtattattaacatggagaaattaaataattaattgtgctcagattgacgaggactgaattacgaacgtcaaattacattattagagggctactttaagatgcagggaaaatatgcagtgcaaaactctacgtaatgcaaacctggattgggagtataagttttactcatggtgatgtctacggaagtttctcagtttacattgtatatgga

SEQ ID NO: 103395 - DNA, 2364 bp, Oryza sativa
atctactatttttttttgttggtcttttctggactataggaaaaaaaaattaatggcgaagggaagggtaaattctctcaccgatgaaccacgctctgataccacctgatgcgaacacgctagggtttgtggcccgatctttcgatgagaggtaagggataactcgattagatgaagtcgacgttcacagcccgactacaacggtccaaagacgctgcgccttagcaactgatacaccgtctccaatggtcgccgcgaacttgtggggcgcgtcaacccggccacgagggcactcgtcctgcaagcaatcgaagaacaagtaagaacaagtaggacaagcactgaaattgctagataaagatgaaagtttcactatcaaacacaatatggtggggttccgattacaggcagacgggcggtttagccaacacgcgcgctgcgagccggtagcaagaagctatctctatcatcaaaacccgcctgttcttggcggtgactagaggtataagaagaggggaagaacgaccatagggtcgtgctccaaccctaggacgcgcccctaatgggcccaacttggatacacagcccattgggccaaaagaggtgacgcagcaccatgggcagaaaatagtcgggagtaaaatgacaattgcggccgctccagaacagatatagatatgtggctggatccatttgaaagtagacttgataagctttccatgaagtacttgcacacccaaatcggagttcgcatgaagtcgtggcggccgtcagaagttggcgctgccctgcaatccgaatccaccccgcgcgaatcctcttccctttggatcctctccatcgttcctgagtaaaacacgagtgcacgcgtctccggggtataaagacgaggaatatgaactcaagaaagaactcacctgataatttagttgacatgcacgagcgcgggtaataggaccatcatgctgtacatgggaggacgtggatgtatcgatggtgttgatgtcctcatcacagaagaatggtgttcttttccttggtcttcaggttcaagtcttctagggaaagctatggtttacttgtttggccaaggtagcttcaacctccactacgaaggccctgacttgcaactagccatggaatcatcctccccaccatcgtcggcacaagatggcttgctgttccaatggaagaagcagaaggacccgattgctttttaagcttctttttaggtcctcttgtgcatactttgcgtttgtcgaaataatatttcggcaatactaaaagggggtggctatcaagtaggaaaagtggatgggttaggagacacaaggtttatacaggttcaagccttctcgatgagaagtaataacctactcctgtccgggcattgatccgctgagtgtgttattgctcgtatgatctgggtgaaaagttatgcccctagagtcacccgggcccctccttatataggggaaggagtcgggattacaagatgcaatccatgttccttacagaccaggtatgtagagataaattacaattgtaaccgactaggacttctaggtatttccttggtatacaagttaatataacaaccaagtctattactaaagatattctatccatatatggtacccccatacccagtcggatatacatgccgtgtgggtatgaggtatccataatctccacagtagcccctgagaccttcatagtcgacgaaataatcttctcttgagcctttacacgaaaatcccgagtgcttcgattatctctgccttggtctcccgtgtacttgaatcattaggctgtgaagggctaaaaaataaaaattaggtgcatcaactagatgcacctaattaggtgtagcccccgactatgtgattagttaagccaaactaaacatatagtcaaggtcaagataagtaaccagctgagtggttttatgaataatattaccgaagtaattaaatattaaagcatatgcgacttctgtccgaagatttagcctactgcttttagataaattattaagctcactatgaaatatagaggatatataaagatctgagtaataaaagcactcttaggatccatcatctattctagagctaaacacagcatttttgataaaacacccgagtaaaaactcataaaggatttatcaactgctaaataaataacggctaataagtttaaccagcctaagctgtaactttagtctgttattaaaaaatacagcatataatgctcaaaaggaacaacagctttataaacctgtcgtcctgatttaacctaacagccttgtgaccttataaaaaggatcaacaaaaataactgggcacctttttgtacgcatcg

SEQ ID NO: 103396 - DNA, 1131 bp, Oryza sativa
ttgttttggtgggagttttttgtaagacttgctatttaatttgttggttgattgctgtgaatagcaggagctgaacttgagagcagtcagagaaaaagctcatatgtgcagcctggtcatgacaacttccaatgctaggatgataatatcagcaaggatatttaaaaaaaaaaaaaggaagtcctattcaagaataagttcttgtgtattcagaaactcaggataagtataatttgaccaaaggatgtgtgcatgtccttatgccaaaacctgagcatgtgtaaaaggctggttatttggcaacagtctgagcacatatatttttagttatatttttaacaatctttctaaaataatgatgttagtagtcgcagtgtccatccccacaccacccctactactgacatctgggggcccacaatttatactatttacaccacttttcaacatgtcctccatttcactattggctcccccaaattttaaaaatcacctactcgttcaataagaaaaattactagaactaaataaatgcttattaattgattaaataagctataaattcaatttgttttctgttgcaacacccggtgtccaagtcagtactgttgcaaaagcactaaagaaatcactccctaatatcataggacattaatgcagtacacagcaaatatagatcaagcagtgtacaaaagcacttgagatctgaaacaaaccatcaaataaatttgatcccttttagacttcggacatattaggggaaagtttggttttgccactaatgaatgtccattctcatatatgccactaatttttccaacttacactaccagaagacattacatatgtattacaagatgacaaaatctcataaataattcatttaaaaaagataacaatgtctagttggcaactaaaagaatggatgggaataactgtagcatcaacgaaagaagtaagggttaattggatctatgccactgcaaatatgacaattagaaaaaataccactactattcagtatatcggctaccctgagttattgttcactgactatatcttagaccattgcgatctctttctttcacttggtaggcatttcttcccgttatcgggacttgcacttgcccg

SEQ ID NO: 103397 - DNA, 1874 bp, Oryza sativa
cgacggcggtggcgctgcatgcaggtgacggccacagtcggccatggcggccgcgtcagcatggcgacggcgaatgtggcagcggcggcggcgacgacgacggagcgaagacggacggcggtggcagccggccgaaggagatcgtgagagatcagaaaggggggagaggttgtgatggggattgaccaaagatggaagagctggcatatggcccaagggcatttttgatatttcacatgatttctctctcctcttcaaccggaaattattattttaatcgacgcagtgtccaccggtaaattaccacgtttatagagtgttttcccccaaaagtgagtttagacggtgtcctagggctaaaatcacacaatagtagtgtcctgtagcaaaatttgcgataacaattataaacaggagacagacgtacacatattcattttgataaaaaaaatcaagaaaattgtaaccaacatgagacactgcaagagccatatgtgttctgtcatcagtgatctcattgagtgttgctgttaaatccttatacctgagattatcatggttatcaacatgtgtagtagcttacttagggactgctaaacgctactccgtaattgggtagttataaaagtagttttcgggtatgatatgaaacatgtagtgagatatgaataatcaagatgggatttgcccctcctatggagagatatctctgggcccctcgatgttgtagattatggaagtgtatggccatgccaaaggtgattgaggagtcaatcacaagttatataatctatcaacaggttcgagtgaatgattgagctattagaggatggcacatatctagccttgagcttaatcgatatcgtgaggcaaaggggttcatacaagtatatactagaggttcagccgatatgatctttatgtatgcccggtgggtcaatacgttctgctaggggccgctgttgacgcgtggaccgaaaaggagttttcgggttacagccgagtatatatgaacctacaggttcgcacgcttaatgggccagaataaggggattggatagagatccaatatgagcttaatttggatagggatccgaataggagttctacgggccttggaggcccgagtgatggatcctatatattcgtgaggggtgtgaccggcggaggcattgcatcacgtgagaaaccctagccgccacttccctccccgagcaaaccctagctgcgcgcgtggtgttccgtccctgtacatgtggataccggtagaggcaccgctggtttgcggtgctgatcggcgtgggagtacgacgaggagaacgcacgaggaggagaaggccgagccggtgcgatcgactacttcctctacatcgacgtgcgctacttcgcgagagttccttcgacttctcagcgtcttcttccgctacacagcgtgtcgagtggtagcgatctatgatctaatactttcatggttcctggtttacgcgatagaaaattttgatttatgctatcgtagggcctgtttggcacagctccagctccagcttcaccccttctggagctggagctcagccaaacagtttcggctccaccaaaactgggagtggagctaggtggagctctctcacaaaatgaactagagttgtggagctgggtttaggcagctccacaactccactccagactcaactcctggagttaaatttaggagttggagctgtaccaaacaggcccgtagcctacgcgtatcccaacagatattggtagttgtccgaacattagacacgtgaatgagtgaacaaatgaaaattcagatgggagcatatttctgagaatactgcacacatgcaaaattgcaaatgggctgcaggaat

SEQ ID NO: 103398 - DNA, 2377 bp, Oryza sativa
caatatgaagttatctaggcacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgattgagagaagagacccttgaaaagggctcattttcatgatgtgattctcttctttcctgcatggtaggatggcttatgccttaatgtgatccgagtggcttttccaagcagagatgttgacctgcagaacatctcagaaggaacacacctatatgagttcgactgctagtcacagtctatgaggtttgggcgatctctagatactcatgaaaggcctggagtttgacttatatgctccaaacagaggggatgcgaacagcagcccagtaccagtcaaggttctgagtgaaacctgatcacacaaaactgacaatttaaggcatagtccattgttcagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaacttatcctattaaatctcaaaggcccataataagtgttaaggataataataccacctcaggatttaagcgaggaatatctcaacctaaatagagagttattggagactccctgttgaccagttgaggtggggatcggaatgccacacgcgcgcgcgttgggccgggacgagggcgtgggcgtgggcatgggcgtgggcgaggcgaggcgtggctggcggcgtgcgtgcgtgcgtacgtcacgtcacatcacgtcgctatccttttgcagccactaacccacgttcccacgattccctccgcaacagcgcgtccacgttctttctcctgatagataaggaggccgcgagtccgatccagtttcattgcttctttcccggtgttagtttctccttctccatgcctgagttgctcttgcttcctcgcttctgatctcttgcgcgcacgagagattggaaggagcagtgcctccgaaaccacaccttcgcctgagatctgcaccgggtaggcttgtgatcaggtttttggggagtgcctcccgcacgactgctcatcgccatgtctggagttgccgccgccgccgctgctggaggagatggcggaggtggtgcgccgccgacaggagctggatccggagccggagctggtgcgccaggaggtgccgtgaacgacagcaacaacggaggcaattctgcctcaccatccagcggagggctattctcggggtataatcttctcctactgttcctgttgttagcgctattcctgttcccattgttagcgctatcgctatactatgtgcgctatgttcttgttcctgttctgttcctgttcttcatgatgcctctagcatgttattgcgttactgttatgttcctgttcctgacattcatgatgcgcatagtatgatactgggtatgttaagatcaccctacactgcttatgccatgattattgctttaacattttggattaaaatatgccgattaatgactatatttccaacaaatggcaggcctactgcgctgttggaggtgtggacagcttccaaggtgactgggagaagttgtacgacaaggtgaataacgcagcttacacatgcaatgccgactcggacgggttcaagatagatgccagtactgctaccggtgacagccccgtcttcacggcgaccatcaaaatccatttcagtgaatgaaaaaaaaacaagatcgaccacatacatgcatgtcattcgctcctgttgcacggggcacgctcgctacattctattgctgtatcagccagtcaatggatgtaatgttattctctttcgcaaaataatgtagctgttactgttgatcgtgcgaaccgatcacaccagctctcgtttgtaatgttctcgtcttacatattataataaacacgttcagccatgtagtgtgcaaaattaaagctatttacatctttatctttactacttaaaagagttttaaaaaagaaaggcttaaggcaaggtgatccgtatctccaattatttttaacgttctcgtagacgtgttagctatccttatcaagcgtgcaaaggaggatggacatattgctagactaatgccacacttgattgatgatggtttatctattctgca

SEQ ID NO: 103399 - DNA, 2573 bp, Oryza sativa
ggccgccggcggcggcgacggcgtgggctggcggtggctcccggcacggctcccctcccctcccctctcagatccggccgggggagggtggtggcggcgaggcgcgtgcggcgatttttttttgttcgttcattgcattttcgtaggcgggccgttgccccgactgcgagttgtggtgcaggcagacctccctcccgtctggaaaaattagttttggccgcctgcaaaaatgctttttctagtagtgagatcgaatcacaacaatacgatcatgctgatcagtaaaaatattttgcattgaacaccttacatagtttgatttcatagtacattacattattgtctcccctattatcatttataactgtactacgaaactaagaaaacccacaagcctatttatcctaaaataagtataaatttgatttataggtttatttatcccacttaattttagcatacatgctattataaatgatgcattacaacattttacataaaaagccaggtaatagtcagaatcatttccgttacttcttttgaaatatccgtttatcccattaaattttaatataaatgctatgttttagatgaagcctacatgctattataaatgatgtgttacaacgtacatttcacgtaaaaagccaggtaatagtcacattcatttctattacttcttttgaaatgtttacaagacaaccatgtttcttaaaagttctttttagaacttattaccagtggcatattatagaatggttaaagtcgtgcgaattagctagtttttttcggatgataatgtattttcataaaaaaaaaattcagtacttgatcagtatgatatataaaccatacaaactttactccaccatgattcaaatctactccaccaaaattaagcatatgtaaatagagctgccaaatataacgaggttaaaatgttgccacagcgatgccttccccgtacgtgtctgtgtgtgcatgtccgttctcagtgtagtcctaagaaaaataaatataaaccacagtgctgattggagatctcgatatgcaatggttgcatagtgctgatagtgatgatcaggatgtgagacaaagtaaagtttttattcagattgcggacatcgaattattttagcatgaaacatatcatctgggggatacgttaattgccagtattcctggcacgtgtactaaacaatcttacgttattagtgttgaccacactaaattgatttaaacattaagtcagagaatatgctcgatcgattaaactttacatgcctgaaccgcgtgtttgagtaatatcaccaataattagtataattaaattatcgttttgacgaagcatgacacgcagatactccatttttgcctcgattcttgcatgacttaaaaattgttctactagtattgaatattttttttcaacgtacgttaaacatgatgggctgtctgtccaaaaagttcgcttgtaattttcaatacgaaaaattggctattctacagtgcgtgttgcgcatgagttgtttatcttatctagccagatgtgaatctcttatatagttttgaatagggtgaatagctaatgcggtccctaaagtttcgctttaggctcagtttagtccttgagattttaaatagtctaaacaagtccttcaaattaatcatttgggttaatatagtccttggacccataaaaagtgccacacgagcacgccaaattatcctcgcatacagaggtatgaatgaaatggaccattctacccttatataccacatataaaagaaagaaaaaaaagataaatgtttcacatgtgtatgatcgtttgagaattttcacttatgattgctgtagccaagcattgatcgtgtaattcctttgtaggccacccatccgtaacaatgctatgcctgggctggcttttttttttttgtcttttctttcttttctatatgatatataagggtagaatggtcattttattcatatcgctgcatgcgaggatgacttggcgtgctcacgtggcacttttttttccaaggactatattaacccaaatgattaatttggaggactcgtttggatgatttgaaacatcgaggactaaactgagcccgaagcgaaactttagggaccgtattgactattcacccttttgaataatgaagatagctggccttagttctgccagtgtgtatatgttggaactgattagggcatggaaataaacgttaaagatgctgtaggaacgtctaaattaacaaagataaatatgctaaaaaaatcatgttaatgtgaagtggaacaatttggactaacgtagtacgtcttgcgttcgatcttatccgctcgtatcgtacacaatcatggcgatcggaggttcacgtgtatgagtaatatccccacactaaaatactaaatccgaggtatacccattcacgctgatacggagtaattgattgcttagagaatatgctcgatcgattaaactttaattacatgcatgcctgaatcgcgcgcgcgcgtcttagtaatatcaccaacaattagtactattaatttgtcattt

SEQ ID NO: 103400 - DNA, 651 bp, Oryza sativa
atgctttctaacggtgtgttttcctaaaaaaattacataacttttttaaaaatattgttataaatcaattcttcaactttatgttagttaattcattcatttgtattcggaatatttatcacaaatctattttgtcattcaacataaaacaaaagcggtgaaggttgcgctttaccatgcaccgctatttagaggtatgcaaatgttataagaaaaggttaaaataaattcctttctttaaaggtgacaatatacctcttgcaaaaattcagtaactcaaaattcaatcagcatatgacagacagaacacaaatatttataggtgacagcataccttgcattatggaaacaaatactaaaaacgattatgataattaaaatggccgcctagggattttatggatattaaacaaatgctttcagttaatggtaaagtacatataagatgtatttacaacataatatcaatatatctaaaatatatgaaaaatgtttctaatataaaagtgatctaggcttttttttaaaatgtcttgaaaatgcttgtacatgttaattgtccctccctattttagagacgatttgcaggtttcttattgaaaaaaagtaactcggtatggttttttattaccgttaagcgtacaggctctc

SEQ ID NO: 103401 - DNA, 676 bp, Oryza sativa
tctcctctctgtccatttctcatcagttatctctttatccactctccctctctctctctcacatacacacatcctctctttctccatggcagcagagcatgacaggttgggctcacaattttttaaacataattttgcatagtctgccacaccagtgctcaagtgggttcgactgttttgcaccctatatgacacttcaagttcaagggcttaaatttacattttgcaaattcgtggacctagatgacacctgcctacaagtttaatgcaagcttgtatattttactctttttagtatgctggccaaacttgtgatgccttcaacttaatttgttctattacagatggaaatggtttcaagacaagtacaatgagacttggtgctgatgttttagttttctcccgtagtggtggaaaaggtggcaaaaggttaagttacacttcatcttgacaaacatttaaaaaaaatcattttagaagatgctgctaacatgatatgtttacaattccctaacaaccaaaatttctttggacagatgagctaccagaaagcctgtgtagttcatcaaacttgaaagcaccaaatgatatttgttcaatttagttagcaggtcaaattaatttccctggtgtaatgcatggtcaagaatttgatttaaatctatattgcatgacc

SEQ ID NO: 103402 - DNA, 675 bp, Oryza sativa
attttgggttgatgtgacatatcctagtactatgaatctggacaggttcgctgtacagatttgtagtgttagaatgtgtcacatccatctagaatcccttatattttgggacagatagagtatatagtttggatggtacatatataaggttgagcattcaatgtttaacatgaatgcaatagggcttattaacacagccgtgaaacattacatatataaccacctgctccttgattgctcttaaggtttaatatgtactggagaaatctaagatgcagtggcttattattagcaggcactgaaaaattatcaattaggcaattcagaaaaagaaaacaaaaaggatggcctgatctcttttattttagtcagtttgtgttggtactaattcagtttactgatctcctttacaactatgcaattgccttccactaactagcagacctatggctgccctacaatggggttccaacttgctacattccagtgaagcttttctagatattacaggcaaaattttagtttatttagaaaacaccaattatgcatgtattctaaaaaaaacactattaaggtgattatacaagagtattatgtgatgccaaacggatcatcaccatcttatctaactgttgactaagcaaatatcttatatgtcgagtaaaatagtacaat

SEQ ID NO: 103403 - DNA, 1399 bp, Oryza sativa
ttcctgcaccccagctggaaaatatactctaaggacatgagttgtgaagtgctgaaaaggaagtacctgagggatggtagaagtttctttagcagttcttcaattgggggttctcaattctggaagggacttcatgctggcaagaagtggctgcagttgttcatggagagaaaagtagggaatggaaaacataccttattttgggaggatgtgtggttagtgtcagagtatatggtagttagagtcatattaggataggattgatttgtgtggactccttccatatctgtaatccttccatatctcctcccatgtactcctatatatacctgccccctgaggctcaatacaatatgtccaatattcgcagtatcctctttccccatactatccaacatggtatcagagcgggcgatctagtcgcctctctctcacgcttccgctcatcgcccccgggagggtttcgatctcctgggggcggccacccgtttttcgtttttttttctcgtcgtgcttcgccgccgagatcgatctcgatctcctcggcatcgtcgagtcgtcttcgcgtcattgtgaagaagtcagtagcatcgtaccatccacatcgtcgtcgccgatctggagggcatggccgacctgatctccaccagcaccctgacgtcgccggtaggccgcgccgcccgctggtcgtcggcctcacctagggcaaggccgccccgacgccaccggcgccatcttcatcaagcttcgtccgggcgccggtgttgctatggtcgtcgcggtgtcgttggcgcggcacagagtacggggggacacatccctgccggttcctcctcggcggccgcctacgcctgcaggccgccgttcaccgtcgacgccccctccaccatccacgcaaccatctggcagtcgtcatctggaggtcgtcgtcgttgcggtcgaggtgcggtcgaggtgcggtcgcaaccatctggcagccgcacgccctccgccttcggtcgccggcctggctgacggggtgccgctttctgctgtccgccgggctgccggcctcggctgctcacctcgaggttgtctccttggctgcgccgacagcacgtctccaccagcgcctcccatccgttcgccggcctcaacgcccaccgcctggcgctctccctccccccgctctgtctctctcggagatggtggacgcgttgactgttcgtctgctccatgccaatgaagtgagagattggggatgagcaagttattcatgggctcaggactgtgtgaacttggtccatggaccatggaagacgtggagtttggcttctactgtggactactgcatgctactgtatcaatttttttttccgaacagagtttgggtttgcgtcgcccaccgcctcgtcgacat

SEQ ID NO: 103404 - DNA, 640 bp, Oryza sativa
atgcggtccataagtggaaccgcatggaaaaataggaggaccggcgctaggtcgtcgcccgcacgggaaaatcgatttttccgtgcgggcgtcctaatccaaccgcacgggttattcctccctcctttccctcccacccacttcaaaattttcctaactctctcttgctttttcccttttattccctctcaaccactcccctctctctctaccttatctcttcttttatcccgtcctctctctcagccactccctcaaccctctctctaccttatctcttctccctcaaccactccctcgaccggccggggtgaggtggcggcggtcgggcgaggcggccgccgggccgaggcggtggctgggcgaggcggcggtcgggcgcggcggcggcctgtgcgaggcggcggccggacacgacggcggccaggcgcggcgacaagcagtgaggcggccgtcaagacctcgctgagggcgccgaccgcatggccctcgccgtcgacgaccacgaggctgttgccgacgacttccgtggcgccaccatgaggtggcgcaagaccaaggcactcctagtgccaacgtcatcacctggtccccgcgcaacgctgagcgccgcaactaccgcctcaccttccaccaccgc

SEQ ID NO: 103405 - DNA, 674 bp, Oryza sativa
cacacttcaacgacatcaacaagactttggagataggctaatacgtgtcctagtgtttagtttacttttcaaatgcaatgcatacattgcatttaagtggaggtgttaaggatagtatgtctagaggtattttagacattttccaattccatagcaaaatccccaatttctcccctaaattaacacttatcaatgcaagttcgagccgtgaactagcgctcaggtatccgtgccggtaatcagacgaaccaacaccaatgggccagcccatttgtgctaatttagtgccaagaatggctctgatactcatgtattagtgccaagaatagcacattgcggtatgatcactatcgattgtaatgtgacgattaagaaatcaacattgatagccattatgaaccggcaccaatggcctgcccagtggtagtggacaaagaaaggttgaatgaattagaacaaaaatgattgggatgctgtccatattgcgtctgtcaactatctggtttctccaaaagaacacccaactatgaaactagctatcgttcactcatgaattatcaatacagatcaaattaatgtatcccactcagggcaatacaacctggtttgaacggtggttttcatgattttgatatccgaatggtgtatcttttaaattgtgtggtacctagttg

SEQ ID NO: 103406 - DNA, 1325 bp, Oryza sativa
cgccgatggagagagagggagagggctccaggccgagaggagattgggcaaagagtgagaggacttttcctaattcggcccgaaaaggaaaagttgattttaattacttttctaattaaattaatcaccgaaataatctttgaattgctaaaaatattttcaatgctcaaataattcaataaaaattctgaaaataattgggcactcaaagtatttgataaaattaaaaccagatcatttaatgaataatttattatttaaataatttcttaaatgttctttgtattattaaacttaggaattgagctatgaaaaaatctgagaaaattccagagagtacaattaatcatggagaatttaataaaaattaagtccagccatgctttatatttaggaaattttagttcccacatttaacttcacttgtaaattaatgaaattttaatataaattctaagaataatatattaaataatttataaatcctgaaatggaaattcaggctatgacatatagatactatgtctatactatttaaatactactctaatgtcgatcaaacattaaattaaacactaattctagtgcacaatattccggtacgttaatggaactaagaaataaaccgcacaaagtaaatctcaattattcgataaagatattatatattaaagcaaagtaattgacaatgtacaaaaagaaaagaggaaagtaccgagaacttcagaattcctccaaccgggactactccgatcagactgatctacatcgaatttgagggtaaccttctattccgcaaaaagtttgggtttttggatataccaaccattcaaccccctctggttggcttagttattgtgtttcgatcctacagttaggagcatcaataccaatcacagccgccatagagaagttggtcatacctgtcatgggcggttgtacttgggctgggccaggccggagtctgccgaacccagaggtcgcctgacccctggccagctcccctggcagtgggcttcctcctaggccctgacaattgactccttggcccaatgatattctttgggcccagtttctagtatttcgatgagtttgcgggcccaagactcaatggatgaaattctcctccacttttatgtatatttcttctcaatgttggtagtttgtcacctgcatacaaatatacaccaacactcgtggaaattgatacaatcaaaccctatcactatgtggaatgttccataatttcatatttatgcaagtattggcggcacaaaattggtatttaacagctgccaacacatgtcgactctccaccgactgct

SEQ ID NO: 103407 - DNA, 1191 bp, Oryza sativa
aataattcaggaaacaagcacccttcagcaatcggcagctgactttttcaaaacactacatcttcatccagtcctataccagtatttggatcttcttacacttaagatgtcatatacagataggtaacgaaagaacttgttcatgtatggtccatgtcagaatagatgaaagcccatgaaattttagttaggagatcagaaacaaaaaaacatcaagcaagttatagataattatttttgactttattcttcaataatactagtatggcatggcatatctattgacacacaaaggccagaagtgaatttaagcgccatcctgacctacttgaaggcaggggcggatccaacttgggacatgggggctcagttgaacccccaaacttttgggggaatgaacaaactgtcacttgtattaaggttcaagtctctgaaattaagagaagggcttcttccagatctagaagagaagctagggttaacgaaacgcaagcaaattccaggcaaaagtagtcccggtgggagagagagatgaaccagaaagaggatgtggatgctcaccggatcccctcccctcccctcgcctgctctactcgccagatggagatcagcgaccctcccctcccctgctcgccggatggagatcggcgcgccctcccctcgcctgttcagccgcgagatggcgcaaggagcggaggagccgagacgccgagacgggagatttttgggctgtttggatgatttccatagtttaccaccaaatatagttagtaaattgtcgcatgccccatattgcagagatatttaactatttgctatttttataaatacttcctccgttttatattatataagaattttcagcattgcccatattcatatactatatgctaatgaaactagatatatatgtgtgcctagattcattaacatctatataagcctagattcattaacatctatataaatatggacaatgttagaaagtcttataactcgaaacggagggagtagtaattaagaatttaccactaaactaatatataccataaaggggcaattttgtttctgcccctattttaatgtctaatattgattttatacctacattttagtgttttcgtttttaccctcacctttttttttgaactgaatgcctgttttgctcctactttggatggtgaaattaac

SEQ ID NO: 103408 - DNA, 1586 bp, Oryza sativa
tttttttatagtgaggggatcgtgctgggagaagggaaagaaggcgaggcatcaacctctctccccgcctcgatgtagatggcgatggcggcatccgcggttctcgccgcatcgtcctttctgctcgctctagtgttgtggatttggagggcattgcctctcgaaagtcaaaggtacatctcactgagaaaatcactgtcttgttattcgccggaatgttgccagccactcttcctcccatagatctaccaatgattaccagcaaatcatgcgtggtctaaacgatgtttgcctaatcatgcctccaatgatttccactcaaacaatacactgcctatcacaaaatttagcattgtgtttgttttgtctgcttcctccaagaaccagaactatccacaaccaagacgagccactactacaaaacatcaaataggtgtcaccactataggtgtcgtagtgctaaaaccggcatctataggtctttttccacctctgcgggctgaaatcgtaaaaaaccagcaccttttagtaattatatgtgtcggttctaagtaaaaacatggcacctattatattttttgtcagtttttaaaaaaaccggcacctataacttgttataggtgctctggcacctaccaattgagccgagccagcaggccccaccactagcattgagagataaggtcgaggagatagcgtagaggagccggtgggccctaccactctcgtctcctctcccgttctctccattctttccgctctctctcccctttctatctcgctcgtggcagctggaggggcagcgtgcggcggcatcagcggcatcagcggtgtgcggcaggaggagcggcggcgggctcgccaacgggaggtggcgcgactgctcgaagaggtgtgaatcccttctctcttttttttattgcataaatttgagtccaaattttgtgttgtggatgaatgttggatgaatggatagtgatatagatgcggatgtgcttgctgtgatgaatgttcttattcatcttgttcttgatgaatgtgatgcagatgtgcttgttcattcttgttcttgatgagttgttcttgatgagtagagtagtcgagggactgctcggctcgatgcatcggcttgagccggcttttttttatttattgaacctaaaaggtgacggttgacctatgacattttcaaatcagcgccgcctcctttgtgccggttgggaaaaccggcacctaatggggtttcccaaccgacacaaatctgtgtttctgtagtagtgagccacgtatgggcaatgctagaaagtcttataataagataaaatatgttctttttataaaatgaggcaaaatagaatgcttgaattatttttgcaggagattatgcaattaaatgagcaggaactcatagccacaaccgtgtaaactctgtactcctatgaattattcaagtaaaaacatgccggtatcaatagataccacctccgtttcagtttataagactttctagcattgcccatattcatgttaatgaatatatatgtctagattcattaatatatatatgaacatgggtaatgctaaaa

SEQ ID NO: 103409 - DNA, 747 bp, Oryza sativa
tggtgctggtctcgtggagcttcccggctcgcgtgctttctgctggaagcttcttgaaggccagctcccgaagccttattgcttgatcttgggtttgtacggcagtacaggaatataatccaacggtttatattacttgccgcatgcattggacggtgtttaatttgtagcttacgtgggtcaatcaggttttgagaaagtttactactttcaatacgttagatacccctggaaaaacttatcccaaaaatgattctttttgacgctagagtggctggcgccgttgtctaatgacacggcgctaggattcgttgttcccccactaccgtggcacacgcgaaccgacgtggcaggaggagggcaccagcatggcaggcgcaacccccccccccacccctcgtctccaatcttgttctatctatggagttgcaacctttttattttagttttatttttttggatattttttcacacttaggatcacgcagtaaccaaccacgaaaaatttaaactcgaacggacgaaatatgtggccttaagaattttcaaatagatatgttttggatatattatgtgaacacattagctcaccttagagaaaaccctttggtcaacatgttaaacatgcattctaccactagatgaaattgcttaattaatctaattcgaaatataaccatatgaaatatgaaatgatagccataatttacttaaacaatattttacagcagtcaataggttaactag

SEQ ID NO: 103410 - DNA, 588 bp, Oryza sativa
cggaaaacgagagagatgagttgggaaaaccgtgataagaacacattgtagtgacccagctaaccgtcctgaataacaagtaaagtagagtactgtcctgcatcagaatcgctttgattaacagaagaaaaactgttggttatacggagcttataggacacaaaacctgcaattgctgcacaagtgcacatgtgctttggaagaattaatttaagcacacataatttttttaacatgatgagaattctcttgcacgtgaagaagatagttggatgtagtgtactactagctgatagctgcattcaatgcaatgcaattcaactaccgcattatatctgaatatcatgggggtatctgacttgactattgacctaccataagcaataacatgcgtagtatacaatgttgcatcatatatagaatcatagtacagatgcaacttaattaactgaattataattaagctaataatgcgaaattcaacccatagaattgattgtacttgcgcacgaataaatagttttaatatttgttcatcttaattttcaggaacgacatggcaaatgtataatttgcctgttataatgc

SEQ ID NO: 103411 - DNA, 1290 bp, Oryza sativa
ctgcaccccatacactcacagtcacagagatcaaaaaaaggacacagtgtagtgtactggaccctggtgatgcatgcatgcctataagcttatgggattcagtaagatttttgtcatgatcgcgagacaccttcaccggtgcgtggtctgcacgttaaatgaaaccctctgtgtgtatcgtagcagtaataaatccatccctccattatttcatcctctcgagcaatgaaatgaattgcatcagcctagctgcgcacaagcttgagctaccgcccgagtttattgaaccattgtccattttcatatattaattatgctacctctataacatcgtttgttctaattttttagacagacgtttaacaatttatcttatttaagaatttacgtaattataaatttttttcagatgaatgattaaatacgtgtctaaaagttaacggtgtcatctattaaaataagataaaatatataggtttatttggggggttttctgggctgttgataagaggatctaatttctatcccagcctattaataagattgctagtttggcatagggtatgggtacaactgtgtgtttttaaggctgctttcgggaggaggggttcccaacccctcctccccggcacgcaaaacgaagcacacgttattacataattaattaagtattatgtattttttttaaaaaaggattaatttaattttttaagcaactttcatatagaaactttttgtaaaaaaacgcaccgtttagcagtttgaaaagcgtgcgcgcggaaaacgagggaggagggttgggaacttggagataagaacagatccttaatgtctttccatttcataggttgaattattggatgcaatttattctttctatatgtgtcgccatattttgctgtatcgcgttgttactttctccgatctctgccggccctacgcaccaagcaacttccaacgtctctatcgtggtctctccgctcataagtcctctccaacatcgccttgtgtcgtctttgttggtaaacgggcgcgtctcaccgctttaccataccatcaacgctttcaagccgcttgccggtgccctaaccgactccagagagttcgtcctctgcctatcctctccttttctccctctaaaaaaatatcatcttggattcattgtctcctaactaatctatttgtgcatcactatttctgtaatctcatatcttttatcaaacctatcattttaaatcccaatatatagtctaagacatcccttcaaataagtaagtagaagtctagagt

SEQ ID NO: 103412 - DNA, 1015 bp, Oryza sativa
tgaccaaggaagtgcaagtgcagtacctcctcaagaggctggattgagttttgagccccaactatcctttgcctgtccatctacaagatgctctctctctccagtttcagttctgaacttgaataattaggcccttatgttttgttttaccagatactgctttgagttcagttttagtttcagtagtttgcagtttagtatcttcatgtaatcctgtagttgaaagttcagttctcagcagagcatttggtactgaattgcaacttgaatggaggttgtctgaattgaaaagccaagatttgagctatttctatggtgaaacatgatcttgttgtcaaatgcttatctttgatctgctcctgtctctttactagcttgtcaaaactatttctcttttcattctttgcttggcctttgcctgtcttatctcaagatattcaccagtttcagttctgaactgtggacagcagcttacaactcaaataattaggcccttgttttgtttctcaggttgtgttgcagttcagctttactttcagtaattgcagtctggtaccttcatgtaatcatgtagttgcagttcagttttcagtagaacatcaagtgattgcaactttactgaattacaacctgaactgtgagcatctgaactgaaactcaagattttagcccatgctttgtttgatctgctactagtctccttatacttgatattttcattgctttgtcagtgtcaacatttggtctacttatactttatgtttatgtcctggaactctgctaaaacctactactggtttaggacatcttaaacttggccagtttatgtgaacagaaaagcctagaattggcaaaggatttcagtaaaaatttgtctcacaatccattttctgacactagttgcttgtcctgccttgttaggcaaaaactaccacactagcaatctagcattgtatacctaacccagaatattccaagagaatgaactcagacaaaatataaaatttagtaatgt

SEQ ID NO: 103413 - DNA, 505 bp, Oryza sativa
aactatgtgaatgaatggtggcatatggatagaggtggatgtacagtttcagagttttactgtagagaatcttccataattcgcacatgatcacaaagatcagtccatatgtgatgaggatattgtcaagtgaggcactagaccaatgataggggtttaccctacccatgcatatccagcttgcacccattaaatccaattaaatgatgagccgtttgattgactaaaattttttgtttctttgcaaatttaactgatctaaatcttttcattggtgtgattgaaaagatgtctccgttgtctttattccattgcaatggtacatttgaaccaatcagcacttaaaacctccatcatgttccaattactccaattctactcccatcagttctttttgacaatatatggaatttaattcctgctcataacatagtatgtccgtttttgcaatgaattatgcacaaaattatattctatgtatgagtatagagtacattactcaagg

SEQ ID NO: 103414 - DNA, 674 bp, Oryza sativa
agcccactaatcaccctatctaattaattaaaccactggagatttcgaatgattttgcccagctaataattgggaatgttgcattatatgattaatcccattttgtgtgtgtgctctccgtttgtcgttagtagagataacatataattgcggcttatttgcagacatgcaccatagtactctaggccaaattattgtggtatctctcacaacctaggagtagtatatagctatattaattcattaaaacaaactatattatgtcccgcaggaaaaaaatagttatacagctatatatatatgtcactctcaaattatttatggatggactaataagattgagattaattgagatgtgttagtttcctttaattattttcaccttctgacatagatggtgctgactaggtggcactgtggatcatgcatcacgttaatattgatccaagctaggttaaagctatactagatatatgttacctaaaatcgtgaagatttgtgtatggaccaaccattgatctggtccattaattcaatctagatgatcacttttactttaaatcatagctaattagcccatctagaaaaatacagtatttctatatatatctttcatatttttgagttttgacaagcacaatgcatggatgacaacacactccaccaaattccaa

SEQ ID NO: 103415 - DNA, 679 bp, Oryza sativa
atttgattaaaatttagcaaacatatatttaactgtatactttttaggcataaagcgtaagattatatttatatgacaaatagacaagcaaaaaaaagttgcagctccttaatattatagatattaatctttccaaaaattcatatttatagatacataaccaaatagaaaattcaaatggacccaattaacggcaataaaaagactcttacacattaatattagcctttagcctataattcaaaaacctacatatatcatccgaatgtgatgcatcacactaatctcgctgagctatcatacacggttgaataaccaaggtcggcatatcttctctgttctagcatgacgaagcatcaaccagggacgaaaatcatgtgtggggtaacttgggcttaagcccccactcgtgacaaataatttcaatgcgaaaataccaaattttagatacagtttcagtgaaaattttaaaacagcatggttcatccctactctcaatgaaatcttgcctctgcccctggcatcaaccaaatctagatagacacaaaattcatatcattgtaaaccgctcgaatgctcctagtccctaaagaaaatgaaaatgaaaaaccgatgaatacacatttcccctttcgcctcgcatttccggttcaaaccgggcacgcgggagcgaatgggc

SEQ ID NO: 103416 - DNA, 741 bp, Oryza sativa
cacaatctcaaatttatccattttttagaaaaaaaatacaacatgtcgtaggaacattcttttttttttctcatatgtaaaatcagctaactatacatccatattaaatccttatcatcctcaaaatcgattcatatcatacagccggcaaattgaacaaaatgccatcctccttcacatgttcgaggccattggaattgacgagtaggagcaagtttaatagtgtagacaactacgaactccaaatcatgtatagtcaattttcatatactcctatagttacctataaaaatatactacactattaatacctaatcctgtcatgcacacattacatctctgagtttgtgctacagctggctagtaccttcgtcccaaaataattagcatatattaaggtttgagaagaaagactatgatgcccctcattaaatggtgtttatatgagagtgggaggatggttgagagtaaaatagggagaaatttgaatgggagatgattgatggggcaattagtactctagaattgtaattattttaggacgaattttgaatcctagaaatacaattatttggaacggagatagtataaatttgtaatacgctgctcttctatctcctctttcatcttctaaacatgtgtctatcgttggcttacagtttatacatgctctaatgttacacacaaaagtacgaaacgaggggcaaatatgtaattttggggaggtgtaccgggtgtcgg

SEQ ID NO: 103417 - DNA, 532 bp, Oryza sativa
aatggaatgtatttaattaattggtttatgcatcttctttaagcaagacgagcggccaaagtttgaagatgaatacttcctccgttccatattataaattattttgaattttttttctagtcggacttttttaagtttaatcaaatttataaaaagaattagcaacatataaaacatctaattagtttcattgaatctaatatttaatatatattttttataaatttgatcacttaaagaagttcaactaaacaatcaaaataacttataataatatgagacaaatagagtagtacccatctaaaaagtacttgaagacagatagagtagtttttttcccctcctccagttgtccatctatgatagatgtttcctcgaaaaaataacatccgtctctattgccaccagccaaatcagtgacacttttcctaagtgttctactggttgggaacaccctcctccggtacggaaaacggagcagttcattagcgtgtgattaattaagtactccctccgtcctataatatgaggg

SEQ ID NO: 103418 - DNA, 1837 bp, Oryza sativa
attttcgcaggcgtgctgttgccccaactgtgaaaatcgttgattttcaccgtcgttgtgctacaagcggtccaaccctccgcctgcaaaaatcacttttgtctgtctgcgaaaatactttttctagtagtgcaatcttcgtactgagaactaaccaggccatcttttttcactgttgtattccttcccggtctagctgtgttcctttttgtagttttgctgttccttccttgacatgttcatggacttctacagttttaccagatagataaattctcagccgtcaatcccattttttgtcgacctatcgtttaggcacgcaagaaacctcaagcatatatatatacaactccatgcttaaaaaataacttaacccaaaaggcaactttatgagattagagctagcagatacaaggaagcttttacaccgtcatctcatattctttacaagcatatatacaaggaagcttttcccattctctttagaaaggcactatgtacagtacccctgaagataaaagcagaaggtagtagatgatgatgatatcgattaatcaatcccatttaccgctttggatctcaagcttaattcccatgattaacaactgagatctcgacagcttaaatgttaatttgtccagtttggcaacagctagctttcagcccaacggcatggtgaagatcaggatacatatatacatggaaagttgaatttacacataattaagatgcgtattactgcgtaggtaattaagcatggcgacatttcaggggtttatatttggtgtgagataatagtgatcatcaagatatgcatgcgacagtctgacagatgatgagaaatgtgaggatatgcattcatacgtgtcgaaactcaaatggaagtattttaaatgattgatttgtaactgacctacattccaaaatattcaagaaattctaactaagaagtataaaacacgattaagataagtattactaaaaaccaaacactgacagatatgatgaccatgcttttgttccatattttaattagtctactttcaaaaacattccttcattttgtctaacaaagtaccaagtactaactctttcttccacactgtcactgacatccaaagtcaaactcaatatttcacaataaaaaaaataacgaaggaattgcattctgatacttcatgcaaaaaagatagattttgatcagttccatacgaaggaacaatggaacaacaaagatatagaacccctaattttccaatggggaaatgaaggcagcatacatgaatgcatatagaaagaatcgaacataccccaatcaagccttgcactacatcacatctacgaccaaccaatttgcaaggggcttagctctaatcatcatctgaccatatgcatacatgaatgaataaactaaacaacaattagacgacgaaattaagaatttagcttttctctaacaacacgagatcagattaaggctgcaataatctcaagaactggaaaccctagtgagacctagagcttgagagtcaggtctatcttgctgcttgacatctcctcctgcgccttcacttccgccgctgtgtgttgctcgccggcggcggcggcggcggcggcgctatggatggtgccgctgccgccgccttcggcccaccggagcccggcggaggcaggggcgcctgtggccctggacgacgacgagccggcgccgtagccgaaggcgtcggccgggtacacagggcgttcggcggcggcgtgacgggcggcgatcccctgcagggaggatggcggctgggtgctccacccgtggtgcaccgcgccgaagaacggcgccgct

SEQ ID NO: 103419 - DNA, 707 bp, Oryza sativa
agaccaaagatcaaactttacaggtaaaagatttaaggttatagatccagagaccaacttgcttagaacaaagcaggaaactgtagcatcttccagaaagatgggaaacatgaaaatcatggggggaacccccaatgcaagcccttaaagccaaagccacagaagaacaacagagccgaaaagaggactgagagaaatcaaccaccaaagcagaaggccgattggagtaaaaacgagagtagtgaaccggggaatggaacctgaaacgtgcttcatctctgatgcgatcaccaggagagaagtcccaacacccggaggagcaggagtcaccatcaccggcgatcaccacaaacacccactcgccgatcgccagctctgcaaaattcagaacctcatttcccccgttccttatagcccattgttattgattactgtactttgtcacctggttaataattggattagctagaacattatatggttttagctaaattaattaggatacttagccatgctagaaatattagcacatgattgggataattaatgtttcattattacttaatgatggatatttaatggtagctcacgatggttaatcgtgattggttaattaattaacatgtcacctaaaacttgattaatggtgggttgtgagcacatagttttgttggttaattaatatgtcaactaaagggctgcaggaa

SEQ ID NO: 103420 - DNA, 689 bp, Oryza sativa
tactcctattatatgaccggcttgagctcccaatgatatcactacacccagggcagttttcaatggacggtaacctcatcccttcattccagcagaatctaaagaactcacaaccccaatgaggatcaaaaccatcatcgtgttcttcataatgcttctcctgctgcttgtcatacttcctctgatatttgttgattatcttagccgaactcacttgaaaaccctttgcacagaccctatcggctgattggccagctgtatgtaccatattaatagaaaaaggattaccatcgaccttcattggtttcttcgaatcatcaaacttgatttttcctccctcaatagccgtttggatttgctgcctgaagaccttgcagtcattagtcgtatgagacccagaattatgccacttacaatacttcttcttgcccaactcttcagccgatggaactttcctcttttcctgaggtctttacccattggcatggtataacctttttgctcctgacccactcggctgccgctatttcggaatcatcatcctcatcatccgatcttctgtgtaagatgtgacaagctttcgaaatcttcagatgagaatttttccctgatcggagcaatcatcccttgaaacgccaaatcggctaactgggcatcagtcaaattcaagctgtaacatttattcctca

SEQ ID NO: 103421 - DNA, 722 bp, Oryza sativa
aaactgcatgtgccattagtctggtttaattagagaagaaatagaaaagttctaatttttaaataatttttagagggcttctaaagttaaccatttgtcataacgtagggtcaaggaggctctgataccaacttgtcaggcccggaatttctatccaaaactccaaacgcttacatgtgtgtaaaccctcgtccaggaatcagccgaggcacacaataacaaattgataatagagtgcaaatatttatctaattaataggcgaatataaagtcattacagaggttgataattcctctcaaatattaaagatctaagcagcagagaaataaaataaatagaatagacgactccatcccacaagcagtttgaccagggctgtgcctaatcctccacaccttcagcataactatagaactcgtcgtctgatgaatgattgcaaggtgagtatatggcactcaacaagccacgcaacaaatatgcaagtgcaagggataacaaaggatggcatgatatagtcttatttgcataaacgacatttaacaaaaacatttcagaatttataaagcaataaagtatttaattcaacattattaatccaagctatacaacatacccgttgcataggcccttccatcctgaacaaccgtacccggatgtacagatctatctccaaacaaggaatgtaccattccaaactaggagctaggtaaattattaccag

SEQ ID NO: 103422 - DNA, 648 bp, Oryza sativa
ttttgggattttcttttaaagatagatctaaccatataagactagtaatatgcacgtgttaaacgctacagtgcaattcaatttgccacacaaggcacatgttgatcgcagcccattgagaacatagcataaggcgtgaatataaacccaaaaataacaaagtaatgcataagggcgtgaacataacaatttgatatgatacaaatatcaaagtaatagtttcataatgtgtataacaattgttggtcatctcgttaacttcttcttcttcataatgtgtataacaattgttggtcatctcgttaacgtcttcttcaatatctacatggaatgactactaaaatttaccgatggcaaaagtacatatttaaacacgagtgttaacatatagtatgaaacagagcagaccatgagattgatatggcagaaggattaaagagaactatatgctcaagtggaacttaagtgtgcatgttgtgctgctgaatatgaatttgtccagagcctagtgaaaagaaaatcatagtatttatgtaagatgacaatgttatccatgcccattcagacatcaacaagcaacataaatttttacagagcactaaatgattttatttacacactgtcagtcatgccatgtaaaagctaaca

SEQ ID NO: 103423 - DNA, 3823 bp, Oryza sativa
ggaaagcaagcgaatcgttctgatcggactagcggcctccttagatagcacacgcgtcgtgggatcatgcacgcgccgttacggagggctcccagcgcgccatctccagagacagcactccccaaaaacctcatcacccgcctacccggtgcagatctcaggcgaaggtgtgattagcgatcagaagcgacgaagcgaaacagcataggcgcgcacggaggaggaagaacactggggagaggaaagcaagcgaatcattctgatcggactagcagcctctgatcgacgtcgtaggatcgtgcacgcgccgttacggaggcagtcgtgggaacgtgggatcgtggttgcaaaagaatagagacgtgacggcacgccagcccatgcccacggcctcagcccggcgcgcgcgcgcgtggctttctgactcccacctcaaccggtcaacagggagcctccaataactccctatttaggttgagatactcctcgcttaattcctgagatggtattattatccttaacacctattatgggcctttgagatttaatagaataaatcggcctagcccaattattcgaacagaatatagggtcactgataatatgttattcgaaataaatagtgcaatgatggagtatgaaactgtgtcagtaaaaggaaatgaacctgctgcgaggactgctctgacggattctgaaacgaacggaggtggcgtgggtgccgccgtggggatccgttcaggcaatcgatcaatggcggcgggataatcgggcgcagcaggtacccaatgagcgagagttccccaaggcagccccgacggcgaaggggaggatcagcggaatcagtcacactggatccagtaccggcattcagcgacggtcaagctaggcatggagttgcagttgcagcggacaaattaagcaacgaaatccagagtaaccaatcctaatttagcacaaattaaagcttcaaagtgtagagtaaatagagacaggtaaagcaatgtgcattacactaattctgttaagcaccgacagctgcagcagacaaattttgaaggggaacaactacattggtctcatcgggtaatagagcaaagagaagttaaggggacacatgcgagtgaaacccaaagtgctcaccagacatgtggacatggcgctgcgtcgaacgccgtctggtccagagaggaataaggccataaatgatgcaaagaaaagctgaaatttttttcacatatatggctatcaaaatcaattgccggaattgtctatgccatattattatctatcaacaatagtctgcaaggctggtgaaattgagctacggttggggatgaggaatggggcgtggtgggcagcggcagaaatattccattgtgaggcaccagagaaaaaacaattggcagatgtttgttactgcatcacattgatttgtacaattctgaatcagttttttttgcacgatcataaaagggtagtcatttattcaacccgttgatatgttgatttagaaagcagtgagccagcaaataaaagggaagttcatctgtcgttgaattgctcatgacttatgataaaaatcacaatcggaagattcaaaagtaaagggataatgcaatcaaagaaaaaattacctggagatacaatggatgttattccctgagtaagcattacatcgatcacctaccgtgcaacgtgcaaatgggattaaagaacatcatgagacaatagagcatgggaactgaaaaggggaagtggcttgatattgaacctgacaatatgtcatgaggtttcgtgaagtcagtggcagctacaagtcattccaatctgaggcttggcaacatggtgaatttgtattgtgacagtaggaatggcaagatcctgtttagcaaagagagggaagtaattcttactcttctaagtgtgaatttcagaaatcaaaatggaacaatggtggaacgaagagtccacctgtctatgttgaccgtgtccatggaagatcctgaccctgttatggtgttctcctcctatttttttctatatagtagttagagaaaatacggtaatttttttttaaaaaaagtggggataccagatttattttttagatggagatcaaatggttaaaattaacgggtccaccgatttaaaggaaaatcgacggtgagattatagaatgccacatggcgacctaggaacgtttgtagaaggtcacgtggcggcttgagagcgtttataggaagtttaatagacttttagtatatacctaggaaggtagcccgcgcatatgcgcgggaattttatcttatttaacaatgttagaaatttgattaggaatgtttatgattactctaatgtaaacatctttattttttcaataatttgtgtgatgtttctttgattgctagtaaccatcgcctgcgtataaattctaaactaaaattacttaaaaccgtgcagttttggttttataagaaaaaatatatatgcaactatatatcatttatacataatgtttttcttttttttaatatttagcatatcttatttttgcactttctaaactctgagtaaaaaattttctttcgtataatatatatgtctttatgaattttaggatatattaattgaagatatttttctattaaaaatatggttaatacgactacatctaattaaatgagctgaatatgttgaaatattgatttaattgtaagtatatagtattgtagtatgaaactacggtttagcggtaaatgtctttcttaatcagaaaatatattagaaaatgagacttttattgctcccaagttgtagtttagggttgtatacttcgaactgaaattatgttagattttgtttccatcataatgccaaaaaagtcaaattttctattatattttatttaaaattttagttattttcattatatcagtactccaaaaatatttgaacattgctatttagaatgggtttcaaattaaaatatttcaacattactatttgagcattctatcaaccatcccttaaatgctttgatctctgcaatttgacatgaaaatataattgggttaaggccatacaacttggcatgggataaagacaacccttaaatgttttcaatatattgtgtatgacaaatagatcctagacgcggtacacgttatgacatgaaaaaataatataattaaaagatttttctctaatctattagtgacatcagatatcatatatgtaatttagatgttatgatcatcttaggaatgtttatttatctctaaaaagatcatttattcataaaagtgcaactaagatcaagtataagtaaatagcccctatatgcatgttaagagaaattaactacttccactgttaaggaaaaatgtatcaatatttataacaccaaattatttttattgaattcaaaattgaatatgtttttataatatgtttgttttgtgtggaaaatgttactgtgtttttttataaactaattcaagtaatttgatgttgacaaaatttaagaattacttgtaatctgaaacagaaggagttggaagaaggtcactagatgtctagcatggtataaataatgggctgaccgtttattgaaaacataaggtgggatattttaatttttaatgataaattttagtattttattttatttattggaggcttaaaggtggatagatgtggtccacaatgtaagtcaatacgcatattaaattattgatttaattgaaaattacaatagtttagaaatatcataaattgaatatacgatttacaattttatgaatattttaaagtctaattt

SEQ ID NO: 103424 - DNA, 1185 bp, Oryza sativa
cttctggtatattatggttacagagttcatccacaagcgcacggatataccattgtagcatttcacccgtgagtattccaagggtatcgtatttattttatcccgtgggaagatcatgtagagagaactcaactaataatttatatattacttatgataatcatattctaaacaggggttaagataatccaagggtagagtgacacacaagcatttctactcatcctcttaataatttatctaagctaggtggaaagaaaagagaaaggaaatctattcctatacttctaatatacatagtatacatacattctagttaactgatatactagctaataccctctatccgatgccctcctggtacttcgagaagtcacctctgactgttgttgatagaaaacacgaggcctgggagatctgcttaactccagtgcaggtccaaaactcgccttcagatgtatgagcgtgccagttgatttgatcctacaatcaacaagaaacgaagacaaagaaaccgcgattaaatccataaatgatagctgatcggctaggtgtcgatgacatatcatttattttaggccgatgtcatgcgtacatcgatcggcagtcatgaataattaaagaacaagtaaatctactcgaccggctgtagatattaacaatatataacccttatgacgatatatacttaaatcaagtgattgggatagatcggtcgccatgccgagactgtataaatcacttagatcgaaatataaattaacaatagaactatatacgttcatatcatagccgatcagatagatctagcatgtatcggctaatactccgatatcactccatattaagatattaaagcaagtagaatatatcaaacagaaccataatatacttagatgcaacaagatcttaacataaagggcagatttaacatgtcaatcaagcacataggataactatagttaaatcaggtaagatcggttgaaaccccgatgctaccctaatcggcaaccagaaggcaggctagagattgatattctaagcatgacttaatatatcaaactcaaccgatgcagcattaagtatgaaagaagaacaatatctagacaatcaagccggtggatgtttcatagagtggtagatatcttatataatccaagctaacgtcgctatctagcctaatcg

SEQ ID NO: 103425 - DNA, 942 bp, Oryza sativa
gtggtaaccatctcaccgcacgattatctgaatgtttaggtttcaccgcataatgggctcgtttgggacacgtaggcctctttcgtgccagcctcctcctgcgtgcttgatcccaaccgacgacgtcccagagctggtcttctccccctctgcacccaggccccatgcccaacctgctattttgagcgggagtgtggcattaatggcttttgttttcataccacggatgactgttgctgtgccaaaattgaagtaaaaaaaacatggaagcagcagtagtacgatgtacatttctgcacaaaaaaggtgacacatcaaggttgttcaatgaaacgggatatatttgtgggactgctgtgctgtgaagaaatgtatttgcttgagcactaaattttttccgaaaatgtattcatgattggttcactaatctaagggtatttatattgttatttccctcacgatcaagaaattgaataaaagaggggagcaggtgataaatcaataaattgacatcaactcatttgtagcaagtacagaaatattgtcttgtttcatatagctgtagcactaactgagacaaatcttctggggtttgaagagagcaacaacttgttaacatagttttggttcatatacttaagagcttccatcttgccaatatattagttcatagcaatttgtttaaagttttatcactcctttggatagactctgaactctgaagtaatatttttctgttgtacatcaaaatatattataagaaccatttagttttagatgttgatggtagccctcccttttgtcatgtctcacttgaaattcaggaacacaatggataagatgcatggactacttacatttttttgtcaatgaaatgtaggccatgcctcgggttactcatagatcaaagctccctaacataattgacaatgatcaagaaca

SEQ ID NO: 103426 - DNA, 1804 bp, Oryza sativa
tcctgcaccccaaattttaaagtgccaaaaagatgtctctacaagataaatttaacaatgtatgctaaaaatgtctctaaagtgtctctagagtaaaaatattttaggctattttaaaagtgcctctaaaaaatatctctagactatagagcttcaaaacttagagacattttgaaaattatctctgcaaaacttagaatggtaatatcgtgcttgatacgcctgctcatatgtttttctccaaaaaaaaattctcaacttaattatgctcgctattggcatggtgatttagctttgatatgctaacaaatgcccattgtcatcatcaacagtgcacctttctgccattatttgtcatatactcctatatttcacttttgttctgtgtttatctgaaccaaatgaaaatctgccaccttaggacacatccacatggaaagcaaacggtcttgtctgcttgcatgcagtgaattggacttgtggacctaagattgtgacaattcggctttgtttgacctctccgttggctccttggagatctaaagaactcaagggagaatcaaacaagccagctattactacctattagtcttgcgactcaaggtagtaatgatcacctgttttgtaggcaagatatccaggggtagatatttagggttcctttgaaacacataattaaaatagcgagtaaaatagataattgcaaagcacagaaaaaaaaacacaggaatatggttgtttgattaggccgtaggaaaaacataggaattaaatgagagagatatactgaaaagaaatttttcaagagattgaatctctggctaacttaaaaaactctatgggtatgtttggaaaataggttaggagaggtggaattgggaaatagaaatgaatggagggatatgataaaatgaggtgagatgaatgaatggctaagattgaaacttacctattggagagtgggaaatcatatcccaaacctattttccaaacattgtctataggattgttcatatcatacgaatttaaaaggaaaaaaatatgattcaattctctatatcaaagacctttacaggaattttccctatctaaagtagtgaaaatactaaagtttttcactaccacaaagcgtcacgtcatcaaaaatttagggctgttggatgcagcaaggaattaaattggtgccattggatctgaaataaacatgagtgaaaaatcccggtcaacagtagaatcctccagagttttcacgtagccaacggtccatggtccacacagcagacgaaaggtggcgaaaaggagaagcccacattcacggtagtgtatatataggaatcactgaacaggtgtaaaaaaaacccatctaatcccagaagccagaacgcatccatccacatccactgcctcctcccccgttgcggctagcagttaagttcagttgcaatgttcttactctttacgattatagatattcataccctgtataacccttacgatattacgcacagtttgcatcaatgtacacctacctctcaaacaggtcattatggtcgcgcaacgtgcgacttacgtggctagtaagatagaaatccctttaaatttcctatgattttcatacaaatcaattaagccttagtattaatttaatagggcattagtacctactatatagattaatttaacagggcaattttaatattctgagatgcaaatccttcaaggtaaaaacacaatgcaactcatgacaatgaacgaggtactatttttattttcttggctcacaagtcttagcacaccgaagttt

SEQ ID NO: 103427 - DNA, 5804 bp, Oryza sativa
cacgggggaatgtcactgaatctgtgtccagcagcagctgctccgtgaggaaggaggaaggcgcaggagctcaccgccgaggggtgccaagggaggcgcacgccgccgccgcggggcgcggaaggaggcgcgcggcgcgggtcgaggatggtgcgggagctcgccaggaagtgtttggctgctgctttgttttttctgttgctgctgctcagctgctctccatctctctctcgcctctctctcgcctctctttgttcttgcccggctggagggagacggagccgctcctgctcaggaggactgcatgctgttggtgctggagggattatgtaatttcttttgtgtgaaatttatcaaaaatctgtcaaatgtatgttaaagtttgtcaaaaatatatcaaatctaagtgaattttgtcaaaaaaaagttaaatcaatttcaaacttgtcaaatccctcgaacctaagttaaatttgtcacttatcttagtaaaagaattgtcacttttttagataaaaatacacaaaattagacaagcaaaaactttgaaaaagtagtcaaatgagttgggaggcataaaagccatttttctcagaattaacaccgtaacaccgttatgttgctttaacggaatagagccagacctaacattcctttttaaaaaagagggtaaaaaagcaaacttaaggtaggattaaattggtagtcagagtttaaaatagggttaaaaacacaattaccaaaaaaaaaaaaaaagaggagaacaccatatcagggtcaggatcgggcagggtaagtacgttctattttttttcggcggtgtacatacgttactacgttagtattatttttttcgtcttttttttttggcaaacagtactttttctttacaccttctgcaaacaaacagtactactactacgcacatcgtacgtaggggagtttaggaggaagtgttaatagatatataaaatcacatattacggatttaagtgaaaatcgacagctagatatttttttatttctcataatttttaatatttattttaatttggagatgtgacatgtggtgatctacgagcgttatatatgagtgtcacgtggcggcttaatagcattggtaggaagtttaatagacttatatactgaaagccaaataaacttcctataaacactatcaagccgtcatatggcctcctacaaacgctcctatatcatcgcgtggcaccctataatcacattgtcaaatggtggatccgttaattttaaccaatagatctctatctcaaagaaaataaatccggtatccctaccaccaacaccttacgtatatgaggtaaaaaaaaacgcagtacgtatcccttccaccctccgaaactcccatcttctcctattttctactccctccatcccataatataaggggttttgactttttcttgtactgtttgaccattcgtcttattcaaaaaattctggaattgttatttattttatttgtaacttactttattattcaaattctttaagttcaacttttcgttttttatattttcacaaatttttttaaataagataagtggtcaaacagtgcaagaaaaaaagttaaaattgtttatattatgggacagagggagtagctaacatatcctattttatcattaacactcaatatatttaaaaataattcggacatctaaaaatgatcatgactctcaagttcaattttattctcaggtgttttcaattgttgtgttatttataattaaatatagatttcaaaatgcatattgctcatattttgttatctaaaaattagatcgtgcagccgttctaactgcaaatctctgggcttaatggtacacccataaacacttctaagttgatcgccacgtaacactctaataaattaaaataatatataagtgtgacaaatgaaaataaaacatctaaccatcggtttccacttacatcgatgatccatagttcaactcatcatgtgacacatccaacgatcgaaaatcatcaaataacatcgatccaacggcttccgcctcccctggcaaacaccgcgccttcggtgaaatcctaacgttggagattgatcccacctcccacctccctcaatcgccgcatgccccctctctcgctgttccactgcacccgccgcattcccattcgcacctgcgccgcatccccgatccctctcccgcacgtgatgacacagaaactgctctgccatcagcgctcccctcccccaaaagcctcgctgatttgccccgcacgtcatcaagggcgccggctcgccgcagtctccatcgccgcgatgccgcccactccgtcatcatcgcatccgtcctcgcccaggaatcacgtcgccgccgatgccctccgcgccgatctgttcctcaccgccaccgatccccgctgaaggctcgccctccaccgatccccccgccggaagcccttttgtcgtcaggtcgctgccgatgccttccacgccaagctgctcctcgccgccactgatccctgctgccatgtcgctgccgacgccttccgcaccgagctgctcctcgccgcgtgttggtatttcttaatgacattactagaaatataattcctagcaatggcgccagaaatacttctggtatattatggttacagagatcatccgcaagcgcacggatataccattgtagcatttcacccaagagtattctaagggtatcgtatttattttattcagtgggaagatcatgtagagagaactcaactaataatttatatattactttaatcatattctaagcaggggttaagataattcaagggtagagtgacacccaagcattaacaactcattctcataataaatgatctaagctaggtggaaagaaaagagtaagaaaatctattcctatacttctagtatagatagtatacatacattctagttaactgatatactagctaatacctctatccgatgccctcctggtacttcgagaagacacccctgactgccgagttccttatgacagcccgtcatgaccatacaaccggggctaaatatggaggaataccctccccaggaaattaacttaggattatatataggcgtggaggaatacctgtactgagctgtcaccatcagcggcccacctctcatccgcaatatataaccccaaataatgatatcccgtaatctagacaccacgtataaactaccagaactactctaatatcatcgtcatgacatagagtaattgcataagcaaacattatacccgcactaaagcatctcccaaataagctagccgtatattcagtataacaagaacataatgtaaggtaggtacttatatactcggaaagtatttcaataccataaatgtataaagaagagtattctaataaaagtacaaagcttacaaaagaggaaaggaaagctgctagagccatacccgaactctttcgaaggcttccggactcttggttcctattctatttctattccaccagctagatactactaaactaaacttgagagaaatgagagagctattgctgtgtgtaagtgaagtgagaaggtgaagtccttttatagctgaactacgacggttgtgacggttggaatggtcggtaataccctccaaccgtcattggggcttcatctcaaccgtccagccaaaacctggatccaacggaggcgagggaggttcggccgaacctggggacggcccaatccagcccaatttcggctggcggccttctccattgttcttctccgtagacttgtgaattttggcccaatgtgtcatgttatttctgagttcttggcccattcatacataagtttggttctcgacatcgtctgattgatttatcgtttgtgttgatgtcgattctcctccactttagtgtcattccctgcaagaggttattatacctaatactagtggaatattattattctaacatatttatgcattgcaagcatcactagttctcctctattttggtaatattgacggtcgaaactgatcgataacgactgtcaacaaaaccccccaagcttgaacccttactcgtcccgagagaaggacgaaagggaacaaagacttgattgattgatcaggagttgctactatgctgcatatctcagagatacaggtgcaaggtatatataccctcactcagattaaataatctttggcacggtggcttacccttacccctgattcccacgagacactgcttctccttgccttgggcggttgaaggacagaacatcaattagagtaccaatcacccaatctttattcacctcttattccggaagtcttcaaatgatttttgcaaaagaaagccaagttcctcaaatgattcactcagtctctctaagtgtatcagtatgaatttcctcaccaaatgttgccttgttgattcctactctaaggtttgtatgtggagatcggtagggatcaaacatggcatacttgcattcacatttattactaagtcaaaaacttagactagagcagataactaaatatactcaagatcaagatcgtgcataatgtgtgtgatatatggtggaaatggtatatgaggaaaaataaaaaaaaatacttcttctttgtgcttactttcttctcccaaaaatccttgttttatcggttaggagagggcatggctacatttttttttcaatcatgctcatgcttgatggagcataactttattattattattttttcataaccatgcctttccctccttttctctcttttttttttcaaaaggatttttctttttaggaggagaaagcacatgaaagcatggataatttattttggtggtaatatggaaatggaatggaatattgcttagctcccagtgtaggagtttagcatgtgcatatatgtgggtgtatgatcttgatcagagagcatgagaagtatctacacaagtcacaagagtttgacaaagttcaatggaatgtcaagcaaccaaaatgtatatggtttaatcatgatagcatatttttggctttggtaggaatatatatcaaatgaggaactttcaattttatcattttgaaaaacaaaacatccagaattcaagtcaaactagtatctggatcatagcaactcatatttactatctcatatctcgcaacaacttagacttagatcagcaagtgcaacccatttacctcaggttcccggataattgttggctacttatatttaacctttgagagagcacttatgttgacggtcgttatcgatcagtttcgaccgtcaatattactaaaatagaggagaactagtgatgcttgcaatgcataaataagttagaataataatattccactagtattaggtatactaactttttgcagagaatgacaataaagtggaggagaatcgacatcaactcaaacgataaatcaatcagacgatgtcgagaaccagacatatttatgaatgggccaagaactcagaattaacacgacaaaatgggccaaaattcacaagtctatggaggagaataacagaggaggccacctgccgattttgggccaggttgggccggcccctggttcggctgaaccaggaggttcggccgaacctccatctccaccgttggatgtggggtttggcagggacgctccagatcctctcctgatggcggttgcggggtacttcagacatttcgcagcagttacaaccgtcatacctgcctataaaaggacttcaccttctcactcattcacacacctcaagcaagagctctct

SEQ ID NO: 103428 - DNA, 707 bp, Oryza sativa
ctgttactccgagaaaagcaaattaaactccctgctggtcataccattccatcggctgaggaattaggcaagaaaaggtattgcaaatggaacaattctggatctcatactaccaatgattgcaaggtctttaggcagcagatccaagcggctatcgaaggtggcaaaatcaagtttgatgattccaagaggccgatgaaggttgatggcaatccttttcctgtcaatatggtgcatacagctggccgaacagccgatgggggccgtgcaagaggttttcaagtgaattcggctaagatcatcaataagtaccaaaggaggtatgataaacaacaggagatgcattatgaggaagatgatgatggcttcgatcctcattggagttgtgagttttttagattttgttggaatgaaggtatgaggctgccatctatcgaagactgtcctgaatgcggcaacgttgcggatggttcaagccggttgtatattaaaggcaatcggctgaagcatgcaagggttcctgttgatcaaagattaggcccggtaaatcaagatcatgacccagaggatgacgaaataggaagactcaatggtgtcctcctggtatatttatgaagaatcagaagagacgagttcaaagattgagaagccgggaacgctttcaggaagtcgagcaggaaatcaataatcggctaaggggtgcagga

SEQ ID NO: 103429 - DNA, 1997 bp, Oryza sativa
taccaaaacggacaaaatatgtcattaactaaaataggcgtaactttctcatacggactcagaatcaggaaaataatatatccacggacatctacagaaaaagttacatccgattcttattggctttgccgggttcgacgatattaaaacctccaaattctgcttgcaagattgtgtttttgaggagagaagtttttcggtagacatttggaaaattccacatgctacatatttcgtccgtttgagtttatttttttatggttggttcttgtgagttcctaagtatgaaaaaaatatcaaaaaaataaataaaaataaaaaatgtggacatctctctcctctacactagagaggagagagaggagaggagagaaaaaattctacaggtcacatattttgtctatttgagttcattttttctatgattggttcttgtctgttcctaagcgtgaaaaaaatataaaaaaataactattgtcttgtccatgacctcatcgagcgaccaggagggggaatttaactatttgccattattgcgtttggcaattatccaaatacccctcttgcatttgcactgaattttttgcccttcttaagaggtggcttcttaagaggccggccttcttcctcgctgccgcactttgcgcggcctgccgcccgggtggtcgccatcaccggtgttagcctgggcgaagtcaaagaagggcggatcaaggacccggagtcaaaaagccggcgagatcaccaccggctccgcgttgatccaccaccaccggcctcgcgttgatccaccaccaccggcctccaatcgcccaagacaccaccaccaccacactcgccacctccacgcgacctcgttccgtgtaacaccctgaaaattcctgataataaaaatcactaaaattttgaactttttaaaacttttgcatcatgctggttgttatgattcctattgcttgccaaaccataaatgatcaccaagaaagtaaagaaaagaactacatttaagcaatagatataatttacgagaatatatttaatcctacaaataattatgcacaagatattaaaatcaaataaaagaaaagttattattaacctattttatcaaatattaaaatatttgaataatgtaggtgggtgccataatatgagtacacatgaaatgatgattattcaaataaactgagctctctgtatatataatagaattatgggagtatttaattcgatatgtagatctatattacaccaagttcctaattgcatttagggattgaaatttaatatattaaacccctccatataaactaacatataaataaattgaactaatgtgctattgtgttaataacggtctcattagaaaattatagaatctttaataaaccttaaatattggataatattaaattttgggcaaattcacatttgaacacttaatacggtcacccaaatgcttaggagtaaatacaaatttaatttgcaacttttctcaatttataaatcaaccaaaaccctaaaagaagaaaaataggaaaactttgaaaaatatataataataataagaatatgttcaatattaaatttgaatataaatttcgatggaataacttaaacttggtgtattttacgttgtgacaaaattagtggcaatagtatatttttcctaattgcaaaataccttctaaaaacaaaaatggtcggcaagcactgttcattagcccccctaggtgttcgatttggttcctagccatcctagccctcttcctccgcactaccgccgccgcgtcatgtcgcgtcgccgtcgccgcgccgtctccaacccgccgcgtactgtcgccgtcgccgtcggctgcgccgcgccgagccccatgcgccgtcgcgtcgtcatcaccgttgtccgcgctgccgcatgttgccgtcgcccgtcgcgtcgccctcgagcccccgcccccacaccaagtcgtgcgcgtcgcgtcgccgtcgcccgtcgt

SEQ ID NO: 103430 - DNA, 2048 bp, Oryza sativa
aattatggataaaacttttactgtattattcatggtctagaaaccaagatgaaaactggactacaatgaaaaaaaaagatccaaaatcagtttcaaaatattaaatttttctatggctaataagcaggtgcggagctagaatagaattgagacgggtgtcacttacttaatttactctactttagattgagtttaagctaatatgggtgcctaaatttgtattgaaaggtacacacatggtaaaaataggtgatgtataactctaaaaaaattttcttaaccaggttcgtaggcacccctaatatattttacctcgcccctgctaataagccaataaatagacgacaagaggattatacgggtttcctatcagcggtggcatagagcatagtttaacgtattgcgaaattctagttcaataacctttgaattactactactagtagagcaaggattcgagtaggcttgagtttttgaaatgaaaaaggaaaggaaaaaaaaacaacgccgtaacatcactcggtgcctacaccttccagagtaaaagctcgcaccaaccgctgttctcctggaaataacaactcctggcacgccgatgccccccacgcttcccgacgacaacaattcggtgaaagtagtagctgtacaagtgacgagtacagctgacgcctctcgtagcactactagcagtctagcatgtaggaagacagaggtaggaagacggtgaatgcgaaagagatggcaaagcagacaagagcacgagaccctaccacaatcaaaagcccaagcgtttcgcctttcggccttatggacagtgagaacgtcggactgtacgaaaagccacaccgatccgtgtcagctctccctggtacggacggctatccttacatgtcacctgcatgttccacgcacaaaggcacctcgcgtgataagagttcgattgcgtctcccataaggcctgttttctcaaaaacttttcccgaaaacatcacataaatacatatatggagcattaaatatagataaaaagaaaaaataattgcacagtttgcatgtaaatcatgggacgaatcttttgagcctaattagaccatgattagctataaatgcacaataacctacttgtgctaatgacggattaattaggctcaaaagattcgtctcgcgatttccagacgagttatgaaattagttttttcattcgtgtccaaaaataccttccgatatccgatcgaacatccgatatgacacctaaaatttttcatttcaccaaataaacaggcccaagcaaaagatacgagatattttgatttttcctgtagaaagtactgtatctgtactggattatgtgagtcgtagccagatagattccgagttctgacgacggtacaatgtaggagtagagcactatagagccgcatggcaaaatagtaatttatcactcacaacggtatagaaccagagtcctgcagtaaaaccgaaacttcaatgcatgtctccatcatacatgggtttgcctcgtatccacagggtacaaggatgaaacagggttacgggaatttttttgggttttagatttttttttaatatttatagaaataatctatcggccaaaaaaaattacaaaaatagaccctgccgcccacctctggagcggcaagctgacgtggcaaacgggggaggaacgggcggtgacggagggagggttttttgcaggaaaacccttgccgccctctggtggggcggcaagggggcattcgggccccttgccactctctggccgggcgacaggcctcgctgcctataaaaggcctgccgcccagcccccagctctcattcctccctcctcaattccagtgaaaaaaaaagaagagaggggaggagaagagaagaaggggcgaagccctgccggattcagacgccgatttcaggtaatattcatagatcctatatgtgactattgagttaaatagtgtgtattttttaaaaatttgtttgaataacacgcactatatttttagggttttagttgtactaatctagaagta

SEQ ID NO: 103431 - DNA, 709 bp, Oryza sativa
ctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtaaacctctgttcagagtataatctattcgaatagccgcgccctcggttatgggcaagcctagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatatggtatagctctggaatcgtgtttacaaaatagctttgagcaactaattatcttttaatgctgtttactgcaaaccctaaccctttatattataacccccttgtactcctgtcgcgactgagaaaatttgcattttcccgaacgctagtgtattaatccccgtcccaggaaaagccgggtacaccacacaaacatgatataaaagacacatctttattatatcgataatatttacattattacaaaggcacttcaggcctggcaatcaaaaataaacagc

SEQ ID NO: 103432 - DNA, 1417 bp, Oryza sativa
aaaaattatatgaatatatttgtcttgaaaaatactttcataaaagtatacatatatcacttttcaataaatatttttatagaaacaagaagttaaagttgtgttttggagaccgtgtcgctgtcctaaacgacttcctttacgagtatggagggagtatctgacagttggacacttggaatattaataaatataggattcgcggagctattaacacaactgcatcgatctctctgatattgcagttagcaaggaattggaccacacgttcaaatattaaagtgtgcattgcatatatattagccaatgatcacctagaactttggagaatgtatggctagttcgttggtgttcatattgtacttgcgtaatctcttcgctctgcatgtgcgtgtcgttgactagtgaggtgtgatatatcccagctagaagacacactaattattaacttaagcacaccattcccatgggtctaatttcttttgccaagttcaactacttgactagccggccgtgcatcaatatgcatgcacaccactacgtactgatcgtatgatccaactatagggtgcaaggatcggggcaagagacgatgcaaacattaggtgaactattttaatccctcgaacagagattccttgtttgttgaaaaaatcatactgatagttatgaacaaatctttaaatctttaataatattcatacaacaaaaatgtaacaatctatagaataggcataaactgaactcacgcattaagaaaataaaaagataaagacaacatataaataatactagtattttttttctcaatgtgttgtcaagtttgaacttgtttttcttgagcatgcaattaaacttgagagaaaaaagagaacggatattctctctagggattagaatatgttcctacaaacatagggcaattcgaacttaagccctacgtttgcctctctttgatccattaaagaaaaaaaatcaaaattctgaatatacaagagggctaattaagaaataccctcaagtggtaaagtattttttccctgtgaggggatatccctaaattctcgaatgcatttaaataattatgaaacaatttgataacacagatcaatatgtgatatatcatttcataaatatacaaaatcaaaattgatatatacaagttgaaacaaaagatcgaataatccaataaagaacatgcactaataatttggtttttttatcaaattttatatgtcgtatttaaacttacatgtgtatgaagtatatatcacatattaatctattattttttttagaatttaactatttgaatgatatgtgagaaactaaggaactagtatgggtttacgacagatgggtccaccgacctacatcgtccctgtacttcacttattttgtgccaaatgtgcttgga

SEQ ID NO: 103433 - DNA, 623 bp, Oryza sativa
tgtgaggatacggggccttgattggcgccggcggcctgagattgtataaaggaggccggcgcccttccgaaggccggatcgtctccacaacccgtgggtcttccttggcttctcagttcattttccacccagatacagagaaaaaaacacactggacgtagggtactacctcttctcgagggcctgaaccaggataaacacctgcgtcaccatctctccttgatctagcgtaccccgtaaaatatatcgccgatactagaaatcgacagttggcgtgccaggtaggggggcgctcgatcgttttcaaggcggagatggcacctactggctttgagatcgccagcaccaccactttccccaccgccacccaaatctccttcggcgcattcgacttcctcgccgatagtgccggcatactccgtcaggtgagcccaggggtcaccgggccggttatggcttgccgctatgctccaggaaccaggttctccttcagcagtctcgacttcatcgccactggctccggcgtcctcaagctggccccaggggagcccgcgccaccgacgaccacaccaaccatacccctcggcatcaacaacttcaccgcttccgctgcccaagcactt

SEQ ID NO: 103434 - DNA, 671 bp, Oryza sativa
atagttttagagtaaattattttatataatttatcacaaaaccacatatttaagagcttgttttacaaaactatagattttgtgtctccatttatcacaaaattataggtactttgtacaatctatcacaaaactacagatttaagaacttatttcacagaactataaatttactatatttgtttaacacagaactatacatttaatgtcttcatttattacaaaactacagatttagtgtctccattatcacaaaactacagggtttaacaatgctaaaacatgttgttttgtgataatgaggacactaaacatgtagttttgtgataaatggagatattaaatgtgtagttttgttaaacaagttcttaaatatctagttttgtgatatattatgcaaaatacatgtagttttgtgataaacgaagacacttaatctgtagttttgttgaacaagttcttaaatctgtagttttgtgataaaagtttgtagcagcgggaacaatgttgacggcagcggccattactggttgttgccatagcagtaaattcttcttttctaaatgttttttctttccattcggtttgaatataacaaaatattggttgtggtgtcccttagcaaattacgaggtagttgggtgtcttacaaccccatcacgtttttgagg

SEQ ID NO: 103435 - DNA, 633 bp, Oryza sativa
attggagaaccttaggaaatcattccatgcctaatgtagttattttccatgacatctttgaagggtgaccatgagtggatgcgcaatagcttgctcgacgttggagctgaacttggtacttttgtttgggatcacctctcccgcgagatcgccaaaccttacaaagccgaagacgaagcactgtccgaacaactggacaaatctgccgcagtgatggctgcaatcgcggcgcttatttttagtacggcacttaacatctttttcaacgtggaatcagtctaccacaacgctgcaaatattgcaattcaggagaaccatcaggcaaatgtggtaaaaacactcactgggttctcgctcgttggatctgcagctgccatcgttttatgtggactagctggatttcccatcttacatgccagactccgaatgcctggtcttattctgggattatttattctcattatatcatccgtgtgtacactgatggcattagcggcacggctgcacctggcgagtactcctcttgcatcggcctttacatggtcttttgtttatatttcaggtttatgtgtagtatactgctacatgaaagccagttacctattttcgaggttcgacgttcatgtacgtgca

SEQ ID NO: 103436 - DNA, 2219 bp, Oryza sativa
aattaagggggaaagagagaggagggaaaggggattaattccccccaattaattttggaatccaacgcttaaatcgcgcggattcgagggaggaacgaagctagggttcacgggagagagagagaggaggccgggcgggaggaaggaggcgaccggcctggcgcgtgggccccacgcggtcgggcgcgcggcgtcagcgcgcgtgcgacgcgcgtgcacgcgggaaggaggggcggctcgggcagggcgcggcttgggccgggcagccggcccaggaagagaggagggagaggcggcccgggggagagagggaggaggagggagtgggccgggagggggaggagaggcccgggagagagaggggaaagagagggagacttcgggctgggcttggcccaaaggaggaagaggatttatttttaggtttttctttttaataaactttgataactgtttttgttgcttaataattatttccggtgctctgaaaattcaagtaaaatttgagggctccttttagaccaaggagaatttaacaaaaattctccgggccacatttgaatttttcttgtacgtattttagtgtttgccaatttaatttttcttgtacgtattttagtgtttgccaatttcttttcgaattttaattaattctattattccttttagcgaatgatttttatttcgggatgaatttatcaggacgtgacaaaatccatcgcccccttttgttccttgtgatacaatttgtctaccagcggcggctgcgagtggcggcgcctaattcacacgtagggctttcatcgggtacattttaggggttaggattcatcagctaccatcggcatgcttttttctgtgtttactgggtgatgtttccttgctgttgtgtctttgcaccaggaggggagggggaagcggacgccacggaccgaaagtgacgaggcggcgaagccgctatgcatctagacgcgaatcgcactaagtcttctgcttgtgtttctgagggatgcatatcctctacctttagctagtaaaaaaacggtgtaactttatttcatctctaccatccaaattaactttacttcatcaacaacttcactttaactatttaactgtatttctattaactagaaaggtagcccacgcgaatgtgtgggcatgcaacctaagttgtatttgagacacttatacaagcggaatattaactggataatatttgcatgccatgcttcaaaagtgtgatttgtttcataaatttccttcttggcattgtttagataatttttctaacctattagagtagttccaattatctaaggcaattattattgaatgtttattgcaatagtcgtttcaatttaagtgtaaagtaagaagtaattttttttctcaattggttaaatctactccgtattgatatttttatattttctattttatttcatacaagtcttatttgaagtataaaatttgtgatatgataaatagtagcatagcagtacacttttttctttatcaactttcataaaaatttcaatcgccttttatataagttggtaaggctagtatatattctcattgatcaataattggtggattggataggacatgaggctacactacatatatgggtttgtagagtccaataggtgtagcacacaatctatttgtgaacactattttgcgtggtatgcgtggtgttgacggtccttaaatcataatatttgaccgttaatacttgcatataatgaaataaaacatggtatcgaacttagtggtaggtattattactaatcatttccactagtgttggtgaaatatgtgtatgtaggtaatttgagaagaaaacacatccgtcatgtaacaaaatgcacctccgcacattcaggacgcgtttacacggattagaggcccaataagtcaataaaaaccatttagaattgggccaaaacatagcccaggttattgggggcccaataagcaacctcccggccgaaggagaggccgggaggagagtttttgtattcggccgaaccgaccagtttggccgaaccaatcctgacgcttcccgcgatctgctttcaccttgacggctcggatttctcctctaaggcagttgcagggtgttttggtcatttcccatacccctaaccgtcatttggagcctatataaggaggtcaccttctcatttccaagacacacaactttgagctga

SEQ ID NO: 103437 - DNA, 685 bp, Oryza sativa
tcagtgcacgcctaacctgaaatagtgagcttagtgtggtgtgattttcgtataatgtgagcaagctagggttcataactatgaatgattgcctccaggttgtgcagcaaagcaaatcactaatcaggttggtttaacagttggtggatgattgatgaaacaccaaaagtgtctccaataatggatgtcatgttgatggcctaatcatctgtccaagttggtgtgatcggttggtttcactgtgatgcttgatacattgtactactggccaaatcatgaaaaaaaacactgatgaaatcgttgtccctgaccaaagcattgtaagctctaatgatgctaacatagtagtagtaaatactggtccatttagctgtgattcagctgatgagctactagagaaaaatgagctcaattttctcttttccagctggtttggtttggggctaaaattgaccttaccaatttttgccaatgccaaattttggcaagacaaagttgtgtttgattgaagctgaggttaactaatgatgttgcctaccatttaggcctgctaaaacggcttcagtccaaatagataatagacagtattgaaattacaaaaatattgatgaggcaatttaggcaacaaacaaaaacaggcccttcatgcatacagaagtctgcttaattaatctgcacatttgaa

SEQ ID NO: 103438 - DNA, 697 bp, Oryza sativa
caggtttggagaacttcttctatgaaataagcattcgtgttcctttcttatgttatttaattatttagtctgagtaagatatatttccatctttgtgggttcattgtttagtatttatactaagtgctctagtactaggactctggataaagaaggaagttcctgcgcaagtattagagtagtaattaataacttaggcgtggtgtctaggttagagattacctttgtttgttgtgtatcccacagatttgtcagaggtaggtggcaggtggtgacagccctgaattccgtcccagtaatcctccacgttcggatacatcatagagctatagccagaaccacgctagcagaccagcaggggtcggtgcccgaagcaacagatagagaattaccttcaacttagcttagataattaaaacccatagaaagacctctctagcctagcctacctatcatcagttgcggtccttggatcgtcttaaccttaggtagatcacaaacgttccctgagttcaatatccttttggggtcacccgaaggtgaagtgctacagccgtattctatatgcttgcggatttatctgtggtcgtaagaaataccaacatgtggcttcatgcagcctatcatgaacacgatcgaacaactaaataaatataatcgtgcaggcatcattatatcattattttaaaacaagtac

SEQ ID NO: 103439 - DNA, 947 bp, Oryza sativa
tttttttccaccttctttttatccccatataataattaaaattaaaaaaaattacgggcctagaaagcccatcaacctactagatccccactgctccccacccatcagaccatttgtgtacatacgcttccttccacttctccattaaggaaaaaaaaaggctgcaagaaaaaagaaaaaaaatgcatatatgcgtacgtaccccagaaaaaggaaaaaaaacacatacactatttgacagaaaatataggtatgtacataggtacatacgaatacgatatagaaaagcaaactatctatccttatccttatccttatccttatccttatagatgactatttaaaatgtggcatatccatcttatctctaatattaacatattaattatattttaatttaaaaattatcatataaactcatattacagtcttttatatctttcagttcgatctctatatatgactgtataaaacatgacacatctattttatttattaaaaaaaaatattacatcacatttatattttagtttaaaaattataacatcaaccatattatggctctctttgtttaggcttataaacaaaacatttctgagcctaaacaaacaattagctttttgtttggtttttttaagccataagccactttaacactaataaaccaaaatttaatagctaagttggagactttttttcttatataaggtagatgtatgactccatcactaaacttaggacattcaatccacaggcttataaatcatataagccaataaactgacttaaaagtctaaagcaataagcctaagcctaaacaaagaatgcctatagttttttatgcctttctcggtcaaatagtgctaacaattactccctttattaggtttgaataactcgcaaaaaacaccctattcattgacaaatatttccacccacttcctggg

SEQ ID NO: 103440 - DNA, 749 bp, Oryza sativa
acacccttagtggggttgaactttatagatactactccctcccttccatatattgatcatcatataagtgttttgtaccaagactaagaaagacttaattaacatgcattttatataatacgggtatgtggtgagaaagaatcaagaaatatacagactttaactcctcatatgcacaagaaacgagcacttacctaccccgaaatgcctgcatgcatactcaatttgcatacatagatgcaaaatgttgcacgtcaaatgaagggtcaaggattatatgattatatgatgatcaatttagaatttctatctttggttttgatgatcaatatggaattaatggaggtagtagttggcaccccataagaatggagggagtagttggcatcccacaccttgctacgggatttgttagttttattgtcaaacaaatcaaagttttagataattaggtgcaactctatgtatataaaaaaagttgataatgtggtttcatatataacctttgttattacaatactatccatgctttatttttgaaagcatgattgtgtattgttaggatatatgaatgttattttcatgcacattgcaattagatagtttgcactctctgattcatctcaggattattcttctgaaaatgagttttgtttaatgatgtgaaaaaattatatgaaatcaaattgttcataataaaataaagcttagttaagtaataatttaagttgtattcgggaaaaaaaact

SEQ ID NO: 103441 - DNA, 1275 bp, Oryza sativa
actttgagctgtaatatctttcatgtgattaattttaataagagatcagcggatgattgctcccaatagcttcaggttatactttgagcagtaatacattttaagtgggtaataccaacagcaaagtgtgaaaaatcatcacccatcattagttccagcaacacccgcgtcgctccgcgttaggggcgacataggcggtgaacaccctgtcacgactggaaataacccaacagattctccattcgtgcgtgtattatttctcgtcccaggagacgatgtacatagaagttgatacaatatctatctattatatactaaaagtccattaaactttctataaacgctattaaaccgtcaagtggcgctcctgcaaacactcctagatcgccacatggcactgtttaatctcaccgtcgatttttacttaaattggtggacccaatattttagactattagattagatgtattattttaaaaagtaatactttcctcctatgtggtccggaaaaagaaacagaagtattcaatatgtacgacgtacatctgaaagaaaatcgattaaccttacctactgctcactggatgagagaggaaagaccatgtacagcttatatatatgatgaaaggttattttcaaccgttatattagatctatttaaaaaaaaaactcacttcttctaatctcccgttcactactgctcgtaaaaaaagcccaaaataccaagtacatacataacgtactataataaaagtagattacagaaaaaacataaaaacacaaattatatacatcaatttaaaaaatacaaccgcttctctctccttcccacctttttccatgtatatgtgagaacataattatattactgataataaatttaaaataattataattttacaaacatagactatatatatatcatcataaagtaactctttacaaataagtataactgaaaattaactctacaatgtttaaaggagaagtttataaaattagatttttaacccattaaattaataatataagataatatttttcttaaaccggtggactcattatttccaaataacacattgtgtgaagtttacaccattatcttttatatctattaaattcactatttataatttatgtgtactaatttatacttaaccacaagtggacccattatttgagactattttttagttaaaatatttgaccatcaattttcatttaaagtgatggataataaaccatatatatatatatatatatatatatatatat

SEQ ID NO: 103442 - DNA, 705 bp, Oryza sativa
taattattaaattgaggtaatgtgtcacatataaaaacagtttcagagatgtgctagtacaaatcttggtactacccatgaccatgaacaatagaaccaaaatggtgaggcgcgtcgcttgctgtctaagctaacaggcaaaccgtttttagccatcaattgtgcatagtatttttaacagaaaatgccaggaattctgcctgacagttttcattaattctttatatgcatgttcagaaaaccaattgcttcatggaaaagcaccctttattccctgaaaaatctaaattacaccaaaggggaacaaatgccaaacttcttgaccacagtacattcctcctagttgaagcacttgagcacacaatgaaaattttaatcaatctcatttccttgcttttttttttcttttaaaaaaaatcttatcaccaaactttgcatcctgaacaccatccaagttatatgggggaaaacagataaggaggaagttaaactttgcatcaagaacaccatcttccaaagttccaagttaaatgacatgttttttttgggggaaaggaacagataattaatgaagaggtaaaaaaaaagtagtagctgagaaaatgaaatggagtggcttactgagtgtagtagtagaagatggtgccaccatcggagatgacaatgacgatgagcaagctgagaaggacgaggggctgcaggaat

SEQ ID NO: 103443 - DNA, 575 bp, Oryza sativa
agctacaaaatatttcaactacacctgttgcaccatcatatattatttctcaaatgtgaataactaaattggatgtatagtacctaagaaataaatacctcgaataagaatagtccaagccactacataataatatttagagggagaaacaacactgccacgttacatgttgtctgaattgctataaaaaatatgaaatagtttgagaacaccaatcacaacattatacattgttttgcaaacatcaataactaaattagatatacactatataaacaaaaagagctgacttatttgaatagtccaagctgctacataaaataccagatagataaaacaatctgattgcttcatgagctttttaaaagtaatgtgctcaaataatccgagcaaggaaaatgatctttcaccatttgtgaagtgctatagactttgaaataactattgcattgaccaatgcaaaacaattgccttggataattagaacaacactaataggttagaaaacttatcttagccacgccaacaagaatatttttgaagcaatcatacttctgaagtatggcacatgttat

SEQ ID NO: 103444 - DNA, 557 bp, Oryza sativa
agattcatgttgactagttcttttctttaaaatatttaaaataccgtacggtctcacatattaaaaagaagcgctatataagatatatatttgatcaattaaaaggagggctagcaggatagtaaaaaaacttaccagcaatgaaaactttctcgagacttcttgaggaaaaagtaaacaatgagaattcgattaagaatgaaaaataccttactttaattttaacttattttgttagaactatttccgaaacaaaataatatgcatgcccgtgcgaatgcgtgggccatcttcctagtttaacctaaaatctgtagttttatgataaatttggtgttaaatatgtaattttgtgatacaactctttaaatctgtagttttataataatttgatcaaaatacctatagttttatgaaatttactcaacttgaaattttcatggccaccttccacggtctcacccgtgcaccaccaagtagcttcactgagaacggcagacccagaagtcaagtcacttattttcctaaagtcaaacgacagtgaagtgcctcaccct

SEQ ID NO: 103445 - DNA, 553 bp, Oryza sativa
agtgggtttagcctcatcacagatcattggccagtaatgagaatacctcatttgtgatgggttaaaacccgctagtgatgacagacatctatgacgagtggttctgtaaaatgcccctaaaactttcagggccaaaaaaggtaactaatgatagtttctagctatttctgttaagatctctagtgtggcctattatttggcaaaacaataacatatattgaataataatccacggttttgcacttttaacttcagtattaaaagtacgaggtgtcataggtaccacccatcataagtaagtgtagcatccgtaagagatagtcatatgtgactggttgtcactaccaactgtacttctgttggagtcttaattagtatttacaattgggaaaatccagaacaaacaagtaccaagagaacggtaaacctgtgatgcacatttttattattgatatgccgtagagacaatcataaagatgattgtatcacgtactatgtttatgactttataaagtgtttcttgaaatggataacttattattaatcaatgagt

SEQ ID NO: 103446 - DNA, 1684 bp, Oryza sativa
cgtggaaaatgatcatgagaagcaaacttatgtcaacatcaaggattgggtgttcactcaaacgcgagcatacgacccagaccagctcatcaaaactggtatggatgttgatttcaatgtatggcaagctataggatcagaagttcttatgcctgtagatgagcaaggcccatgttttcttagcatacaatttctttacaccttgcgagatgcgggcaatggtattatgttttgatttttcataacacaataccatctcaaatggaagagcctatgcatttatctgggattcaacaaaaggtgttctgtggacttggagtcaacaacttcggatttcaacaggaacgagttttggcatcacattgtgggtgaagttgtctgtgggaaaccacgaaccaatgacatccacaacccaaccttacgcttgatacacaaatggctggctttactctattccctcgggaagatatgaggccaatatgcaaagataagttgagaatcctatataccatggttaaaaagactaaaatctctcctattaaagctatgatcaaacaatggttaggaaacattaagatgataggaccagttgaatgcacatgcttaattactcttataaccgtgaaagttggagcgttggaggatggtccaatcatagacatcccgagggcccccacgtaaggtaacttgtctcttcatttcatttcattgcatctaaaaaaagaaaattgataaaattttggaaaagataaatagaataccaaaaatatttactttccctgcgaggtaagaatgttttttagttctcaaggttgaaatgatgaacaattgctctactttatttccctctagttcctagtttacagcttagtgttcacataagttttgagtttgttggataaaaatccttgccttgaaattgaaacttatggttgcatatccatgatctaattctaagttgtagtgagatatgagatagtgaagtagagttgctttaatctttcttcaagttatacttgacattcatagttttttttttccaaaagaatgaaaatatataagtttctcaataatggtaaattcctaccaaagtcatatgatgattacattgcaaagctttcacacatatactacttatcattacattgagcttttgaaattgttgtgacccttgtgagaatctcttcatgcttccctgatcaagatcacacgccactaaatatgtttgacctctacactagaggtcagcaaaaacctgccaatcaacccatgatatttgctttacctctgcattgggggttagcaatccatccgccaaataaagtactccatcttgtcgaccaaaatgtatctggtagtagtttgcaaaaagaaatggttgcgattgaaaaaaaaagaagaaagaagtagaaaatattctcaagtattatgtgaagaaaaaaagagaaaaaaaggagaaaaggagtgtatgcccaaaaataatcttgagcatcatgcaaaaaaatatagtctatgacaaggtgtagcaccaaacaactaccaccatatagcctcacacttgcacttgcacatcttgatcatattgtatgatttattttcttcttgggtcctctttgtgattttacaatacttgtgatgtaagtaatgcctcatttatcttccctacattgagctccccatataa

SEQ ID NO: 103447 - DNA, 899 bp, Oryza sativa
attcctgcagcccaatctaatctattagagcatcatgtgatgtcttagagtgtatgtaggatgccacgtgatggtttagaagcgtttgtaggaaaagtttaatgggcgtttatataaagttgtgtgtttgtgcaactatattttctcacaataataatgaacaacgtacaaatatgtttgtagaacatttttgcactgtggatataacattatcacattaaacttttttttgtaattaacgaaataatttgttatgacatcacaggggtgcggagtgaggtttgaatgtttttttaaagaaaaaaatagatctaacaacctaaaactgatttatgtagaaatcgatgatcgaattttattttttttttggattttctctaattcaagagtgctaggtagttatgtagaaatatttgtatgatgtttagtgtactataaagagagtacaaagaaagagcttgctcgatccagaaggttaatatctatctatggatatttttaggcccataaagaaaaaataataattttagttattatggaaataaaaaaagagaaaggaacggacgaagggtaggttagatacatgcgtgagaacacagcacaaaggcatggacagagggagatttttcttaagatagatctcacgatttaaaataatgggttcattgatataaatgaaaatcgatggtcaaatttctccgttttattataataccacgtgacgactcgaaagtgtttatagggtgccatgtgtcgggttaggagtatttctatgaagtttattggtctataattatgatcatcaggtatctataagcaatacgtatttacatgcgtaaatattgctaagataaatgtaatagtagaaaataattgatcaaccatatttaagtggaaat

SEQ ID NO: 103448 - DNA, 763 bp, Oryza sativa
acagaaaggatgcagctggactttcggcatattagtgggacgcagcgacgtctatttaagcttcagaaacaaaaatgggcacacgcctcttgatcttgcggtactgggcagcacaagccgactgaaattttggccagtatgttctattaaccccttgctcctctcctcccacaccctttgcactttcaaacactatctaatatattcctattatatcatatactttcacacaatatatgatattgttgactttttaacatatgaccattcattttattttaaaaaagaaaaaaaagttcattttactctcccgaactatttcacaagaacacttaatcccctaaactatttttttttactcatatttatccccccctcccccgtcccccaactattgaaaatggttaaatttactccttataatagcatttcttttatatgttacgctttatacaagttgttttctcagctgaattttattagagccatagatgacacaattatctaatttgaaaaatatgttcaatttttttcataactgtttgcttgaacattaaaatcatgatgtttgaatcagttttaactatttccaacctatgtaaacagtgagaaaaaaaatctttaaaaaatactgagaagtgagttataacacatctattattcttctaaaatttcggtgcaaaatataactcatacaaagaaaaaacgaaaaagagaaatggcgtaaagaagtaaagtgaactattttaagtagttcagggtg

SEQ ID NO: 103449 - DNA, 695 bp, Oryza sativa
ttgacggtcactgcacaattatcacgtaaaccgtcgagttaccatcgaggagttgtaacctgcccggtgatggtttgggaaaccttgctcataggcattatagccgtatacaagtttatttcctaactttattggaagataaattgcataggcacatatacttcttagtttcaaaattcgctttgatatgcccttattgaacatatgggatatatggaagttaaatacccttccattacctgggcagtgctttgatttgtctgtttactcgttatggtaggtaattaacagaatacgttcggttggcaccgattaaataaactttcatgcaacaactccaaatatgatatcccacgtcacatccatatgctcgcatagcgtgcagtttatttaacgataggaaatatacaatatcaaggtgttaaaaataaaatggaaacaattcaattaactattgtcaggtactattagaccatatgacgtcgtgggagtaagctactaggttatagcacacgttctattaaaaatatatgttgcccaatagcatcaaagataatttaagtaaaaaaaccatagtagagagaacatgaagtggtaaaaaaaccattgtcacgggttttggttagtcatatttgattactcgtcaatatttttactaaaataaaagtgattgagtttgaatgtaagcaacttct

SEQ ID NO: 103450 - DNA, 627 bp, Oryza sativa
cattaaagttaacactaaatagttaaattcataaatatgaaaattttctgacagattataattgtttccgtaaaaataatgataacttttccaaccatctccgaccgttttcatccagggagtatagttactgtcaaactcatcgttgatgaagctgagaaaattatgcgggcccaatccgatacctttgcctggtttctgcgtgcgaaaaatctcgatggccagacgtgcttgcacgaggctgtgcgccacggtcacgaagatgttgtgaaatatttggtttcgaaagatgcagatttgggggatgtcccgttgccgctggtgcagatagtggacaacgagggcacttctccgctctacttggcgaccacattacgcagagacagcattgttaaggtgctcacagaagcagcgccatcaggcatgcctagagccgcgtcctattctgggcctgcagggaaaacagctttacatgctgctgttctcttcagtgaaggtacaaactcagtcttatgttcgttgccaagttctgcaaggtttattacatgacatctctccacgtttagtaggctaatatatcttacattttctgcaaatcatgcacaatttgctcctacggagtttcct

SEQ ID NO: 103451 - DNA, 591 bp, Oryza sativa
ggtactatggcaaagggcgtgggtgggtgaaacctcttcgcccgcagcctttgacaccgtgccttattggcactatggcgaagggcgtggcgtgtggcaaaacctcttcgcctgcagcccttgacgccgtgccttattggcactatggcgaagggcgtgggtgtggcgaaacctcttcgcccgcagcccttgacgccatgccttattgacactatggcgaagggcaagggttggcgaaacatgttcgcccacagcccttgacgccgtgccttattggcactatggcgaagggcgtgggttggcgaaacctgttcacccacagcccttgacgccgtaccttattggtactatggcgaaggatgtgggtgggcgaaacctcttcgcccacaagcccatgacgccgtaccttattggtactatggcgaagggcgtgggttggcgaaacctgggccctgttcgcccacagcccttgacgccgtaccttattggcactatggcaaagggcaaggcgtgtggcgaaacctcttcgcccagagcccttgacgtcgtgcctttttggcactatggcgaagggcgtgggggtgcaggaat

SEQ ID NO: 103452 - DNA, 1094 bp, Oryza sativa
taaattctcaatagctatcttctcgtcactcctcagctgcttctcgaaatctcaagttccccataagagccctaggtagccagccattggagaggtcatgcaaggacaattccatccaattgatgaattgcaatggagtagcagtaggatgagcttgtccaaattgtaccatcctgtgccataactctcattacagcataaggtactgtgtgtggtctcctctcctttccctttgttgtgtcaatgaacagtatgattgtgcttgatgtgacttggtagccgtagtggggctgtacaattgtcaccaattatatccagggaaataaattgccttcaactaatcacccagaagagccactgtgctcatagactgcaaaacaatccagtgccacttccacagtacttgggcatcaataatgccttgtgtaaggaggatgagatccatggaatttaaacattcaaatgcctgcagaaattcataggattttcacaagaatcggtttaatttccgtaaaacgtacagatataattcttatccacattacaaatagagtcttttatgtgtgcaattcactgcatactgtaagatggatgagatcggtttaattttcacaaaaaagggtaagaaatggagcctttttaagcctgcagagagtttcccaagaatcggtttaattttcacaaaaaacggtaagaaatgaaaacaaattccacgttacaaatggagcctttttcagtgtataattcactaccttcgttaaggtaatctgattggggcactagtaaacttagcaggcactcaaagtagttgagatgcagatccattgcagccattctttgggagtgtagtaccagacagagttccactcctagtattgaatgatcaacagtacgccgtgccaagatcaatcgcagccgtcgattctcgatccaacggctcgcctacacttggtacaaaccactgcgtgacactctcacattttctcacacatttgcagctactccagctttcatatctatcatggcacactgctgcaaaaatgcatcacctgatcagtgatcagctctgtttgcctgtctaagtcctctgattc

SEQ ID NO: 103453 - DNA, 1559 bp, Oryza sativa
agggagtaacacaataacaccaatttttcgttgagcacaaatgccagttcagaactaaggttaggttcaggaaattaatgtaggggtcccttgggcctaaccaacccagtacttcacataatgccacttaacccaatgatgcctaggtctagctagttgtactgtgtatgcatgaaagcaacagagctgggtcagtacaattcaccagaattacatactacatccgtcccaaaataagtgcagccgtggatatccgtgcccaacgtttgaccgtccgtcttatttgaaaaatttgtgaaaaatttgaaaatatttagtcacacataaagtactattcatgttttatcatctaatagcaataaaaatattaatcataaaaaattttcaaataagacgaacggtcaaacgttgaacgtaaatagtgtaaaactgtacttattttgggacggagtgcatgcttaattgcatgggactctcttggagttagcttctcatcactgtcccatccttaattatgcatatcatacataagacaaatccaatggatcatagtctatgtatattctaaagtgacagcacatcctaatgctaccaggaaaaaagcctatggctaatccaatttaggtactccctatctgagagggaattaatgtgttaattaattagcagataatcacaagggccgagttgctaaccaagcaagtgcatatctgataaggacaacacccaaatatgatattgccacatgtggggtcatcctttgatgcatgaaaggttaagaccaagacatatatatctctctaggaggttcataatatcatctactcctaattaaaattgagaatattttgctttgctttgtgcaagagtggtctagagagcccaggagggggcaatgatgatgattaggatggaatcaatgttccccttggggctagctaacttttaattatggagacctcatgcatgcatgcatgccttcatgcctgttgctaaagagagaagccctgtactgatgcatctgcaggcacgcttgctcaccttatgttttactgtacatttctagctgtttacatagagtttacatatataccaggttgcagtcttgcagatacataaacttaattagctataattaaagtgattttttttgcaaagaaatgattttaatcgtcaaattttaggtccttgagagttactagaatttttcgtataaaatttggtaccctctaatatctgaattattgggagaaattttacacgggacctctcgagaaccgtaggtagaatcactattttaaactagttgacctcatgagcaccacaatttcactaagtaattaaaaaaaagaactcacaaagtcattgctagtacattcaattattgtttattaataagcctaggattgatggtccttagtgctttatgtgatttatttctttaaactagttaatgtgtgttttggttttatacatcttaattatacaaaggttgagagtgttgtcattgcagttgtatcatcttgatgcaatttactgagttcaataaaaacttctat

SEQ ID NO: 103454 - DNA, 935 bp, Oryza sativa
ctccagaagtagaacaaatcaaaggtgaaaattttcaagagtatatgttagttccaatctgcacatgactgcaggctgaacatatgtcacttgtatttactgcaagaaggatacttgcaataagtaacagaatatacagacttgaggggcaaagattgtatctctttctgaatttggtcatacatgtaatgcatacaagcttttaagatgatggccctactcaataaaaccaactaaccctagagtggctatttctgaacattgctacataattttatactgctggtacctaacctcacaatcttcctttgttgattgacagtggggaagctaagctttagggcctttgccctaacttgaggaagaataaggccatcttaggaagcatcattggatgcctttcttgaccacttttgacactatgctactactactacctctcgatgaaattgtcttgtcatgctttgccaccacatgcatttctttctttctttctttctttctttctttctcatgtccaagattattcattttagttttttctaagcacagaacagagagggcccaatatatggacccaccagctcattgagtggactaggagcaatgcgggtgaatttatctccatcaagtctattcttgttgtcagttgctatgtacagtactacttatgtgttctacccttgatgtagtacatttttttctgaaagctgcatgccaaagttcagcaataattatattatgcattatgtactcaaaatcacttcttttcatctctctctctccaactgatgtctctgtaagattgttactgtatattgaaaaaaaaaagaaaacactgtactccctccgtctcaaattgtacacggatctgaacgtagctataaaagttggtttattttaaaacggatgaagtatctaatatgtgaaaaaag

SEQ ID NO: 103455 - DNA, 665 bp, Oryza sativa
attgttcacaaattttacacatctcatatggttttataaactataagtgggatatataaattttgtgaacaatgttactatcattttgtcggatgaagaaatgaccaaaataaaagttatagatactgatgagttatacaattttgttgttgatgacattttctgttgaaatcatttagtatttgaaaatattatttgaagttgtcataatttgaaattcaaattcaaattattgaaataaagtcatatagcaaaatgaccaaaacaaaagttgtagatattgatgagttatacaactttgttgttgatgactttttcagttgaaatcatttagtatttgaaaacattatttgaagttgtcataatttaaaattcaaattcaaattattgaaacaaagccatatatcaaaatgaccaaaactaaagttgtagatcttgattagttatataactttgttgttggtaattttttcatttgaaatcatttactacccgaaaaattatttgaattgagaggagggaggcaaaatagacttctcggcgagggaggatcaaaagggctaggccggcggcccgaagagagaggaggaagaagagagaggctgcgggttgagggagggagagagtaatacttgggccgaaaaggccccagggctgcaggaatt

SEQ ID NO: 103456 - DNA, 1289 bp, Oryza sativa
gtcaatggtagtacaggtcccgacgctaattaaccgcgagcacgactactcgaatagattgctttactcacactgcagtggatgtacgattttaatcccgtactccgcggcttgcccaacacatgagcctagtcccaacacatgagactcgccacggcccggcttttcagtcgctctcgcatttcggcacctgctccaaggactatgaacccccattgcaccccagcactccaaaaccctactgccggatggtgaggggagtcctggcgctcccgggaaatgggatatctactactatgaatgaggtgccgccccacgagagcttcctaatccatcaggtctgcccatacacatgaaatgcggtcgtacttttttcgtttcccgtatagcttcttgactcggtccttaactaacctgggtcggcgactaaccatttctagacccacccatattctattcatgccgccctagtcgaaatagttttgttgtattaagttttggttttcgcaaaaggtttgtgtgtggcgggtggcgctcatgtctccaccctcaaatcatcaatcactacatcgagtgatctcacatccataatcatctagcataaatatggagtgtacgtatatctacaatagcattactaagcattgtcaataattgaccgcatataaataaatgactcaggtgttcaaaggtatacaatatgtataaaggtaatcaatatcagggcaagctataattaattgtaggtacacaatttataaatagcattaaatttatttgtaaacaaaaaatttataaatataggatcaatatgttcaaggtagggagcatagtgacttgccttgctatcagttcctaatgtctttgagagatccgcagcagttagataattagaatacccacgatcgaagaataaccagaatattcacgttcgataaacggccaaagaaaccacacacaatcctaaaagaaatgaaatagagtaacattcaatacaactaatggtgccattaaatagatctcgatttttgagagattatggaatttgaacggagtcgatcggagttacggtttgaaatatatggattttcgaagtcaaaaggttttataaaccgaggaggagctgctcctcgggtagggaggtgatttggactttcagagagggctttgggctgtatagagatgcaacataaactttggcgaacgcgagggttgctggtgggttacggctgagatcttggagaagggaggtaatacatactctataggaattgctactccgggtttgg

SEQ ID NO: 103457 - DNA, 891 bp, Oryza sativa
cccgaatttttgtccttgtgacatggcgaggggagagggatcgctctgctgaacgaggggccgaacccctggttcggccgaaccagggagctcgctaatcggctccaaaattgctggggagcctggcacagctaaaggggttgagcccatacagcattcgccccttccatcgtgtattcttccaccggaatcaattgatttgccagtgtcggctctccggtgaggttgtatgtggaattggatgaagagccgatgaatggaatcaaggatttgctagccattagaggttcaaagaatttggatcgaaggtcttgggggtgaatggcagattgaatagagaagcttttgcaagggaggaagaaagagaggaactagcttcaggggtgtgatccgatcgttctacctccaaactggcatcaaaatagactcaggactagcgggggagactatcattcaaaaatggggccgaacgggtgctgccctggttcggccgccctggtgggcccggctggccgccacctttcttcctattgccactaatttctaagctaagcacaaaaataacaactatacatggttttaagcatgcattagatgagatcaccatggttcataaacaattaattcaataacatccacttcttcctctaaagtttcatttggctcaaggaaaatctttaagtgttgactgtttaccttaaatatgttacctgaatcgtcacggagtgtgattgccccttgcaaagagtgtcgatgacattgaacggtccttcccatttgctgcgcaattttccgtggccaaaaagctttaccctggagttgaacattagcactttgtctcctggctagaatttcttgatttcaattcttttgtcatgccagcacttcgtc

SEQ ID NO: 103458 - DNA, 659 bp, Oryza sativa
tgacacctgaatatgtcgatcactgcaggctgaaacattgtctattgacttaataaaaatgtatacacttcaaatatatctacttagtcacaccaatcttactaattccactatgcaccaatagaacaattcaggtttagcaagaaaagaccaacatattgtctaataataatatgtactatcttaaggtttcatatgaataggtcagttttttatgtagcctagagcatttcaaatggagaggtccctcctctttttccctgattgcagcaagaatttcgtcatggaccttcagaacagcatatatattgtaacataacatttgcacaatagaagtgcaaagtatacataactgcagaactgccgaatgctacgattaatggtatgaaatacccaaaaaaaaatgggctcactgctttctcttaatatttgcttgatactattctctgaagatattttttcttaggatctggatacctaattagatattcacatctcagaaatgcagaagctaatcatctctcttcttatcctctacatgtattaattacataaagatgattaaagaaaaacacatcataaggattatgcaaatttcagtacataaaaagatagcaattgtttaaagaaagtatcgctataactcaagatatgtcatt

SEQ ID NO: 103459 - DNA, 608 bp, Oryza sativa
aattcctgcagccctataccatgacataattaaaaaactatagtcaaaatcacaattataatatgtttgagagaaacaattggcatttgatacaatataatatgaaaatgaaagggagaaatgtagtctgacatatacaccctttatttacaaatttacgatgtcttgaacatcaatatgttagtgaatacctataaattgtaatattatgggaacatcttttacgagttgtgaaaaatctagtgagactttttcaactgatcagactaaacatttcttatatatattataggaaaaggtagagacctttaactgcacgttttatataaaatcaaaagtatctaaatagagggtgtacctaaagctgcatgtgctagctatttaaaacattgtttacaacagaagggttactaagtggaatataccaccaaatcagatgaattaaacatgaaatcaattttaagcgcagagatcccttttgaaatgataaataataatgaataaatccatcagtccaaaagtttaacaaaaggtccagacagatgttgaacatgaactagaacattgtttgttactagctatgtggggcccaaatgtcagtgggtggt

SEQ ID NO: 103460 - DNA, 1621 bp, Oryza sativa
taggaatataaactgcaggggagacacccgtactgagctgtcaccatcagcggcctgcaaatcacccagagaatatacccccaaataatgataagcggtaacctaagctcatgcttaaattactacttattactctacaaccttgcaatcggtgcagagcaccatagtcctcgggccatagctctcggcctagccagagtagacttatgaccaggtaatcagacattataccaacatcaatgcaaatcccagaaggtttaactacacagattatactacttatgaataaactaagactggtactcatactctatgattggaataaagtaccgaacttgtataaagaagaatattatattgataaatggaagtcttacaaagaagaaaggaaaaggtatagaacctttaccgaactccccgaagcctccgcggacttggaactattctaactctactccactaacactactactaactttgtagagagctttgatccttgcttgagtgtgtattgaaagtgaaggaggtgaggtccttttatagcacccaatgacggttgtagagcatgggaattgtcggaaatgccctgcaaccgccatccggagttcatccggagcgtctacaccaaaggggagagccaacggctgagatcaaggttcgggcgaacctagtggttcggccgaaccctagagtggcccaataggcctggtttttggcctgctgctacctcctcggtctcccttatctcttggccaaaatgtgactggattgggctcaacaaagggtcggcggaccccctatgggctcttctggccctcagcttcctcctggagacttccatgtgggcccctaaatcagtgacatacattctaggcccatttgtgattattaaattggacttttgggccttctcatgtaattgtagatcgctggcagactttcgattgattgatcgatatatttccacctccttctcttcatttaagagtgcttctcctgcatacatgttagtagcaaagcatatagttgaagtaactattttatttgagaattatgcatttcaagcatagctagtcttcatatattggataatattgacggttgaaattggtcgataacagccgtcaacaaaaccccccaagcttgaacctttgctcgtcccgagtaaaggacgaaaggaacaaagacttggttgttgatcaggagttgctgcaatgttgtatatctcaaagatatagatgcaaggtatgggtactctatctcaaattaaatatgtttggcatggtggcttacccttacccctgattcccacgaaacactgcatctccttgtcttgagcggttgagagacagaacagtaattagagcgctagttacccaatctttatttaactttcattccggaagttttaaaatgatttttgcaaaagaaagccaagttcctcaaataattctctagatcactcaaagtgtatgaatatggattcctcaccagatttgccttttgattcctactctaaggtttgatatgtggagcttggtagggataaaacatggcacacttgtattcacatttattactaaatcaaaaacttggactaaaatagatgactaatcatact

SEQ ID NO: 103461 - DNA, 712 bp, Oryza sativa
atattacatatatgcatgtgttggttcctaataataagcaaagaaaaataaaccagtcatatcaccttgaaactaaatcaaaatatttccatttgcacattatgcaatatatatcatctgcttaatgaaactcctctgttgacaaaactcccctacaagcaaccttcagaatgccttcttccgcataatgaaatgataagagctttgagtatagttctatttggtcttacctcctaatagaaatatcagtaaccggatctaactttttttaaaagggaaatgttattgtcttgcaaaaccaatgagcagtgtaaaaggttaggaaatattattaattcaataagctgcaagctgaaccagaggaatggaatgtgctgatcataatagctttacgctgatgtgaagttaatctactgaatcattttatcaagcatttgttgaatacaataatcaagtggaactttgctcctcattccaataagcatggatatttatcagtggatgagactctgactaatgtttgtgaatttaatttctaaagtttaactgcagcacataggtttcctaaattcatgagtatttatagaatcaggttagaaagcaaactataaacataccttttgcttgctctaccacttcaacattgcagtttcttttcctttcccacattccaaaccagattgcaccctccccccccccgggctgcaggaat

SEQ ID NO: 103462 - DNA, 615 bp, Oryza sativa
agaacaattttgaatcgtattctagaaaatacttccttcatgacacaatccaatgaaccccagcaggaggcattcgtgtccaagatagaggaacctctaatgatcgagccacgcactgaaccatccacttcagctagctcgattgatgagaaagttcttgagcaaccgtccgtcgaggatgaagagattcagactccggattgtgccgcaattctgttcatggacggcttcgacgaagactacggcaataccctgaactattttagcaagaggaaaccactcgttcctttgccacctcccgatcctatggaactcgggttcctacgagaaactgtctgggtgttaacatccataatgagcgatgaatggctaagggaggcagagctttcatccgaagtaattcggataaataccgctccccgaatcattccttgctatatggaagggaacgacgtcggtattctctacagtccaattgtcggggccaacctcgtctctgagtcttttgcattcgcttatttaagcgataaggcagtgaccccaacaaacaaatttttcaaacatccgaacggaaatatcattggaggatttgggattgtacaagatgtacctgtc

SEQ ID NO: 103463 - DNA, 668 bp, Oryza sativa
ccctgcataagcatgagtcgataactcgacatgctagataagctttagacacatgtgtcccggaaacactagtgtgtagaggatacacacatctgtgcccatgaggtggtgtgagtgtggtgtgtgtttgctgccctgtattgataaatattcagaaggacttcagtgtaaaagagggttataaagtcatccccacccctcctcccagttaatctacaagtaacattaaccctaggtggttcttggataacacagaatccatcataatcaacggataaaactaagaatggtgggacccatatatatgagcatctaatcttcctcttcatgtgccttcttcctcctctcctcttctctcaagtgctgtaccaagcttgccagttcctctgtaatgcattaccacctggtcaagcatgccactttcaaagagcagcagccctgcaagcctaatagaaccttgtttcctaggccaagacagcctataagcacgtgaatgctctgctccaccgtgttgccattactggcctagaactacaagccttacttctgagcagcagtcatcaactagaaactaataatactatttgttataaaaaggattttcctatgacatctagaagccacatactagtttacatgggatctataaattcaactacaccaagaaa

SEQ ID NO: 103464 - DNA, 615 bp, Oryza sativa
  unsure (1)..(615): unsure at all n locations
tctcctatgtacctggacaggaaggacttcagtgatctcgagggctatcaccacctctacacctaccgccaaaaaaacccccaaattttaaagncctttgggggtttaaattggaatttaaaccggccaaaggccccaaattttaaactggatataataaattacctaaacaccacgtctaagcaattaatatctactttagtgtttataactcaccaaagcaatcactatattttagttgattataatgaacaataatcccgtatgctatttaggaactaacaaagagataattctcacaagataaatctaaattacttaagaagaatattatattgaattcagagtaataaatataataaaagaaataggagaatattaccgacaactccggaattcttccaacttcttctactctactctcttcctcttctagtatacaatatagtacaatagagcctcttataattcagctcaagcttggaagtgtgtgttgaagtgagtgagatgatgttttatataggggtaggtatgacggttggcgaaggggaaatgtttgaagtgccccgcaaccgccatcagggagtgatctgggacgtccatgccaaaacctgg

SEQ ID NO: 103465 - DNA, 614 bp, Oryza sativa
tcagttcaattcaattcgtcggagaacttgcatctccaactgatgaacactgcaacattttgttcatagatcgtcgacatggatgcaatgtaatgtagtacttggcagttgagctctgtgtctccatgttgttggcgcgctgcttcttggagtactcgagcagctctgctccctgcgacggcgacgacggcgtgcgtgcccgcttctgcgaaccagaggcggcagcgctcttcggggtggttgtcacaatcaccatgccgttgtcgccggaaccgccggagctgaagcaggaggaggaggaggtcgtcgccgtcaggccatggccgattagttgcagctcggtggcgtgggcgtccatgtccatgtccatccacgaattgcgttgtgctcctcgccgtggccgtcgaaggtgagcgcagatgacgaggacatggaggtagctgcggcggcggcgtggaacccccatccccaattccgggaaaccggtttccgtttggccgggccccaaaaaccccgggggtttttaaaaaacccccccgggactgcgggtcgcgcgcgtggatcagctccgtgcccatctgtagtaatggctagcactagtgccagcgaacccg

SEQ ID NO: 103466 - DNA, 601 bp, Oryza sativa
  unsure (1)..(601): unsure at all n locations
agatcatgcaccgattgttgttccctcctttggttagataggaaacggatattagaaaatagaaatccatgataaaaaataccagtgataactttgtttcacatcaacactgatagcacaatctaacatattaataattcccttttatctccgtgtgatatatccaaagaagaaaaggcagaggatgttgcattgtgaatattcatatattatatatatttctaaaaaatcatgatgaaactaaaactataacaagaggtcaattcatcatgtatgttaccatgtctaaagcaatagattaccgcattttaaatcagcataactaatatcataatgctccattaaaattgtaataatacttcatttagcggagctacaacatgtcagtcatagaaaagcaagaagcaaaccttgtctagaagtaatccagtaagcaaataaatgttgtgccttctttttactggaaaaccaaaccccctttggaaaatttattgggtttccggnaaattttcccaaaaccctttggggcaggcctgaaacattgtctattgacttaataaaaatgtatacacttcaaatatatctacttagtcacaccaat

SEQ ID NO: 103467 - DNA, 609 bp, Oryza sativa
  unsure (1)..(609): unsure at all n locations
ccaggaggcagaggtacaccaaaagttgatacatttcagagtttatcaagcggaagcgtaaataattaatttattacatgggcggcgaaggcccagccacacaaagacaaacgggaaacagcggaagactagggcgacgaccacaggcgcttgacggcaggcacgagctagacaccaaagccttcatcttccaggaactcctcttctgggtttgggaaaaattgagcaagactgagtacaaccaccgcactcaacaagacacacccacaagtgcagaataaatgcaagggagtacaagggagccataatatagggggttagggtttgcagtaaacagcattaaaagtcacttagttgctcaaagctactttgtaaacacggtcctagagatatacaatattattaattaaggccgtgaacccacacgaacctgccttaacccaaggccttacgaatgaatnttccaaggaaaacccccggaaaaacccttggnggcaaaaaaaccccccccccggaaaaacccccccccctttgtggtcccagctcgtcccaagccaacccaggccaaccattccacattttagttgttaagcaggttttaagaattaa

SEQ ID NO: 103468 - DNA, 947 bp, Oryza sativa
attcctgcagccctgttgtataattattgtttccagatgttcttggaccgatgatcagagagaacattatgtacaggcacgcctaaccgaagtctgaacgctggagtttagcacctgacagctgctcaccgtctccaatcaactcatcacactaagatggtaccaataacactcacagcaaagtgacaaggtgcacacaaagagtggcaactcgctactacattacaatggaatataacaacacgcatacttcccgagatcctaaatgctgcgatgcaaaaaaagttcttgaaatatcaattcaaattcaaaattcatttcttaaccttaaaatagtcaattaatccgtttatattctcgtacaattcagcattccatttcactccattcaacccccaaaaaagaaagacatacccccgaattaaaggaaaaaccttttgtgatataatgttttcataaattgtgagacccatataaggacaataagttagatgatctaatttcaagtttgatgatgccctgtgaacatgtctcggcccaaccccaactaatgtcagtacggcaccttggattccccaccccgctacaccgccaaaaaccgcaaggctccgaggttttttttccttcaccgaacgcgtctcgtcagtcatcagtcgtcaccgcacgcactcgtgtcccgcggagctcatttctcgcgtgtcgtccacagccaaaaacccaacccaacccaaccgcgcgcgccgagccgtggacgcgagcctctccccgcaccaaccccgcagaaaaacgagaaaaacaccgcgcgattgcgcgagacggagacgaaatcaccgcactccgcaccgcaccgcgccgcgcgcaggcagcggccgcgcccacgggatagtcgcattatacgtatttagtactactagtatatatcctagtaggggggggggggggggggg

SEQ ID NO: 103469 - DNA, 688 bp, Oryza sativa
cattacatttacagttagttctgaacagataaaaagggggaaaaggatgcacaattctatgtaacatcagctaactctctcctggagcgaacttaactccttttctagatacagtatgtgtgttggccaaaatttgatacctcaaaacttgggtatgattctctgttccaatatttagaacaaaattggcagaatatactatatacgatgtacagacacgacctacaagtcagctagtcatatctactcatcagtattaggtaattgtacaaccaagtcggatgacagtatcaggtctgcaggctacttggcaaaatggaaaatgtaccagcttctatattctctaccagggcatatccaacaacttggtttgttctttcaacctgcatgcaaagcaacagtgaagagttagcaatttagcacagtgaaaaatgaggtcccaagtgaagttaaggtacataccttgtaatcaatggacgagactatccccgattggaaggttacaacttgattcatatatagtatattcccgaaaaatcaaaacagtacacggtagtgtacaagtttaagaatatgaacattgcagatgccccaaggacaagcacaaagttgatgcatcagcataatctctgagattctttttgaggtaactgggtgcttccctctgaacatgggggctgcaggaatt

SEQ ID NO: 103470 - DNA, 671 bp, Oryza sativa
aattcctgcagcccctgcgaatgctaatactgcgccttcccatggcgagatttcgttctgatgggttctccctgtcgttggtgctgctgctgatgcagattgctgcctcgcgctctggtggtaagcgatcctcgtcgatctccccggctccatttttttttaccccgacctgatatattcgacgccccccttttcttctagatctgggcgaatctgtctttttatttctgaattaaactagggtttaaggaatctaagtctgatgagcataaggacaatgtgtgattccgcattgagttgttcaatcactcgcagccgtggagattgcctagattcttaatgcctgtttattatgcgcttgtttgcattcttaaatttgatcggattttaggtgcgaggaatacattgcgacattaagggacgcgttgcacctttgtcagttccttttattctttattactgaaaggaccgcggaatttagattggcctcaggaatcagatccaggatgacacattactgtttcatgtaatatattttgttcaacattacgcttcaaagttctcataatggcaaaagtaaaacggttcctggataggaactaaactgaagtttgtcgttttaaagacagctccattagcttcaagcatcagcagcgtcaatgagcagtcac

SEQ ID NO: 103471 - DNA, 868 bp, Oryza sativa
ttcctgcagccctgaaagcttatctgtgagaggattggtactactgatcacgcttatatgtcatgtcttggattctgtcttacttttttaaggcaaggattttgtcttagtagctaactggaattgtaccatcagtcatttatgttaggatgttattactctctccatttaataatataagacggattttatttcattagaacaaagctttaactaacaactattttactgatattatcatctatgtgataaaaaaattaattataagaaagtattttttttgttaatataaatataatagtaacaaaaaattatgtcataatagagtaattgttagtcatagtcttatcctaatgaaataaaatacgtcttataattttcaacggatggtattgcaataaatgaaagatagatcatggataatgcctacaagaaatacgatgtatttagtttttgacatatttataacaaaaggacatgcatgctaccttctcaatgaagtcttggatgtaagtggcatgagatatgcgaaactctgttttttcttgaaaaaaattgtgtaacactcagtggcgacatttctcatccttttgtttttaatttcagaggccagtggttggtaattagtggcaggatctgatgcactttccccctctgttttcttataatatttctgctcatcttttgagcaaaagaaatgaaagtcatggttcctttctagtttctacgcttgccggaaacttgtagtgcaaccagaagtttgctgcccattcaggtatccatctttctatttatttatttctatctgcttttcttggcacgcatctacaaaggcaataataatacacccgtcaaagccatccaatga

SEQ ID NO: 103472 - DNA, 513 bp, Oryza sativa
  unsure (1)..(513): unsure at all n locations
tctctctctctctctctctctctctctctctatatatatatatatatatatatatatatatatatatatatagagagagagagagagagagagatgtccctttcagatcttcagtcccagaaaaaaaaactgaacatgtaagtaattatgcattaagatcatacacatggtaaatcactcattcttttttttttcagtatagtaggctagcaacctttgctcaacgtggtgaatcaaatcgtattgacctagtttttatctaagaaaaccgtttaactcaagtgacagagatggtaaaaaggtgtttctcaaccnnnnnnnaaagagagatgataaaaagtacaagcacttcattgtcatggtaggtaatcgatcgctaaaggtgaaaaaaataaatgcacaaagttggtaagaatttcacttctaaacgacgactacgggcttcgacagtcattttccgtgtaaatttgaaagagaaccagagaaaaaggaatattagatccggagggcaat

SEQ ID NO: 103473 - DNA, 627 bp, Oryza sativa
ttcagctagctccaaaaaatggtgcactagacaacttgggttcggaatcgtaccttttctaattatttgatattaggtcattccctaatattcacgtcttttagtatagtgcttaagtaagtggattaaaattaggagtagctatattttttacgctattttttagttaaattagttttacacggtaaattattatagttacactatagttatatattgcaagttttaatatttacattgtaatttcttggattaagagaattatgttaaaaacaatttattatctacttagaagagaagagaggtgaggttgatatgaagcgcacttacacacgagagagacactagtacagatccttccatttgtgacggcccataacaagactggaatttgcgggccgtcacaaggaagtaatttcaatcgggccgaagtttcgcccgattgagatatggtcgcacagccatgatatatcggcataaaactaaagcctatcacagatgacacttatctgtgacaggctatagttgaggcccgattgagatgagggttccatatctcaatcgggccctaaaagaagcccgtcacagatgagggtcatctgtgacgggctacaactagaggcccca

SEQ ID NO: 103474 - DNA, 970 bp, Oryza sativa
aattgcatcggatgggcataccgaaggaccccaaaaaaaaaaaaaaacttctcgggttcgatggcgcttgggtcagtccttcgctactagggctagggcctagggctagcggaacgatcgtagttgcagggagacgcggcggcggcgaggagcggcgaggagtgtaggagggggctggtcaaacctgtggtcgcggcggccgctgcagcctggaagggcggcggacctcccgccggcggcgagacgccgagacgccgcttctctgctcttttgtattatttcgtttttatttagtttcgccagaagaacgggaaaaggaagtagacctgccttcgggcctatggtgggccttgctgtttttactaggaataagtctactatagctccctcaactctcaccctcgataaatcacatccctcaaccgtaaaaccatctttatataaacggtattgtaaaatttaagagttatttaagggttgaatatccggttttaaagtttagagtgctatactttcatccaaaatttaggatatatttgaactctttttttagaaaaaaatggcattctcaaacctgcatatacgagtcaaacatcgtcaaacctgcaatcgtacaaactccagatcaccactccaagcccagataaggatccagtgcagtcatagtagaaactacaagtttggcagttggaaccgtttttcattatagaatcaagacaatcaaacggctgaaacagacgctacggttgttttaaacagtaattgctagagtacctaccacaggaacgtacggtcctttatgagcagtatttagaaaagatctaggacgctaatttctaatccaatggtttcagtggaactgcttaatttgtaatcaggtgatcccaaattcccaaatccagcatctggtcccgccaacggacgccgccacgcgtcccttccccgtcgcgctgacgatgccgcggcctct

SEQ ID NO: 103475 - DNA, 2114 bp, Oryza sativa
aattcctgcagccccctgaagtgttttggaccacttaatcacccatgttagtatagtaaatagtatacatgatatgccttagaataaattaggttgaaccaagaacccatgtatgctctgaaaattatactaagtaagcacctttttttttaaaaaaaaaaggtatggttactagtattatctttctcagatagatgttgtcctagaatgcgtatagtcaaacctccaaaccttaaatgattaattgatgcaaaaaataagtgtttgatatgagaaattttatttgtcgattttttgtgaaaaacactttcatatatctatgcttttaatatttttttttttgtaaatatatagttaaaagaagtaccgatgagactagtgtatattagacactgtgttgatgtccaaaatgataggtaaaaaggaaggtagtacagattggttgggatgaattaagctaaagtttacttctaaatttcatcggaataatccatcatttatattattaagatgactcaagaacaagacaccatgtttgtttgttgtggatagcaacttctgcattaattggagaaaaagataaataattacactgttagattctagtggttcagattgtcaaagaaaaaggtaggtttgatcgatttagttatatataatatttatgaaaaaaatactccaaccattttacattataagttgttttgactttttttaagtcaatgttctaaagtttgatcaagtttggagcaaaatataataaaatttttaacaaaacaaatatattatcaaaatctattcaatgttttacatttaatgagactaatttgattttgtagatgttgctaattatttttttttacaaacttagtcaaacataaaaaatttgacaaaaaaaagttaaagcgacttataatataaaactgagggatcagtagaagcaaaagttgtgtacaaatgtatttatgaaattgaaaacaagagttgtatatcacaatttacttttaatatttactataaaaaaatctaggtctgcacaaaatcgagcaggaaaccggctaattcagtgttttttgggccaagaatagttcacaatttcggactttctttatgttgtgagttacagatacggtagatgacacattgatctttactctgttactctgttcgcaaggggtgttcccaacatttccctctcgttttccgtacgcacgcttttcaaactactaaacggtgtgttttttataaaaagtttatatatgaaagttgtttaaaaaaatcatatttatccatttttgaaaaaaaatagctaatacttaattaatcacgtgctaatggactacttcgttttccgtgtgcactgtgtatgttcccatcctcccctagcaaacacagcctaacagagcatagcagagcgagagacaattcgtaagacagaactgcatggcaacagtccaagtagaacctgaccccgacaagcaaacaagaagccctatttgtggcttgcaccctaaactgaacatttagtgcaatagcaatgcaagctatggggcccatacccatagcctaaagtcacagctcaaagatactccccccacagtgcaagcacccatatatgtgtggatagagacactgatgaagagtaccaagcccacagtgggcgttacccaacaatgcgcgaggtcacgggaggggcaaagaaattttcctcacctacccctcctggagcgagggtcgaccctatccattcggcgattccagcaattcctctcgtctctccgcctcgtcctcctctcgccgcgcttcctcccactccgccgcacacgccgtcacctcctcccactccggcacacacaccgtcgccctccccttgttgccgaccagatcgattcgtccactccatctcatatcgtctgtccgcccgcccgcctctcgctgcacatctttccctcgctcgtcgtcgcgtcgtcccattccgctgctcctttgatccgaccgaaccatggacgaccgccccaagttcacgcagatcgagctccgtagtgggcttgtgctgctcccgccgggctataccccgtccagagtggctaggggtggcgggaagaagaaaaggg

SEQ ID NO: 103476 - DNA, 1678 bp, Oryza sativa
taaggtgctttagttttttaattgaatttatttaagtttgatcaagtttttatgaaaacatagtagtgtttttaacacaaacaaacatagtatcaaaatatatctttttgactgaatactatcaaaaatctacttttttaactgaatactatgaaaaaaactattcaacatttaaatttaataaaactaatttgttggattttctataaatttaatccaactcaaagaaatttaactaggaaaaaataaattattttataatataaaatagagggagtacatcacgttttatcatacacatctcacatatacccctcacacgaaaaactcttttgatccctcgtgagattgtcaccttgtttcttcaattaaataacatacaaatagttattaaaatgttcttagaatgttgtactcgtttgatccctcgtgagtatgttcttagattttgtttttacaaacataaaagctaatatgacacgaatcttgcacgatgcaataggtccactcgtcaagttgcaatttactcattaagaggtgttctctgcttttcataatgtttgtctattatcttgaagtatggagtttcacagtatttgtttgtagtggaaaaataaaaggaacaaatatttttcctctttttattatacagaaaacctaaacgcacacaagtaagtgacaagtgagctctctaataacattcaaagaagtatatttaaaccatggtgagtacagttatacgcatatgacttcacattattaatatttttccattactttttctcgtcttatttaaaaaattttgaaattattatttattttatttgtgacttactttattatctacagtattttaaacacaactttttgttttttacatttgcaaaaaaaattgaataagacaagtggtcaaatgttataagtaaaaactcaaatttctttatattgtaggatgaatggagtatcattttagcaaaggatacacatggttactttttctttcgtttctgcgtgttggctcgaacaaatataattagtatcaaatacagggagtactatagttaattgcgatgcctatgattgatgtggcaggactgttaagcactaaatgctgtgtcggggacagactgaacgccttcactgttggattaaaagttggtaggccaatcctttagtagttggtgtttctgttactaccatattacttatctttttaagtttttatttgtcaatgtttgatcattcgtcttattcaaaaaattttgaaattattatttattttgtttgtcatttgctttattatcaaaattactttacatatgacttatctttttttatatttacactattttttcgaataaaacaaatggtcaaacgttgcaaataaaaagtcaaaaacatcacttattatgggacggagggagtactctgttacttaaaagaagtgttcttaagtggcagaggtagacccaattaacaaaacctttaattgaccctctcctcatccatctagcccattaaatatatactcctggttagtttaatcccctttaaggatttaatgatgatttaattaatggtttattaattattaaactcctgtttgcataatgatgtttaattaataactaatctccatgtatgaacaggcctcaattaaacttcaattgaagctttt

SEQ ID NO: 103477 - DNA, 683 bp, Oryza sativa
agtacttttcacatccacagcagaccacacaatttcaatgcttacacatacaccagcagagagtgaaattgaacttgctttaataggaaaagtttgataacctgaagtacatggtcaatccgaccatctggtgaacctgtcagcctttccatcagcatgtaaccatatgacttctctttctcattattgctgtcaacatcctctgaacaacccaaaaacgtactcagaacattgctttttgtgacttgcaatgtgtagaagacagaaaaaaatctaccatatgcataccgtctgtgtcatttctgctcagtgatagcaaagcagctactgctttaacctcacacaaaagggagattaaaagtcccaactcattaagaaagagctacgtgaacagctatgtttctagatcattcacaggtaacaaagtgtttatgtaccaaggcccatgtctcatattaccatagccaaagagcaaaccttaccttcagtgacttgaactggcgagcaacagcttgagaccgtgcagcaatatcttcagtgaaatagtgaattcctgcatgacatgtcaacccaaataagataaatcagataaacaagagtaatttactataacagagacactcgcctaaaaggtgtccaagaatatactgaatcactcacctgcactcctacatgtatcctgg

SEQ ID NO: 103478 - DNA, 668 bp, Oryza sativa
tccaatatggcaaagtggcctcctgattcagtggcctaattagctggttcatgaaggatgatgagttaaactgaattcctcagcattagaacattattatcatgggtccttctagaagcttctgagggaggatatatactagtagtggtagcattaaacaactcgcaagtacagtacactccatctctctctgaagctaaacctgaggctccctttccaagtgcacagggaagacaattaatcctaacgaacctgatagatcatgtaggagcatgaaagattccgattgagatgatcagaaacgaatcaaagatttactaaacacaccctaagtgcagtgattgatcagtacagtacagaagagtacagacagttgaagagcagaatgcaatggcactaaagtgaaagcgagagggcactactgctgctacttctaccactatttggcgtcaataccgtactttgcacgttgatgactcgactccccgaccaaattcgtggctcagattgaatctttttcatcgtttccaggggctctcattgcaactgtgttaagattagatacctggttttaccttgaagtcaagtctagctcagctgtcacccctagcttttgtatttggagcctggcactttccattgattaacccgtctgtttcttcttaatt

SEQ ID NO: 103479 - DNA, 694 bp, Oryza sativa
aattcctgcagccccatcgtcgaccacgaccaagctgctgatcatccagatcttggataaaaatgcccgatcgtcaggggaacaagctgctaactactccctcgttccattacatgtacaaatataaattttcgtgcccaacgtttgatcgttcatcttatttgaaaaaatttataaaaaaattaaaagttaagttgcgcataaagtattatttatattttatcatctaataacaataaaatactaatcataaaaatatttaaataaaacggatggttaaagttggacactgaaatccacaactgcgtttattatggatagaggaagtagcaagataggcagtattacggtgattttatttctagctgttgtcttactgctctatgagagtcgttgatactgaccggtgaacagtgaccaaccctttttcttctcttatgcaagtagtgtcttttactgttgctttgcactttttcttttctctctttttcttattcatcctagtaggaatacttcgttttcatttctcgaagctttatacggcctgatcgagaaatatgggtgtccctcgtccaatgcgaattgagtttggtgaagactagctaacatgaggtaggttctttgatccacaaacaagttcagtggcgtactactagcactctagcagagatggatctgaagaatggtgaagtat

SEQ ID NO: 103480 - DNA, 522 bp, Oryza sativa
ttttcgtgacctggcatgtgcatagagttatagattgagtggcatgcagatgcaggggatcgaggggagaaatatagagtggtgcggtactatgatcgtagattgtatttaaagtaaaagtaaaaccatattatcgtaataatttatttaatttgtaggaaatgacggaagtgattttgagataaaatggttgacagttgtatgcatgttgtcacggacggactaaaggcttagcgtgatcttggacagccgccatggattgactgtgagctccaaaactttagatgacatgtactccctccgtcccccccaaaaaaccaacctatgaaggatcacatcccctcatagtacaacaaatctggacaaagttattagttgtactaggaggggtcacatgttggtttttttaggacggagagagtatttgctagtgtcccatcatgtatgtatatagactaggaaaatatggatcttcaaattttactaaacttcagaaattttatgcatttatcctttcataat

SEQ ID NO: 103481 - DNA, 699 bp, Oryza sativa
gaattcctgcagccccacgtagtgggctgcgaccttttggacagctgggttgcaaaggccaaataacgcaatctatggctaatgggtagtacatgccacaaacgtctgaatcagcaaagagaattggcatactcccttccctaccctttttaacagataacaccgatgacttctgaacacattttgatcatttgttttatttgaaacttttatataaatgtataagatttaaatcatgtttaaaatattttaagtgataaaataacttacaaaataaattataatcacgtaattttttaataagataaatggttaaacgtgtgattaaaaattcaataacatcatctattaaaaacgaaggtagtatatgataagagcatatgtatataaaagagacgttagcatacaaacatacgatggaaaaaaatatgagggctgcatttcgttcctaattaacaagaatcgctgcctcttgtataaatagaaatgaacgaggtaatttgtttctgaatgctcttgttatacccaccaatagtgctattggtgggcaccagttcgtcaacagcataaataatgcatcatggtagattatcataaaccatcggaaaagctattgatccctagtaggactatttgttgactgccctcaacgatgtcgctagctcctctctattgttcttcattgactggcttgatggt

SEQ ID NO: 103482 - DNA, 525 bp, Oryza sativa
attgtggtttcttctgactaaaccatttgcattttgtcccaagcaaaatctactagccaaactgttatagtgctattacctgttccttccattttattattcacatccaataattttcactatgtgaaaactatactgttaagagttcactgtgataatatattgttttggtgaacatgtgaaagatataagttcttttcatgatgtgaagtttcactgttagtagatcgctgcaggattccaggatgtaacaaaatgaaaaaaatccagtgcatgtgtataatctgttgtagcataatgtttacttactgcagactagagttttcttttcagtgcatgcggtctttttgttggatattttcttcataattcaatttaatatgtttactttcacaagtgagttacaacttacaagttcagagtaaaacctagcatgatgacttagtgttttccatctttttgaaatagctcaattagtatctggtaccattgcaataatcttaatttgcatgtctgcattttttt

SEQ ID NO: 103483 - DNA, 667 bp, Oryza sativa
attcctgcagccctaatatttgtgtcttttaagtacctacaagcctacaacttgattgataaaaaatagtactaattagagtttgatagtaaagtcagggtgtctatgacgataatatattcgcgtagtgttacgatggaaacttactacgcacttgctgagaggtggcgtagttctgcgtaagcttaatccaacactggacgtagtagacgatgatgaaacacttttactaacggatttttattgatcatggtcctacatttgttggtggatctagttgccactgctttacagggcattttcatttggatttgggtgttgataaaataggtggggatcgctaagactaatcaatataatcatcatagacaggctagatctattaaatgccatgaatggctgtgaatgcttcctgctttacagaatggagcaccgatgttagtcatccatctctgaaatctgaacaatattgtttcactgaatgtctgaataattaatggatagtagtagtatcatccaaagctcaaaagccagcaaactttaccccacatttacatgaggtaggcggttacaatgatttttaccactaggtcacatcatgatctttcgtcaggagacagcccaaatctgcaagcgacgagctttcagttcttgccttaaccatgaa

SEQ ID NO: 103484 - DNA, 525 bp, Oryza sativa
actgctaaatagtgcattacacgttgcatgatttagaaatactttctatataaaagtttttttaaaaaaaataaataaattcattttcctttttaatatctaatactcaattcctatgttaatgaccagtatcattttgtatgccctagataagctcatctaatgagctggatcgcacaacctaagtaggatataaaagacatcgacgcgattgtcaaaagaatacatttgatctttaatttctaataatatataaataaagataactaataatatatgaaaaatacattcatggtaaatttagttatattatttcgatatatcaatatatatcttttattgtagggagggaataattactggagttgtttttatttttgaaaatgtaagtctaattttactttgcatattagtatgtgatatacaattatatattgtatattattgatttgtttagattttttttatggatgtttcgatgatgtacatatagtagaatagaacttaaaataacatatatttttt

SEQ ID NO: 103485 - DNA, 895 bp, Oryza sativa
  unsure (1)..(895): unsure at all n locations
ccagggatttttcggctagctccacaaggtggtgggctagatgacctggtcgggttcaaagcctcacccattctaattatttgatattataggtcattccgtaatattcccgtctttttgtagagcacgttgtggctaggcacatgatgtgttcttgttgcttagtagtagttttctctctttctttttttcncnttggtatgcatccttgatcggtgtagaggcaacatgctttcaatttattaatgaattaaaccttacattatctagaggatatctaaaaataccagattcaggatcatgagaatggtgtttgtatactttatctacctttgccattgaaatgctatatataatttcccactccccatatgtaggacaggtgatcgatgtctcaaactaaaagagagagaaggacatgtgtcacagcattgtgcatcccccaaaaaaagaaaatccatacatgacaaaaccaatcataaccaaaaaccaactcaactaataatattacatgttccctcaagaatacaaaataatttagtcgttatgcagatacatgcatgtatctaacgacggcgagtagccattagccaatatgcacgtcacatgcatgtaccgtatccaattataatcttgtaaagttgtagttgatccatccaatccgaaaacaaacgttgatggtcaatggtcgatcagattgatatcgatcccggccgaccatagcgaccacatatatatgtttcccgagatccatcaatcgatcgatcggctgattagagataccattagtctttgatgctgaccattaatttactactaatcatcctactaagcccccgttccaacctgattaattaagtacagacacataaaatgagaaagtcataagcacata

SEQ ID NO: 103486 - DNA, 1357 bp, Oryza sativa
acttttgaaacttaacagtgctaagacaattttttaactttaattttcaataacaaaaagaaaaaccataacagttaacagtgtaagaatgattttactagacttattgtgaactaaggtcttatttagggagcttttatcagccgcaggttgtcttagaatcttcaactctctcaaccagtcagtttttaaaaatatagaaaaattattttttgtgatctacgatatatagattgctattttttatggccattaactaccaaccatcttcttagaatattaagcatctcaaacaagaccaaactatcgaaatatacaactcttctatttcaaaaaatatatatcttatactcccttcgttttatattataagtcgtttaactttttatcagtcaaaattctttaggtttgacctaatttatagaaaaatagcaatatttacaacactagattagtttcattaaatttaacattggatatattttgataatatatttgtttcgtatttaaaatgttactatatttttctacatacttaatcaaatctaaaatattttgacaaagaaaaaaatcaaacgacttataatataaaatggaggagtagggattaccgttttaagtagctactctatccattgtaaaatataaatgtttttggacgatggatatgataaatcatagtacaaattcgcatgttaaactatgatttatctatctaaaattatttatattttagaacaagggagtacatgtgatactatcttaaaaaaataattatatttatggacgacggagggagtagttacgtgagtatatagcgctacattgtcagctagctagctgatcgatcagcatgcatgtcagtacaccatgggcgcccgcggccggtgcgccggtgcgcgcagctgagctagaggacgacgcgcgcgccgcgcgccggcggctggtccgccgggcgccgcatgtcgtcgtcgtcgtcgtcgttctcgccgcccatgctcgcgcccagcaaaagcgaaatgatttcaatttcgctttaatttgtcgtgagctatagcgcgcgcattgagctttttttttttccccgagagtttaccggcggccgccggccggcattgatgaggggatcgacgccgatgcacggatgaggggctctagctaccgacgccgtactcgggagtaaatgcgggctgcctgccggccggccgatcgagctctgcgttaacgtacacgaattaggcggccacttaattgcgcccactgtgtgtgtgtctgtgtttcagtgtttgctaccagccgtttggtacttggtaaaacggttatttaaccgtcggggggggggggggggggtaatttt

SEQ ID NO: 103487 - DNA, 1044 bp, Oryza sativa
tgtttgctgtcatcgctagacaaactttcacacgcttcaggatttaattagaaatttagtttttttttctgttcataaaacctggaactctgctgtctattacctttctactacaaactgtgattagccaaccactatattcgtgcctcagtttttaaacggaggcactaacgacatgaaagcatgtatatttgtcgtatgctagaacagtttcctgacttctaatcaactgagggtcctaattttaataatcaccgattagttggttaattggtatttaatagcttgatctgcgcatattggatctcctcatcttgctcttgccacgtagtaggtcctgaattagggattcaggactcatagtacgtaatatataagcacagggcgcaggaatattttttttggtgaataattcatatgaatttattattgtatactaaaaccccagaaattaattgttccatttagtagttcctttttttttcaaggacattttgcagttccatttattaaagaaagatatatgtagcaggggaggacattagtattctctcctatgattgcagcgttcatgaatgtcatcttctgggaatcaaatcctacaagtgacaaagggcacaggactatctttgatttgacgaccacaccttcaaccgctctctcctggtgctataattgtggactctagagagaatcataaacagagtatgatggtggagtcgtgaataaatggctctatatatccacccgaatttaaatcctgatgtcatcaataactattacacacagtcgcatattgtgcattttattagagaaatttattgtgtaggtgtgttctttatttctacctttgagcttgaaagttgtagaactcaacgataattttttaagtacatatcattgggaaaaaatggtttataggatcatgaagtttttttttttcaacataatgatggcggtatgaagtatttgtgggaaaaaatagttatttgaggttaggaggaatctaaaaggacctagatgcctttgtgggctgcaggaatt

SEQ ID NO: 103488 - DNA, 3182 bp, Oryza sativa
  unsure (1)..(3182): unsure at all n locations
tcgcccacagccgcgctttcctgccgctgctcgcccaatgcactaangagcccccgcgcctcccgcacctctgttccccacgtcccccgcctctctctccgctcacgctcaaagccgctgacggcaatgaggccaagcggcgcggagtcgtcggcgccgctgctccctttctagtgtggtggcggctccttccccagtggcagcggttccgcctcgccccgccgctctcctccccatccgtcggccactcggccagccgccaacctatgtagagaactgagaagtgagagagagaagagagagaagaggggaaaaagagaaggtgttgacgtggcatcctgacatgtggtgcccgtatgggtccaacgctgactcaaccgctacatcagataaaattgggtcaaaaccaccgaaggaacaaaggtaaacggttctgtaagttaagggatgtcatatatctggttttacggttgaggatgatttcgtaactcgacgacaagttgagggaccttgggtgtactttttcccaaaagaaaccaccatacgagcggattggcccaaatgtggcccatatatgtcctcttccagatttatccgacgcaaaatcgatagaacaatcatccatgcccacggagtcatgtacaattcttcaatgaagcatatacatatatacagtattactacaactactactactagtagtattcaatggtgtgtactcgagacagtacatagctcccagttgtattcatgtagatagtacgtactacaccagagaggtagtatagtagtgagtactactcactactcagtactcactcatgatagcaactactagtagtaaaaactagagaaaaaacgaagatgaaaccaacgtgccgcggcgtactactctccgtcctcttgctgctgccgccgccgctgccgctgctgctacatgtcgtcgttgctgccgtttccgctgcgcaatcgtggtgggggaacgcagaattgaattccgagggcaaagggtagttgttgcaggcacggagtgaaggcacatgcgccccagagattcgacagtgtcgatcgtgtcgctgcagctgctatagctgttgtactagctcaaaagccctcctctccattgcgtcatcccatatacgtgactgaatgcctgattggttcatgcacctgcgagtgaattgatgatgtaccgacgaccacgtactggcaattgtcggtagagctagccgggagggaaaaaaaattaaaaagaagaagaagaagaagagttggggctagaaataacggctgatgttgagagagagttaatgacgatcgtggagcgggcaacgaacgaacaatgaatgcaggtgttctcttcatcgacaaaaaaaatttaaaagtgataccccaacagtgtgtgcagtgtcgtactggtagtcgtggtactaccatcccgacaagcacacgccgcggcgcacaggcccggaaagccaagcgcgacctaacctacgcagcgcacgtacgtacgcacgcagctggctgccggctgcatgatggtttacgtcaccggttgaccactaaattggtagtatggttttcgactaatttcaaccacttttcgataaatttcgattggactttaaccaaatttactataaattttgattggattttaaccaaatttactgtataacatttgattttatccgaaagcatttgaaatttggttttcgttggctttgtgcaacctagctgtgagcctgtttggggagcttctgctgcagcctctcctagaatcagaagctcacataaatagtgcagcttttggtctagattctgaaaatccgtagtcgtagaatctagacaataaactaaggccagaagctgaaaaacccagtttttccacattctcagaagctgacttccaaccagctgcttctcagaatctcaagctccccaaacagccctgcatcagcttggccaccggagtaaatgctagaaacattagccacgcgcgtcgcggtggccgccggcggagcggccgcgcgcgctagggagagacttttttttttttgggagatcgtcgttgctgttgcggcgcccgtgaattccgcggccgcggccgcggcgcacatgggagcgtggcgtgcggcgcgcgggcgcgtgaaggagagttagcgcatatatcgatcgatcctgtgcacagcgacggttcaaccgtacagaccggccggggcgttgcgttgctctagtctacggattaattaaggattattagtattcgttattgttgttattataggcacgtttctgaaactaataaaaacgaataagcagtagtagtgtgagtctcacgtaagctttctctatccatttttctttgaaaactttttaagtatttaattccgtaatttatgcccttggataattatcataaaatcaatttcatctgtcatcatttgtataaggctacgtttggacctataaaatttcatcttctacattttcgttttttcacacatatgcttctcgaactactaaacgatatgtttttttttaaattttttttataaaagttaattcaaaaattatattaacttattttttaaaaaacaatttagctaatatttggttaatcttacgctaataagctacctcgtctaccctaggttcgaacacaacctattacttcctccattccaaaatataaggtacaaccaccttgactcaaagaccaagaaacaattattatcacctctttatttgaatcaatccaattaatacaatacatgcaaccaatagaattaaacatcttgtaagtgtatgatttaaaaaataataatttaggagagaagagatgctaattaattgtcatgcatgcatgcacgtcttatattatgaaacacctttaaaaagtagttgtgccctatattttagaatagagggaatattttagtaagacagacagacagacgatgaacagctgctcgtcaacaataagcaagtgacgacgaagttgcatcagtgacggcgtcttctcctacgaggtgaccgtagcttgtttcgatttgttgaaacgggtacatttagaagacacacaacacacatataactacacacatatacacttgtaggtttaacacatgtttttaaattagaggttaatttggaggacctaaactctatgatgcaccgga

SEQ ID NO: 103489 - DNA, 731 bp, Oryza sativa
gcaccaatatcgtgagaatatcccgatagatcaacatctgcgggactactcgttttttcttgatactttcgttctttttttagttctttttggttttatctatttcaaactgtaaaaccctgcttaatataaaccagctaaccctggcttcggttcaaaaaaaaaaaagaaaagaaaaagaagaatgtgcaatcgccggtgtgtatgcagcaggtatgtttatagtcttaaaaataaactaggcatttgatggcttgatctaaaaattttctgaatttttacggcataagattctgatgtcttccatgcatccttctgcttagaatggggcaatattatgtagcaattcttttcttttattgagaagatttagtacttggttgcttgcatccattatcctttcatccacaagcctaacaaactaacaaagtcatattaacctaccagatcgattgatagtacttgtaacatatatttgcccatatagtatcgaaattaccccgtaagatcaacagcgttcgtcgaggtggccggtaggcaagctaccaaatcgatctgatagatagctgtgtatggcatgcaggtaggttcagacttcagtgtctcctgtcttcgaattccttcttggggctgtttggttttcagggacttatttcaagtccctgtcatatcggatatttagacattaatttggaatattaaacatatactaattacaaaatccattccat

SEQ ID NO: 103490 - DNA, 660 bp, Oryza sativa
aacgatgtctttacttgctgtatgtatgcaaaacagaataatacatgtttgcatagtttccctttttgatggatttcagctctaatttttcttatcagttctatgagcttattttggggaaatcagaagatattttgcgacgtgatgaagagatgcttttcaaggttagctgcagtgcatgttctaaggatttgttaattgttataacatgcgtacattaattattttttatgacattctattgcatatatggaataggtgtctattctaaggccaagtaacggtttaaccttccgtgcaattgtcaatgctgaagtggttgacatgagtaggaagaacaggtttatcctaacgctctacagctagtcttgcaaatttatgttctaatgtttgtattatgtctcttaattgacagatggcctgtacctaaggcggagtggctatatccatgtacggacgatagatgtgatgaaattgtcgcgcctgatccgatagttattcgaacctgtgaagatagctattatttacgtaaggatcttatttcttacttttcactatattataatagattaatgaactaaaatgcgtcaaatatataacattgatatggcctctgtcaatttgaatgaatttagtctgtactgcagcttataaagctgt

SEQ ID NO: 103491 - DNA, 1293 bp, Oryza sativa
cccttcttccttcttttttcactactgcgacaacccctcccctcgtgccgcctctcagcaccgagaaaaaagaaggaagaaagagaaaaaagaaggaagaagggagaaaaaaataaaaaaaattccatgtcattgtccacgtgacgtgtcacgtaggcaagaccatagtcaaacgcggttttggaccgagatgatacaaaaccaagtttagggatttcgatgtgcggtttgcaagttcgtggacctaagtgaaacctcctgacaagtttaaggatcgttggtgtattttactcattctagatcttccttaaacaaaagcctaacaaatgtaacaaattaacataacttacacttctcaatcttatcaaatacaatactaaaatttgataaggttcattttcagatcaaatgaacaacccataaagcgatgtgtttagtaggaagggttggtacgctttaaaaaaaagaacggtagatcaatccatgattaattaagtagtattaactaataatattttaaaaaataaattaacgtgatttttgaagtagtttttttatagaatttttttaaaaacaaaccgtttattaattcaagaaacatacatgtgaaaaatgagatgcataggttagaaaagtgtgaaaggaatacaacaaattttaaatctactattatttaaatgcaccattataattgaggaagcgtaccagtagaaagaaaacgatgggctggtttggtttgtgacctaaattggccttaccaatttttgtcgatgtcaaattttagcaagttttggcatggctaattttggcaaggcaaaattgtatttggattgaagccaaaatagcctaagttaacgattgaaatgtcctattttctaaggcatgctaaaatttggcttcaaactaaatagacactaaacactgttaaaattgtcaaatattggtaaaaacaatttaagcctcgaaccaaaccggcccgacccgatagaagtaagaaagcgtgaaaaaaaaggaacacatcaaatcgcccagacctaccaccgttcagcacgaggacgagacgagggaacgttaaagacgcgggggccggcagcttccaccacgcatcccacctaccctgctacacacgcatcctcgtctggcggtggactggccgcgggccggtgtgctgtggactccggcacgaccacccgcgggtcgccgacgcgcgggccccaccaccacgcaggccccgtaggcggcgtgtaccggacgcgcggcgaaacggcccgccccgcatttaaggcccacccc

SEQ ID NO: 103492 - DNA, 655 bp, Oryza sativa
ctaaccccgtacacgtggcgtccacacggaggggttcggggcagcccgacccccaggcatggaggggacggccaccaccctaccctgggcccgacccctttcgggggagtgccacgtgggtattgggggcagcatcctccctctagtcttgataccccgagcccatatcactaacaaatgacttaaaagcttatgatgaaaaatcactctactgagagagctaggatatattctgaaacactagagcaatacgtgttcgtgagttgtaacctatagcttatattgctagaacaagaaaggagttaactacaacttgagataaaagaaaagccaaccaaggtatcgacaagtgcaacagatccaaagaaggaagtggcacagcggtgcgttcatatgctatgccactgcagggttgaaggatgtaacaagtggtaaagcaacacgaaaagcaagcgacaacgtagaaggaaagcaaaggcaaaagagtatgcctttgttgtgtacactataaagctaccggtcacaaatgcatcctcggaaagaaaagaagtctccctccatgctgctgcttcctcttcgcgactactcccacaactatattctgaccctttatgagatgacatgcccctcttcctcccactcttctcatcccgtt

SEQ ID NO: 103493 - DNA, 682 bp, Oryza sativa
cctgcagcccaaatgaatggtgaaaggttatgattgatttagaagagaaggtaatagaaaaattaaatagggatagattggttaagatgagaggatttggcgaagaaatagttgcattttaaaacaaatttgtattctagaaatagctatattttagtcttaacagtggtaacaacaagccaataacagtccatgtaagaattggcccctgtgcattcgttcagtggctatgggtgtgtttagatcccaaaaatttttggacaaaaatagacatcaaatgtttggacacatgcatgacgcattaaatgtggaaaaaaaatcaattacacaatttgcatgtaaattgtgagacgaatcttttaagcttaattgtgccatgatttaataatgtgatgctacagtaaacatttgttaatgacagattaattaagcttaataaattcgtctcgcagtttataggcggaatctgtaatttgttttgttattagtctatgtttaatactttaaatgtgtgtccgtatacttaaaaaaaaattggccaatgaactaaacatggcctatggaaacaaacgtctggaaattgaggttcagattactgcatagtgcatacccatgaggccacacggcttgttcctcttcgggctagtgggctaccaagtccatgacggcacgaccattatca

SEQ ID NO: 103494 - DNA, 636 bp, Oryza sativa
aattcctgcagcccactctcttaaaacaaccacaatcccctctctgaaaatgaagttagaaaatacagtaaaaaaatctatgaacacataattaattaattaagttgcacgttcatttaatattttaaaacaatttttatataggaagtttttaaatgaaacatagtagtttaaaaaacgtgctaacaaaaatcgagataaaatttatatcgtaataaaagagaacaccaactgagacttgaaaaaggaatgtaaacattcgtgagctatagttttctacgcaagtatatagcaactagtagtaggaaggatttctatgtaggataacagtataccaccagtcaggttgtgtttagttcatgccagagttggaagtttggctgaaattggaacgatgtaatggaaaagttgaaagttcgaagaaaaactttggatctaaacacaacctcagtctattcactttattgctaaaataaaccctactagttatcctagaataaaccctaccagtcagtctaaaataccaccaaatttgacaaggtaacaaatctaaaatattatcaaaacttgacaacactactaaaatttgataattctagatgagtaaaatgcactagcggtccttaaacttgttgg

SEQ ID NO: 103495 - DNA, 714 bp, Oryza sativa
ctgatcgaagagcaacagatggagctggtgacgaggcgcaagctgcgcgaagagcaagagaggaacatgcagatgcagggccagccgccgatccagccctgatcccatcatctattcatcttattgttcgttgtcccctgtccttcagtccttgtccataagaattggcatggtcaccggcgaagggtgtcactgtgcgtagatgctactactccctcagtcccataatataaggagattttgccctttctacttgtcccaccatataacacaaattaagtatactttaattacctgaatgacacaaattaagtatacttagagaaatctacagtatattaacaaaataagtaaaaaaacaaaatgagtatagaaaaaatgctcgaaatgatttagttgttccatcacttcttatgttattatagcaaatcacaccaaccttgcaaggcgttgcatccgtgcgctcacttgttagattcttgtactagattgtacccacatatcaaattgttgcgctaccacgcttacttctcaagtttttacactaaattgcacttgcatgttaagttgatgtaccattaatgcaatttattcatcatgtataatactatttgttattgtatagctagcttacaaattggaatgatcaaattgagttaaactaaggagatagtcattggcacctcaaaattatgggagttaggctccactgca

SEQ ID NO: 103496 - DNA, 512 bp, Oryza sativa
acttttcaattgagtgccggattccaactcctaatggtaatggtatgaaggttttcatcaaattttggtaaaaccaaaaatccccatcaaatttaatgtttcaaatttgaattctcaaaagtgattcaaaaatttcacacggaatagcttttgtcccacatcaaaaccttgaattttcacagtttcttgcatttttgtcaaaaatgtgaacatttactccctgcgtaaaaaaaaacttctatctcgaacctgaatatgcctatgccgaggttcctatctagaaatgttttttcgatgaagggagtaaagtggtgtttgtttttactgaaaatgaatacaaaattaggatatagaaaaaatccattagcacatgattaattgagttgtaattgttacaaacataaaaaatagatttatttgatattataaagcaacttttatatacaaagttttcatataaatacaccatttagccgtttaaaaaatattgctaaggaaaatcgatgtaaaat

SEQ ID NO: 103497 - DNA, 654 bp, Oryza sativa
atgtcactcaatacggtatcagaaccatatatctcaagtatgaatctaggttggcacacaattaatcaaaaaaaaatacaatccacttctattccacgtgtggagattatgagtactatatacccacatagttggtttatcggactggttataggggatattttatatctctataatatgtaacggattaagacttgggcattatgtttccttaagtattaaaggaaacagcctacaatcctggattcagaatattgtaaaatatatgttgtatttagttaacttttatatgtaatcctgccttcctgacctatataagatgggtagtaggcccccttaaggatataaccacacttaagatcatcagatcaatacaacacccgacaggtagaaatctcaaacaacacccgacaagtagaaatctcaaacatgagaatggtgttacctattgacaagggcctaaacttttataatttttttgcaattcaatccatctactttagctctcgtgcagtatgccttcttgtattgccgattagtagcatcgacaccatggctgagatatgagggagccttctcatgtaactggatgtattgaaatatattagtgaattgtccgtcttttttaaaaacttccattttttattggaatgg

SEQ ID NO: 103498 - DNA, 3511 bp, Oryza sativa
tctttggagcacctcaacggagagtaggattgcaagaccaaacttcgggaaaaaaatcgtccttgtcctctttgtgatgattctgtgcatgttgctatagttgtgtatctgctctgtcatcctgtagtttatttcgtacaatttagttcaagtccctgttaaatctttaggttttactatcgcccggaagttccggtagtaagaacaccggaagttccgggcattctgagcagaccggaagttccggtgttcccgggcctactgaattttaccgttgcgaatttgtttgtaattttcaggaaagcctattcacctcccccctctatgctatatctttgcgcgttcaatatggagtcgctaaccacctcaacctagcaaaaactagatcaagatgagttttgtaagattaaaccggcaagcggagccgatttagatggaacaaaagataaatatccgtctcgtgagtgaacggaaggtttacaggacaaacctacaaaatagttttgcactaaactaggcaaaaaagatgtcatattgaaaaaaagattcttggctaattgggttgaaagtagattgtctctaattgaaccggtcttgtctcttataaaggtgttggtcttgcctccaatacagatctctttcacatcaaattcaaggtagagatcaattagaactcgaaaatcacctctctatgcaaggaaacccgagacctgacaaaattcgacatgaactcgcactctaccggtctggctggtcacatgccgccgatcaaaccaaccgtacacatcggtcaaaccggcctatatatggtggtctgaccaactccatgaaagaaacccgacgacgccttcgaaatttttacaatatttctctttcgcatctaggtgtcaaatttaggtgtaaacatatgccccttacctttttttgtacttgtgaacctaaatgcacataacacatggtctttgggcgataatctaagacaaatttttctacaagacactcaaagtttgtggtttttgctgtgagacacccaataaaagtgtatcttctcatagagactgaaaaatatggtaattagctgctggacacctgcctcattattttattatattccatggtcgcggatctccgcctcccacttcccccacggcctgcgccggattccccggtatagcgtcctccgctcccctcgccatcgactgctcctcctcgtccgccgctgcacgcatagcaatcagtagttcagttcgtatgcatgcaaaatcaggtagttcagttcatatgtatgcaaactaatggtaatcaagctgtattactatttaattacattgctatttctatttaattaccttgctcggccggtggagctacagcggtggtggtggtgaattggtgaagtcgtcgtcgctggcgtgctgcggcggcgccgcggcggccagagttcatcggctacggagaggctagctcctcttgccgccagggccgtggctgttgatcagcgggatggcgccgccgcacatatctatcttcactagctcgatcgatgcttgccgcgaagcaacggcgaacggcgagagcagcaagcaacctagtgcgtgggtgagtgcggaccgtgtaggaaggaaggaaatctaaaccgatggccaaaaaaatgcaacaaaattaagaaaaaaatcaaatcaaaattgttgttcttattttcttaatcgatttcgctttgcgcatccttgttggtggaggtgctggagctgggagtggtggtgcactcgctcatcatcgcgatgtcgcggagcgcctccgacttcccgagcacggtgcggccgctcgtgccggcacaccacgcgtggtgctggacatcgagggcacgcggtgacggggacacgcgacccacacgcgtacagctgggaagctatcgtgccgctccccgtggctgcagccacccacggctgctcgggaaggcagggtgagatgagatgaaagaaaagaggaagtagaatatttctaggggtatttcgatactttcaaggctctttctctctctttttttatctaaaataataaaataatgcctcggatatccagctgctaattatcacatttttgcagtgtccataggaagtaacacgttctttgggtgtctagcagcaaatgccacaaactttgagtatcatgtagtaaaatttgccataatctaattacggaccatataactcttcaagcatcctgccaaacactcggtaaatatttcttcaagtatttctcatagatcgatctctgaaatttgaattcattctccttgcaatgtctcaagaatcgaataattccacatattcgataagacactcccaactaagtgaccacttaccgaattccttagatctaggaccctctcaagattccgagtctatatgagaaagttatgctgttttaagaaagaacactcgaatgtaaaaaaaaaatagcaaacaataggaagtctcttaccaataaatcttcgggagcaattgctcaattgaccctgttttgaagcttaactatcaatatgaccttatttttttatgtttgcttatttgaccccattttttaaaattgaagagcaatattgaccttattctgtgaagattggataacggtgttaactaaagggcaaattatccatctttccgctttctacatacaaattaaaagaagagaaataaaaggaaaaaaagaaatggtagcaaagaaatccaagcatgcccaaactaacatatgatgatttctccttgccatgtacagcacttccttccatcattcaacgattatttctcccaaccacatgcaaagcactagcaatcaaggggaaaaggttgggctgggatatggcgcctggatttttcagattttggtacttatgaaaaacttatttcgcaaatagacccctagaaaaacttatcctagaaatggtcctttttggggtgccacagtggctggcgcggtaccggcgctagcctctctggcgccgtcctcctgccaccatggcacacgcgaaccgacatggcaggaggagggtaccagcatggctggcgccgccctagggaggagggccagtatggctggcgcccccccccatcccctacccctagcctccattcctgtttctctatatggagttacaacctttttatttttattttattttttcagatgtttattcacacttaggatcacgatgcaaccaaccacaaaaaaaattaaactcgaaaataatgcaatctaccactaggtgaaatataaccacataaaatgagcgtaactttctcatacggactcagaatcaggcaaataatatatccacggacatgtacataaaaagttacatccgattctccccaacttcaccgggttcggcgatattaaaacctccaaattccgcttgcaagattgtgttctcgaggagagaagttttttggtagagctttggaaagttccacatgccacatatttcgtccgtttgagtttatttttttat

SEQ ID NO: 103499 - DNA, 956 bp, Oryza sativa
tggcgcctcgaaaaggaccatttctgggataagtttttccaggggtctatttacgaaataagtttttcaaaaggaccaaaatgtgaaaaatccaagatatggcgctgtggtgatagcttcacgacaggggtcggcatgacggtgggacaagctaccttcctccgcgtaggtccgtgcgacgtcggggtcgccaaggacagcgcaccgccgcagctcctcgggtcgtcgctggggtcagccacagcttcgccgtggccctcccaccgccaccccaacagcgcgaagcagctgctcctgcgcgcaccgataccgccgccgccgctgctctctccctccgctcgcgagccggcactgccgctacctccacccacgagctggcgccaccacagtcacctccatgcgccggcgacgctgcattgccgctacctccaaccacgaccgacgccaccgtagccccctcgccgccgccgtccccacgccgccgccgcccccacagagctcctccgtgccccctcagagcgccgccaccgcagccctccatctccacgagcgggtgccggtggggctccgcttcacaccgccgccgtcgccgcacgcgtagctcgccgccaccgcacgatttgcacgagagagagagtgtgttgcacaagacagtagataaggtttggagggtattttgggtattaggaatattataaacattttctttttttaaaaaaaaaccttaacggagtcgtggaatggaggtcagacgggagcttcatttttgaagagggtcaaataagcaaactttaaaaagtatggtcaaattaatagttacagcttaaaacggagtcagataagcaattgtccctaaatctcttaagtggatttgagtagaaaggagagagagtaagagcggcactcgagcttagacagggtaggtgcaatggtgtgtgaggggagggggggggtga

SEQ ID NO: 103500 - DNA, 549 bp, Oryza sativa
tgcactttatggtgataaagattggagatcagctctgataaataccattaaaaatgctgtgagtttccccaattcatttgcctataaatattatgatatttaagctataacttctctgtggccttccactttgcactactgggaaggaaccacttatgttggttatgtgtaacttccgtagaatccaaacatctgttacttttgggaaggagggagggaattctatgcttgcctactgacattcaagtttctaattgataacctctgttggcccccttcatgcatatatgaagcatattgttcgacgttatcagcagctctgagatgattttgcttctgttcttaaaattgatcactttttttagtgggaatacacgattaattctatatttttatgctatgtataacaacttgagcttattgatgtttaattttgccttgccagttaactgtgaaatcttccccaacttgtgttgtggctgacgacagcatgttcttggctctcttaatttcctccatgtcacccacttcaaaagtcatcgcgatgta

SEQ ID NO: 103501 - DNA, 1100 bp, Oryza sativa
aagaaaaccaattatacagttcgccaggaaatcgcgagatgaatcttttaagcctaattgtgccataatttaacaatatggtgctataatgaacatttggtaataatggattaattatgcttaataaatttgtctcgcagtttcctagcgaaatctgtaatttgttttgttattagactatacttaatacttcaaatgtgtgtccgtacatccgatgtgatatgtatgggtaaaatattttgccaactaaacaagcccgtacgaacattcttgttgttgggcttgggctatgaagcccaaccaagtaggtcaaatttgatggtttgatgctgtttcttaaatctagcagtactactagtatttcagatcgtacttgcgaacaaattactacagtagtatgtacttaccactcatagtagtaaaataaattaattgatggaaaatagaaccagtactgaggactagtagtattaggtaggtatactgagtaaatttttcagatttggaaatatgactagattttggaaatatgactagatggagggagtatactagtatatgtaccttagagcaagtttaatagtatagctcactactagttccaattcatctatagccaatctaatagccaattcgtacaatagttgtttactatactattaatatatggtcccacatgtcatacacatattgtgtcttggagttcgtgttgtagctggctacagatctgtagcccgctgctcttctctctcatcttttatcttattaaaatatatttatagctggctaataatatgctattgtatttgctcttatcttctaaacaaaatactctctcgacatccccatgttcagattgaatcagacaatatttatacacttggaatggaagtagtactaggtaggtattgtagtactccatttctcccaaaatattgagtatatttcatcgtaagtcattttctattactgatatttcgctttgaaccatcctctaatcaatatttttacttggaagtgagtaatcttgcctttatttcaatttagatcatctagactcttttatttcaatttagatcatctagagggctgcaggaatt

SEQ ID NO: 103502 - DNA, 676 bp, Oryza sativa
aattcctgcagcccaaatgaaccttacaaaaatttgacaatatcaaaattttggcaaattgacaacattgctaaaattttggtcggattggcttaataatattgtcaaaattctatacacattaccaatatttggtgacaaactaaacgtatcgacataattgtcaattttaacaaataatgatatgattgaaattttcatcaatctaaacaagccctcgtaaccagaccttttatgaatgttgttagataacaatggcacacttcctccgttttatatattgtaagtcgttttaactatttttttcaaactttattagatataatcaaattatagacaaattagcaacatctaaaacacaaaattagtttcattatagaatatattttcataatatatttgttttgtacagaaaatatgattatattttatttataaacctagtaaaaaaaaaggttgaatatgaaaacgggaggatttaattggattgtaatgttgttttgagttttcaggcgtcagcgcaggagtgttggtggtgctagtggccttgttgttggcgtacgtgggcatggagaagaggaggatgctgagggcgaagcagaggttcttcgagcagaacggcggcctcctcctgcagcagcagctgggttccctggccgcctccggcgtggcgttc

SEQ ID NO: 103503 - DNA, 649 bp, Oryza sativa
ttgcagacaaattctagtatgaaatatatgaagcaacagggctggatgcagaaaaaacacaagaagtccccgacataatatataatgttatgccaagtgacatagaaagaacaggtaaaaaatatagggtcacagttgatgcagcacactcaacctactcctgctcgtgccacaaatttgaaagagatggacttctttgctcacacatcttgagggtgatggctgtccttaacatccatgagattccaagtaagtacttgctgaaatggtggtcagagcaagcgacattgcaaatacgtgatgagtacaatggtccagcaccatcaattggagtcccggcaacaagcaagctgagattcaacgcattatgcagggcaatgacaagccttgcttcagatgcatgtgttaatgaggaaaagtacttgattgtttcagctgggattcagaacctacacgcaatggttgcaacaccacacactgttgagacacaacatcagtaaggtatttttcctagtcaacaagacccatcaagttcagctaagaatccagcaaccaagaaaaggacagggaggctggtagaaaaaactcataggatgaagccaataggggaacaaataactgaaagcagcaagaagaggaggacaaaaaa

SEQ ID NO: 103504 - DNA, 681 bp, Oryza sativa
cttacaactctttggcatctgccttccttgacctatttggcaaagaatcaacaacagatcttctgtacacatcatctatttcagaagcggtcttcaacttcttcgcctctacatcactatcacctttctgtgcccttttcttcctatttttcttctcatgggtgcttggaccactactaccagcacctactatagaggaaaaaacattagagaggggtaggggtgttgttcatagttactttacccacaccgaaaagagagagagagagagatagagaaagagaaggaacaaaaaagtggtgattttacctagaggtagcgagcttgtagcacgtggcggtgaagatgtagctggggatgttgcccttactgctgctagagagagaactactgaagttgatgtttttgttgcaatgggtgaagggggggctggagaaggtgtccttgcagtgggtgaaggagttgcagaagatgtccttgcagaaacaggtgactgaggtgatggagaaggtatccttccatccattgccgattgaggaacatttgaaacatccaaggagagcatctcaacagccaagtcctgagtactaatgaaatcaggatcagattcattgaagagtctgaatgacggtgcatcacatgcatcatctagatttgagatatcagagggctgcaggaatt

SEQ ID NO: 103505 - DNA, 665 bp, Oryza sativa
ttcgtctgaagaatataaatatatgatgctatagaagtactactattgtttgagttggattggtgataaccatggagtgcaagcaacaagagaagtagtatgtgaagtgcaggaagcattgattgagcagggtaggttgcttgagcagtgatatactgctacagcagcatgaaagtaacgcccatcgatcgtgtgcgggtgcagtcgcacttttttaacttttttttttgagaactttgttaacttttgtagaggtctgatatatactctgatagtgaaaagagtgaagtattatttaatgtacttttaatttaatgatgtcccagcagcttaatttgagagtttggcagaagtacgcatgaattgtatgtgtcaagtgatcgatggttataaatacggacaccgtgatggagtgatcgatctaaaaatgcagagtataagtactactcctgtggtagtacagtacaacacagtaggtgagcacttgagctgctgctgctaaggaaagaaaagaagattggtagaatcaagaagaagaagaaggtgagtagtactgtacagtacgtgtttgattttcagttagagcttgactatttgttgcagcacattaactctggctctcacaacaaggaataaactaagcaaagcaccgcccaacgaaaaga

SEQ ID NO: 103506 - DNA, 1831 bp, Oryza sativa
aattcctgcagccctcatgggtattaaccttaggcaaagccaaatggatattactattttgtccaaaatgtcattagtattagtcttgggccacaaaatacatgaatgttaatctttgggccaaatttcgtgagtattaactttaggccccaaataactaaattttacccttcaacccctagacacatgagtattagccacaagtccaacatctaatgattattaaccttagtcccaaaaccaaatgagtattagtgtttggcctaagatttcatgattattagccttggccactgaacacatgaatatgtttctttgggccaaattttatgtgtattaaccataggctccaagatgttgaattttacccttcgatttgaaaccataggagtatcagccttcggcctaaaatttcatgactattaatcattggcccaaattttcattagtattcatcttgggcaaaaaaaaatgcatgactttttttttaaaaaaaagaggaatccttaagcacaaaagcacatcagtattagcctttggctcaaaatttcgtgagtattaatcttgggcaaaacaaatgactgatagcattcagcccaaatttcaagattactaaccttgaggccaaaaatatatgaatactagcctttggcctaaatttcatgagtattaaccttatagttgaaagccacatgaatattagtcttccatctactcttggaccaaaaaaaatagatgagttagccttcttggcccaaaattttatgagcattaaactttagtcttggaaacaaataagtgttaccctttcgtcaaaaatataatgattattaacttcggcataaaacgcatgaatttcatgaattaccttgggccaaaaacacatgaattttaacatatttaccaaaaaatttgtgactattaaccttgggccaaaaatgtatgaattatatgtttttagtgcaataacatatgtatatcaacattcgaacaaaactccctagtatagcctttgggccaaaatttcatgagtaataaccttgggccccaaaagtgttgaattttaccctttggcccaaaaacatcttagcattaatctttggcctgaaatttcatgaatattaatcgttggttcaaattttcatttgcactgaccttgtgcaaaaagaaacatgatttttatccatgggcagaaaactacataagtatttgccttccactcataatttcatgagtattaatcttgggccaaaaatgacgccaaaattcatgactatcaaccttgaggccataaacacatcaacattagcctttgaccccaaaattttacgagtgccgatcataggctaaagacacatgattattgatcttgatcttagaaatgtatgaacgttagtctttctcccaaaaacacgtgagtattaaccttcagcccaaaaatgcatgaatattagcattctgttcaaactttcatgatattacccttggggaaaaataagtgcctttgaaacaaaaaaaaacagaaacaaaactctcgggcaaaaaaatccttatgcacaaaactattagcctttggtttaaactttcgtgagtactatccttgaacaaaacaaatgattgttagcactacagtcaaattttcaagagtattaaccttgaagtcattacaagtgatgaaattataattcgtgtcaaattgaacattagcatttgggccaaatttcatgagtattaaccttagacttatggacgcatgaatattagtctttccgctaatttttgtgattattagccttgggggccaaaaaaaaagcatgaattcggcccaatt

SEQ ID NO: 103507 - DNA, 639 bp, Oryza sativa
ttttcccaaggctaatactcatgaattttggctgaaagctatataactcacgaccaaaagctgaaaataatgaaagtttgcatggagggctaacacatgcatacagttttagtcctaaggttaacactcatgaattttaagtccaatgagtaaaattcctattttttttggcgagaccaatttttttgtattacaaaattttaggtgaagacttaaatttatgaattatggccaaggagtataattcgcgaaactataggctataatacacatgcagtttttcccaaggctaatactcatgaattttggctgaaacctatataactcacgaccaaaagctgaaaataacaaaagtttgcatggaaggctaacacttgaatacagttttagtcctaaggttaacactcatgaattttaagtctaatgagtaaatttcctattttttggcaagacctttttttttgtattttttggatcaaaaactaatcatcactaaattctaaacaagaaaataatgttaatatatttttatgtcagggctaaacctcgtaaaatgttagggcggcgaaaaatacccaatggtttttttccaaggttaatacccatgattttatgagacaaaccagtaaaaattccggt

SEQ ID NO: 103508 - DNA, 681 bp, Oryza sativa
tcctgcagcccctaaatgtctcgtgtgcatgctaccaaactaaaatgtagacaacaggtatcaaaagtgagaattttgttttggggaattgagaaaagttgttaaggtatgcagttcaatgaaggattaatgtactatacttcacatccatgcagccatacacacctaacaccttcaaagggaaagaaagtgaagagatctagcgtggatggaggcaagtagctcatcctagtgacagatatgagtttgttcaggcatccttctctgaatccggaagaggcttgggggaagaggaaaacatgaccaaacttcacacgcgacgagtacctgctaagcctatctcacacgaattctcccttgattttgatcgagcccatgcatgctccacagactgtttttttgttggccatttgcaatgcagtcatccaggatgatgatcaacagagtaacagactaccttcctcctcgtcaagtcactgtcttgcgagtcttttgttatttgctcaattgctcgtgcagtcgcttggcatgtaagaataaggttaggaaaacctatgctagctcagctagctgaagaaaagttgtggcctgactagcagtggatgcactgcaccagaagcggtcactcccttctctgaacttttcccaaaaattcctctctcaaagcaagaattcaactac

SEQ ID NO: 103509 - DNA, 637 bp, Oryza sativa
tcgaggatcagacttatggatagatgggctgagaacacagaaaagacatgatcaattaagcccaaaattccatgttttggattgaggagcaaatgaggagtcggcccgccaaaaattgggccgtttgggccagatcatggttcggtcgaaccccttgtttcggccgaacccctatcacagccgttcaggctggggtttggcgtggacgctccagatgaactcctgatggcggttgcggggcatttcggacaactcctatgctctacaaccgtcatacctacctatttaaggagccctcatcctcacttcacaacacacactcaagcaaggattgaagctccattttattaatataatatttcttctttatacaaggtcggtactttattccattcatagaatataggtaccattcttagtttattgataatcagtataatcttagtagttaaaccttctgggattttcattgatgctggtagaatgtctgataactgggtcataagtctgctctggctaggccgagagctatggcccggggactcagatgctctgcaccgattgcaaggctgtagagtaataagtagttacttaagcatagggttcaggttatcacttatcattatttgggggtata

SEQ ID NO: 103510 - DNA, 970 bp, Oryza sativa
aaaatagaaaagaagaaaaggagaaaatagaagggaaattgggggagaaattaggaggatttaggaaataaaaatggtcggggttaatcatagattatttttggaaattcctcgagcgtaatagtatttcgatcgaaattccgagttaattataaaatatgtttcttgatcagattagattaaaattggtagtaatttagatataattaataactaaacaattagatgaattctcatagattattatagattatttttggtaatctctataagtcatcggttcacggtagaaattcgaatttaattactaagaatcttagccgcatattatatttaatcgtttagtcatagaataaattaaattgtataatatttctaggatttcctccgatatttagctcttaatagaaatttctaacctattatatggatataatgctcgggaagagtaaattaaaaacttatgacaacaaaatatttatgcccgcaaaatagtttaagtcgaaattgggtttgccgtagttcgcagatagtaaagttaataaaaaggaatcgactttcacattcgactttcatttggatttatttggatttttatttgaattctaaccgaattcaaatcaatttttgcacgtaactatagagcccgagggagttgcggatccaagcgaaggccgagacctgcaagactctgagcaaggcaagtcatcactattcctcgaacatgttgatcctaattacgaaattgttttgtttacaaataaaaattgcatgaaataatgaacatcctacttgtgattatgccatgccttgattattgtttacccttaaatctttgtaaccatgcttacgtatgagtccctagtcaactatgacaattgcttagaaatgctattgtagaatcatgcatactcatatttatcaaatgctatatgcttgggcaattacttcgggaagggctgcaggaatt

SEQ ID NO: 103511 - DNA, 1813 bp, Oryza sativa
caattttagataatctaaattcctagctataaataattgcattttaagatagaatgagtaattataaatttataaccagaaatagatatatttttggacggaggagtaagagaagatattaacttattaaggcctgcagtgataaggaaagttatgctttttatttcattccattgcattctgtagttattgttaatcacagctaggcagctagctaattatatagttatgagaatgaaagacaagggtgatcaacaggtgaagtttagtctggtgcagtacatggaacaccaatgcaaaaataagatcttttgcttgaacaaagaggaaaggctgacttgatcccagttaagaacgggtatcatggatcctgtccaaaagtacaagatttcctgcgagatttaacaaacactaaataggagtttttttaaaagagttgtcaatactaagcatgaggttgttaatttacaaagcctgcagaggctacaacttcccctctaaaaaaagagagagagaatttgtaatttctctccattgttgggtactgtatgttctttctttgtcatattgttatatgttggttaggaaccagactttgagaaaaacccggtggttgacttcaggtaagctgatctgttctgattacaatctttggtgacattgacactggacaagcactaatattgaatattccccttcacgccaatgattttacttatcataagggttggtaccctaccatccagtgtaaacggtatttatccttccattttgcaagagatttcccctacagcatgttcatgacacaaggacattagcatcccttcaagctaagtcaagggataaatgttcttgctcttggtgaacagaacttgataattttggacatatcaattaccaatatgacgttttgaatttgaactaaaatgctactccatctgttttatattataagtcgtttgattttttcctagtcaaacttttttaaatttgaccaaatttatagaaaaatatagtagtattttcatcacaaaacaaacatattatcaaaatatatgcaatgttagatttaatgaaactaatttgatatttcagatgttgctaaatttttatataaacttagtcaaacttactccctccgtttcataatgtaagtcattctaacatttctcacattcatatggatgtatatgtctagattcactaacatccatacgaatgtggaaaatgttagaatgacttacattataaaacggagggagtaacatagtttaacttaaaaaaaagtcaaacgacttataatatgaaacagaaagagcattttatttcattctttatataaatatatttttaaaaaatattattacaggagaaaacggattgattaaatcctacctctacatctaccaggaatatacatagccaagagttacacacttacacaagagctacataagattacttaaaaaaggttttgacgaacaaacaactagattacgaaaccgttcaaacaacatagaaaattacgtaccttgttccagtcactctgaaagtccgaatttcaatcacgaattttcctgcgtgagtacttgtccgtttgcactttggcttcttgcacggtaacacattaataacattgcagtttggtaatccactcgtggagcacaacgactctgacctcaccagatcacgcggttgcaagagaaaacaacagctacggctcatgtcccccactttgacttcgcagtactctcgctttctacatgcatgggccggcatatagaggtgattacacgacagctccagcctgaaa

SEQ ID NO: 103512 - DNA, 1527 bp, Oryza sativa
ttcaattggaccagcgaaaataataaaatatggattatgtgtcctctagtaaattactttttgaatgcgccttccaactatgatacattttttatgatgttcacaagcaaattacaaaaacttcgagtgcgctatagcaaaatttatctttttgttcatggagttcccctgcagtatcaattggagcaaagcacctgataatcaattacctttttctagtcaagagaacatatcatctacaaaattcagttcaatatctatttttttatcaatgtattttataacatgacgaaatattatgtacggaagtacgttttcttcgagacaaatatatgagcaagatctttcaatgttcagtttaattaaatataaaaataaattgatgcaaagttgaaagtttgacctcatccaaaacatatttttgtgaccagagaaagcaccgttacttggatcttgtgtacgtagcttattagacagagtcgtaccagaactaccattgtccacaaatttaaaactccactaatgccgcattatttttttgttgagacttattgttgcattatttgtggtagcggttgccaattggatttggatggaaatgtgacgccatccaaatgggtcacttcgtgcaaaggcagcagggggtccatgaagctttacgatgattgaggtgattgtccactgcaatgtttgcacccagcatggtgtagaactcactacaagtggataattatgaacggaacagtgatagttatgcgaccaacactgttcgaggttaggtctggttgttttgagctatggttacaagacgtagacaatttaaaattttagaacatagtttagttgttttagaacattgtttgatcgagctgcgacttataagacgcagtcaatttccaatcaatttaggtagttctttgtcgttttcgtcactgaaccctgaacttgattttggacaaagaactaggagggtaaaagatcttagtttaaaattatttctcgttgtatcggtcatatgtcttcgtccccgtttaggattctaaaaatctgtgggtagtaactagcttatgagaatttggagaaattggatttttccggtttccggcttttagtttattttctgattctacaactacggattctcagaatctggataggagttagaaattctgtgagaagccgcaactactaaaagctttcccttagacttatacgcaagttaaaagtgccttttgtattgtgcttttccttctaacgtagttgattatttaccggcgatagttagctattctttagtgttgagtgggaagaatggctaaatagctgaacgatttgtgataattatttgttgtacaaacgaataaattgaatgtcattaagttaaaaagttagattaaaaatagtattataaggaaattccttatataatgttttttttaagaaagtttagcatcgtttacgagcttggtaaacgtgtatgttaagtgcactcggaatttctgtgatgcgttattcatggcaataaga

SEQ ID NO: 103513 - DNA, 660 bp, Oryza sativa
cggttttatctgtaggacaccgtacaaagtgacttaattacgggaggagacactatgtaaatgtggtaatttgccggtagataccgcacccattaaaataataattttcagttggagaggagataattaaaaaatcacgtgaaatatcaaaaatacccttgtacccacatgtcagctctcccatctctcttctatctctatcccctccatcggtgccatggggatcattgccgccgacgggaagcaacacgggcgggcgggagagggaggtcattgagctctgtcttggctgagcttaggctagcatcatgccgtgccaccatcttccacaccatgtcaaacccaaccgtgcgtcgcgccaagctgcctcgcccttctccatgtgccacaccaatcaccccccttgctgctgttcttcctttaactcgcacttcgtcgtcgagtctcatcctcggtcccactgccacagcaggtcaccgcccaaacaccaacaacggattggaatgtcgcttgtcgtgcatccatctcgccaagcagcgctctctgctccgtagaaaaatcattgtgccacctcacctcagctagtcctgcctcagcgtgaagtctcgccaccgggcccgcttccaccgcacagaccgctcaacataccgttgtagcgag

SEQ ID NO: 103514 - DNA, 961 bp, Oryza sativa
ttttgtttgggagcatatgttccattcgcattatataagtagcattcattcgatcctatatgcactaggcacttcgttgcaaggtcggctaatatatggatataaagtgaagtaaattccctaagaatatatacaaatatatatatatgtgctggcagaagagaatccaaagagatatctcgaaatcaagctaaaaatcagagaacttttcttatagttacgcttaaactagtataagcttttaatagtcctcattgctcagttaacttaagatttatttgacaaagtaattagcgcagtgtccaaacaagagtatttcacagtgcagattttgcctttacataggcttaggggagcttagagtgagaggaagtgttccaatatataggtaactaaatcacgtgtactttgcctttagatgattgatgcatacgacttaatagtttttggctattattcttcttgaaaattcatcggtctagaaatttctaccagatttaagttgttaggcccaaatattgtacattccattccacaacaaagaagtgttgtttgggtagtttggcatattctaaaaaccaaaattttcaccaataattatcaatacattcaatatatctgtcaaatctaatgaaataaaattatgatatatactatgatgattgataatattgtgaaaatgtacgtgcatttataatattttgattgcactaatttcaggaggcttatttttaaattggtgcacatattttttctcgaatatgaaaatggtcagacaaacatacaccctcgtcttaaaaaaaaagacaacttctaaaaatgaatctagacaaattcattcatagaagtttttttttatgcaacggagggagtatgttatcttgcccgcgggaattaaattcagatggaactttaagtaggatatatttttttttacaatttgcgacagatcacatcgaca

SEQ ID NO: 103515 - DNA, 1372 bp, Oryza sativa
aaaaaaataagttaaattatgagacgataatttttttattgcaacgaatttgttgatcgtggcaacaaaaaatagtgaaaagtaccatgtactatataaattgccacaaaaattaaaattgtggcgataaaacatgttttttgcaacagtacgattttttgtgacgatatctcattttctattgcaacaaaagtactaaataaaacaacgattatagattgttgcaataaaaaataattatttaccaaaaaaaatatcattgctatagtataatatattgctacgaattattttttgttgtaataatttggaggtaatagctcaattatattgtagtgataatttccctcggtgaaaatttatgttatgattttagttgtttagagcataataataacagtacatctgcaaatcattcttttaaggcattgttttagggagttcaggtagagtttggagatgaagttcacttgtgattgtagatcgccgcgacacaatttatgtagttgtcacatttttttcttttctttcataatggtggtaggttgtgtgcttgtaactatgcataaaccgagggtagttttagagtaattgtatcattttaatgcaattgcctaagatcaataaatctctctttattatcttaaaactacaatagacgcacacacatacatacactacacatataacaccatactcacacacccacgaatgtgtaccctaacccacactcaaagtgacggtaaccaaatcacacatcccagattttactattttgtttttatcaaaaaaatccacttacgtccgtctgatactcgtgagcaccaaaatttaaacactacttggtggggtcatgcattcacaacttcactcacgctgctagatttagctaagcagcagcaggatactccctttatcccaaaaaaaacccttacccgatgagatatgtctaaattcgtagtactgaggccctgtttagatcccttggtaaaattttacactctatcacatcgaatgtttggacacatacatagagtattaaatatagatgaaaaaaataactaattacacatattgcgtgtaaattacgagatgaattttttaagtctaattgcatcatgatttgacaatgtggtgctacagtaaacatttgctaatgatggattaattaggtttaataaattcatcacgcggtttacgggcggattctgtaatttgttttgatattacttattataatacgtttaatacatcaaatgtgtatccgtatatccgatgtgataagctaaaactttacacctctggatctaaatacagcctaaaatatattacattaagtggttgattttatgggacatatggagtagacggt

SEQ ID NO: 103516 - DNA, 2795 bp, Oryza sativa
ataagaatcttactgcaagattaaagtatttatcacattcatatctaccacgagaggtcattggaccaaaatttgtttatttttcttttcatggaaatgtaatattattctcgattgaaatccattaaaaattgctcggctggtaagatttccttatagtggaacactggaacttacctatccaaatttaaattatagaccacgagtgtttacatttacacagctattttattcttttggtgtaagcgatgaatacactactagataacacatcttttatccaatgctccaaaccacaaattcaccgatgaattaagaaccggtacttaaaaactctttagtatccgttctaaaagcccaagtccccaaaaatatctttagttccagttggtaacactaatcggtacaaaaaatgcacttagtattaccaatcgatgctaaagaagtctttagggttagttaaaaaaagaaagcatttctatacaagtaaatgtgtggggttggtgggatggttacatacgtgaggattaaggtgagagatcttgagtttcaatctcacatcccacttattttgtttgacttaatatgtatctttagtactggtttcttcaaccggtactaaagatcacaaactttagtctcgatttccttatctcggttgctacaactagtactaatttaagggggtttattaaccggtagtaaagatcatttctctactagttatatgtcggcctattctttgaaggtacgtataagtatgcatgtgtgcgtctatatggatacctatcctagtttttttaggggtttctaggggtgggatgtgcgttcataagagtgagtgtgtggggtatctatgggtctacgactttactgtgttttcgaaaaaaaatccatgaaaacaaaatttgatactgctgaaactgccaaaaaatatttcagtctcaaggaactattctaatttcaaagatgacaaaattgacagcgaaaattaataaagaaactacaaagtctgttgcaaatgagcctgcctgatcaacttggacccgcatgtcataagcaactgcatcactttccaacagttcgagttgccatgcatgtactccgctaaatgtagggggtgggtagacaatgggcaagttgatgaagttgtcatacgcaactgcatcactacctgcaagttctgtaagaattcttcgttgataaaatatatgtggtttctgaaaattgaacttgatgttgcacttagaattttttacactaagttgtaggcttatgaaacttattgtaacagaggtcaactaacatgctgacaagttggattagatttcagttcaagaattgggaaaagattaagaactagtggaattcactgcgagtttgagtccattatttatatgggtgacatttcttcatttgactgacccaaaatgtgtccagattctggtttagggctgggcctgtttagtttgttgtcactttcaacgtaccaattttttttgaaaagattcaacataccaaattttggtaaagcaacaaactaaacacacttcaatcattactatcttaccaaaatttaacaatcactactggataactgatctttcgtcgtggtacccaaaatcacaaatatctcggttagattaaaaaccggtactaaagatgcttttagtaacggttctaaaagtccacatccctggaaacattttaagttccggttggtgctaccaaccggtattaaaaatacatctttagtatcggttggtgttcggtaacaccaaccgagactaatgctagaagatctttagtcctagttagtaaaatcaacccggactaaaaatttatttttagtaccggttggtaacaccaatccagactaaaaacatttttagtactaaatatacctccagggttagtttaaaaagaaagcatctttatccaagtcagatgtgtgtagtagggtggaatgttaatgctcgtgagagctgaggtgagagattttgatttcggatcccacatcgcacatatttttttacttggtatgcatctttagtactggttatttcaacctcgatcgtcatgatttgcttgtcacggttgctacaaccagtactaaagggggtttccaaccggagttaaagatcatttcttcactagtgaattctagaagctctcttaaaactcaccaaattttggtaaaagcatcaaagcaaacaaagcccattaccagattttggtaatactaaatgtacgagaatttggcattgtcaatatttggtatggttgatttaggcaataaagtgaacaaacccttaattcgttcactaacctataactataactatgaccctacctgtgtagttagttataaatggatttgagaagctgacagattttttttgtgaagctgacaaaataactttgtccacaaagatatcaacttttctagtggccacataatacaagtcaacaaaaacaaagcaatatccctttccgaaaactcgatcaggaaaaagaaggaacatgtatactccatgctatatccctatacattacagggtgcatttggaagaaatcatatggacaggattctccatttcctcatttaatcaagtattttccctgctgctttgtcaaggaccttaatcttgaagcaaactcccaacctaacaaacgaagatctgctaccatcatcaagtttgttttcttgtctttataatagcaaactaagttaactaataaaattccataagtcaccatgcacatgcacaagggatcacggcctgtcccccccc

SEQ ID NO: 103517 - DNA, 1798 bp, Oryza sativa
taacatcttacggcaaaaaggacttactaatctcatgcatgtttttctttcaggggtcaaagcaattatgcaaatgtcctacccatatataatttagcaccaaatggttaaatttaaataaccctacccatgaaggcagtagaagtgatgagctgccttttgtccagcctatgttgaccactgttgttagaggcttggagctagctagcgaggagattaagctaccgacaggaaattaaagccaacaagtcggccaccggttcggatcccgatcgtttgataacaacccgttacacatcattctcacatcgcacaactagtacagatcctctcatctgtgatggtccctcacatacctaggttttacgggccgtcacaacgaagtcatctcaaacggactcaaaaaggaccgacaaagatatactcgcacatacatgctagatgtgcataataattgagcccgtcacggataacacctatcagtgacggaccccaacttgaggcccgacaaagataaccgatgatatctttgtcgggccctaacaaaagcccatcaccgatgtccatcatacgtgatgggctccaccttgaggcccgtttgagataactattaggcccgtcaccgatgaatgtcatctgtgacgggctccaacttgaggcccgattgagataactattaggcccaccgccgatgaatatcacccttgacgggctccaacttgaggtccgattgagattagtcccgttaccgatgaatgtcatccgtgacgagctccaacttgaggcctgattgagataatgctttgactagggttcacactcgctcagatcttgatcgaaattttttctaagtgcacgtcctagcaccgccgccgtcggccgccgtccccgagcccgcgttggccgccgtcgaccacctccacgacatccctcgcttgccgatgccgcatcgatgacccctgtcgtgcctgagcccgctgtcctccaccgaccttctccgtgccatccccaagccggccgccatcctccacgccgtcccctgccgtcccgagcccgtcgccgcgtcggctgccgtccccgagcacgcgccgagcacacccgccaccgaccaccttccccaagcatgcccgccgcctcgacctcctccttcgccagttagaaatttgttccaatttacaactcgggtttgcaggtgtttgatgcttagcacttgaagatgttattgtgaaatatgtgaataatggatgtgtatgtgaatggatgtgtgaaatatgtgaatggcatatgtgtatgtgaatgattagaggatattgtgaaatatatttgtttctgctattttgcagcaggcatggctagcaaagacttgagggtagccaaaaaaacaaaatttatttttttggggggaaatactcatcagtgacgggctttaacttagcccgtcatggatgacctcatccgtggcgggcttaagttaaagcccgattgagttgagtcatctgtgacgggctttagtttgggcctgtttgagattgtggtcattcgtgataggcgttaattaaggcccgattgagataaggtcatctgtgatgggcccttgtttgactggtcgtctaggtcaaagctattagtgatgtgctttagtggaggcccgattgaaataacttcatccgtgacggccgcatgcccgatagagatgacttctcacatcagtgacctttacgccgtgacgggcgccatacccaacacagatggttgctgcccgattgagatgtgggtgaccgttgtagtgcatacaact

SEQ ID NO: 103518 - DNA, 1122 bp, Oryza sativa
cttgtgttagcctacttttgtccctaaaccagtcacttgtattggatgtatggttgatggtaaaattcagatgtggtggttccattggatgatggttaattgatatatttttgcatatttcatttctgggagcatatggcgtgttgtatgtgtgtgctcccctcctgttatgtgtgttaactggtaacacatatgcatgttaaaaatttctgaaaaaaattgtcttgggttcatggtccatggacaaatatgcagacaagtaacatgaatgctcatgagcatcttgtttaattttaattttctgttctcaaggtagacaacaaatacgttatgcatttgattatttgtacatgcaaccatccaattttccaaagtataccaggtaggaggtattctcaccatttccatccaaaaggtgatgacaatactcatccatcctaccaaacaaaaaattggctcaccatatccaccttttatccatccaaccaaacaaaaacttggctcatcccatctatccaaccaaacaaaaaactggatggccatatccctaaaaaactggatggcccaatcccatccacccttgaccaccatccaaacacatcctaagtgaagagagatatttttttcaagtggatctcttaaatgatggccggcgaattcgctggtggccactaaagagcaccgccattgaaaaatatcgccacattaaaaaaaaatcgccggcacactgccacccaccgcttctccttctcatctctagatccacccaccctccccaccgcttctcctccttctcactgcccttgaaaaatatcgccacatttaaaaaaaaatcgccggcacactgccacccaccgcttctcctccttctcatctctagatccacccaccctctgctcctccctcaccggcagcacctccatcacccaccgtagcacccctctcctccttcctccccattggcggtgggtccatcgatcggcagcggctcgcacaagcagtggcggctccggcaacggcaaaggggaggggtggcggtggtgaggcggctcgtgtaggcgacggtggctctggcggcagtgttcaagagggcggaggaggtgtggaaagatagatccgaca

SEQ ID NO: 103519 - DNA, 1500 bp, Oryza sativa
  unsure (1)..(1500): unsure at all n locations
tgacagcattcgaaccgggactaaagatgatctttaccaaccgggactaaagatcaaatatgcccgttcccttttgaaccgggactaaagatcatctttagccccggtttttattgcatccggaactattgtggaaatcggccgaccgacgaaagatggtttctccaccagtgttactagttgacgaggagatccgatccatgacatgaacaaaatttaagtggtacgtactacttaagaggtcgaattagggagtatcttagtatgaacttgccctaattaattaatataaggagtaataattaagaggtcgaattttccgaacacatttaataatcgagcctaacatactaatgtgaatgtatatgttcgtaaattttagtatgaatgcatggctttcattaactagttgcacttatacatgaggcgtcatatatacatatatatggcaacaatttgtagcataaatatggcgtgcatggcatggatacttgtgtacccgtgtaagttacgttgtatacatatccacttatttctcagcaagatatatatatatatatatatatatatatgattcatgcatatgcatatataatacgtagataggtagagagcatatgcatgaactgatatattgacagtacaacatctgtatatatatatatgtaataactgcangataactgataacagaatggatgaacgacacaccatatgcaagctaattagtactaattaataagctgtctagaagaagggtacataatagtacgtacatacatggtagctagtatgtgcacgcaaatttagtctcaagtatgcaccaacatggagtagtggatcaaaatctggcaagtactagatagtaacagggtaacattaagtggatcatatacatatgtatcgtcgtcgtcgtatgatatactagatgattagtggtaataattatatatatgcatatactcctatatatctaaggagagcagaggtagctgcagggggggtctttagtacagttaagcagcacgcagttatataatatggtagaagcaagcagctagcagcttggagcaagctaagacacgtagagtgaatatttcaaactggcaaaacggctccgatcgtagagagcagctggtcgaacgtgtagatatctagatcagccatcggcgtgaaagcttgtctccccatcctgagtgccatgcaacaatcaccccagttctggaacagatcggtgtgttgctcaccgacagtactctcttcgtctgctgtcttacccatcaggtacacgactcgcttcttcagcaatgggaatctgaacacctccggaaacacagcacaggtcttgaagagcatcttttgcaagtctgacaatcggaccattcccgcgttgtgctcagggtcatacaaactcagcatcttatagatctgaagtggagtttgtctgctcaccttgagttgtgctaagtttgccgccattcctcttactccgtagttgga

SEQ ID NO: 103520 - DNA, 645 bp, Oryza sativa
atggaaaagacccgtagtggtggaaaagacccttagtcgaggagaagatccatgttggtggaaaagactcttggccatgaagaaggcgacttggacaataaagatgccaagagaatattcccagggaccactcaaccactccatctagctggcaccaaaagactataatgacccccataatgtaccaaaatgcccttagggtctgttgatatgcaggggcacgattgtaatttcatgtgggcccaacaaagagcacaattgtaatctcacatgtaaagctgtgtactatatagagcagacaaaagcctgtagcagacaggacatcttggaatactaaaaatcttgtcactcagggtgtgatcatttggtattcgggctcatttctcaggataggcaggaaaagggtgttttcctgtctatccccaatcttgtccgtgaccttgtgtcacgacaaattattttcaggatttttcttgaaattatttgagcattgtaattatttttaacaattcaaagatcatttccatgattaatttaaatggaaaagtaaataaaattcccttttccttttcgggccagtcttcagcccattcttcctctttgcctgcttactgtctccttctttcccgaagaactctatttctt

SEQ ID NO: 103521 - DNA, 548 bp, Oryza sativa
ttccttgtgcccctgatttttcccactacactacccgttgtgaacaacgatgacgaagtaaaacccgaccaacaaccagtcaaccattgacggaacttgccaaacccgacccaattatcaggttaactcgtcatctactagatggcaaagggtataaccgtatggcaaaaggcaaaaccgaaaaccagtcatcattgtcgccactcagcactcacagggctagaaaaccaacatggtcacatacataccgcgctggtgagctctcataagttagatggcaacacgtatcaatgcgcacctggcactacataaaacggaatagttttaacaagcacaggaacacataaaagaagggaaactttgatgaaccagataacttttgcctaatcatcatcaagagtaacccaaaaaaaaacaatgcttgcaaaagagcgatcagcgagtgcttagtacacgatgttgctcaagaagtcgaagaatcaggcccagactacaagcgagggttactcagcagctcaactcctacactacagaacctaacactaaca

SEQ ID NO: 103522 - DNA, 1910 bp, Oryza sativa
ttgttggtttgaacatgaaatgaaatgctgaatgtatgtataaaaactggttcaaaaataaaaaccgaggtacatttcacattctagcaagtatatcatggttgtactagcaggattcatggtgccaaaaaagaaacaaatgcttcttaccatgtattaatcatgtgaattggcaactgaaatcacactatctaaaactatctcaattttctcaactgagttatgtaggacatacactgtccacagaaaacagaattatagaaatgatgcatcttcggtcttcagtcagaatatggtactgacccttcttcttacctgcagaatgaattcctcagttggatctgctggaagaattatggaagaggtaccaaatgaggggagtgatgtccttggtgaaagaagtatgaaagagcaacagagtgacaaggatgatgtttgtgttgaaagagagatggagcaagtatcaagtcatgatgatgatgtgttgagggaagcaagtcatgatgatgatatgttgagggaagtactgcttgaaactgggctgtttacaggtgccatgagcattgatcagattgatacaggtgatgggtttgaaatacaagatgactttggacgtgaagatggagagactaaagacgagggggtccaatctcaacctgcagtccctactgttggtatggagttcttttcagaaaaagaagctcaagattactacaatcgttatgcaaagaactggggtttcggaacaaagatttcaagcaaaaaaaaagcaatgtcaccaaggagtataatagatatgagtttgcttgctactttgagcgcacaagccagaaaaagaatccaaagtcaagcgctagcagtgggtcaaaaaactgcgagagtttgggaaaacccaaaggcaacgcaagaaagtgtaacagtctaaaaaaaactgattgcaaagaaagaatggtagttgtaaaaaggaaagacaagtggtgatgagggatgttaggtcccgatcttccgataggtattaataaacaacgatttgggcggagtcgcgacacaactcgatccggcttctgaacgaacacgctactgagccccgcaatcgcagcaccacgtctcctctagttatcaaccgtgccgaaacccggttgacctcgccgagaaggctaatccctgcatgtgaatcgaagaacacaagcaagaacaagatagattgcaaccaaattgcatatgaatgattaagcactcgaatttgaggttccacaaaccgatctagcggcgaaactgttctggacagaataatctaagcaaaacccaactctaaacgatgacggctactaaattaatatgattagggacgtcctaaggtttccctagggcgcacacccccttgggctaagcccacgatacaattgcaaggcccaaaacctgagtcagattcagactggatgagatacgtggcttgttttgcagattcccggcagctcggtaggaattttgacgtgggaccaaaaccatctgaaattagactccataagctttccaacaagtactcatgggccccgaaattccttctagatcagcggctaggtccgtttgaagttgatgctatcagaggcctgaatccgaatccaaaacgtgtaaaactttatctcttgtcttctatggaccaaaagtgacgtggtgaggtagaagtagacttggagaggtcttggtttggtccccaatcaacttcttcaatcattcatttattagttacgctcggtctcttttccttcgcccaagcaagtacctctgcaaacgaaaacacacgaaactcattgtgtagcaacgtttgttcaaatatataacaagtaaatctaatgtagaacatatgcacctttatttgattaatacataaggtagtcatggttatatca

SEQ ID NO: 103523 - DNA, 631 bp, Oryza sativa
agtaaaaaaaaatgtgtcacagaacattgcatccacacaaaccaagtatctttgaaatgaacacataaaagtgcatgattttataactgcgacagctgctgtcattacatcatgaagatttttcacattactgttaaaaaacaaaaacacaaaaaaagctatcaccacatggtcgcccccctaggtgcagtgaacaaaagcgtcaaatacgtgcttttgacaacgctggtactacatagttaactatagtggactttacatagttaaaaagcaaccatcgctcattttgcacgatgtggatgtaggtcattgaagcgatgctatatcaacctgtgacatagctgcttgcgataggttggaatgcctttctgaggaaaaaaggaaacaatatgagaatccaatgaggtttatctctgtatgaataaaaaaacccaaaaacagaaaaaaaaatggatttaggtaccaagaccacttacagaagtgtatccaacaagactccggccattgtgacactcgagcattctcagaacgcagaacccgcaatcatgactaggtagagaaaataaaaaaaatgtaaaacttataaatgtgtacaggaaaaactatggtgtaagttagttaaatagaacaa

SEQ ID NO: 103524 - DNA, 724 bp, Oryza sativa
taccagcgtaccccaataccctctatatccggtctacgggtatcccccatcgacagtggcgtgtcaggtaggggaacttggtgctcaaggttctactaatatgtcatcaagcttcgttgacaacagcgtcaaccctggcatcaaccaaggtgtttctacttcgacaatactgatgtggactcaaatcgtcttcctggtttacaccacggtgccaatcttgactggtccatcaatgaccgaaagcgagaacgctgtggttacaaccctggacggctccatgtcgaaggatcctcccgcaaaagtggagaacagaacatcgacgacatccgagcccgagaaggatcctagtgctgctaaatcttgtccttccgacgagaatcacgagccgacaaggacaacttccgaggcgacaaggtcctggtgtcctatccacaaaaccaggaaacataccttgcaagcttgttgggaattcaacgtacttctccaacccgtgatgtttattgtcctattcacaagacgaagagtcatgacctgtcaagctgcaaggttcttctcagcgccctgaagacgtcacctcctaaggtccagtagtcacaaatctctcttagagatgcgaacaagcaacgaggagcgatggttatctcagactgattcgttggggtaatcaacatcgatccccacgagccggtgtcacgcccaccaaaacttttcgttgagatcttga

SEQ ID NO: 103525 - DNA, 574 bp, Oryza sativa
attttaaatcatgcagtatgtacattaatatcttaattagagtttttaccaatatgataatatcattcatatatatgctaagaatatatatatattggaatttttattaattataagtcatatatttgcttattacgatttatccaattaatttattacagccaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggactaaagatatctttagtcccggttcaaaagggtaacgggcatatttgatctttagtcccggttggtgttaccaaccgggactaaagatcgatctttactcccggttatttcacccgggactaaagatagcgatctttagtcccggattggtactcccggtttggaaaccgggactaaaggggggttacgaaccgggactaca

SEQ ID NO: 103526 - DNA, 3453 bp, Oryza sativa
caacctcttctccccctccggtatgccatcaatggtatcaatcaccataattttatcacattaacctcactcgatcattctaaatctaaactcccttctctttgctctcctggtctaaatacaaactctaactagatatactcttgttgccagatttcacgaaactcaaatcgggtttagaattaacatggttgtccttcgaacaatgaatttgcattcctttcttttaaagaactaaaaatacatttcacaccacatcgaagagccacttccacttacccatctttaacgactctggacgatgagcctccagtgacaggaaaaatctagggaaagaggccaaaaagaaaaggattccacctcacggtagtcgttgtgctgtggtcctctacctcctcacacttcgccactagagatcctaatgttgagtagtctgccgaatctggttgatttcgggtagggagcaacagccagtgtcggagccacgttcagcttagatggtgcacaggaacccccataaagccaagatttctcactttaaaacaccggaatgcatagcgtttagattgaagctttctaggttttcaatggtagtgcaccaccttagttttggtgctagctccgcccctggcaacagccgccatagttggatccaaccctcaccatcgttgtcgtggccgaatctagcgccttccgtcctcatgcaagaggagctagagactctcggcatcaagcgccatcaccaaccatcactactccgcccgtcaacctgatgcctcgagttcctcactagcatggagaagcgatgggagaggagaccggccggttgtggcggcataaccgctacgggacgagcccaacgcgtggggtggagcagaccaccttgtgctcgtttcaaataatggtttaaatattcaacctttacatatgttattacaaacggttctacttaagctgttacaattacaaatgactggttgcaaataaagggttatgttgtaatgtgttctaacaatatgtaggactaacatgctagtttatctttataggcctataattaagtacaaaatttactggttgtattagaagtatgtagcaccgtacattttccttaacatcgatcagcatttttcatgtactatcatgcatgtaccactgaactgttggtcgtgacctacacattcaatcagcatgactattaatctgtacatgcacgataaataatgttatacgtctagttaagtttcatgcaggtacgcacaaatatattgttgcatgtaggctccacgtaccatacgtttgagaattgaccatactgaattgtagcagaggatcgatagctggtatatgtgtactacgtactcttttgatgtttatcataaaaacaaattaaacgttgtaaattaatgcttccaaatcgcacttgttagtattacttttggaacagtaggcagtaagagtataacttttccttgcacggtaacatacaattaagtacgatctgaacatatatatacacattgacgaagaaaccaacaaacaaacaaaacaagaaaacatgcacagtggtttaattaatttacatccccatcatgtatactctctgcacaatcagcattattattacatgctagagataataatcaaggaagagagattaacaacttgtaagaccatatcaaagtcatcaaaggccgagtttagttacaaattttttcttcaaacttttaacttttccatcacatcaaaactttcatgcacacacaaacttttaactttttcgtcacatcgttccaatttcaactaaactttcaattttggcttgaactaaacacaccaaaatcagagtacctactctctctgtcacataaaaaccaaacaatattagatgtgacacatcttagtattacgaatctggatatatatctattcagttttgttgtaatataatatattacatctaattttagatttatcttttttatttaaagacggatggaggatggagtaattagcccaagcagccgcatgcgaccggccgggtacagagatgagacgaagacgaagacgaggagaagaggactgcaaaggtgtgtgtgtattctctcctgtcagtaaaaattcctggccgtgtcctttgtcgccaagtagtcatactgtttttgacaagaagcaaggcaggcaggagagcgaatggcaggtccggtaattacgcgggaaacggcatggcacaaagatgagcaaaagcaaagccacagccattgcaaaatctctccaccattttcttcttcccttttttactttctctctcttgcatctttgttctttcatccggttggttagacagagaaggaagcaaggaaacaagcagcacagagataaggtcagatagagagagagagagagaagaagcagaagcagcagcagcaactgcgaggaggaggaagaggaagaagagagagaagatgagcaataaatagaaaattaaaggtcggagctagccgctctcatggcggcgtttgcaggcggcgccctagaattcctcccctcctgccgctgcagctacacccactactcctcatctctcctcttctttatatagcccatccacctctccttctcaccacctcaaaaagctacctaagctaatcacccccatcatcttcttcctcctaacccttgttgcttagaccccaactagtagcaagaagctctcaagataggaagaagaagaggaggaaatctttgtagagagaagtggagaattctagctagaggtgagtggtggtggtagtagtaactgtatttgtgctagtagagtggagtgatgtgtactgtatactagtgtactgcactgcatgccactcatactcactagctctctcttcatcctccatggatatggcttgcatgatctcactacagatctatctatggcttctagtttggtagcaagtgtgtgtcatctttgcagaagattatgattcttctagtagagcttacaatcccatgccttttcttgtgtggccaagatctgattttttttctccttttttttgtgtgtgtaggggataataattaaaggggagattttatcggagaagaagaggagaaggtggtgttgcactcgaggtttcttgatgggcggcgcatggcgggattctctctgaggggaggaggaggaggaggcggcggaggaggaggagtcggcggcggcggaggcggggggaggggaggcgaacgcggcggcggcggcgatcacgccataggggccgacagtctgttcctgtacgcgcgcggcgcggccgccgcggccgccgacacggcgggcagcggcggcgggggtggggggatagggttccagctatggcacccgcagcagcaggcggctgccgcggccgccgccgtgccgcacacgtcgcagttcttctcctcgggcgtggccaccggcgt

SEQ ID NO: 103527 - DNA, 2654 bp, Oryza sativa
atccgtcccaaaatgttgctacctaggatgggtcatcctaggacaacgaagctctgtctagattcgttgtcctatgataggtcaaatcccatcataggtagcaacattttaggacaaaagaagtaccaaactttagtaaatatataataaatcttacaaaaatttggtaagatttattttggctataatctgaatggccactatggtttgagaatattgcgtttgaaaggagcacaaagattatgtgtatgttagtgttactacttactaccatgtgggacccgacgtggcaggcttaggtggccacgtgcagttaacatctgccaactcagctggatgatggcatgatgcatgttggccggccggctttctgcagcacacatctggaattgcaggattctgtccatggccgacatgggagggaggcgctctttcttttcctttttctttttcttattattgggccttttggacaatgagatatttagcccggccttattttgttgaattcttaagcccgctcctgcctgtgcagcgggccagccttgccggtgcagatgcaggttggcaactaggccgtccgaaaggcccaaacatactagtcgtcttcttctcctatgggctggcccatacagagcaggccaaaattgattgacatgtaccttttgtacatgatccacattacatacctttcgtaaacacgaaaaaaaattacatatcaatatattagaagaaaacagaatttaagatacacaatgcaacgtacgccgaaagcgggaggtacaacaagaaaaaaaaactagcacaaaaacccgtgaaaagagatttaaaggactaaagccggtaacacattacatacggggtgttcggttacccaactgcagtgctctccaacgctgttgctgcagcggttaccgtagagattgtatgtttgttactgtatttgcaggcagccatctagccatatcgaatagcccccaataatattatcacctttttagataatggtatgataatgagctattcgtgcgacatgatagtgagacgccggccaatatggacaaggggagttcagagaaaatgtcgctttaagctcctgttcctttaaaccttttttttcatttttgccacggattatttgttccgcagttcttgaaaaaattattatattctattgtttatactatttattgatttatcacgttaatcaagtaaacaacgcgtaaaaaaattgtgtaaaattctgtttcaaacaggcctgtgaatatatatgcactgtggcgtgcatggtgtaattaccagcactgtggcgtacagggtgaatgcaccatgcatcacgacgaatttatttgttggccggccaggatttacgatataataacactactattatcctatcattatagcaaagattaatgtttgcagtgttataattacaaatcccccctatctatgcatggtctggccggcctgcacattatattgtttgtggattgactgatcaatcagcactactcagggtttaccttttgatttttaattaaaaacctctcctaatcagtttaccgaaatctaaccgaaaacttgtaaaaactgataacttaccatccggtttctacaaactgaccaacaatggtttcaaaaaaccaggcggatttcacgaaaccactcagttttgataaccctagcactgctgatctttcaggttttcttcactgaatcatcccttgcaaataatgtggagtggtggaccgtttttgttgtttgtttgttgagcattacgatcatgggctgcatttgttaatagcatatgcggccggcatcgtttatataacagctaatatatggtacctaggttctagctaggcgcatccgcgcatgtacttatctattctattttaaatgatactagtggtgtggtgtacgagtctgccttcaatgccacgagctgatgtgtagtatctaatcaattaactatgctataaacttgtaattatagtgcttgtttggtttagggccataccaaaacattggtagtgccaaaacctaggcatattttggcactaccaatattttggtagggtagaatactaggtaatgtgtttggattaataccaattggaagccaaattttatattatggtgaagaaagttctagaattgtaccaaattaagcatggtcattaccattcatttggcttcaaaccaaaccatcatatttactattcaaactaccaaaaaattggcatgacacattttggcatcaatccaaagtggcccatatagctttttctttggatatggcattatatgactaaccaactaactatgctataaattaaacttgtcatttttgtttttgttttttggttttacaatacccgttgcaacacacgggtctttagcttggttgtgtgtgtgttggcatatacaaacagcattcccctagcttgtcaatagttgaggttgttgatggcacagggtagctgttctctaattaagttccctgagcttaggagatggcagaaaatgaattctgtatgcttgactttctttaattttgacattgcagtgaattgaatcatggtaatcttgctttactgataatttttcaatatttgtttatgcgtttggctcttaatcatctgatgaca

SEQ ID NO: 103528 - DNA, 684 bp, Oryza sativa
aagcaggatcgaacagcaggaggcagcagccatgtgccaacgaatccgggcgaaaaggcgttccatggactgttgcacatcgactaaattaaacaaacaagattaatggagtattaattaagcatgcatgggtgtgtgtgtgtgaatgtgtttgttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcagaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttaggctaatataaataacacaaaaccaatcgcaatcagatgagtggtggcgtgatggcccctgggcgtgcataaaggccaaaagctaccttttgga

SEQ ID NO: 103529 - DNA, 1576 bp, Oryza sativa
gatgcttgtgcttcaattggtctattgaaatatactcctatgtaataaccaaattaacccgaaagcttaagttgatgagtagagacgggtaattcactaatgttgcaacactcattctctcacgcgaaacgctctaaatcttaagcgtggaataggattaggctgcaaacttttatttgataattgcgtgttagtcaggatttgaactcaagatgcttaaactcatgaaaaaaggaggacggcttacttctattttaaagcgttcaacaattcaactcaaaaagtttcaaacaagacaactcatcaaccaacctcctgaagaattctaccaagttggcaagttccgctccacaatcttgcatatttacgtcaaattctgtatgagtagaatttcatcacctgtctcccggatcccaattctcttggaacagacacatgaacttgcaattgttctgttttgtttcccaggttctttgattggtcgtatggttcggtgcagtttttcacttctgacgcctactttcttcacgaaggttttgagtagcgacctcattttcgtccttttgtcgcctacgtgtgaaccataaatataatcagaacgtgcaaccacccgttttgttgaatgtcgatcacatcatcacgcacatcagctatgctgcaaacactggaaaattctccttttttttcaggtcaaaagacattttcaggcacgaattggacgtctcaaaccaaacaactgacgagtctgaaaattccaagccccccaggcattcctcatctataagtaacatgacgtgtacagtagtactgaatactgatgatgctgtattattctgaccaaatggctccatctccattctagaagattcacaaccagaccctgccaaccagaaagagcagccatacttgtcaaagagttgatatcaatgatgggtttcccttgttcattgatgataaaacaaaagggaaattaatggccacatatcttggttcagaagaacctccctgctataacaaacatcgatccgcctatatctttttatataacaaatatggacagtgatggaaagaaaatgaatgaaaaaactggtttgtggaccacttggttggtgacaaaattataacttatataagcaggcaattatcttacaaaaagaagggggaaaaaaagaaacaacacgcttctatttttacaatcttcacggaataaattatactactagatctagaatatgggactcttttataggagtgaatggcggtaagaaagtgtgtagaaagtacatgataatacagcaaagattgtgatgctgcagccacaataaaaagcggagccgatggaaacacagcttctattgaaacctacaggactattgtcgggatatactttttttttcaccatcatcatctggagaggaaaccttgtatcgccagcctaggaccacaaaaggagatactgtcaactaaaataataaaaaaagaaatcacttgtatgattaaagaaaatctgctgcttatgttcatcaagttaatttttttgtatccaactaatatctttttttcccctcaaaatcat

SEQ ID NO: 103530 - DNA, 705 bp, Oryza sativa
tatttatattaaattgattattaactagttgtgtctcagaatttttagcttttcgatatgcccttcaacaggggagggagggagggaggaatgaagaggaggcactgacaggttctagacccccaagtggtgtcaatgccgtgccaagcagcagctgctgcagcagcagaaagccaggaaggaaagcatatggtgacaacaagacaccaattaaaaacgccatggccaacaacaagccagcctgaagcttctttcactataacacatccattatttcacctctattttattctcttcacccattcagctgctgattgccgcttcgctagtagtattaatgctgtttactgtgcagtatgctgagctgaaatgttttactgctagctactgtagacatatgggccttcgaaaaggtaagaggagagatgaatggagatgagaggtgggggtgggcccggatgggcagcggctttcacggcccgaaaggaccccgacacacgacctcgattcccgccacgtggctagacatgcgccgtccgctcgatcgtgcctagacggccacgatggcccccaccctctctccctcggggttttaaactcatctagctacgtgcacacgctatatacttagctctgctgttgtgccgtcccggccggcgttgcaagaacccctcccctatagtctctttttttctttggactgtt

SEQ ID NO: 103531 - DNA, 648 bp, Oryza sativa
aactaaaacaaagaaaaagttcaataagaaatcatttgtgaagaccaaattttggagctggaggtactacatatttcatttcaaccaaaatgctggacgattcagtacttctaggtgcagaaaattcatcaatgtcaaaatgccagaatcaagcaaacatttcaatcccaaaaagagtacttacagcaagaactgacagctgccttgcatcaaattcattttctttcaacctggaattaaataaaattggccttacgtagcatgaacattatttataacaaaaaagcagcaccacaagcaaaatacaaacccatgtatgtaaagatatgatgaatgtgtcagcagttctttctcatatagttgcaggcaaatttctttgcttcgcttgtaaacctgcagttaaaagatatatcagattacttgtttgtatgctctatgcctctacatggttagaagtgtaacaaaagaatgaacatgtgtgcttcagcagtagtctatgccatttcaataaagataggacacacatattcaaacaccaaaaggatggtaaagactcagggaaaactgggactgcataaatgttgttgctgtcagagacaggttgaccaccagataagggagcaaagtcaacatagggagcaaaaatct

SEQ ID NO: 103532 - DNA, 1343 bp, Oryza sativa
ctgcagcccaggaacccttcctcccaacatgcaaaacggagcaacagattagcgtatgagtgttgtttcagtgtaactacataccacttaaaagtaaatttcatcgcatgtagatgcttctcgcatgcccctaggttgttgtttctaagtcagcgcatcggttcagcctaattatgcgcatctatttggccatttggctcaaacttgtgtgtctattcggcccgacatgtggctaagagcaagttttataatagagatgactactacgtccaatttagccgtatcatctactcattgattaagaggcaacatgtacaacaatttacctccaacacacaaaccctaataatttttttcgttgattcactctcacactatttcactttgctcttagagtttgtgtagaggttgcctattacataaccaactacgaggagacaaccagtctaagggggtgactcatcctctctcctcactttcctcctccatctcatcacctaatactatgtgatatttttatatgtagcactaaggctgggttcttcctcttattttccaactcacctttcttttatttcgtacacacgtttttcaaacttgctaaacagtattttttgtaaaaattttatatatgaaagttgttttaaaaaatcatatgaatttatttttcaagttttttagctaaaacttaattaatttcgctcttatcgcttgctttgtttttcgtgtgaggaggtaaccttgcctcccgaactcacgtgacaacctgctctaattcagcccaaaggtgagtctaaatttggcccgtatattcacgtaaactgggccacgtgggtcaaatatcagcccatccaatatcctaattggaactatttgaggcctaggaaaaatccgtggcacgtctaatattcaaatttctgggccgaaatatattccaccatcacttgttcttccctaaatctgagctgtctgattaaatacataaatagtcgctatacaatatatgcagatcttgacatactgcaattatcttatctcctttttttttatacaatagaaatacagtaactcaattgtgagaacatttattatttacaggtgatggtaaaactgtcaaaactgactatagaaagacacaaaaaattctaagcagttacacaatgtgctgtgcttctgctgctgccactgttgttatgcttttgctcgaattcttgctcaaaacacgctgggctacacatgaagaccatttctgtgagatgatctctgagagcttcaagacttttgatagttcattgaagattggaactgtgaaatttgtcaaagggaaaatcaacggaagctgt

SEQ ID NO: 103533 - DNA, 656 bp, Oryza sativa
atgcagtgagggacagatgaggcgtcgcacatttatggctgttcagcctgtgctcccctctcgctctctccctccgccgcgtggcagccgggtgagggcctcggggtgaagccgcgggatagaccgaggggggtgacgccatgccccgaggccccccccctcccggcgcttccacgactcgcgtgacgtgtgaatggaggtaacttgcagagtcacatggccggagggaaaataattcccctctacttcacatacccccgggtccatatctccgacgtagcccccggcgctatatcagatatcgatttcctgagatcgttctgacatggcgcctcacgactcctcgagctggggttgtgggcccggcagggaatccaaaaggatatcgccgcgtggccaggttggcgtgctaaccataacagcggtttgaccgccactgaccgcgctcatgatgaagatgcttgaggcgtgataaccgagagggggggtcagtcagaccacgcctcgattctctcgctcgctactcctgcggcggtagttgtgacggtttgctcaacttgcgctcatggccgttgcgcacttcaccttgagtgtgccactgacagacgcactaaaggcgggagcggatacaacgggcgacgtgatgagtgggcgca

SEQ ID NO: 103534 - DNA, 662 bp, Oryza sativa
tgctccctatacggctgtacccagaatatacgtgtgaacatatacgttcatttttatgttaaataatagaaggttagttagctagatctaaaatgtgagcttttctatggggtggtgccctggtatacaataagtatatggttaatattttcagtattctgctttgtttgatctctataaatgtacagatgtctcaagccacttgtaaaattcatgccaactgataacaaatacagagcagtatatggtatatttttttatctaatccttacatggataatctatctatctatctatctatctattatctactaaaagtctattaaactttctacaaacactcctaaaccaccacgtgttattcctataaatactccttgtcggtgacatgggaccgggagtatcatgactagaggcttggggcaggagcaatcacccacgtggcctgaccccctcgggggggtcgggcccgagggtgatgtggccgcccccctctttgtctccccgaggagtcggaccgctctcgtttcggccccgagggctgaggcgccccgaccccttgtgggttttgcgccgcgtgtatgggttaggtgagcacaacggggcttacctaaccgcatttattgcgggttggacaagcgcgtcacgcccaatgtaacgca

SEQ ID NO: 103535 - DNA, 3465 bp, Oryza sativa
  unsure (1)..(3465): unsure at all n locations
gtgaaagtcatatgcatggtgggtgtgtgactgactgatcgatatatgctcgatgagctgacggggcctgacgggttggattgggcggcaccgagatggcgagatgttgtaccgtcccaagcaaggaattctactagctgagtagtactttccggctggccatgcatggcatttgcaacacacacatgctttctttctttcttttgcttgtgcccaattgcccaaatatttagtggggaaaatatccagtgaaaacatgtggaaaacatactcaaaagctctttaaatttatgaaaaattgctgcagatatgtaactataccaaaagtttttccaaatttataaaaaaccactactagaaatacgtacctataccaaaagtctctaaatttgtgaaaactttactagatatatgtataggtatcaaatactttcataccaaatcttaactccaaactcaatttcatttgagagacctaaaatttgtctttttacttccaaatttacatgaatttacagaactttaaggtccagtttttattggtttttacatatcgatcgttttcaccggctatgtcaatggtttagtgctaaccttgttatggacattacaagtactaactttgactactgcaaatttatatcacaaactatttaaataacatagtttctagatcttcagcttcgctactgcaaccaaaatttaaatttcaaatcttaattataaagaattgatttttatgttctttcatcgtaatttattttttaaaacactatgagcacatttattaaagttttattcacaaatgactttttgtcattaagctatacagtttataatcatccataggctaaaccgatgggactgatttgtagaagtactcaagtatgctcaaacgctaatttatatgcaaattacaaattttgtctcatataatatagcaacctctacacttctttataatataactataacagtctctcataaatttctttatctacttactcatctcaactatttacagcaattatattcatttaagtttcatcttaaaattgattaaaaattctctagtataatttgttgagacagagctagctagtataatttgtcacacgacgtattttagtcgttggatagtgcattcagctgggaaaaaaaatgagcatccaactgcattaaactgtactcccttcatactcgtaaaggaagtcgtttaggacaatatttatgtcaaaccttgggattataaataatcatgaataactctcaaattgttgagtttaaaaatataaaaattatatgaatagatttgtcttggaaaatactttcataaaagtatatatacatatatcactttttaataaatatttttatagaaacaagaagtcaaagttgtgttctggagaccatgtcgctgtcaaaaacgacttcctttacaagtacggaaggagtatttcagtttgaagcaaagaatgtccaatactgnccgtaataaatgggcccccgtcctttacaagtgagccatgcatgcaatcacgtggtgcgatatccctcgtggttaatagtagcgctcactcctcttttttcttgtgaacctgagcatgcaataattatgaaagaaatggcacatttaacttactcttgtgcaaattgctgatatatttcaacacaaaaaaaaatctgtgttgatgttctcctttaaccatgaaaaatctcatcttctttatatacattgttagtcacgtaggccacatttctatccattaaaaataacactaattataacattcacatgcaatacatgtctccatttatgtaaatatatttttggatgaataataactgaatttctgtaaaaaccaagttatttatgtattcaacctagcatatcctacattatctcatcaaatccattaatgaaacaaagcatgcacatatatatatatacatagaagcattgaaacctgccaggaatgtcggtagcaagtgagtttctcatttgatgttggccatatgacaaatccttaggcattagaagcatggaaaacaattaatatatgggattaaaaacacgttgacgtacttaattactcaagagatgtaataattatttcaatttcaaaacatgaaattaattagagcacgttaattaggagagaccatcttataatgtggactgttggaatagaacgatcttaaggatcaaagtgcatcgcgtatgttttatgtactggtacacttgacaaacaatgaagctcctccctttatatacaagttttttttgcagagcacaaaagcacatacctatatatattaatatatatatgaacacagattacatagataggtcccactagatgcaatatttgcacgttctctcggtccacgcataaaaccacgtcatctcaattatttttaatagtttgatggttttatttatgatatgacattgtaccgaacatatgttagacttaatctaatccaatagaagatgggcgaaactgcaagttatatcgacatagtcaacgcatcatatatatactttagactatatatgatcgatctgtttctgactgcaacaagcaaagaaaatatagtaccatactgcaatgttgtaactatcaactgtagcttgaagctattttcagaaaatgacttgacaatatcacacattgcaacattaattattcagagttaataggatcggatcatcggagtatgtttttactcgaacacactgtactctttaaactacacatcatcaatagatccgcatgattcatagccacttagtactaatggcatgtactatataacaattaaactaatctactgttgtgtggaggagagagaaaatatggtgctaagcttaaaatccatacttagccaagataggaggggatttaaatttattgcctgacactaggaaaaggaagggcaataaatttttttggtgtatgaatagttagagatcgatcttattgtctcagctattttaaggagttagtctctaaataacgtgtagatcataggagcatgtattaggctcaactgttgtacttacactcatgaggagataatcaaaggactttatccccaaatcaattggaaggatatgtcactactacagaaatcatttgtacaagcgattggcatatttgtctacaacgggatctaagatgcacccacctgctactaaggcggagggaccttaaggcttagcgttccacctgcagtaatgtggcaattagcgcgagttgtgtgtgaagacatcaacgtgcgaataatgtatttacacaagcggacaatagttgatacccacccaaactaacaagccgatttacacaggttgttctgttttaccatccgcttgtgttaatagatctccatataagtagtcgtctttctcccagcaatctgtttagacaaagcttcactacgcatttagcacgggccaaaaat

SEQ ID NO: 103536 - DNA, 871 bp, Oryza sativa
aaattaaactaggaattttatagaatttgaaagggctttctagtaattctatggttttaatccagttcaattcagatttgattgcgcatgccagtgctgccactagctagatctcgtatgtgcgcctacaagggacgatgacacgcgtcgtggtggtgattcctgatgattcatcattaaaaatgtatatactgtggttataagggatcaattaccggtcaaatattgtaagttgtaccatagcagtgtgtagaaagccttacacattctaaattttgctagctaggttaacatattcgtacgagcgagcctgataatagtaccaatttttttatttagattaactactttcatttttaacaaaaatgatatcgtgcaataagaaagaaagacaaaattacacttttaaattttatgctatgaactatttaagtgaaagatcaaattaatctacaccgttagatcatttatactaatagtatatacatatactgtcagtaaatttattaggccgcatgttcagctatcggggtagtggctacgcgatagttaatcggaacagtgcgcggcggctgcaacatccaccagcccatgccagccaagtaataagcctattatagaaacaaatggactcgtggatttgttttcgttcttaattctgcggagatactaacactgaatttgatagacgtcgctgctgctgctgctgctactgttatgtccgcagagataaaaccctaaaactaccgtggccaattggatcatttgctaccaagcaaacaagtcttactacatcttctgaaaagtagacatcaacaaagagctaggaagcacaaaatacactaaataaaattgtccttatgcatgaaaa

SEQ ID NO: 103537 - DNA, 3871 bp, Oryza sativa
attattagaggatagatgactagatgcagctagagaagaaagggctcattcggattataggatatagcaataacataggaaaagtataggaatagaaaaggaatctaagcgtaaaatagagaaaatgaaaaataaaaggaatacaaaagctaagggcattcggatcacagcgagttgattgcctaggatttgcatccaagaagccaaaaagagcttgaggtggaccgatttttcatgtactttttctttgaaatcagtatcaaaggaaactttcctttggattttctacaaccagttttcatgatccgaatgataggaaaggaaaaaaaatcgtatgcacaatattcctcgaaaagacctgtgaagtcctctaatccgaataagcccttcctggagatggtccaaataagtataacaaacttgtctcaaataaaaatattagctagaggatggcccaaagtaaatggtaacaaatggtagaccaagttacaattaactcttaatttagtctaactgggcatttttttctgattacaagcaaacgcacacaaaaacaaaacaacacacagatatccacaagtacgttatctaattacaagaaagagagaataaatcgttgatgctgcaaatgttttgttgaagtacattcgcttaaacataatatagactattggatgaagttaatatgcaactagaccatgtctccaccgacccacaaagcggtggaccctattctgtaggacttcttagatcacatatagccgttttgcctttttattagataagcctactttgacaaagtatataaagtacaaaaatatcaaattgattctagcgatggaacaaaccaagtgggtggaaaggaatactagtgttctcctactacggctctatgtactacatcagacgttgctcttgccatgtgacattaatctatatatattttaattagctagacgaacaattatattagtgaaggtatttaatagccaccttggaagcgttagttaaatctgataagctcgatctatcagtatctatctggggacatataagtaactaaaagaggagtagaggacacatcatatttcagtgggaaatataaatctatcgaagagaagttaccaaccttctctctcagaatgcaccttaatagaagttcccaacctttgcatttcccatgcatggtccgttaatctatctaaggttttactgtatgtctgtttagttaattttgctgattatatggaatataatatttataaagttgaaggcattagtcaatgttcaaaattttttggaatggggccgggggaagtccacatatatgtatgcttggttagatttaaaacaactagcttggtgattgcgactgcgtgtgagctccagtactaccacaaccatttacacttcaaaacctttatatatataatttgtatgtatgcattttcatttatatgccttggttaattataatttgcatttgtttcacatcttagaagccaacactactacacaaatcttaattggtgctaatttaatttgaaaccccacgaaggtgctggatttcccaatcgacaccaagaaggcagcactgacgtggagcggacataggtgccggttgcggtgccggtcttggaaccggcacctttgaggttccacgaataaaaaaaatagccagctcgatgcattagcttgaatcgagctgatgcatcgagcaattctacatcactatgaccaatccaagaacatccaagaacactaagaacaataaaaacactaaaagcgggccgatgtcggggagggcttcgtcgctgccaccaccttccctcccgtcaccgcctatcgctgctatcgcttctcctcacgctgccgccgccgctgcctcccctcctaccggatctggtgaaggggagagtgccgcgagaaaagacagagaggcgcgcgtgagaggcatgcacgagagagagagaggcgcggtcctccgcttcttattcgctcaggtgctcaggaggataagaacaagcggtctgcatggcttagtttttacgggtgcggggtttttaaaaaccaacaccttttaatatattgtacgtttcgaatttttaattaacctgtacattaataaattatatgtgttggttttttcaaaaaaggcacctatagtattgtgtcgctcttttatcgaaccgacacctataatcacttaaagatgttggttttttcattttcagtctatagaggtgggaaaaatactatatatgccgattttagccgtttcaggacctatagtgctgacctgtatgtgtctttccgtagtagtgcatgcaggctggaggagccgattaaacaaccccattacctcaaggaaaaaggcatacatgtaattgtataagctagtttacatcattaggttgtaaaatttaaatttctaatttctaaaatattatttgaaatttgtttttcattttgctaagatttatttttttctatgcgtacaatttgtctactcagtactaagattggattgatatgaacaaatatatgttctatagttacatgcctatgtcatgtattatcattttttttaacattgttgtgatatattattgttatgagaagtcttaaaattggcatatattttttacgctatatttttatgatcgtaatcatttgtccagttggctctcctcaaattggatcattggatcctagcttcaccactgtatatacatatcggcaatcaaatacatatggtgatcaaaatttatatgagcaactgttgaggttcgactttattctttatatccaaaacttatatatatatatatatgctatatattaacttcagacccttttgcggatatattctatattccaatactttaatattcttgctacatctttcaatactagaaagctagctacacggctacacctaactagatagttcagtcgttggcacttttctgttgcgtggctataactgacgaagacgaatgctgctgctgctgctcctgcttgtcaattgtcatgcatgcgagaaaggagaaatttcccctagttcgcagcagcttcttccgttgtcatcacatatatacgcagcatgatctgctcgattttatcgagcgccgcactattcatctacaccaacgtttgcgccaatattttccagcagctatgtagattgcattaattcttccgaccaatggacggagacatgcacatggcgaaagtacacccttcggcgccggaaaacgccactctgtcacttgtcagtgaagatttgctttgcttgctgttaaattaatcttggccatatatatgctcggtttggagaaacatgaaccttccatttgttacctagtcgttatgatgtccttttaattggaggaataaaaatgtcagccaccagatgttgcctttgatcaaaacagatgatccgacagcttgagagtgtactggacttccatttttttatataatatgtacatactttttccgtcacaaaatatacttacctttagatataattctagacaagggtgatgtctagattttttgatagagcgagtagtattttttttttataaaaaagaggttgcatgaagagaacaggtaggatcaattgcacggtgtttgagtttaggtttagtgacaaaattggttatataaggttttactgttattttgtgatagagcagttttttcagagatttttttttgatagagtggttgactagattgatggattgcgatcgagttcgcctataacattacacactaatcaatataatgtattgcaatataacgagagacagcttccactcatctcattaatcttgaggagctaaaagacagtgtggctcgt

SEQ ID NO: 103538 - DNA, 621 bp, Oryza sativa
caaatattataattcactcatagtccagagttcagtctcgaattttcttgaagctaaaaaggaacaaataaaagcttagaaaaaaacgaagtgatcagaatagggccaaggctgcaataatcaaagctaaaacagcagaaatttgcattcactcatgtaaactgcgatgatttgtcatcatatcttttacgaaaatttaattcccaaactaataatttgaagctgtatggaattttctagcaggttcataatttgtgctaaactgattaattataggtatactcaatcatttttttacgcagacaatgattaaaaaacagcatcagaactccacttgccaatcattatcccggtggtatgcgaaaaacaatcattatccacagaatgactcccaacctgaaaaaaaattttggcagcaaaaactgtgatgcgtcgtgttcttgcccaagtgaattcagacatcatcattcaaccaaatatttcaagtttagttacctccaagcttgccacccaatgaaacttggaaatttcgcaccaaacaaatcaaaagtctgggaagcacccctttgctagttgagtcgtaggtatattactctacccaaatcttgataaccacaaggg

SEQ ID NO: 103539 - DNA, 951 bp, Oryza sativa
agttgccacgtgacgctctaataaattagagaaaatcctagaaattctaagaaaaaaagcaaaacatctacctctttattttcacttaaattgatgggtctaatattatacgccgttagatgagattgatcataaaataaacaaaataatatgggtcccacctctcctgtttctccgtgcataggtcacgtagtaggtacatggatacgtagtacgtacggttccctccatttttttccctttttttcttcttttttccatttatacaattgatatattttttaaaaattttacaaacaaagaatataccatcatgtaattctttataaacacatgtaactaaattagctctacaatctttgaaaataaaatttattccattatacgtttacccattaaatcaataatgtaagataatttccacttaaaccggtgtactcattactctgtactattattttcaaataatgcactattttaaaataaaatttacataattatattgtgtacctatcaaataaacaatttaagatccatattaactaatttatacgtgcgcttaaacagatggccccattatttaaatcatcggatctattttttattactttggactattattttcaaataatgcactgttttaaaataaagtctacaccattatattgtgtacccattaaattaacaaattaaaatttatattaactaatttacatttacactgaaccggtgaacccattatttaaaacgtcggatctattgctaataaataaagtgtccgaagttctcctttttttggcccacagcacaatgcatgtttgcacctttgcctttcacacgtgtgacaaagcgttgtgtctgaggcatctaaggtgatcatgaccgctgcagcgctaccgctttgcacacatcaaatcatatatagagatgattgattttgttaataacatg

SEQ ID NO: 103540 - DNA, 1931 bp, Oryza sativa
tatgccccgcatagataaacatcttatttagttgatagtcaaccattatatttgaatcaaagcgagtttgatttccctaatttgtatataaccaacacttaacagcgatgggtgcctcttcctccccctcccccttcctctcagtatccataaggaaatagcgtgggcgacaaggaggcaggcaagctatcggttctaatttagaaccgacacctatagggtatacccattattttgtaaatacacctaaaccctaagccctccactcaaagcctccctactatctcacctagctaacacttattgtcttggaagcaaacattattcttttgagactactcttatctaaaacttatattacatatttagcaccatatatgagctaaaatgaaaacattgttaactacaaaatttcagatctcatagagatctacaagtatcatatagatcttgtctccattcgtgatggcaatgaggtacccaatcttctatcaggtgaagataactagataactatcgatttggcgaaaacttgacaccaatgatccggcctctgatcaacacgatctgaaccatgcaatcgcaaaaccacatctcctctggttttcatgtatttcttacattcacagataaaatctacaagcgcacggatataccgctgtagcacttcacctgaaaatattccagggtatcgaatttccacagggaacttctgtgtgtagcttttctctatgttcatccaaagacacaatataaatgtaggccaaaggatagagatgatcttctaatatggttattagagagtcgtttagaaagcttaactttaataattcctatcgcttcaagcactggcttgctcgctattaccagaacgcgctctactccgtacacgggcatagaggactacggtgatctcgagggctgtcaccacctctataccaacctctaacgtactgtaggatacacaacaaacactagtaattaactatctagacaccacgtctatacaattaattactactctaatattagctaaacactgaagtaatcgctattaaaatgtgaaaacccggttttaaacgaagaagcaccaccgataaggacattaaggacgttacggacgtggtgctctgtactagtgcaacgatgggcacaagaagacgatgtaaaatattgtaatgttgaatgcaatcaattagcagcgcgcggatagaaattatgttctacattaaggctgtgttcgtgggaacctcactccctagcacgtaaaacaaaccagcatttatctcataattaatcaagtattagctaaaataaatttaaaaaatagattaatatgattttttaaagtaactttcgtatataaaatgtttgcaaaaaactcaccgtttagtagtttaaaaagcgtgcgtacggaaaacaagggaggtgagttgagaaaatggaaataagaactcagcctaattggtggatgaagaattgaaatttctttccatttgtgatagatttgtggtttaaaaggtgatatttgacgggtgggtgcgatatagtccaataactttagaattgaacgtttgagtgcaacaacttgataagtgggtgcgttctatgacaagaacatggcaatttagtattttggtgcatcaacttagctaagcatatgctaggtgagtttttctcgcgatgtcaatataccattacataacaatcctacggatattaccttataatattgaatttagagtaaagtccatcaccggtccctaaacttgtaccgatgtgtcatcccggtccccaaactcgcaaatcgaccattcaggtcgtcaaacttgttcgactgtgtcatcccggtccctaaacttgcagatcactcgtttttgtcctccaacttattcagttgtgtctccccggtccctaaataagacggtcta

SEQ ID NO: 103541 - DNA, 5392 bp, Oryza sativa
gtgggggctgggacggcctggtaggagagagagtgtgtgttgattgggaagtagtggggagggggtggaggccgagaagataagtactagtactacttaagatttttttggtaggaacaatttttgcagtcggaccacataaggttcgcctacaaaaatatattttcgtaagcgtcgcttaagtggtccgcctgcgaaaattattttcgcaggcgccgcttaagtggtccgtctgcgaaaatagaggaactttaccccgatttatatttttgtaggcggtcatttggctctaaaggtcatgtccgcctgcgaaaaaaagacccccacgtcaggaaaaatgctttttctagtagtgcatgataagttggatattcttccagaagaaaagggaaaaaaaagacagcaagtcatgcatgtattcatacctcctgggtcttacttttctgtacgaccattatacacacaattaatatttatactagacactatgttacgttaacctcactgcacgattcacgggaacatacttagctcctgcataaatactcctgattcatgcattattctactttcggtgattcgtgaattagttcctgggagaattagttttggtactagttgatatttttctttgcattgttctcggaggaaaaaaattgttgattttttatttgactacggaatgaaaaattttcactacatattctactttcggtggtctgatcgatcgtatggtaatcagctcagaactggccggtagtaccaatcgaagacaatatctatcggatctagtattagtccgagaataatttatactttacttacagacaaagttcttgaaacggtttgatatttttttccgagaaacactatagtttgatttgatttgaaaatgtactcagcaagctatgtcaacatttgtaagaattttgtaacaaaacttttgtatgtacatatcattttccttgtacttttgatcatgcatgcatgtagattaattggacggaaaaatatgtagtgcaaaccacatatgtagtggaaacttggaaaactaccactgatggagaacccatttttactctcggttggtaacccctttagtcccgattttctaacggggagtagcaatccgggactaaagatagacatctttagtcccggttgaaataaccgagactaaagagagggatctttagtcctagttgctgttagtaaccgggagtaaagaggaatagcggcagtaccagatggcccacttttcttttctttttccttttttttctcccgaatcaagtggcatgtaaatccccaaatcaaaccccaaatccctgaatcaaagtagcatcccaaattcacatcaccaaatccacatcacaaatcttaaagttatttatacacataaatcaaatatatcacaaatcctaaaaaattacacacaaatcaaatacatcacagatcttaaaaagttacacacaaatcaaatacatcacagatccatacaataaatctcaaatttatacatccatgtgaatcacaaattatttaaaaaaacaaacaaagcccctgccgccgctcgccacggccgccgcctgcggccccgctgccgccggccgtcgggcacggccccgccggcctccgaccgcctgcccgccacggccgccgtcgggcgcgaccccgccggccaccggcccgacagatgggaaggggaggagggggaggaggaggaaggggaggaggtggaggagaggggatgaggaatagagggtagatctgatttgtaggagtggaggaggagaagggggagagattcgatctgtgagttgtgattgtggaggagagaataagggatagggattatatactaaacgttcaattttagtcccggttggtaaagtggtgagatcctcagcctcctgacatacatctaacagggaatgaaccgggactaaagatcatctttaaatccagttgagaaccccaaccgggactaacgatcataaaatagcgatagggttttcaaccgggactaaagatcatttttagtcccggttctttttggaaccgggagtattgtggttttgggtcgacccagcaaagatcatttctccaccagtgtaccgttggatcgagaaatggacatccgagattcgtctacgtcaccatgagttaaaatttaactcgcagattcactcatgagttaaaattttactgggagttaaattttaactcatagtgacgtggacgaatctcggacatcatttctgaatccaacggtagttttcaagtttccactacatgtgtggtttgcactagatattttccctgaaccacacgtattcaagtaatctccaactgttaaaaaaaactgtttattttttcccacaaaaaaatgtttgatgttttattgtcactaatggttgcaaataccaaccattggaggaaacaagaaatctgtaacggttggtaataaaatcccgttaggccttgtttagttaattctatctcatggggattgaagtggattcaaagggtaattgaagtggattccaaggggaatatttcctcatctattaaggtttgagaagcaacggtgcttcactgaagcagtttaatgttacaccaaatctgctgttgaaccactactaattacgcatacacactactccctccggctccatattaatttacatttcggccaaggttaaggtcagtctctgatagattacacgatcaataactttaaaaatatttagtttaaaggaactagaacaacatatataggtttgtcttttaaagtactataataaaagtaaacatgcatttatttattatatatattataatagaaaaataaggcaaagatgtattttgtagaccgtgtcattgtctaaaacgtcaattaaaataattaaaatgaaaccggagggagtaattaatttgtgccggtatattagatcgcaatctggcctgaatttacgaactccttgcagtgtctaaattaatgcagctttaccaaatagcttcagcaagatagtatactccctgcgtccaaaaatacagtttgttttagtttaagaatttgtcttaaaaaccgcaattttaagtaaagtccagtagaactctttaatactacgtacttcatcattttcttatgattttaatcatccaactaagtaccccatccttctattcactttctccctctcctaatttttttatcacattaatattggatatagtagtattttaacctcatgcttaatatgtttttacttcatccgtttctaaatatttgacaccgttgactttttagcacgtatttaaccattcgtcttatcaaaaacttttgggaaatatataaaactatatataaacatataagtatatttaacaatgaatcaaatgataggaaaagaactaataattacttattttttttaataaaacgaacggtcaaacatattttaaaaagccaacggcgtcaaatatttagaaacagaaggagcattatctaagggtgttatcggttgccgaaaagcttattataaaccgtaacgacttattaacgatcagaaaataatttatgtgtaaaactttaatatatgtgttctgtgacttaaagtcaatggtaaaaaagaaattgcgttaaaaatatctcaaaatcaacatcaaaattaagttgtagaattcaaatttgggctttggctttacctttttagccaaccgatggggctctaaaggtgggttacatattttaaaggaagtcaatgcttgtcaaaatttccgggtaaaagagattttaaaagagtttatccataaggcccaaaacgtgccgccaatcttaaccctagcccccactaccctatttgtcgcccaaacctgaactctcctgcatcggtggatctactctgcaggtggcgatgactcaacttctcctagtgttgtgttctggaggcagcagcggtggggagcgagagttgagggagagaggggagataatgagagagatggtgggctcgagatagaacgcgactagtaaagtacccaattgaaaaaaataaaagtaagagagagagaacatggctcgacggctcggctttatcagtgcaaggtctcttaaaaacccgcattgatgtgcctctgttaacatcagtgttgggtttcttaatgaaccgtactgatatttatttcattggtgccgggtttttttcagaacatgccgtactgattgtatcgtgtggggtatgacggatgggaaaccactatcagttctagatgtagttaaatcggcagtaatgacgttgcactgatgtgctgttttctggtaggtagtgatatttattcttgctgttacattattcccattgttaaatattagattctactatttttaggagaaagttgatttatttgaattatagatactttgcactaaaaaaaaccttatagatatattttttctctcatactattatggcacttttcaaaatgcctcataagagagtaggggaaacaaaacactttacaggactgcagaggtattttcgaaaatacctcataagttcctcttgctgaattgtctctatgaataaagaaacattttgaatagaaaggcattacataaaatgtcttgccttgcatcatgtgttattttttatgtttataagagagcaaagacatattaaattgtggtacaaaaatgtaaaaaaaaaacaaagtgaaaagagagaaaaaaaattatcccctacttccttgaactcaagacctcttgagtaaatcttctttatcttcaatgcaataacaatcccaacctcatgttattgcttatatataagtaatacaagtcacacacacatatatatatagacatgtggttgtatattaagattgtgaaaagtgtctctaccaaagttgttgacggcatgttcgtgagggccttcggccgaccctgccgaaacacattgcttagcattgagacgaggcatcaaagaggcggagtgtcgaagtagcgtggcatcaagctgaagcggagccaagaccccctgttgaagggggcaaagcaaagaaccttcgcccgaaggcgaaggaggtcgaagcccaaccagactagacttcttgggaggatggcccattaggtggctcaggagggaaactatagggcgcagaaactgggtagatgggcgaattgtctatgattacccttgtaaacgtcccaattacaagggcggtcatgtatattccccagtacatgagaaccctagggttgtgtaaacttgtactgtgaaacctataaatagaccgcaaggttgtgaaacaggggatcgataaattttgagcattaatacatttaatccaccttcatacctttttgagtgaagcctgtcttccgaca

SEQ ID NO: 103542 - DNA, 688 bp, Oryza sativa
gtgttttcgcttctgatctccctcctggaaatgctagttctcagggatctggtgccgatctttctgcttctgggaatgggactgatcagtggagaagagtgccaactaatgatcgcactagggtttctgcatcagctactaactttggtctggaagaaggtttcaactcgcttgggcattcggcgccagcccacaaggcaccacgggcgccatgacgttcctaagctagaactgccaaggtattggcgggagccttggcagtaaaaaaatggtctatctttgccgtatcatagcatctactaacgcgcaggtaactttcatttctgaaacaaaaaatgattccctttctgtcaatgatcttaataatgccttttgtgtagataatagctatatagttcctgttgttaatacctctggtggtctttggcttttgtggagcgatgagatggacatcacggttgtgaagagtagtgctaactatatcttaggtgtaggtgttcagagccctaatggcactcttttcaatattttgtgtatatatggtgatgccatagggctcctatttgtatgggtgatcttaatgacattatgagccccaatgaaaaatttggatgtaatccttctaatcttaatcgcattgcatccttttgtcactacatgagaaatctaggtctgattgatatggggt

SEQ ID NO: 103543 - DNA, 629 bp, Oryza sativa
cccacatataaggtttctgtgcagttagaggaaatcaacaatgtgtgaagtgttacatcaaagaatgcatattgtaatgaaatttaaaacaaggtatgtgtatttctataaaagattactgaagtgaaacaataaaatttctagtagctatgatgacatcaatgtcattttgcagaattgataaaacatgaaactcaaaaggctaccaccaagattccatggcatgtttttgcagaattgataaaacatgaaactcaaaaggtaccaagattccatggcatgtgttatcaggatttcaccattatttacaggaaatactggcaacagccagcaattaagaattaagaaaaaaatcaggaacaggttgtatttcaatatattgcactttttgacgagttacatccgtgattattggcacccataccttcgtcttcagcgttagcttcttttattttcttaatctctgcctctatctgctctttggtcaaattttcatcgtcctgccaatgtacaatggaccttacttaaagttgagacagattaaagcatgcatattcatctcatgctagaagaagaaaaccagattatacagaaagagaagaagaattcgacattggataaaaaagcat

SEQ ID NO: 103544 - DNA, 660 bp, Oryza sativa
gtgtgtgcgcgcgcgcgagcgagagacacacatggagaaagtgtgtgtgtgtgtgtgcgcgcgagcgcgagagatcgtgggtcacacacaaacaaggtctatatatttttttttgtcccactctaaaactatatggttttttgtctctccccggacaaaacatgggataaatatcttttttagtcccagtttatttagtgtgagaccgtggcacgcacccaagtatgtatagcatcggttagttgtttataccaacggggatacacatacaaaaaactcgcgcgggggagagagagagaaaaacgtgtgtatgagccccatatatatatatatatatatatatatatatatatatatatatatatatatatatatatatatatatatatatatatatatatatgtgtgtgtgtgtgtgtatccctcaaccttatcgcctactagtgctcatccttctcctatcttcttatcctcttctcctcgtccctcctactcctcctcctcctcccctcccctctttgtcggctgttgccggcaggcgaccggatgcgagaggacacggcagccgtcggcggcaggcggcagcacctggtgcggcgggcggcggtaggcgcgccgtcggtggcaggcggcaccgcccggcgcggtgggctgcggctg

SEQ ID NO: 103545 - DNA, 1291 bp, Oryza sativa
ggagataaaaaatagagagaaaagaatggcgcacgctgtacatgggcagggagggagggagggaggtttggaatgtttttctaaatgattaatctaacagactaaaataatgtgtcagatgtttatgtcgaaaccgatggtcggatgttttgttttcttgtcagaattttattaggattttatttgatttaagagaataacataatatcttaagagcatttataagatgtgtaatcgacttttaacaccgtatgccgcaaaggagggagggaagaaggtttagggtgttcttttttttttaaaaaaaaagatctaatgacctaatataatgtgtcaattaatccattgaaaaaatgtgtccatcgatttatgtcatatctaatggttgggttttttttttccaaaatttctaagatttttctctaatttaagaatgccatataatagcttagaggcattaataatatatttaatggattttaacaccgtacggggatggggagggagggaggaagagaggtttgggttttttcttattaaaaaatacaaatcgatagccaaatgttttgttgtttttttaatattttctagtattttatttaatttaatagcacacgtggcagtttagaggcatttgtaggatatttagagttacagagcgagagtgctagacctaataggtggaggtctctttgtgatttttttaatgtaaaaataattttgattataatttctcatgaacatagctcgttggtacgtacgtgacgggaggttcggaatgcgtgcttttttttaagaaaaaaatctaaccttctaatataaaaataatagatcaccgatttaaataaaaatcgatggttggattagagtgccacttggcgacctaggagcgttcgtaaggtaccacttggcgaattaaaagtatttttaagatatttaatgaacttttatatataattatctttttcttgaaaattctaagaagtatgtgatatagtagcttagaggtgttcataaaatgtttaatggattttaacaccgcataggggtggggagggagggagagaggttgtgttttttttcttattaaaaaactaacaaatcgatagccaaatgttttgttctttttttaaagattttctagcattttatttaatttaatagcaccacgtagtagttcagaggcatttgtagaatatttagagtcaaagagcgagagctgctagacctaataggtggaggtctctttgtgatttttgaatgtaaaaataattttgattatgatttctca

SEQ ID NO: 103546 - DNA, 697 bp, Oryza sativa
cctgcagccctgggaatcgatcaacatcatacatgtaagcataaggaattctctgaaaatagctgcttaaattgtactcccttggttctacagttcttgacattttggacaaggtttaacttttgtaactttgactatcaataactttaaaaagtatttagtttaaaacaacaagaaaaacatatatgaatttgtctttcaaagttctacaataaaagtaaaacatacatttatttattgtatatattatagtagaaaaacaatgtcaaagatataatttgaagttcgtgccactgtcaaaaacgttaagaattataaaactggagggagtagctgcatatataaatagctataacaggacttaaaagtctgatctgaagtcattgtaattggtactaataagttattatcagtattctatggatttaccaaatagctaatgtctttgctattatgaacactaggaaaccatataacctaagagttccactttatctatctatctattatatactaaaaagtccattaaatttcctataaacgctctcaaaccgccaagtgacaccctataaacactctcaaatcgccaagtggcaccataataaataagaaaaatctgaccatctatttttacttatgttggtagacccattgttttggatggttggatttagttagatctattttatttataaag

SEQ ID NO: 103547 - DNA, 675 bp, Oryza sativa
attaattctatgcctattcagtcaccatgatgcacggaggaacaatggagtatataaaacacatggacgagcatagaccaatcatagaggagacaaagacaatttttttctaaagttcggatcacacggatcctactctccattgaggaactccaaagaactgggtctcgattaaccctttgcctcacttgtgcaaagatcctagaagaagtccaccatcttcaatctaacacccctaggtcattctctagaatttaagttaccaccaagatcaaactcaactttcttctagagagaaccacaagtgaggattgctctactaggactacctctgaaacctcagcacaatttccttaattgcttactttgtttccttgcggaggtgagtaataccttcacaaacttgcccaggacgtccacaatcttgaagaaactcgcgggtgacacttaatcgtctaggaggtgtctctccaagagtaacaagcttcaaatcacagcccacgagataccccaagtgttgaaaccttcctaaccttcaaaactttctccaaatcactccaacaccctcacaatcactctctcacacacacaataatggctcaagatttgggtggaggaagaaaaatcacattgggagaggctagaaacagctagggaacaaagagcaaaagtgaa

SEQ ID NO: 103548 - DNA, 638 bp, Oryza sativa
ttgaaacccagaagttcctgtgcttgaacttcggaagttccgggcagtataaagctacctggaagttccggtgttcttcaccaagaagtttcgggccccgttaaaatttgaccgctgcgattatttttagtgattttcaagaaagcctatttgcccccccccaccctctaggctacatctttgcatgttgacctcctacccatgctaacaccatccaccgatctactcgatctccggttgctagtttcagaatccgggggatggcccctcggtgagatatgccgggatgccgccgaggtcggcacccttaatcactggccgccgcatcccgcctcctctcagttcatccttacacaactatatcttctcctcatttttctaattctttatgagttaatttgattcactaaaacttggaaaaactcttgtggaagataggttttgaaattgataatagttgtttcttttctccttaacaaatggttagggtttacagtgaaattatatacacatattgtgatgcaatgtaaccatgataggatagtatagttattggcttctattttatctattttacatcaaattatatagtatttcagttgaaagttaaggcaattattttattcaccatctagtgg

SEQ ID NO: 103549 - DNA, 763 bp, Oryza sativa
ggctctattgtactattttgtatgctagaattagggagagagtagagtagaagaagtcggaggaattctggagttgttcgtagtccttctctcgtttctgataagtaccctgctttaattgaatatcattccgagtatttaagatttattctgtgagagttacctcttagttagttcctaatcaacgtacgggatcactgatcactataatccattaatatatagtggttgctttagtgtttagctagcattaaagtagttattaaactgcgtagacgtggtgtctgggtagttaattttcagtgtttgctttgtatcccacaataggtttgaggtgggtgtataggtagtgatatccctcaaaacactgaagtcctccctatccgggtacgttgtagagccatatctgggagcagtgggctggccagcgcccgaagtacctttttaggatcaaattgagctttctgtatacatcgtctctcactagtaaatcctttctaccgttagcctatcttagcttcgtgtccttagacgaacctggtgaagagctgacacacacgttccctatggaaatcaataccttggaatactcccgaatgaagtgttgcatcggtatctttcatgtgcttgcggattctatctgtaaggttaagaaataccaacaaagagctattgcaatatgactcacgcaagcccgtgttcagcaatgctatgcagggacatggaaaggttgaatcttcacatcatccaccaaggctctctg

SEQ ID NO: 103550 - DNA, 696 bp, Oryza sativa
ttgatgcggcatcaattgtccactttcctccatcagttcttgcagaatcgccgttgtcgcccacggaccttctcttgcagaggaagaagaagcagtgggaagaggggttttgatccagcttcattccttatgagggaggaagacaataaatttccaccagccaagttaacttcagttcccttgtgtttctctgcgtgtagctaaattgagtgagcaatctgtatgggcagttcaggggcattactaggctcagcgtgattaaggcagcacagagacttcagtggtatggagtttaattcctgctggaactggtgggaagcagacatttgataatggaactccaggttcttcttagcaaggatcacatacagtcctttcttgtcttttttgtgcagttgaagcagttgttggttggcccaaatttagggagtgtgctttggccagatgggccatttgctgcttggaaagctgatgggtggctttttgtgccgcaggcaatccatctatctgcaggtgaatattttctagggaaatatgcttgtcctttgaattggcttcttccacaccctcccaacagtgtgcacttgagtactttgttgacaaatttgcatagggcccaccagagcaaggactttgccctccaccgaactgttcacctgtcctgtcaggagcgttggaaggattttcggggtgcag

SEQ ID NO: 103551 - DNA, 732 bp, Oryza sativa
ctgcagcccccctcaacccaaaaaccaataaataattattatcatcttgtagtttggatcatcctaataaatataatgcatgcatccaatagtattagataacatgagagtagaggatttaaaaaagtagtaatttaatagagaaaatgtcataattaattgcatgcatgcattatattatggaactctaagaaaagtggttgtgccttatattatggaatggagggagtaagttacttatgatcaactgactaatcttgccacagaattatttctcttagtaaataaattatatcttttagtaaataaattattatttggaccggtgcaaattacttatgacaacccttctatcagtgactaatcttgccacaaaattaaatatgttacttacgatcagcttattaatcttgccacaaaatctcttagtaaattcttgcagtgaataaattactcctatacttttcttctgatatctttttttagtaaataaattacacctaggctgctggagtacaagatcttgtagtaaataaattactcctatacttttcttctgatatcttctttcggtaaataaattacacccaggcttctagagtacaagatttaagaacatactgttctaaccacaaaatttaataaaatcattccaatcaaggaattgttcgaataagattcagtattatatcaatagtctaatcacatatgcaatgcgatacataggtagaa

SEQ ID NO: 103552 - DNA, 2416 bp, Oryza sativa
gccgccgcctcgtcgcccgtcgctggccgccggctgccggactcccgcctcccccacccgtcggctgcgctgcccaactgaggagaagaaaagtgagagaagagaggtggagaggctgacatgtgggacccacgtgggtccgatgttgagtcagctactacgtcaaataaaaccggagttaaaactaccaaggacctattttgcactggttttataagttgagagatgtgttgtatccggttttgcggttcaatgacgatcttgtaactcgatgacaagttaaggcatcttcggtgtactttttccattcgtctacaactggctaatgggcttagaatacgtctgaattggcctaaatatttaggtccagaaaaggcccattaaatgttactgatctgacattttcacaaggaataagttcacttaaaatcccttttaacggatgaaccaaatagcaagtatatatagtccatccactgtatcattattatgccgtgttaactttgatctacaatgatcagttttgattgacgtaggaagtggaacccacgtgggtcccacatgtgagccatgaaggacgtctcgttggtacggtgcggattacctgtggctgtgggcgcgagtggtgcacgcgccgccgtcgtgctttcacccgcgactttgcaccgtggctttgcgggggattcctaacgcggcggattgtttaggtagcgtaacagactgttagttaagaataatgacagtaattaaggaaaaaaattattttgagatttttttcactaattgattgaaaatttttaagttatatttgaaaattttcaactcgagatttgaaaactttcaactcagatttgaaaactttcaactcagatttgaatatcgaaaactttcaactcagatttgaaaacttttaaaacttttaagttaagatttgaaaattttcgactcaagatttaaaaacgttcaactaaaaacatgctaaagattaaaaaaataatcagaaaaaagtggggaaaaaaagcgaaaaaaatcggttaaaataaaagggcgtggggaggaggcgcgcgcgaattagcaaatccgggctttgcacgccgcccaacatcgctatctcttcatcgctgccaagcatccactgcccaaccatagaacacatcccatccagaaattcgcatctctgatttgactagatagcacccaaacaaaacacaaatcgaaactcccctaaatgctccataccaacaaactaaattcacgattcatctctactattataaaatctgaagatgttttcgtggtccgtcatccatgtttgagtcggttataaataaatgatataaaatttaaagatgttttcgcggtccatcatccgtgttttgagtcggttttgattttatattttggttttaatctatatctcttctctatctctactattataaaaattgaaaatgtttttactgatattttagtatgttattcgtgtatgagtcggtttttaagttcgtttgctttttaaacttgtcaaatttgtccctcgcaaaaaaaaaacttgtcaaatttgtcaaacctcttatgcttggtacactctaatcctttcccgtgataacttctcaaattcactccagaatacgtttggcatacaaatcaaagaatagaggaaaggattaggaagaagcaatctagaacaagaagaagcaggctattagaggctagagaattagagtttgaatcagagaagcattggagaataggagacgaggcaaacgcctttgttcgatgccgtgttctgtggctggcagttcctttgtactcctgctaatttacttgctcccttttatgtgacttgggccaagcccagtttaacctgcagaccactatccagcccatcgtgtatcacatcattgggtacatgacatggcgctagctcttcttcattggcatgtaatcttaatcttaataataactaattaaaatatttatatttttccgttcgtcacccctctattcgtccgtattttcgtccctccctcaaattccaatccgatttcaattctgtgaatgatcgaaaaaattgaaaaaggaaaaagagaaagccaaactttaacacccgaaaacaccaaatatatcgacccaaaacaccaaatacatcgagtccgtcgccgccgctcgggattgggttaggcgccgccaccgttgccacctaccggtgatgggggagggcgccgccgccgttgccggtgttaggggaagacgccgccgcactgccggtggtgggggaggacgcagccacgccgctggtggtgggggagccgctgtcgccgctcacggggggaggacgcccctgccactcgcggaggaggacgctgccaccgctgcccctgctcgttgccgctgccgctcggggggagaggcg

SEQ ID NO: 103553 - DNA, 763 bp, Oryza sativa
gtgtcctatccacgtattttcgactccagactagcgtgggttccctccataaatttgtttcattaatggcagagagtagcgttgtacagctagacataaaacacgctcgtcatcccaaccggcccggtgtcacgcccgcacgtcctgaaaaagatagttgtgttatatttagacaagcttctcgaagatgtctttgatgaatatacatataacatgtctccacgctcctctcacaaaggactccagaattccgatgtaggcagagatgagcatgggacccgggatagggctgggcccaaggtcggtctttgcttattccccaagctgtgtatcttgtatgtgtttctacactcctctcgctgaagatcgtaggacgtacaaggatagagtgagcctgggacccaggacaggggtgggtccgaagccgacctctatttacattcttaagatgtagatcttataggtctctacgcttctctcactaaggatcgtaggatttacaaggacagaggtaagcccgggaccaaggacagggctgggtccgaggccatcctctgctaatgtagacataaggaagttgcgattcctcgtgctcagagttttgagtcattaaagattctatatgtttcaatactgctctttagcagtggttcacatatcgacagaagtgggcctggggtccttaaacaagccgaccctaaatctatctcttcctattattactaagatatatttcgtgtaagcttgcatgcctgcaggtcga

SEQ ID NO: 103554 - DNA, 1052 bp, Oryza sativa
attttctttaaccaggctgaccgaagtattggagccgaagtattggagtccaaaaattattaagctaagggagcaaatattattaagctggaccggagaggcagtgaggaggccctcccaggagggtgaagcagcctcctctagattctgatgagacgagggccgcgactgtggccttgactactgcctactggtgcgatgacggagaggggagaagcatgcagaggccgctcactttctacatcgcgtcattgttgttggttcgctacgactacctgggacctcgagggaaactgttttaaacactcgggtggacgtccacccaagagattagaatccatcctcgggacctcgacttatctgcccctgtccattcgctctactcggcttggtaaaaaaatcccaatttttcttcctgtatgtctaagtttgtaaatataattgttttgctgaatggagatatatcatttctacaaagaatgtcagtatgtaggtagaaagagtgaatgttgttgtgtattttccagtttatacctactaaaatctgaataagccaattggctgggcgggagtatataatttttggatgtaatgtacctgtgcattttttccaaggttaatgtgcctgcatttctttaaatatgccgataaaatgtaaatcttttggtgaatggagatatataaatatcagttatagaatgtcattttattgccagcctatctgaaatactttatgttttctgagcaggacaacctatctgaaatctattttctccttgttcttttggattttgagaggcaggacacaacagaactcaggcagtggaggcatgacatccagggccgagaggttggcggctcagtagggtagctgaatggcgattggcgacaatggcgttggccaagtagcgccacagcggcatcaaggagtgctggcggtcaactgtgccaggattcgtgcaagtatcgatccgcgtcgtcggccctaattagtccttgcatcaatctccattagcatatccatcagtgatggtgctagggggatccactag

SEQ ID NO: 103555 - DNA, 576 bp, Oryza sativa
ggcggccgctcatggctagtggatccccctgcacctcaacacctgtgaaaatagttgattttcgcaggcgcaaaacacgtcgcctgtgaaaatagcttcgggcgctaaaaaaaaaaggcagccaccgccgtttccggcggtagcttcccgttcccaattcagttcccacccattccctatccaatccagtgaatccaaattcaacagagaaatcgccagtttatccagttcatccaaaatcaccaaatcaatactagcaaagaaaaaaaataaaaacattcctaaaataaatcacggccccgccctgccatcatctgccgccgcacgtccgcgccgcgccatagtccgccgccgctgccgccctcccccggtctccctccagccggatctgggagaggaggggaggggaaccgcgccggtcgccgtcgtcgtcaccgccgccgccctcccgggcctccctccggctgaatctgggaggggagtggaggggaaccgcgccggtcgccgtcgtcgtcactgccgccgccctccccggccttcctccggccagatctggaaggggagggaaggggaacc

SEQ ID NO: 103556 - DNA, 678 bp, Oryza sativa
agaattttgtaacaaaacttttgtatgtacatatcattttccttgtacttttgatcatgcatgcatgtagattaattggacggaaaaatatgtagtgcaaaccacatatgtagtggaaacttggaaaactaccactgatggagaacccatttttactctcggttggtaacccctttagtcccgattttctaacggggagtagcaatccgggactaaagatagacatctttagtcccggttgaaataaccgagactaaagagagggatctttagtcctagttgctgttagtaaccgggagtaaagaggaatagcggcagtaccagatggcccacttttcttttctttttccttttttttctcccgaatcaagtggcatgtaaatccccaaatcaaaccccaaatccctgaatcaaagtagcatcccaaattcacatcaccaaatccacatcacaaatcttaaagttatttatacacataaatcaaatatatcacaaatcctaaaaaattacacacaaatcaaatacatcacagatcttaaaaagttacacacaaatcaaatacatcacagatccatacaataaatctcaaatttatacatccatgtgaatcacaaattatttaaaaaaacaaacaaagcccctgccgccgctcgccacggccgccggggctgcaggaat

SEQ ID NO: 103557 - DNA, 505 bp, Oryza sativa
agggcatcctcccttctaaggaggtcccgctctcctagaataagcaaggtggtagtaaactccacatgcatgccatcccatgaggtgggtttttgtgattttccaaagaattaatcttcgaatgggccttagcccatctattaattccaacaaacctagcaaatggaccaggtatcatcaatctcagtccaatctatttaatttaaaatataaaactattttaaaagtaaaataggtaaacattttctaataatggataaaccatccaagacaatagctagagctcaaaggcatattagtacaatagcctaggctgtgtttttttcccatgggttctgacccatttccctcgtttttcgcgtgcacgtttttcaagctgctaaacggtacgcgttttgcgaaaagtttatatcggaaagttgttttaaaaaaatcatattaatctattttcaaatcttttatagttaatacttaattaatcttgtgttaatctatcgcttcgttt

SEQ ID NO: 103558 - DNA, 1560 bp, Oryza sativa
agatcgctgcctgccgttgcgctttattaacgccgacgcgcattaaaaaaaattataaaagaaattacaaaaaatgttatttcctgtgaaattgaagaaaaaagagtgttcccgtgctgcggcgtctcctcgtgggtgacgacgatggtggactgggcgggtggacccgctctacggatgggtggggatggttgagtgactgacaggtgggcccgtgggtgaggtgttgtgaacttgtgagaggggtggtgtatggtgggctacgttcatggaggaattgggaggttggagtgtgggcaccagctatggtgggcgggtgtggggcccagtgcgtgggccacgcccccaacttgaggctgcggtgggaagaggaggaaggccacgtcaccggacggcggcgggggaggggggatttgctgccgtcgccgtcggagtgtcgttgccgccgcagttacgactcggaaattaaaatttgggattaaaatattgcttatttttaattgtgaatttcagttattgttaaattaaaatttgaaataaaaaataaaatgaattccaaaatttaaaataaataagagttcaactaggaatacaatttataaatagctaaaatttataattaaaaaataaaaactattgaaagaaatgaccatctaaaacacgatcaataaaattcgaaataataaataaaataaatttagaaaatagaagaataattataagagtttatgtaggaatacaatttatataaataaaaaatataggaatgaaaaatatgaaattttcaaaaaaaaaacatctagaacagtaatgacaaatggcaataaaagatgggagaaggtaatgaagcagggtagtggtgattgatggaacatctaaaaactataaacagagtcccaaattgaatccctatgatgattaagaggaggaacaacgagcatgccattaagcagcaccagtcacgacgattagtggaacttctggaaagtaaaaaaataaaccccaatgataataatgttggacttttacaatctcaaaagcaataaagagcggaagcagcgggcaagctgtagaggagtataatgacgaagccgctaatgattttactagacttatagagagtaaaataataaactcaaacgataattatgttcaatttttaaaatcacaatgacaataaatagataaggcagcggatggaccgtagcggactatagtgatagtgtttgacgagacttctaaaaattataaaaacaaaacccaccagaaactaatgaattatactatgcatgtaaccaatgaggactaagatagttgttcatatttcggtcaacaatttaatttagcatgagactataaatatgaccatctcttttggaaagaaaaacaacataccgaaatgtgtaacacttttggatagagtgaataaattgacccttttgataaaattataaataagttctaaaagtttttctatagcggacctaaagcatactccatccgtcccataatataagggattttgggtggatgtaacacatcctagtatgatgaatctgg

SEQ ID NO: 103559 - DNA, 1709 bp, Oryza sativa
cccaaaatctcttatattatggaacagagagaatacaaaaggttttgttaaatacaaccttagagcatggctaacagttctatgtctatttgcctaaggattggagttctcttcccccataaaattcggtcctcacaagttgggagccactcttgtcacaaaatcctcactcgtagctactttccttgcactgagcggagaggagaggaattacgctccacccacaggagatagcccaaagtgtggaaagggaggttggcccttttctttattattatttagggctcaaattagagtatatttggggaagaataatatttccatgtcttaaattctccttattagaaaagagatttaggagattgagtttatgtgaactgttggacatgcttacgcggacagcagatcatcttacatgggcacattgctatttatcctttaaaacaatagtatcgattgacatgtagagagagaaatgaagatttggctggctaatgtttatcttttgaacgaaaagagaggataggaaaaggtcatattttgtgcattgttgtctcccaacgttggggttaacatatttggttgacttggtaactatatatgactacacagaggctaaccattgtaactacaaaaagtttcgaatcttcaaatataaaatatttcgcactttataaagaaaagatgcttttttttattgtaacagttcctttaaactcctttcattcctaagactttttattctttggctcatgcattacattgcaaaagtgaaatggacattaggggatattctttggctgaagcatcactttccctaaagatgtctttactaacaaaaacccgggataaaggcaaaataattttacacaacttgcaaacacacaaatactcttccaaacggtttaataaccgcgttgaccactctgacatcctaacccaattaaaatattgtctacgtgacctatgagtgccatgtgcacttgattaataccaccttgatagttaaattaagagtgaaatcaacttataagacattgttcgttatgaagaatgaaagtgtaagtggggtgctacatataagtggtgcacggttatgaatggcaaaagaaccatcaatgtcaaggaataaagaaaaccttacatatagcttgataacattagacaaccatgcaaaatttcaataaggagctctacttcatttgattttgagatatgaaattgccaaattgcagagaaattttttttaggaaagtgcttttttcaaaattagttaatttcatatttcacaaacaaagtcaagtttgcttttgagattttgtatagtagtttgataacattagacaaccatgcaaaatttcaataaggagctctacttcatttgattgtgagatatgaaattgccaaattgcagagaatttttttttaggaaagtgtttttttcaacatcagttaatttcatatttcacaaacaaagtcaagtttgcttttgagattttgtatagttgcacaatataatgtgaatttttttttagaaactttgagttttatggttttcacctaagttgtggtttgcaaccaaaggtttcttatcgactcgagatcataaaccattcggtaaactagtcaaggtcaaactggattttaaatttttgataaaatttggtcaaatttcactgttagtcaagttttcaaacagtttccgcgaa

SEQ ID NO: 103560 - DNA, 1272 bp, Oryza sativa
  unsure (1)..(1272): unsure at all n locations
tcgactagaatcaaaactggcagtgattccgtttctatgatttggtctatcgagagatgctagctggacaaaagaaaaaacacaatttggcgacaattcaaactgagatacagaatttacagggacggacctaacatggggcatcaaggttcagttgaaccccaatattttgggtaacaaacaaactgttattagtacttgaggttaaggcaaacagtaaagcttccacatacatcagagaagctaatgttaacacaaattcgagcaccgtagagtgcgtacgggtgctcgtcggcgagcatgcggcggagcaagcagccggactcgcgaggggactcgggagccgaggccgaggggaccggggagatcgactagggcgaaacgcaactgagtcactcagaagctgccaattacgctggaggggtgtccgcggggggttgagcgccacacggcggcgaggcgaggcgaggcgagcggccgtcgttaggacggaggggtggctggcctcgccggagcagcggaattgggaagataaggaggtagggttgcggcgggaattagggcttaccacgcgacgtggagaggggcgaagcggatctcgcggcggcgggcggcgatgggagggagggagggagggcggaggagacggccgccggctccccgcctccggcggttcggcggcgccggagccggagcgggcgggcgggaggggcggcggcttccgagaaggcacggggaggagtcgtggagtcgcggtcggggggagagagaattccgagtgagtcgatctactcaattcttcccttcccctttttaaaaaaaaaaatattaaggcgtccccgcgcaattactgccgcgacccaccgcccttcacgatttctgtcataattttttcggctactcgattattattgtcgtaggtttatttatttcaccaagggtgtgttacaccaaaattagaagtttaaattggaacgttgtgatagaaaagttgaaagtttatgtgtgtaggaaagttttgatgtgatggaaaaattgaaagtttaaagaaaaagtttgaaactaaactcggcccaatttaaaaataggggtaattataaaattgagtaaattgtatcggcggtacacgaacttgttaggtgggtgcaatctantgtatgaacttgtaaaatgctcattttggtacatgaacttatcttgcatgtgcgaactaaggtcaaaaggatattacatgactaattttgttgattgaggtgctgattaggatactac

SEQ ID NO: 103561 - DNA, 1445 bp, Oryza sativa
ccgaccccccctcgggggaaatcaggaggagggcggacacctcaccctcgggcccgacgtccccgaaggtgccaggccacgtgggcggttgcgtctgcctcaagcctctggtcatgatactcccggtcccatatcaccgacaattatatatgcatatatatgtattgaaacatatatatgcatatatatataaaccatgcagcaacagggccatgaaaaaaaaaggtcagctcgatctttagtcccggttggtaacatcaaccggtagtaaagatggctcagccggccacgtggctaagccatctttagtcccggttggtaacaccaaccgggagatctttagtcccgattatttcacccggaactaaagatagcgatctttagtcccggattggtagtcccggtttggaaaccgggactaaagggggattacgaaccgggactacaaacgctttctccacagtgctttttgatagcaatcacaacgtcaaaatattcaacggatagagggaactattagcagtaaaatattattttgccagtacattgaataacgaaagacctaatcagttttattccagtagttccaaaaggcagcagagtctgtcacggacatactaacaggacaaagcgtcaaagcaggcataaagatgtttgattcagtcagaagaattcggaataggctatccaataaggatttaaacctttatacaaatttgacagtgggaaataatttccttggacagtaggactgcatgcattctgaatcatctaaacatacatcaatcgcattcaatcattttaactaataaatccataaatgtaggttgtttcatttttataattagtacaatgtcagtaaaacataatccagaaaacaatgtttgacatcaacctgacacttcatattccccaaataaccacacaacttgacaatatgggcaggaagatttcaattccaaaatcagcgttacacatctagccatgctaaacgacaacatatcattgtactaaacggcagaaacaaagtaaaatatgaataatgacagcattagacataaaactcgtcgacaacacttctccccactactacaaaaaggcaaatagatgtcgccactataggtgccggcacaccaaaaaccagcacctataatacctttcccgtccacgcgcccacccccacgcaccacatattcaaaaaccggcacctttatattcaaataggtgccggttttacggtttttaaataaaaccggcacctaaaacctgtgtcagagaaaggtgccggttctagacccaaaaccggcaccttttatattcaataggtgtcggtttttggtctagaactggcacctttattccgaaagtgcttttcatgcctcacacaaaggtgccggtttttgggtcgagaaccggcacctttcttccaatagtgcttttcatgt

SEQ ID NO: 103562 - DNA, 1903 bp, Oryza sativa
ggaagacaattctttttagggataattctttttatctcttttgtgtccattgttggatgaaatgctaaatttgtgttaatgttttcttccatctacgtcatggccgttagtcaaattaatgctagtcaaactatgttaaggccacgaaaatatctattgatagcttgatttatctcgaatttatgttaggatgcccatcgatccgctagaggaggtggaagcggttttgctcgatttttcttaggttttggttgaagattgaagcctacaaggtaaaatgcactactcatttgtatggatctatcagccattcgtagatctgttctctagtgttatgctaaatttgaattaaggtgacgtgggtgtgtacaaaatcctcaattttatcgtagggtaaaatggtccttcctcgttgtttttattctaatgtgcttgtaaattatgaaatcttcattgttttttccttcacggtttgtaataaacgataataatcgcaggtacccattggatataatagatttagaatggataactacagcgagatcgtgactctgtggagtatttcaggggagtaacggctctcgttgctgcggccaccagcacaaactcagtcgatgcaccggaatatatttggtgtccatgccatgattgcaagaaagacaaacaacttccggctcaacgggtccattcacatctccttacaaggggttttatggaaaacttccttagcgaggaggagcaaggtgagagaagtgatggcaactgtcatgggcatgatgcggatgtcggctgcgaggaggaggaccaaacatgtgtcgattagatgctgcgtgacggggagagatttgacactgatgatagggaatatcacaagttcacaaccagggtgaaggactccaaaactccagtttacaatggatgtaaggcggagcacagcaagctccaagtggtcctatcgctgcttcacctgaaggcgagcaacggatgttccaataagagcctcactgagcttttgcaaaaaagtccttcaatttttatgtaactagaaaaaatgctcgtgcgttgcaacgggtgaagtctattttaatcttattatttttatatggtttagttaagataaaattcactgtgggagttcgcttggatatatttatttttagaaaatcatgagatgcagttagaagtccgatcgtcttaagttagcatgcgagtttttttagcagatttcttgtatgattccttctgtattactaaaagtgaatgatctttaaaacctcaaatacagatatgtatttccaaaagcaaacaaacttaaaaatcgactcatacacagatgatgtaccaaaataccggcaaaaaacatctttaatttttataatagtagagattcgatctcagtcccaaagaacagtacctcagagacgctattttatgtagagacccttctaaaagccggatattccaaacaatggatagaaaaatagctactccctccgtccctaaatatttgacgtcattgaattttttaaacatgtttgaccgttcgtcttattcaaaaacttttgtgaaatatgtaaaactatatgtatacataaaagtatatttaacaatgaatcaaatgataggaaaataattaataattacttaaattttttaaataagacgaatgatcaaacatgtttaaaaaagtcaacggcatcgagtatttagggacggagggagtaattaggactgcgcttgaaaaagtgcaagtataggggctttttcgcaaatgacctccactaaccctagccagcgccgcccccttgtacctcttcctctcccgccgccgagagccgcgcgcgccgacgcctccgcgtgcagagccgtgcacgccggcgcgcgccgccacccccatagcccg

SEQ ID NO: 103563 - DNA, 625 bp, Oryza sativa
attcctgcagccctgatccgttgcggccgtcgacctgttcgatcttgttgttttgcagcatttggaggatggatgtatctgtgggtgtgaggtgtctggtgtccgaccaaatcatcatgacaggataatgccatgtactgtcgtgtggaatcatttgcattggtcttgtgtgatcagttaggattagtatatatattgctttccagagaattcttcagcttgagagaaattgctagtggagatatagtttgagtttgattaattattctttggccacaagtcttcttccagtgcctccttattataatatctgtcttaatggtttacaaatcataaaccaaccgtcgccatttgcaaatttggaatgtttgttagtaccgaatgattatgtgcttatcatattagaagcctgatgttttttttaaaaaaaattgtgcttcttgtgtgaatgggtgaaattacattacttcgtctcaaaattgagttccaagtccacgtacgcttgcgatcacggatctacagtcagagctgagagctctggtcctctctcctctctgacgcggagctgaacaatttttgttgctttgcacagcgcttcatgatcacaatgtgacagaacacattt

SEQ ID NO: 103564 - DNA, 1282 bp, Oryza sativa
taataacaaaacaaattataaattccgccaggaaacaacgagataaatttattaagcctaattaatccgtcattagtaaatatttactgtagcattacattgtcaaatcctggcacaattaggtttaaaagattcgtctcgcaatttacgctcaaactgtgtaattggttttttttcatccacatttaatactccatgcatgtgtccaaatatttgttgtgatgtgtgaaaagtttgttttgataactaaacaatgcctcaatcttctcattctcctcctcacaaacccgagaaaatcaacattctactatcattgaaacaaggattcgtaaaaaataccacaccatagttgggattcgtcataatgctactcttaattgtgggcttcacccaaataccattttcttccaattctgaaagataaaaatagttttgtcccttttctctcgtctttgttgaccaaaatccccctggttgaatcaattcaattagttcaaaaatgtagattacatagtacatatttcccaaatgtcttgacatgcatggcggtggagcgacgcctccgagggggcagcacgggaggcgggtggtgatggcggggaggcaggccaacgagcgcgagtagcagagcggcgacgggaactctagcctcccaagcagctgctaccttgctagaacagatgatggggatattttgatgatttaatcttctttgattcaactaagggcattttgatcaacaaatagaacgaaagggacaaaaaagaaactattttgatttttcagaattgaaagaaaatggcagttcgggcgaaaccccaaagtagcattccggtgaatcccaactgtggagtagtagtattttggcgtagctcggttctgatgatggtacacaagttgcgagtatggcgcacgcataccggggattcactttctttctcccccatccacacatgcagacaacggcacaatgccgaccataccgttgctgctgcctttttccggtgaggttacagcgccccgtccggccaccggcgcaccactacgaagccgctcgtgaagcctggttggaaaaggccgccatccacgccggagacagcccatgcaccgattccacggacgccccctcccgaaaacccggtgcgccaatccagcgacaagcccaccacgagagaagtaataaacaatccgacggcccgtattccgtggtccacggccacgaccgggcccacctgtcacaagcacgcactccccacctcgcaacctcgcctcggctctgcct

SEQ ID NO: 103565 - DNA, 846 bp, Oryza sativa
aatagtgtcgggtgcacgtaggggtgggtatttggtctaaccgaaaaattcggttcggtttctcggtctttttaaaattcggtctttgtaatctcaagaccgatcggtctccaacaaatctcaggactgagcaaatcggtcttcggttagtttggtttggtcttggtcatagaccgaactaaccgtaaaaacagcaaaaacaaagcaaatcaacaaaactatttgtaaaaacagcaaaagcaaagcaaatcaacaattagtggaggcggcgcccggcggtggagccagcgccgggccggctgggggcgatgccaggcggtggaggtgaaggcacgctggctagaggcggcgccgggccggctggaggcggcgccggcggtggaggcggaagcggcgcccgacgatggagcgaagaaggatgcggatgggatggagacgggagtcgggacggcgccgctccaggatggatggggatgaaacgatgcgtcgatgcctgtgaggctgtgacgcacctgcccctaggatttcttattagtgggtttattggaccaactagatctattgagcctaattcggttatttcggtcaattcggttaattaaggcccatgaccaaataaaccgaatatatttcggtctttcaatagttgagaccgaatttttcgatctcggtctcggtctcttcggttcggtcttattctgcccacccctagatgcacaacacgcactagggtagaaaaggtgatgacggtaaaatgagaatgtactatggctaggttctcatgtaaagagagatcacgcgataccattaaatacactcggtggaatttcggtagacatgaagggc

SEQ ID NO: 103566 - DNA, 705 bp, Oryza sativa
attcctgcagcccttgctactcttacaagtggtgataaaggatttactactggacctacatgtcatatacacatgagagcccacatgttatagatagcgagtgataaatccttaattgccacattttaaaagttaaaaaaaaattaaatgtcccacggttaaacatgtgcggctaaaatagagtgcatattcccaggacctgttagctggttttccaagcttctgatttctagtttattttctggattctacacctacttgtttttaaaacctagactctaagagaaagtgtagcagctaaaaacttttccaaacatgccctcaaactcccagcacaaactagacagactaatgcaagttaaggttgccattaatttaagttgtacagtactactaaatgtgatctcatgtctctctcgtcgggctgaatgcccttaattagtcttcaattggcgccttgatccataatgcttggcacatggctgcgaaggagatggccatgaagagctagcaatgctttgcacatgtcgactaaacaatcgctttccctaaacgaacgtgattagcacgtgccactgcgtttaatcgacttgaaatatggagaaaacgtgctgcatgcgtgcagaccgacctgagaacattttataaaggagaagagatctcgaggtagaaagcagggacattgtagaagaacattcacctttc

SEQ ID NO: 103567 - DNA, 707 bp, Oryza sativa
attcctgcagcccaattaggcttaacaaattcgtctcgtgttttccaggcgagttatgaaattatttttttcatttgtgtccaaaaaccccttccaacatccggtcaaatatccgacctaagtcgtaatctgggcttctagctggtgctgtgaccataagacctgatcacctaaaacctcaccaagtgtttttagtaaaaaattatcatctaaatttttacataatttttttattttagtagataacgtttaatagataaggttgttaagttttgggcacacgttttatttaaaagttttatgcagatacaaaagatataaatcatgtttaaagtgctaataactcacaacaaaataaatagtatttatataatttttaataagatggatgattaaacgtgtgttacataattgtcttggattttctctactttcaaagacggtgtagtaaaaaatttgtcctgttttcactaggctactactagtacatttccacgagtccatctcatttcggccattgctgatcgtcgtgtgttgttttgttcggtagcaataggagaaacatgttgtgccacgttccagttggtgaagattgatacattttcctttttgtcttgcttgtttcacgtcatgctttccgttcagaggtcagccagacgttcatgtggcatggctctctctctaccgttgtagtaccacagtactag

SEQ ID NO: 103568 - DNA, 672 bp, Oryza sativa
acgaacggtcaaacgttgaacgtgaatagtgtaaaactgtacttattttgggacggagggagtaattatttcaggatcactatgacgatgactgaaatgtgaggattttgtaatcgcgaaaaaaaaacttttcttcttcttcttcttctgcttcttcttagaaaagggctgaagtactcatgaggaatttaccatccagattttgtaatcgaaaaaattaaatatgatgaacttttaaggaacttaccatccattattgatagagaagaaaatgatgagataacattttcgtgcattgctcttggcagctctctaccagccgagatagttaccattcttaaaatttgaatccagactggtgtattgctcctggtagctctatgtcagtcgagctagttactgttcttaaaaattgttgaagtaataagaagaaacttagcatccattatttaaagagaagaaaatggtgaggtaacctgcgacagagaggatttgtacccatactatcgagttgctcttggcaactctctgccagtcaagctagctaacattctctttttttagactgaaatgtaagaaaaaaataaatgtgaggatttttagtcatctttattctctagatttggggaggaaagaagaggggacaggcagtcagatggctacttagcggcg

SEQ ID NO: 103569 - DNA, 704 bp, Oryza sativa
attcctgcagcccctattttagtatttttcagctattagatttacaattatatagtggacctgatattatacgtcattagatctatttttcaaaaaaaaagaaaaagaaaatagcatcgatcccctcccatcccgcttaagtacatttccatttacgtgaactccatctgtgtacgccctcccctctgttccttttctctcctattttcatgattttcatgctattttagttagatggaaattagaatttataataatattttttctaaaaaaataaaactaaatcactgtccttttgtagaaacggacgtatgcctcctccttcgtgttccaaggccggtgtccaccctcctttttttatatattatttaaattcaaactagactgaatatttttaaccattaaattattaaattattattattatatcaaatagatttttaaaccttttgattaacaaaatgcactaaaattagaataatttaagtagtttaattagaaaatacagcacccaaagtattttaaattagatctaatattaaatgtatttataaaaatagataactctaaattatagtgcacattcgatctattttaaaaacagtaatctcctcccatcatcctgtctttcgtaataccactctcctcccactctggctcttgcatcctctcctctccaatgcaattatcgtctcttttatttt

SEQ ID NO: 103570 - DNA, 653 bp, Oryza sativa
ccctaaccggtatcgggtgatacttgtcagttattatgcgattctaccacgtatcaggtgatactagcggggtattagatgatcctcgtcatctccactgcaccgcatgcccattcctcccccggcggcgctccaccaccaccaatgcatcggcgccccagcaggaggaggagaggatcccttggagtacaagcagtacatcgttctcctaaggccgcgaccggacgacaacgccgttggcatggacgacgacggcacacgacggagctggcacctacccttcctccccggcaacaccaccgccgatggcaagccgcggctggtccgctcgtacaagcacgtcgttgacggcttcaccgccctgctgatggaggtcgatcgagatggaagaggtgtccaagaagcccgtcttctggcgctgcttcttggacggcatcgctcgcttgcatccaagccctctaaaaaattcattcacttgcattgctggtttaagcaggaaggaggatggcaaccttgcaggatccggccatggcattgcacacgacggcgccaccattctctctccaatccaatccaatccaatcccttcgtctcgcattgttgcggtggacgaaagaggattctgtcccgacgggatcccgttgttagcattc

SEQ ID NO: 103571 - DNA, 1517 bp, Oryza sativa
attcctgcagccccgctgcatattgtcctgtacttcgttcattcgaaagatgctgtttttaaagaaagatgctgttgttaagagatgtatcgtctaaatatgttttatttatagaaccaagatgtccattttgtcataaaaaagttgttccaacacttttaataattcatctaaacaacctaataaaaacgctctcttaatactatttatctgtgttcgcggaagagtttatgatcttgagtgcttccaatactggtattgcgaaaaactggtccatagtaaaatgtgttaacatgttatttgatcatgacttcctgagttcatcgtcatactagctccaagagaaatataagtgttaggtcttgtttagatgcattatcggaatcataggtttacaaaagccttttgtgttgcaagtgtggactggaaagccgcaattttgtgttggttaaaaagtttgctatatagttatattaaatttagctactaaatgagcataggattacatggcacgattctagctatgaaggcgtgtcaccctatatatcattgaggcttcaaaacaaaatgcattaataaaaagttaaaatcattgaacttggcaagattaaaggtaacatagaaacaaacaacccctaacataaatataagactgataaacatgatccataataatcctatacaacatcgggagtcgactcatatgcaccaccagctatcaaaaattcaactcaccaccctaaattacatgaatcttaactactctctccgtttcacaatgtaagtcattttagcatttttcacattcatattgatgttaatgaatatagatattgtcattttagcatttctcacatttatattgatgttaatgaatctaaatagataaatgacttacatcgtgaaacggaggaagtagttttttacgaccatatgactattgcaatttcttagaaaatccctccactgtacaaccgtacttgagttgacattattgcacacatttgaagtgtatacagtgtccatcttagcgttgttccttgatacaacagtcaaccgactcaatccaatagatcgttgctaaatactaacgaatatcctttactttagtttcacacatcctctatcataataacattatcattatagacattgatatatgagataatagtaaaataaaacccacattactataccggtagtaacattacaacgtaacatcctcacccccttagtctcttcggccatccatcgtctaaccgtaaacaccaacgcctgagattaaagaaaaccacgaggaggaaaagtaaccgtaactaccaaaccaccaagcccaatacccataacaataaataattaataaaagagcgcgggcccaccacccaacccacctctcctctcccgcggtcaaactcgtccgggtcaacacacgcgtgacgcgcaggcgcagcgagctcagttacctctcctcctctctcgcgcgcgcttgccccgccatatataccggcgagctcgcg

SEQ ID NO: 103572 - DNA, 694 bp, Oryza sativa
ccgacacacaggcgaattctgaatcctctctggccacaagcccagctagcccacaaccggtcaaccaaaaccctggtcgctttggacagggattgcctctctacgcgcgcaccgccaccagttgttgcacggtgcattcaccaacgcacgcgctcgctggagatatatacgcaccggtgaccggccggcccctgagctatatagcttagcctggtcactgtcttcccggacaatgacccactggaccctcccccgctttaccttccctccccattactgatgaataatggatggatagatgctctatgctttcatgtcgcgcctcagctccattatttgcttggagatgcgcctagcttgatctgaggctgtgtttagattcagggtgaaaagttttgacgtgtcatatcgaatatacggacacatatttaaagtattaaatgtagactaataacaaaataaattatagattccgtctgtaaacagcgagacgaatttatgaagcctaattaattcggcattagcaaatgtttactttagcactacatgtcagatcatgtagcaattagtttttaaagattcgtctcgcaatttacacacaatctatgtaattagtttttttacccatatttaatactttatgcatgtgttcgaatatttgatgtgataggatgaaaaattttgtcgggatcta

SEQ ID NO: 103573 - DNA, 705 bp, Oryza sativa
attcctgcagccctgaaaaaagaatcgtacttgttatttatttttcttttttcaacttgtaacggtagtagtacttctgtcacgtagtgcgatgtactacgactgccgagctcagtaataaaccgacgactaatcaatggattttggagcaatcagtccccaagtcccaacaaaaaaaagccgtatccagtagtaaccagtaatggattttggagtatactgctgcaacaaccggacacaacacatcggtgctcacgagagaaacagtcgtcgtaggacgagtcaccctccagcacagtgcaacgaaagctaggctggtgtcacgcaacatcacagccaaacaagtctcctgtagctcaagccattgcagtccacgggacgatcatacgaagctgaaaacggaatgactatccaacaagtacgtgaaacgcgtacgaacttccactttacgcccagtagcaccgtcctactgtttcaaaggcacctactacctatgtgatgtgcccacagaaccggtcccaaaattggtatgcacggatctgttccttctctctcagcattgatcagctacttgaccttctacatacaaatcactgttcacccttcaacaaaaactattttagttcgatgcattcttttttttatactactcgtataataacttcacttgagtgtcttctgttgtagcctgggaattttcccaac

SEQ ID NO: 103574 - DNA, 667 bp, Oryza sativa
aaaagttagaagtttgtgtgtgtagaaaagttttgatgtgataaaaaagttgaaagtttgaagaaaaaatttgaaattaaactcggctaaatttaggataacccaggataaaccaggccctactctataggataacattggaagatcagagcaaccccacgccacgccaagtcgccaaccccacgctagagctagcagcagcctcctagcactgaagattctcacctcaaatcatgccagcacagcgcacccgcacccctgcgcgtcggcaggcaggtactaggcaggcagagcagagcacagccgagagcccgagacagacagggacggaacctaccatttcctgatacattacccccacatctcctcgcgctgcgccgcggcgtcgaacgtgacgcgtctggatccacgacgccgctgccgctaccgcgaaggccgaccaatccgtacgtgggtgtatggccgcgactccgcgaggccggcgctgcaatgcgttgcggctgcgcgcattcgtgagaagaacatacgctagctcgtgcgtttggtcgcactggagattatggcaacaatggaaggacactggagattattgcaacaatggaaggacacgcttgttcgtcgttcacggataatgctcgtggtttcacgctttcagccgagatgacag

SEQ ID NO: 103575 - DNA, 1303 bp, Oryza sativa
aaaataatttgaatttttgataaattttacatggtttggtacggtttttcacggttaccgcgattactgcgcggtaaccgtgcttacgccaaggcacggtaaccccggcccctacggtttaggaaaccctgcagaaacctcacatcgataaaagaaataggcagaaacaaacgataaaaaatggctgagatgcccaattgaaaacaacccattaagatacctctcaacttgctgtgcacctgttctcagttgaagttgttacttctctgaaacatttatggaagagacaccctatatgaatggcaagataggatacacctagatcctttctgatcgcaaaccgtaccccgaccacgccacatggctgaaaccctactactacaagtggatgtcacccacagacaggcatggcaagtgagtgaaaatggggcttgtccatgcaatgaatgatgaggtttcctcctcctcctctccctgatcattaacacgccattggataaagatgtggcaacaacacacaggttgtccctggaaagaccacagtaacaaatgtccccaaacctctcatcacatcactttgctacttaccagcctccattagtcattcagatggtggaaaggattctcttcttccaggtacagagggagatcatggccaagctggacatgcacaataatgtggcggcttgcccttttggtttttatatggcctagtcaaaaggaaagttcttgcactggctggctggctggcaggcacacattctctcatctcctttggattttggattgccttctttaattgtatgtctatctatctacagcttgcttactttgccaaatgccatgcctttgctttagtttgttcggtggccttttgctaactgcctgcgccagagaagcagcatggtttatgcccatcattagcagcataaacacttggtagtacttgtctgcttttggtttggcctgccgccagcagccatgcaaatgagatgtaaagatgagttcttatgcctaattaggtatagcatcagtgtctcagtaaaaatgggcaagcaaatggctatgggaggtgaaaaatttgtcccgacacagcgccgcgtgaccattaaccaaatgcagagtactatcaagagcaacgacaaaacggaaggagcagatgaacatgaagagtaacatggttgccaatgatgacgacaaaaacgaaatgcttctcttctaaaaattaacatgttgctgaaagagaatccatggatgcaatgtacagacagatatacagatcagcaacaggggctgcaggaat

SEQ ID NO: 103576 - DNA, 822 bp, Oryza sativa
atcatggcagacttaaagctaaagcctaaaaggcctcaacttcataaaagcaagataaagaaaaaatcgtggggctcccatctagatgctctcataaccaacgtcaaattctcaaaaatttgatggcctttaaggactgcaccaaaagttgttcagaagcatttcaaaagggttttaatgcaaaatccgtgtccttttctggggctaaaatgtaaagaactcaacatttgtgaccttgtaaccctgttgcacgaataaaaaaaccagcatcccagtgtacttcacatctccattttttttattcgtgaatgtacttgtctttgttttgtttagcagaggatgcatgcactgttcctcgtctttttgcccgtgaaaacggagggctcatccatcacggttatctcacattctcactgtactctgcaatgtttacaaagctggtttggatgaatgttaggtggaggttgaggcgcttgtgatccaagggcccaagctgggcaccgtcctcagccaggtgaagaagctggatgcatctgtgctggtgctgagccaatgcaagccatctcctttctgctggtaaagcttgtactactacatctaagcatatgcatgcatgcatcacaatccctcatctatgcccacagaatagtagttctgcacaaaggtgaaagagagagaatctttacatagctggcacagtagcacagcccatcgcactgtcaagtcccttgtttctttataagcaaaatgttagtactttaatagctggtcatgtctgaaggttcctcagagtaatattttaacagcttaagttgtgtttct

SEQ ID NO: 103577 - DNA, 1173 bp, Oryza sativa
gcggagcggaaggcgaggacaaagcgtgtggattccccgcgcatttgcgccgccgcggggggagggctgggaaatgctccggattccaccgtacggcccacaccgcagtgacgaggagggaaaggaaaacggcgagattgctaccttcccacgggtttgggccgtgtggagagcacacctggcctcgtcgcggtgtgggcctgatcctacagtatctttggttgcgtgacctgacgcgctgaagtgaagtcagctttgtcctgaccgctccaagggaaaccgagatggacgcagattcagtgacattaccccatgagatatcgtcctcgtaaaaccacaatgctataaacaacatccggatgaaaattacggagttgtttggttggcataatcatattgtcaaagtttgctatacttcatttagctaacatgcctaacatgttgccaatgaaattaaagccacacttcagccatagaagagtaagcttgccacacttttacgtgccaatgacatgtgagacccacatcatcgtgaaggaatcttgccacaagtgtggcacgaaccaaacagatatggctgggcacatttagaccgaaccgacccgaaaaaaccgagatcaaaaaattcgtttacctgttcggtcctagtcatcgaaagaccgaatttatttcggtcaattcagttattgggctcggttaactgaattaaccgaaaatgaccgaaattttggcgcaacaagcgaagcccaataagcccaatagttatctaaccatagaagaagtggagaggcgcacagcattccccatcctctcggcctcggcctccaccatgctcggcctcggcctccagccctccactgctccggcgtcgtctcgccttcgtcctccaccgtgccggcgccacctccgccctccaccgcgcgggcatccatcgcctcgggggcacatctgatggtgcctcctccaccccaacggcaacgagtggcgccaaagccgatttaggatgagtatatgacagcgaagaaagctaatctgggtttttatgaaatttcttcatgtgtatgattttttgggatgagtatatgacagcgaagaaagccgatctaggatttttatgaaatttcttcatgtgtatgattttttggatgagtatatgacagcggggctgcagga

SEQ ID NO: 103578 - DNA, 1021 bp, Oryza sativa
agccgagtttagatttcatccctcaaccacagtaccatatacaatgcatccttcatcttccaaacaggtgtaaatcgaatctctcaccgaaggtctctaagcctggtcctggcttttttttttaattgctcggaccgaaggtactgagctttgttttttggtttcacacttgtaaagtttaatcctcttctattaaatgaaattggcagcttgccgattcgttaaaaaaaactggtgtaaatcgaatctctcaacagtatacaaagcggttttgactaatgtaacacctacatagcagtaggacctggtaattttggtgagtggcatttatatgggtccatatcatcttctctcctctctcctcatctatctcctctttttcttcatctctccggtgacagctctcccccttcagcatgagttggtcgcacgagctcgccaatggagagaggagaggagaggaagagccatgctagcgacaacatcctctttcacatgatggggacggagcggggtgtggggatggaaacggggggagcttgaccacggcgtaggcggtggagcggaggggatggggatgggcagcggcgacggagcggaggggatggaaacaggaagctcgaccgtgttaaaggcagcgaagcagagggaattaggacggacggtagtgggtctccacagcttcctgtgacgccgatggccgcatcccctccacacagcggcgatggagcgaaggggatgaaaatgggggagctcaaccaaggtaggggcggcggagcacaggggacggggatggggatggggtggcgacgagtctccgtggcaacctgatcctccttcggctagcgcggcaaatggtatggcggctagcctgtggctgagctcagcctccatcgacgtcgctctgccgagctcgtccgcttcctcgccgccacctccgccgtgctgatctaccccgtgcggcaacgacgccacattaggaccgccaccacgatctctcccatggcagcaacgacaaagt

SEQ ID NO: 103579 - DNA, 908 bp, Oryza sativa
cgtcgacagatatctgtgaatgcacaacaagtctgcatcacttaagtgttcaaataatcaaaacgaccaatatttttttctttttcaaaaccaaaaaaaaacttattgcttgggtgactgtcggcagagaggctgaagatgagatccattttcattagttaattaaatcaaaacgaccaaacatagcaagaaacaaaaaagaaaagaaaaagaaaagaaaagaaaagaaaatgaacatctctaatcatttcaaacttcagtggaacagaaattctaaagctgtgggcatgtcaatgatgctatcttgggcacatctctctgatggaccattatcgttgatctgtaaagataatgtagctaacaagaatctctaataatccacccaaaggaaacagaacccgctacagatttgatcacgacattatccattttggcgtatgctgaagcttgcacacacatgacacacgacttctcagcacctactgctacagctgctcgtgttttgcataaaaaacttcagaaatctcagtcagtacgatgtagggcccagttgcactattatcaaatcaataatgcagtcataaaaaataaaagaaattgttattaatgatgcagtttggttttgggtcccgttctgatttgaagaccttttcttggtgataatagtatactgacatgtcctgtagcagatgtttaattccatgatcaaagtgttgccacgttaggtatgccatgaaacttctctagcatacagtcacgactaggaaattaaaccacagcattcgtcataaatacttgatgtatagcgaccagtgagtcagcgaccagctagtatggaacttcacatgaacaagatcagccggatggctttgccttaacggcacgagctatccccatcaggcagtaaa

SEQ ID NO: 103580 - DNA, 673 bp, Oryza sativa
ttcaccccagtgcttaaaagagttccccccccccattttattgttgtacagtagaattgtgaatcggagtcagtgcttcattcaacataccattttacatttctttctcaagtgtagcatctcaattgataagaaactatttttgacttcttttcagtaaataagaaacaaatcagtaggtgaacttacatcaaactgcttacagaaatagtgacattcctgcagttgcagaagtagtaaacaaaaacctactgtccatgcaactgagatgctactgctgaactgcattacaacctgaagactcttttcgaacatatacagaattagggataaaggacttgacaatgtgattgagcacaactgcacaagaaccctattaagtcctaatgatttatctacagacatgaaccctgctcagctcgggagctagctttcctccattgcttgcgtctgatcggttgcatgctagcgagccatcaagaactttgggagaggaagcatgcacggctccggcgcgacgaaggacggtccggcgaacaccgcgtgccgtggcttgctgatctccttgttcgtcgtcagcctcatggtcatggcggcgttgcggtcctcctcgccgtggagcgcgtccgcctgcagccacggcttcttctggatgtcccagcgctcgtcggag

SEQ ID NO: 103581 - DNA, 655 bp, Oryza sativa
tgtacctacatccaagctaagtctactgaacaatcacatctaatgcaaaactcaaagcaccatctgaatctgaataagagatgtaactcattctatttgtagtactaaaatgagtcaaatctctctaacatcccgtatattatgggatgtatgaagtatttatcgtatggttcttgtgctcgaaggtgagatgagaagacgataacattgagatgatttttctctcgagaaacattgagatgattaaaagaggactaaaggataagaagattatatgtaggtaaaaaagaacttgcaaattatatataggtagtagggaaaaaaaggaaacccaattaatatatatcaacttcggatgaagattcataaataggattcattaaattgtggtttcttttattttgtgttggtgcttattaatttgtgcttgccgtttttgttaaatttcggtgtgttcatgtgaaccctttgatatgtggtcgcttttgaatgaatttgtataataattgattgtaacttgttgagcgaatgtcaaaatttattccattacaaagaaaaaaaactatgctgatcgtgaactgttgtctcaaacactcagccaccgaaccgcttccaggctcacagattcttgggggaccatataaacatgcatcta

SEQ ID NO: 103582 - DNA, 3742 bp, Oryza sativa
aatatatttttataggtatatattttttatgtatacaaaaaatatacacatatgcatcctttgtatacgacatgtacaaattttgtacaaattttgtatatgatgtatacaaactttctatataacgtgtacaaactctctatacatacatattaaaaaattgaaaaaacaaaaaaaacatcatgtatattcgaatacaaatgtacaaactttatatacgacgtatataaagtttgtatatacgtcgtatacaaagtttgtatacacacatacaaactttttatatgtatacgtatatactaaaaaaaccaaaaagaaaaactggaaagaaaaaaaacgaatggaaaaccgcaaaaaacggaaagaaaaaaaccgaaatcagaaaaaaaaaccaatggaaaaaaccgcggctccaccccgacacgcgctgccgcgcggcccactctacgcgcgccttgtgccttgcagcgcgcgggggtggggggggggctgatcgcgttttagctggcgagacccgtatacctgagggactgtggtgaaacggtgaaatattgaatccttcagctactcgtagacccatccttttattgatgcggaattcagatagacaacctctttgtaatcaggggcggatccagcatggggggcggggtctcgagcccccactactggcgtgaagactatgagagactctacgaaaacctcactaaattttttgttaccatatttagatgggaggggagactgtaactctatttagtttgctcagaccctattgctatttctttctggatccgccactatttgtaagggtgaaatccaaggaattcaagatggtcaccatcattaagactgttgccttgattgtctacaatgttattatcatcatcagaataccattcgaaattatttccagccggtgattcaccattctgaagaatgaaaattagcgggatcatattcccaattgtataaatcccactcccctagaaacttttggctataaagataatagttaatatcccctaaaatccacggtccataaacttgtttgctatggttcagacaaagcatagggcttaaggttgttttggtgcttcaatacccacttaaactcgccacacgattcattaaggacccaaattgaaaggcaatagtcagttttaagtgatgcaaggtacatccctttctctgattttccaatgtaaatatatggtctgctcttgtaaatcccagtaggatttttgattacttggtagatcccattagatatactaggtgattccccgcgttttgctataggaattactaattaattttcaatattatttttcgttacaattgagctagtagcaaaaaagaaaaaaaacaaatcttaaggcttatcagtatttatcatgaaaaaaatgaaatttactctttaatgtataacatattgtaagtatgcttgcatgaattattgctagtggatgatgtggcatggttgtatgtcaagctttagagttagtgggttataactttatagaaagtatagatatggatatcctacgaaggaaaaacacaaagatctattatatagtaaaagttcattaaacttcctacaaacgctcctaagctactacatagtaccttaaaaacactcttaagccgccacatggcatttcaacaaattctaaaaaagacaaaatatctaaccgtcgattttcatttaatctgatggacccattattttcaaccattagatctatcttaaattaaaaaaatatcaattaaatttatcttcatcaatcctacgtacacatgcatgtaagcacaacacgtacgagaatgatacctagcgatcgatcgctaggggtcgctagggggcaatcagattctgattccctctctccacctggtttctttttagataccatattacttttctattttagtaaatttatgcaccctaaagtttgtacacctcaagtttacacattttcacaagcattttgtttattagaaaaatttatgtatagaaatactatatataaaaaatttgaatttaaattcaaatttaaatcaggtatgtaaacttttgacttataaactttgggtctataaactttagatgtatagaaatactatatatagaaaatatttgaattcaaatttaaatttgaatcagatataattcaaattcaaatttgaagcgggtctataaactttaggtttataaaatttaaatgcaaatttaaatcgggtatgtaaacttttgacttataaactttgggtctataatgtatagaaatactatatatagaaaatatttgaattcaaatttaaatttgaatcagatataattcaaattcaaatttaaaacgggtctataaactttagatttataaactttaggtgtataaactttaggtgtatagaaatactatatataaaaatatttgaattcaaattcaaatttgaatcggatatataaagttttgacttataaacttttggtctctaaactttagatgtgtaaacttgaggtatataaactttaggtgcataaatttactaaaatagaaaagtaatacggtgccaaaaaagtaaacaggtggaggaaaggagggggatcgatcgctacccctgtcgccgggcgatcgatagcccattaggcgtaccccaacaggtacgtatgtacgtaactagctggcctcatgtccctctttttctttcctttttctttctgaaataaaaaaataaatacaccgttaaaaaaccattagatctatcatgaaaaaacaattaaatttaagtctacaaatccctaaatacacgtgcacataaaaaccgtatgtaagtacgtaagcacaagcactttggcctcacaaccctctatttctttctttttatttctgaaatccaaacaaacataaatacaccataaaaaaattggattcagctcaaagctatatttaggatctaaaattaaaattctaggctcctttggattataggatgtaaaaacagtatgcaatttggattcctattgattcatcgctatattatcctttggtttccacaaatattagtaggaattacacgaatatgtcataacaattctgaaggaaaacaaatccatttcccaccgataccatgcaagaaacacacaaaaatttaagcccattaaacatcatcaaaacgctcctaaattatcatatgacatcctacgaacactcctaagccgctacatggaactttaataaattataaaaaaatcatataaaaattataataaaaaatgcttagttatctgttataacttaaatcggttgacccattattttcaactgttagatcaatcgttcaaaaacacaaaccccttccacctcacacctcccttatgtacataatcactcgtccctccccaacatccatatgtacaaagcatatatcttacgtacaacagtcaatgaaccctgagttctacaagacacttaaggtagttttttggtccgatctttcggtgagttgtggataactacaatttgagagaaatgttgacgatccgactacaaccgtacaagacgttgtgttgcgcctttgcgatcgatacacctctccgtgggttactgatcttgccggtacagatcaaccttattcctacaagcaaatcgaagaaacaagcaagaacaagataaagcaatctgaattgcagacaggaatgaatacacacgataagttggggtttcgaatacaagca

SEQ ID NO: 103583 - DNA, 694 bp, Oryza sativa
gtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcagcttgtccaccttccaacggagtttcttccaccacggcatgacttgactcccccgatcgatcaacacattttgtcttctgcaccactattgccaggctatagcctttctcccttactttactaacaaacttcctccaactcccagttgacgcaacctccactactctccactgccatccatgttgacccctcactagccacacggcatttatgataaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtacta

SEQ ID NO: 103584 - DNA, 621 bp, Oryza sativa
atagggctccatatgtcactgccaattctaatgctttcccccaagaaaacagaaggggttctgatgctccaatgtcccctaggtcccagcatggtcctaacagtttctctcatgatactgctggaggttcaaatgtttctagaccttactcccaatatggtgcaacagttccagatacaggtgaaggtcatataatctgaacattaccaattttttagtgctttcttgttcattcctagtttaaatgttattttcagatacagcgtccaggagggaagagttcaatcactctagggagagaaaatcttcagttagtggttccaattggaatatagaattcaaggatgcaacatctgcagcacaagcagcagcagagtccgcagagatggctagtattgctgctagggctgctgcccaacttgctagtcgtggaaacctttctgcggagcaaaatactggagcttttgagtcacctgcttatacccatgaaactacacccaggaagcaacaagctgaacatttaatgaaggatgggcagaggagttctaatgagcagagttcaggggcttatgatccaagactcatctcaagtaatgatgctaggaaggatggggggagaac

SEQ ID NO: 103585 - DNA, 653 bp, Oryza sativa
caaaggaaagtcacaagaagctgatctgaatacagtttctgtcacaggaaaggaggaaaacacagaaagcccagcagaaactccgaaagaaagcacctcaaaaactgctccgtcgcatgttcaccccaagcttccgacagactatgattcgtttgctgcacattttatgtctcttcggaccaatcgccgctagttttatgatcgcataccagttgagttttacatgtgaagaagtcgtatttacaaacacagggatacatacattctatagcttcgagttgacatttgtacagtatatcaactcatagcactcggtcttatatgttggtctttttggcgagctattattctttcgttctattttggcctcatgttcatcacatcttaggtattgtcattatgaaaggattgttagcgtgtaataagcacattatgcagtcagatgtacagacgtttacagaacttaagaggtttaccttttttcatatattctgtttgaaaaaggaacctgtttccatatattccataccatcccagctagttgctagtacttactacatttgttcaacatgagttttgattaacatatccagctttatctgtccagctagtttttgttgatttatgcaagccttggagggggctgcaggaat

SEQ ID NO: 103586 - DNA, 610 bp, Oryza sativa
tgagaaattgtctgtattattgttgagaatggcagtcgggcacgacgggcacgagtagtgactacccatacccatgcccacgaggtaatttatgctcgcgggcatacccgttactacatgatgagcaaggaacactactcatgcccgttacccgcgggtgctatgtgcccgcgggtatgcccgtttacccgtcacaaactcacagttcaacatttcaaccacaaatctccacaagcagagagacattatcgcaatttaaagaaagggtacagttgtatcaagttcaacaatacaagcattacaagttcatcaatactagatggtggcatttatactaatttgaccgagggaccacatatcagttggtttttgcgggtaaatgggcgaagcgggccagtgcccgtatgcccattgggtataggttttgacccaataaaaaacccactggtactaaatggagaacaaacccaactttattagggtttttacccacgggtaaacgggcaaacggtttaaattgtcatccctacttgagagaacttgtgcagagtagaagtgaattggatggaatcggtaaaaaaaaaattaattgaacaggctgttgggcagt

SEQ ID NO: 103587 - DNA, 563 bp, Oryza sativa
ttgctctgagctagcttgctgtgctccgtactcgactgatgagatgttttgttttgaagctttggctgtgtcgaaacgtagagaggcgtgtgggttatatactgcatgccatggactaaatgtgaggacatgtagatggaaattaaacttgattttggattaagatcacattttattttttgttattcgattctgacaatatataatgattagcccggcgaaagaaatgatagcatgtaacgattgatctgcatggcacttttaagagaagaaatcacatgctcatgatccgcttggtgattagttaagaatttgtagactataaagtatattcaggatgaagatatatatgcagatttgccagaacgtgctgcccgtgtctgtacctaacggcactgcaataccatgttgggcagatgatttttttgccgatagggctacccctactacgaaagtgatttttgcacacggcccaaaagagattttcgtgtgcagtagggtagcccgctcgcactaaaagatctacgaaaatagctatttttgcgtgcaggagtttgagagaa

SEQ ID NO: 103588 - DNA, 1220 bp, Oryza sativa
aacaaaagcaaaaccctatccacttttttctttgttccgtaactaccctttcccacccccaccaccctcggcatcgacaacaccacaacgcatcatcctaccgcatcaccgtgccgctccccacgctatcctgtcgcgcatcctaccactcttctgtactgctacgttgtgtcgtgccgccctgcttctccgcaacgatgcctcctcaagtggagatctagcggcactcatgatatggagatctagcggcaataatcgtgatagaggaaagcgcaggtgtaggaaaaaggtgaaggagagaaacatgcggacgccggcgaaaagcaaatgttttttttgttttacagtactgcgattttttggtttgaaattattgatgactattgttattcttttgcttctcaaaatttgttgattatcttcagtcatgacagatacggaggccgcattgctcggtgttggccactttttgaatgcatgtagaccaaggaaactttgatgtggttttcttgatctactcatttgacaatggctagaaagtatgtgattttcattgtacttgtgtaactcagtaaattatttattatataaacacatacaatgtaggagactctccttaaaaaagttttctagatcgaaaatcacaccaagtttattttgcagcaaactaataaaatcagaacaaatttaccacaaatatcacacaagagcaacaataattaaaacagaaacacaaaagaaacattatccacaatccaaattgagaattcagtgcctcccatattaacgaaaagcgcacgtgtaaacgccacagacgtaggcacatgcacggggcgcctcttaatgcttgggagggcagatcgctggccggaaggcgagcgggccagcggcatacatgacgttatcgtagccctcgccagtccaccgtttgccctcatcacggagcgacgcgccctcgatgctggagtaattgatgtttgtggggttgttgcacttgaactccggcgacgcctgaagtcgcacgtggcatgccttgctcggatcgcccatgaagaagtcagagactttggtcacgccgagctccgtctggaagtagccgctctcgtcggcgatggcccgcttgcactccatgacatgattcttgacgtcgtggcaggtaacggacacctccgccttgggcagcggcatcgcgccgttgaggctatgcgtgttccggtacg

SEQ ID NO: 103589 - DNA, 840 bp, Oryza sativa
tttagagacccaaagtttataagtcaaaagtttatatatccgattcaaatttgaatttgaattcaaatattttttatatatagtatttctatacatctaaagtttatacacctaaagttagtttatagacctaaagtttatacacctcaagtttacacatctaaagtttagatacatgtttcaaatttatatttgaattatatctgattcaaatttacttgtttcatatttgaatttgaattatatccgattcaaatttgaatttgaattcaaatattttctatatatagtatttctatgcatctaaagtttatacacctaaagtttatagaaccaaagtttataaacccaaagtttataagtcaaaagtttacatacccgattcaaatttgaatttgaattatatctgattcaaatttgaatttgaattcaaattttttctatatatagtatttctatacatctaaagtttatacacctaaaatttatagacccaaagtttataagtcaaaaagtttacatacccgattcaaatttgaatttaaatttaaattttttatatatatagtatttctatacataaatttttctaactttttgttttttaaaaaaaatttgtgtggtgtactgtagtaggggaggagggaggagtgtatctagtagtatagggagggggcgggcgggtgatcgctgggcgggcgggggagcgatcacccgcccattagcatttccgagattgcatgcattagcaaacattgatgtgtgggtcctgttgacagaaaacacgaggcctgggagatctgcttaacttcagtgcaggtccaaaactcgccttcgggt

SEQ ID NO: 103590 - DNA, 671 bp, Oryza sativa
caaccatataattgcgtcagggctgttctccaatttgagaattgagtatcaataacttagctatagcacgtattactattttttttccctaaacgcatgtaaaatggctgtagaaatatcaaaatgatcaaactaagcctccatacacaactttatacaccggataattacaagtcaggataggcagcagacaccagatgctcgtaatctataattcataggctcatagcgaacgacgagcagatgtgcgtgttcaatgggattgggagggcagcatgacgctccatgttgaaacttgggacgctcaaacgccagcaggatgatgtcgtggtgggagtctaaccatttcctcgccagcaggatatctcgtgtccaaatccgctgatctgtccctccacgtgccaatcacgtcctgctcgcacaaaatcacataaaccatgcattgctttattaataaacatatgatgcagcgtgcgaattgccacctatggtctatgctatctactggtaaacactggcacaggtgactattatgcttcctctatttcaggttataaaacattttgactttagtcaaaatcaaactgcttaaaatttgattaagtttgtaaaaaaagtagtaatattttaaacacaagacaaatttattatgaaaatatattcaattattg

SEQ ID NO: 103591 - DNA, 596 bp, Oryza sativa
atgagaatacgattatttcctcgcaatctcgcatcgcgcacgcgcgcgcgccatgtgttcggctccggccgtttcgccggctcacggcgtacctaaccgcgcgcgcgcggccaccatcgatcgatcgcgactttgcggatcgcgcgagcccccgtgcctgcgttgcgtgcggctcgatcgatcggcaggtgcgtggcatgcggtacgtgtggctctcctgtgacctcaagctcaacggtttgactaatcgatccaagactctaatttatgtacggacggatttttccatcgatctgcttgaaaaaagttctggaatgcatgcattgtacgtcaagagggagattgtcaaggatatgatctgacgtgtgttcttgctgtggtgttacgtgttaacgttcgttgagctgaatatatgtatgcatgaaaactgaatcgagaggacagcaacacgaaaatatttgggttgtggtcgggacaaagacgtacacaccagctggatatcagagtatccacgcacatcatttcatagtatttcaatagatatactagctcttcgctgatacgcacacagtttattattcaagttcatggggtca

SEQ ID NO: 103592 - DNA, 619 bp, Oryza sativa
gcgcgccacactagcgttttcgcttttcgtaaacctgctgcgcgaaattgggttaggcatttgaaataaataaaaagtatactttgactcccttaactattatttgagcatgattcacgtccttgtcgacgtttgatatcgtgactacggaatttgcatagtatggagattgttagtaccagggtatatgcgagattgaggtaaaagagatggagatagggattttatacaggttcgggccccttatctgacaggtaatagccctactcctgttgaccgaagccggtgttgctcttattcatcataatcacatcagtacaataattaggataacttatgtagccgtcgttgacttagcggcatggataaccaacacgtagtcgatgacagggtagtcatccctcaagtccgcactcagcgagatcggagatagcactagtccctcttgttggcctctgcagataccatattgggtttgtctaggctatatctcatgatatctgatatccggcgagcttgttcatggcacatgttagcttgtgaatcgtgtgtcgatatgttgttcttgttgcttgtcccatctcctcctagcgggcttgtatttatacccataggtgtc

SEQ ID NO: 103593 - DNA, 618 bp, Oryza sativa
atttcaacgaaatctctatctctatctctactacttaaaaaataagatgtgcttccatcgtccgtaaaaaaaaaccagacgaaaaaatccatccgatccaaaacaaacgggctaaaaaaaccggacaaaaaacgggcaaaaaagaaaagaaaaaccaaatctgtcccatcaaaaaagggcaaaaaaaagaaaggaaaaacgaatccgattccgtggtaaaaaaaagggagaaaagaaataaaaaaggaatctgtccgattccttaaaaaaggggcgcaaaaaaaaccaggtgaaaaaaagaccggccaaaaaaaacgaatccgcgtggatgcggtaaaaaaaagagaaaaaaaaaacaaatctaaaaaaaaagaattatatgtggtgcagtaaaaaaatcgaatcctattatatttgacatggtactatatctctattttctctatctctactacttaaaaaaattaaaaacgtttccgttgtccgtaataacgaaagaagggcgaaaaaaacattaaaacagaaaaagaaagttcgattcaatttacttccattgtccgtaaaaatcttatcttatcttaatctcaatctttccaaggggacgagcagcaccctcca

SEQ ID NO: 103594 - DNA, 715 bp, Oryza sativa
aaccgagactaaaaatgatctactaaagatcaaaaagtacccctcaacttttaaactggaactaaagatactttttaatcccaggttttattagaaccagaactattgtggaatttgaccgatcgagcaaagatggtttctctaccagagtcatctggctcacattatccattacccagtgagtgcacaaaatttcttgttttgttagttttctaggaaatgattttttttaaaaaaaacaatgtccatgttacagttgggagctagctaacttagctggaagctaggttgcaccgagtgtcacgctaagatctacttcaccttcaatttatttcctcccctattcctattatgcctcctccataacaaatttatccatccaactccactcatcttgtcatcgcatataaagataaagaaaaattgtattggtttatctgtgcatgtattagaaccgcatgatgctaacaaatatatatctctatatacctaataaaaaaatacataataaaatatacataaggctaataaaaagatacataaggcttctcggtatttttccatccgtattatttcgccgatccccccgcttttttttcatctacttttttcatcgcagttttctcttcacatgtttttttgccattttttcagggtttttttcatccacttttttttacatcgcggtctttttggcacgcttttttttcatccc

SEQ ID NO: 103595 - DNA, 781 bp, Oryza sativa
taactttaatcctaatgcaatacttcaggcactggcaacccactgttcccagatgttgctctactacgtaccaggacacggaggacttaagtgatctcgagggctgtcaccacctcaaacgtactgtgggatacgcatcaattattggataataattacctaaacaccacgtctaagaaattactatctactttagtgtttataactcaccaaagcaatcactatatttttgttgattatagtagacaataatctcgtatgctacttaggaactaaccaagagttaattctcacaagataaatctaaattactcaagaagaatattatattgaattcagagtaataaacataataaaagaattaggagaagattaccgacaactccggaattcttctgactccttatactctactctactctcttcctattctagtatacaatatagtacaatagagcctcttataattcagctcaagcttggaagtgtgtgagtgaagtgagggagtgatgtctttatatacgggtaggtatgacagttagcgaaggggaaatgttcgaagtgccactcaaaatagcacgaaaataacacaaacaaaacagcaacaacaacaacttcctctcttcccttccttttttttttccttctcttcacttatgattttttttttgttttctttctttttttttgtacagcaagctcaaagcttcagccaacaagtcaaaacaagccttagcaaaataaccttttctcaaacattttcgaaatttcacaagcttca

SEQ ID NO: 103596 - DNA, 669 bp, Oryza sativa
aactttttagggattggttcacaaatttctatgatgggttcccaaggaataccagaatttggtttgcatatgaagaattttcaaattttgagctcccagccgattttcggtttaataagagcaactctgaaaagtttgataaatccagtgaagtgttctcaacagccatcactccttgcatactcccagttggcatccatcaaggcagaaacatccaaatatcttatgagttttaccatccaagaagtgcggcaagacaattagggatgggccaactaccgattggtctgttctttgccgataagatccaaagcaggggagaaatcacatcagctctcatgatggatcggctgctgaatataccaagacccactctagggagtattgaaaatattgagctagctgtattatggactgcggcatttgaccgatggtggatagaatggaagaaacatctgttccatcagtcaacttcaatgtacttgaacgatttattccctgaagcggtccttcaagtaagtacttttatctttgtcaatctcattaatcataagccaatgcaccatacttgaccattttactttctggtccgcagacaacagaatcctctcctcctcatcagagtgaaagtggtttggagatccattatgcttcaaggatccttcccaa

SEQ ID NO: 103597 - DNA, 635 bp, Oryza sativa
tacgaagggtgtgtttgatataacatgaactaaagcggtgaattttttatacttatgaatcacgtgatatcataggcatgttttttaagctcttacaataattttgtaaaaactttcttcattagcatttcttaacccatcaactttatcgtctatgttctcgaataattgccataagctcgatttcatcaatcacgcatcatcaagaatgcactctttactggaacccaagtgaccaaaatagatattctctcgaataattatattaacttgaataattatatcaagagacgtactccgtatcaagtagtaatactcaatttgatttataaaaatagttatcactacatttcaaagctaaggccgtgtttagttgcaaaatttttctttaaacttccaacttttccatcccatcaaaactttcctacacacacaagcttccaacttttccgtcacatcattttaatttcaaccaaactacttttgtgaactaaacacgacctaaatagacatagcacagtgtacaaggcatagcaccataaatggagccagtgctcagtgtagaatactactccactaataattgtgtgctgtggagtactactaaattgttgccacttattcggcatcaatgc

SEQ ID NO: 103598 - DNA, 621 bp, Oryza sativa
gaattttttgggttcaaagatgaaaatcgaattcatagacaaactaagggacctgaactgaacttatatctaaaagaaacccatacaaagttttgggttgggcataaattagtaaaaggccgaaatgaaatcaataaaccttacgcaggcccattttgaaaaagaaaaaagcccaccagagcacgtgacctcacaggcccatatactccgataatcccctatactccccaagactgaatggaaaaagttcatctgaggtcccttaacttatgaacgagtccgattttcgtccctcaactgtcaaaatcagtgcaatataagtcccatggcagtttggacggcggttttagctgacgtggctaaatatactcggtcttcatctgatgtggcattgacgtggtaatttgatttggaaaataatacaactatgatcccacatgtcagttaaaaaaaataattaaaatgatgtggcccacatgggccccacatgtcattctcaacacccccagtttgagaaacatacgcgtgaaaaatgagtgagtagaatttgggaaagtggccaggaagaacacagcctatatatgtgccaagatataatgcattggattattaaagaaatat

SEQ ID NO: 103599 - DNA, 552 bp, Oryza sativa
taatcttagtttagaaaatcaccggctgcactactgagattgaatgaagtaaagctatcatactatgatgcatatccctattggtgcgagagaaaaagataactcactttacaaataaacgaagtcagtactgatataggttctatactaactccgttataaaattatgttcatctttcaaccatcccacatataccaatacataagaccctcgtcgactacttatattccctaatgaatgaaaacactacattaccagaatataaagccgtttatagacaaaaattttatatattatgtcgtaacgactgagaagccaacggaacaaggacatcacgtcgaatacatcttcgcataaccttcaaaatcaagctccatagttcacatgctagtgtgttcttggcttatcatgctatctcatggggctctaaaatattcatgcttaccaaatctgaatgatactactttatattctaatcttgtctcaatacattaatacctgactatgatatactatgatgtagtgtgaactccaaaaataaatttattaac

SEQ ID NO: 103600 - DNA, 994 bp, Oryza sativa
cccctagcgatcagccggtcccccctccctccctccacgtggttttcttttttggcaccgtattacttttctattttagtaaatttatacacctaaagtttgtacacctcaagtttacacatctaaagttaagtgacccaaagtttataagtcaaaagtttttatatccgattagaatttgaatttgaatttaaatattttttatatatagtatttctatacatataaagtttatacacctaaagtttatagacccaaagtttataagtcaaaagtttacatacccatttcaatttgaatttgaattcaaatattagtttatagacccaaagtttataagtcaaaagtttacacacccgttcaaatttgaatttgaattcaaatattagtttatagacccaaagtttataagtcaaaagtttacatacccgtttcaaatttgaatttgaattcaaatattttatatatatatatttctaaacataaatttttccaactttatttttttaaaaaaaattatgatgtagtaggaagaaaagagggggaggaggaagggggagagttgggagcgtatagggggaagggggaaggggcgggttgatcgctccccgcgatcacccgcacattagatttaccctgttgcatatactagggtgatcgatcatctgccgaccttcgttagcctcgacactcgagttttggcaaaatttaatttgaagcaaatggcgtgcacaaccacgtgcgtacgtatgcagagctcgctgtgcaaaatgcggctgtccagtaagatttgacgcacgcaaaacacaccatccattgacaattggatggaataaatattatatatactcacgtggtacttatctataattggacgttttcttgtgtgcagatcagtgcatgttagcgtcgaagttaccgtaaggagtgcaggggaaaggttagtttctccacaaaatctggggaagatctaataaaatatgcaaatgaattt

SEQ ID NO: 103601 - DNA, 574 bp, Oryza sativa
tgggttaagtattaacggtgtaatgcatatttatataaactattgtatggataggctaatagagttgttgtagatgacgtgttaattttatagctagaaattggctatactattaaacttattttaagcacatgtggagaatagagacaacgaaaaacaagaaatgtttcacatacaagagcaaatgcattgaatacagaagtgagagaaaaagtgagcaaaaaatcatgagctggctcttgtcaagcttgttaacgtatttatatcacctttataattagtaatttatttgtttacaacatataaacttaataataaacactagtgaagaattcacaaaatacaaatagttttgatgtaactaatggactagtcactactcgctagttaagaaacactaagtatatatgaagatgtggtgatcttttgtagtaatgagcaactcacaagctagttcattaagctcaagagttaaatttctagcttggctcaactcattaagaccatgggtttgagtcaatcagagtcgagctcagtagctcaccatgagccaatccaaaccacgagcttcgag

SEQ ID NO: 103602 - DNA, 702 bp, Oryza sativa
ttgcagtctatggagattttgggtgaatcttataggaagcttactaaagacctaggagtatgacttatacgctccacccaaggggtagtctacagtcggtctaggaccagataagactctgagtgaaacttgcttgcacaagacttgcaattcaaggcgtagtccattgttcaagttgtgagtaagtgtagcttggagttctaaggggatgttcaaccttaatcggtctccatcgaacagctggtatataaacagtacattggaaaaggcaaatctacgagggattttgagatttggtgggggattgttggaattaatagatgggctaaggcccattcgaagattaattctttggaaaatcacaaaaacccacctcatgggatggcatgcatgtggagtttagtacaaccttgcttattctaggagagggggacctccttaaaagggaggatgccctcctagccacttgaagcatgtgtggtggagagaagaggggaaacacgcgcgcgctcactcgcctcgcctcgcctcgcctggcctggcctggcagggtagggcaagcggcgcgtgtgcacgacgtacgcgtcgaatggtccgcaaaattggctcctcacccttgcgcagatgcagcctccttttgcagttttgttttgctacgggaaattcggatttgttttgttttggaaacatttcaaaaaatcc

SEQ ID NO: 103603 - DNA, 733 bp, Oryza sativa
taaattactttttagacatataaaagtaaatttaataaattctaaaagtaatgaagtaacttgagacaaaaaggaagtaactttgtcgtcacattagaaattaatccgttgtagggataaaaacataattctatctagaaactaaattaatcagcacaaattaacgaattgactaaaaacaataataaaagtaatcacttcatagcattatgaatgtataggaagtaatttaatcaaatctaaaagtaatttatatatatgataaaagtaacttagtatataataaaagtaattttcaaacatttttttcatcataatataatcatgtaagatcatgttgtacagatttaattgcaacaaacacaacgatgtaatcggatcgtatatcaaataagtaatttaagagaaatttttatttgaaatttagatgggtaatgaggatgcaaatggcaggtactactacttttaggtgctactacttttagtaagggcatccacaatgtagaaataagaggggtctttaagcctccaaagaagtctatatacattgtggaagtggtctatatagaagacatttggatgagctatccttagctataaagaccggccacaaggattaaaaaattggtacatcctctccaattctggtacttgccgctatgagaagaaagaggaaggcgggaggagcaccttgcagccgctgccattgaagccatccgtgagcgtagacgtg

SEQ ID NO: 103604 - DNA, 1044 bp, Oryza sativa
attcgactccagttctgattcggagttcgcagatcgcacccgccgaaataccacagaagaggtgaacccgcgcgactgagattcggattgcagactaatgggccgggctttccaattcgtggcgctgtggaatcaggctcattttcgtacaggcctctcctttgagaggccgtagtttagcccagcccgtgctcggccacatttcgccacagcagcggcagagtcgcggcgcgagagctaattcgctcctccccacgccacgccttttttggcctttttttttttttttgctttttttccctttttttctgattacgtttcttaatctttagcacacatgttttttaaaaatattttgatttgaaagttttaaatcttgacttaaaattttttcaaatcttaacttaaaaatttttaaatctcgagttgaaaagtttttaaatctgagttgaaagttttcaaatctcgagttgaatgttttcaaatctgggttgaaagttttcaaatatcgagatgaaaatttttcaaatctgagtgaaagttttcaaatatgggttgaaagtatttcaaatttgagatgaaaagttaaaagtttttaaaatttgacttaaaattttaaatttcgagttaaaaggtttcaaatatgggtttaaaattttaaaaattcaacttcagttataaatttcttttcaatttgttattaaaaaaaattgcgaaaaagaaaatcctaactactaccgttattaccttttaaactgtaattatagtcttgtagaactagccaatagttattttgagagttattttttttagcacaaggaaatagccattcaataaaatagctctaaattgtttggatccaagtgttatttttcagagctatttggcctttaatacactttcctattaagtgagaactgagaaagagaaaaatactttttcagtgagccccaccccagatagcaccaattagcaccctttaaagggatagtttttttagtaggttatttctaaatagacttgaaatagctcatctgtttaaaa

SEQ ID NO: 103605 - DNA, 703 bp, Oryza sativa
catcatcgtgccatattcgacaaagccatcgaagcttcctcaaccagaaccgctagagctcctcccctcaaagccgccgccgccgccaaatccagctccgcttgaagccatcgaagtcgaatccggctcctaccaaagctaccacttgctctccttcatccgaatccagatgtgacgacgagagagggttgtcactgctgacgcccggatcttcctcctagtcgccgctgtcaccgccaccatcgccactgccttcgtctacagctgctgcatcgggccctcttcctctcccttctttcgtcagatccagagcccaggagctcgatctagtggcctcaggcttctggttgccggatccggacgcttcctctcccttcttccatcagatccagagcccaggagctcgatctggtggcctcaggcttccggatccgaatgcttcctctcccttcttccgtcagatccagagcccaggagctcgatctggtggcctcaggcttctgattgccggatccggacgcactgatggcggcgaatcgtcaggatcccgctactgccggatctacgccctgccaccgcggcgtagttggctgtctcggcgacgaggccacagtcacctgccctctttttccttttatttatttgctgttttttctcaccgcttggatgaattaattgaacataacaaagttgatgcaatact

SEQ ID NO: 103606 - DNA, 563 bp, Oryza sativa
gaagttatatggaggtgccaatgtgaaaggcactctgaaagggaagaaaggaatctcctgcaggctttggtaccttcctgcctgtagacaagtccaacagaaaatgtggattagtgatgctgaaataacgtttagttgatgtcttttgtcacaattcacgcatcatattggtaacgtgccgtttaatgttgacgtgtgctttttgaatccactgcaagatgcttattctttatctttgcttaaagtaaacatatcacatttatggcatggctactctagttcttcactccttcagatcagacatgcatgcatgatttgattaataaagcgtgtatatttattagaaaatcaacatttgtaacttttttcattaataatgaaactaacaatacaaatattttagtgctaatataagtggtactactgtattcatatttgaaaatatttttgtatgatgttaatttcagtagttgttaatgatgtataattatattataaaataaaataataatcaaagcaaaatgttggagaacaagccaaaaactaataagccttactactat

SEQ ID NO: 103607 - DNA, 630 bp, Oryza sativa
tttataatgtttgatagtctaattaggacggctatagattattgacgtctatttatttttaagtagtcattagatttttgtttattttaagaagcacatcaagatacacgtacagtcattagtcaaactcttgttgaacagtatggaaatgtccctcaggttctcatgcaaagattgccaactaagcacgcccacatttctctcccaatttccataaaaaatactttttttctcccaagcttctttgacattaatttattatactgtaaattataatatccaatgaatggtttgtgcttgacataatgaaaggtcagaatccgagcaaatatttttccttatctactgacccgttgtgataagaaaagaatttgaggatatctaatggccggaatttgttctttgtcaataaaagaagcacgttcagaaatgagcttctttcagtcagaaaaatggtactactaactgctagctagtactagcgtgcgtgtcaaatatgaattcacgctccgatcttccaatcctaatcagtaatttgtcacgcaatcttgcttcaaaacaaccggccgtaccgttcaatacggtgcatgcttgcaacattgacatctgaattaaggaaatgttcgccca

SEQ ID NO: 103608 - DNA, 548 bp, Oryza sativa
taacttcccattcatttcttctgtaatattttgtgcataaaagcttaataaattctcaggattaagtctgtcatccttcaaatatagctgctgaaaaaaattgtgtgccaactcttccatttcacctatttcacatgtggccatgccatcgtttctctttagctttcttactctgttcttcctggatcgccatgaggcctttaagtggaagtatctggtgttacgatcaccttccttcagccacatgatacgtgatcgttgcttccaccagatttcctctctatgcaggagctcttctaattctttttttatttgtcggacttggacatcggaatcaagggatcccatgctcctgcactctcttaacttgtctcgtaaggcagcaatcttctttcttacattccctatcttctctttactccatctagataacttgcacattgtatttttcatcttcgcactaatgtcgcctaaatttgtgatagcgttgccatcactccatgcactttgtatgacctctgggagggatgactctctctcccagactt

SEQ ID NO: 103609 - DNA, 687 bp, Oryza sativa
catcattcaccttaacttctcataatggacgaattacccccctgagtctctttagagcggttttcgtcttatgtgacacacacgtagcagtccaatcagcattaaaaatttaaaaatagtgggcccacatatcatacgtgagcaatggaggatgaggggagatatgacatgtgggcccactatatttttaaatttttatgctgattggactgccacatatgcgtcatgtggaacgaaaactgtctagagagactagggggtaattcgtccgatataaaaagttgagaatgaaggatatctagttttgtgattcaggaggtaatttgtattgttgcaaatagttcaggaggtaattcagacttttctctttaagaaataaacttaacttgtactaacttataacatgtggtctaaacaatatcgagaatttttcttataagaaaacgtactggctccatattttcatattttttttatagatgaggtcactgatttttaaacatatgtttcactattcatctggtcaaatgaatggtcaaacatctattaaaaattaatggtgtcatctataaaataatagaagaaatgtattttgtagatacatagagtaaataatcaggtgaaagaacggaaccggaacaatcaaactgggacctcaaatatgctaaagatgaagattaagtacgg

SEQ ID NO: 103610 - DNA, 960 bp, Oryza sativa
gattgttttatggttgcaacttataattgatttcactgaggctttctttacaaactgtattaaaatatagctgttgatttattaaaagctgatctcccatcttcaataagaggtttcatgctaaaaaatgctggtatcgagcgcttcattgagcctcctgacatgaaagctagcttgtaggccaatttaggctcgacctgagcttctatccagctcaagcttgcttggttgatagccctaacttcagacatactaataacaaacacttgcaaaaacattcagtaaatagttactgcaaattctaatctcctccaatacttgtccttgctaggtataaaaacaccctccaactatctagagggaaatggagtatactcagaacaaattcagatgcatatggttttatagtgtagggtgctagacagacgttcactcaaagtttaggatatatggagtctaaagaatagtatatagcactgtatcaatatttacactatgcgtttgtcgtacttacatagtagtaaaatttgaacacatcaaagaatggtgtatagggtaccctattgtataacactattgcaagcctaaaccagaaggatgagtacgaacaaattgtctatgacacattgtaaagacaggaatagaatgtgcttcccaatcaatattcactatatgttgaatttactgccatttgccatggccttggaccttctatgtacctcctaacagcatacaacttaaatcaatctttaccactcacagacatattcccttggcagttttgagccccgcaaaaacattctatttcaagaccataatgttgctcgaatctacaaaacagaacccacaatactgtggtcatcaactgcatcatgcatatcctttttcaagcaaatagaggatctctttgtgattctgttcaacaccttttgaaccaaagtaatatgacaactgtttttt

SEQ ID NO: 103611 - DNA, 656 bp, Oryza sativa
ttggcaggtacgaaaggtagaactattgttctgcaataaacaaaagtaagcagagctaaaaagttttcaggcaagttccttcagtactgccctatgaaagtaatttaacaggtttaacatatgtaaaatcctttgataaaatagtccacaaaagcataagtaagaagaagcagtgatctgaataaattacaataaaatgtctaagcaaaccaaataatgaatatcttataccttctccaacaaattctatgacaaaatcatctttctcaatggcttccagtgctctagatccccatccacaatattgtgtctgcagaagtattccactaataagtaggttgtcaaagagaaacaatagtgacagaaaataatttcaaaatcagatctccaaagcacaatcaagcacagcataagaacacataaagaaaagggcagcattagtactttaggaaaagatccttacatgtatcaatatcaccaagacaactatggaacttaactgccctccaaaaactcagcagtccatgacaagccttaccttaacgatctcaatctttttctgtcggcgaaatggtttgttagtgcactcatctgagcagtgacaagcccgagagcagctaaccaatagagacctgtaggaattatcttaattttct

SEQ ID NO: 103612 - DNA, 650 bp, Oryza sativa
actcaacgctaagacaagtgggtggctccgagaatacaactaatatttgggaggacacaaaccaagttttcagtttatgtgattcatgatcactgaggaccaacatagactattataactagaacactacagtttataaagtggatgggggaacaatcttgaacatggaacattatctattcgtaacatatggataatcgattaaaagttttggaaaggggacaaaaagcaaaaaaaaaaacaagataatcacagacacatggctcaccgcattaaaagatgcattctcttcatctgctgtcctatcccatggaggtcgataccattcctcgatccgatctttcacaggcactctaaacatggatgctcctgcaggcattgccatcggtcctcctaaccaaagctcaccatgaggcgaagggaatgtgtcaccgcggaccggctggaagctgacggacaatcgcgagggcacatcacagagcaatccagtatcgcgctggaccttggcctccgagttctctctgctcagcaatttcagcagcaatgacctcctgacgaatgccctcctcccagagctcccggcggagcgcgtccatcgtcacctgcactgaaactccccaaccccaccgctgtttagtttctgcgcatga

SEQ ID NO: 103613 - DNA, 695 bp, Oryza sativa
agctccaccggtgggctaacggccgtgccactcatgtccctcgcattcactgccgctatatgggctgcggcggccggtctcgccggccacgacgacgacgagcttcctgatcaggcggctgcggaaaccacgccgctcctcctgctgatcctgtctatcacttacttcctagcggtcgccgtgatgtaccgcgagctggccggcggcggcggcgtcaccgtcaccgatcagaagcaggacacggtggtaagacgagacgcttgctagctctcggttgctccttagtacgtgagtgtgtgcacgccggccgatcgacgtcgcggcgacgcgtatagctatatatgtgtactgacgcgtataggtatgtatgtttgattgtatatgctagagtgagatttcgcgcgcggtagaggttacttcgtttttcttttattttcgtggcttgtctgaatgtgaatcggttgtgagacgatgatgtattcgcccgtttgtatatgtttggcccaattgcgcgtttgagtgtgtgcaactgaaatattattttcgttttcatgggttgattgtgaaccgtgatgctttattttgtattccatccatccacaaaagttacacatatttcacatttaagtttttccaaataagttgtttctatttataatctttatgcattcaagacttagatgaagagataaatt

SEQ ID NO: 103614 - DNA, 519 bp, Oryza sativa
aaatttacatactagttacaccccacttacaaatcacttatatatgtaattttgagatttacatatgtaattttaagacttacatatgtaattatatgtaattttaggacttacattgtaaatatactaaaattacatatgtaatttagagatttacaatgtaaatacataccgaatattttttgataaaaaatatggtgtcataaatatagctagtcccttaatattatccctcttgctgtccaaatcaagcttaattagctcggacaagagtcccgcggttaccagtagctttcgtgattattattcttattccatccagctcgacgttacatcatttttctaactgaattggttgcgttggtaaattacccgatactgactaattgactacgaacacttgttcttttgctatctaacgtgtactacaatctgctgtgaggttaagttagcaaccaaataccaagggggggtgcgcactgcgcagtgatgctggcccgttttgacagatcgggccaa

SEQ ID NO: 103615 - DNA, 690 bp, Oryza sativa
tctagtattatatctctataatttgtatttgacttttatctctaaccaacgcatctgtacttgtaacgtgaagtactaatgatagttccaacttccatgcatgtacttattcattagttagccaattagattccgttgccgaggggagcaatggaattcagaatcagtggcgttttgattcgtttgtcagggatacagagctgccgaacctggcccagggtatctcatgaaaaaaagaagggaataaaagccgttcattcaaaaaagaacgggaaggaaaaaaatcatattaccaaatgacatgtcgaccccgaaaagtgctgggcccacatgccagtgagacacggtccgtagtcgcgtgaagcaacaggtcaggtcaaaggtcagaagcgggtacactgggcgctactggccgtaggagttgtctgcctctccgagtccgggcagttgtacaattgtactataagccaatgtgctagtataccactagtctactctagatcagtacaggcagcgcagctcacacacacatatagaacgcacatacatggaaaatgcattgctgatccagatacattctccggttgcgaaacacatggtgtactacgctacgcgaacgtgatgatctctttttcacgtagtactacacatacacccctctctgacaaagccaaagatgcaaaagatgac

SEQ ID NO: 103616 - DNA, 1418 bp, Oryza sativa
ttttctcttgttgtcaacgaaatccatgccacctggagtagttttgatttgacgaacaacgaccaaaccattagttctgcatatgggccgccaagaagcaagcagtgggccgagcttcaacttgacgggaaaaggtataccggaggtccctcatcttaccgccgagttacaaaatcgttcataaaccgaaaaaaacagatatatatatatatatgcatctcttaacttacaaaaccagatcactctaagtcgttagacggttttatccttggttttacctgacgtggcagttgagtcagcgtgtgacccacgtggaccccttcccctcctctcttcacctatctaactactgggtcccacaccattgttcacgctcagttgccacattcacatgccacgtgggcaaaagtagaaaccatctctttagagtggtaaaaaagagagcaaatctaaagggacatttggataactgccaaacttattagtgatgaaaattaaatttcctgtaaaaattagtcgccaacagctcatacacactaaaatgttactattccccaagaaaaaaggttatcgtcgaacacaaattgtgaatcaataataaaaagtttttataacatggccctggcataacccacaagttttttactccctccgtctcataatataagggattttgaatttttgtttgcactgtttgaccaatcgtcttatttaaaaaattttgaaattattattattattattttgacttactttattattcaaattattttaagcacaactttttatttttatatttgcataatttttttaaataagacgaggatggagggagtataacatggcattcatgaaaggaatttttttggcggggcatgaaaggacttcaatcttgacttacaaggacaatcttaaaaattgtagtaggtggtacgttcagaagaggtagatctctggtctctgacacgtaggtggtacttaaaaattgacgggatataaagaaacacgtatgaaacacgtatggatgagtcgatgcatgagcagagtattataaattgagataatttattgtatcggttttaccccgttatataatagacaaaatttaccacaggacacgtaaaaaaacgtgtaattggctgagagacaccgcgaaaatataatacggctgatggacactaaaaaagtataattagccataggacatcggtcgtattattttattatttccaggtcaaaagaggtgagatattttttaaatgcccatattgccccttctctttccttcttttcaccttcccgttgacttcgccgggaacgacacaacagccacagagagcgcggtggggtgaggtcagcacgacgagttgcgacgacattggcggccagggcggttgatggcatggcgccaccttgga

SEQ ID NO: 103617 - DNA, 708 bp, Oryza sativa
agacatttgaataacagcggcaagcaatgcctccaaacctccatctattcagactctaataatatgagcttcttctaccagttattagttaaataatcgcatagtcatcaatttctatacaggttactgaataattactgtatggagaacatttgagcaacatataatatacatcagggtttctcatgggagagggagacatccatacaaatatctgacctcttcagcaaaaattcagtttcttcaggttgcatgcatatagatcgacatcccattcccatatgcgattatgcgcagtagttgaggactacagttcaagccccatccctgccttaattaagaaaatgtttactcctatacatccagctctttttcttgcatagagcttaactcttccatattttctcttcagatattacttgctttccacgatcagttcagtccatattcatatatgtacagaaagtgacctatcatttgtaccatttctacaaatcgttatctgttgtttacaaactttgaattccatcaccattcaccatttaacttggtttctcattatgcttttaataaccagctacccaaaatttaatgaaactagctttcttggaaatacagttggtgtccttagtccaactgtcctaacacaaaatgaatttccattccacttacatttcctactgtaatgggaatgtttttcctgtaact

SEQ ID NO: 103618 - DNA, 691 bp, Oryza sativa
gctctatctgtagggccgtcacaggtgacctcacctgtgacggcccagagtgttgggcccgtcacaggtggtcttacctgtgacggctccacggttggcgcccgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgcgccctcctctccaccaccgccctcgccgccgccaaatccgccgccctctccgccctctccgccaccctctacgccctcctctccaccgcctcgacctcgacctctccgccaccatctctgccgccgccctctctaccgccatctccgccctctacgccgccctccccaccgccgctcgacctccccaccgctgccgcctcactcactctctcgacggccgccgggacctcctctcagtcgccacgccaggaccgtcgtcgccgccaccgggatctcctctccgccgcctcctcctctcgaccgggacctccacggtgagcccactccccccgcctcccctcgtttactattggtcgcccgattaaccccctcttctcctcctcagcgccgccgtgccaagaagccgccg

SEQ ID NO: 103619 - DNA, 607 bp, Oryza sativa
accgacctagtcaccaaaatttttcatgcatattgttttctgtcattctttaataattaaggaactttattaggtttagggtttgaaatttagttcaaatggaagaattgattgattggccgcagatttaatgttgttccgaggttatcaaaccatcacagaatacaaaatgcatggggaattttggtggattggtcagtgtagtccatggacggaaccgacctagacaccaaaattctccatgcattttgttttctgtcattctttgatgattaaggaactttgcagattatctaaacttgtggatttatataccctttttgtctatgaataggtgaattgcatgaattgttctttatatacatgatttatatacccttgatgctgctgccacataaatgattgtgggctgttttattatctacacttgattgaattgaatggatgaattgctgtttacatgaagttagtagtactgtctcattttttttgatgaaatatatgcatatttgagatgtgaaatatatgaggtgatgaatttggactatttgtggatgaaatatatgcagtattagatgaattagtctttttgtattagatgatttta

SEQ ID NO: 103620 - DNA, 4571 bp, Oryza sativa
ataattcgccgcgacaaaagcacaaatctctctcaaagcgtttaacgtgtcgttagctttgccctttgattagtgcacgtactctacgcagtacgcacgcgtgaagctttgtgcgcgccgtgccgggcgcgcgcccgcgcccaccgcgctcccgcaaccgggcagcttagccagcgagccatccttggaatccgacgtgattgccaaccggcaaccgcgcctgcggccgcaatcggccgcgggggtagcgcgcggtgcggggagacgacaccacggctcacgacaaggcgaggctttttttccgcgcaggttttcgccgggcgcgcaccgcgaaatgtcaggccatatgcagcgatacaggcgggggctgatggcccagcggcagcgagcgaggcgtggaccatggaccacgccgcgggagcaatctcggtcgacttgagccgagcttagttctaaatttttttttaaaactttcaactttttcatcacatcaaaatttttctacacacataaacttttaacttttccgtcacatcatttcaattctaaccaaactttcaattttttttctttctcgagtactagctacttagctagctcacaccatctcaataattctagccagctccgagtattacacttacatggcgaatgatggcggcgagagtatacatttccgttggaaccaaaggtagacaatggctgtgtttagattcaaagtttggatctaaacttcagtcctttttcatcacatcaatctgtcatacacatacaacttttcagtcacatcatctttaatttcaatcaaaatctaaactttgcgttgaactaaacacagccaaagtgcagtttagtgagtacagaagcagactagcagtatatactcgaagacgacaacatcagctattcagctgcctttgctgaaacgctgccgttcatgatgctgctagagacgttgatgacactactaccatccaaaatttaccgttacgcttaacctcaccgtatagtatactcctactgctactctgtgttatcaacgtcaagaagaaaacacgcgcgactttcgcgtgctgctgatactggctcacgtacttgcaccgttgtcccctccctttcatggacagcttcggcaccggcctcatcacagtgatattcaatgtgcattcgtacataagtaacgaaaaggaactatagacctctcctaattccgtcgacttgttcgatcgaaatgaaacaccatcaacacaaaggaacggtcgacggggccaggtgtcaccagattaggcgatccgagggctgcaaacggtggggccttgcttagtgcttacactgatcgtgctacctggcccgcaggaagataaaaaggtcacaggctttttcttccaaaaaaagggacgccatcatttagccagagtggtacactcgatcggggcgtaattatgcaggttttctcagcttctgtttaagcttggggtctctgaactactaatacacacaggatacaacaatttgtcacctgtttactgacagctcggaacaaattagagatttgagaacggtttgtgttagattaaagaaggggctgtggtacgatactgcgggttgcgtgctagctaatatttggctcttttctgccaagattcggaaagaacaaaaacacaagcgtatcaataggttaatgccatcacgtggggatctggaataggaacaaatcgaggagatgcgatttgcaattcgtcaagagtaattcgtcgtacgaatgtcattaagggcattcccaacccaatgacataaataagctgccacctaggataaaaaataatgtggcaaatgaataaatgaggaaagagaagaaaaccatgtcttatacgagacatggtataagacatggtttctacacaacatccaagacattatgtgagataagtagcattaaatttaaatatggaatagtagtgtttgtattggaagagtagtgtctagtttcttgatgatgtggagtttataaaaactatgtttagtgtcttgggttcggaatgcccaacagaagagatcatgagccgagatgagaccaaatgcaggctgctgttgctgcggctctgttccaacatccaaccaatccaacatttgctattgatacttgataggtgatgctagctcctgacgatggatacagacatagtacagatacagtacacatagtagtagtgatactagtgtagtactagcacgttcctcggcattttcatagtcaaacaaatgtcccagaaagtaccgctgtgtctacattcatctgcagtagtagtggctagtaattgtacttaggtacgaacacatccataattttacctgtgcccatttctggaaccatacgagacccagtcgttggcgccgtaaccacgaagttaactgcagtgccagtatcgtagaagacggttcatcattaactgccacactgcaattaagttctcgggtacttcaacaaacataaattcggctctaaattcgctaattaactagatatggatcgactcacaacagcttcgatcttactctacgtgattacatctgacccctgtctcaaagtcatcacctcatcggcgccattgctccgccggttaactcgtcctcgccattgtcggcgcgcgcgtcgccggcgggcgtcgtcctccggccggtgtcagcgtcgccaccatcgccggctgcatgcacgtaccgatcgatttctagctgggccaagtgttgcaggtcacgtgaacaaagggctcatctccatctccatatgctgtcgatccaagctggccctgggaaaggggagagggcgacagaggcggccggatcggacggattgcttgcggtctccgcgatcgccatgtgcctgcgtgcatgccgccttctcctctcatcaccacctcccaatcctattcctgccttattagacttattaccttgctcgctctttcctttgccgcagcggccgtaccaattatgtggcgtacgtgcacgcgtgcgtgccagtatatatttcctacccgtttcacttttttttctctcttcacttctcgcagctctttccgcgtagaaagatgtccgagtacgtgtgtagcaattccgagatgaggaaagcgtctcaattgtccggggaaatctttacaaacgcagccaagcatccgaacaggtcacactgttggtcgacgcgcttccttgtccagtgaacagtcacagccgttggcgccactcgcgtgtattttgggcgcaccaacgactggtgatgtttcgtaccacgtcgacgtggtcacagtcgaatcgctcgaacacggctatacgagtgaaacgagcgacagccgccgaagtgggtcagcgacgtgcatgtgtgtatcgatccggcgacgaaagctggaaagcgaaagccaaccccgcgggccgggcgagcgagcggagcaccacgcccgcggcatcattcggctgcttcgtgggccccggcggccgcgtcgtcgaccgctgcgtgctggcccacctgggcgcctgggcccaaggcgggagaaaaggaaggaaggctccttggcccatccgcgagtcgtacggcgacgcagcttcgcgaacgttgatgtctctggccgcgtgggacccatcgtacggtcggtccacatgtcagtggcggctagcgtatggggggacgggtagccagcttccaccgcgtcgcgacgctccgcccgcacgggcgaaccggagggtgactcactcggttagccatttactagtacgggacgggtactttacgttaatttgtaggagtactttatattcacataaatctccaatgaaaagcaggagtaattaattacagatcgtatactcgccacaacgttgcacaccaagaacaaaagtggaatgctcatgtgatcatggaacaatgaaagggttatatgcacaagcgatggatacttaaccaagcccctgtttagtttgtgtgcaaatttttttttaaatatacggtcacatatttgaagaattaaacgtaaactaataacaaaacaaattacatattccacctgtcaattgcgagacgaatttattaagctgatacataatattgttaaatcatatcgtaattaggctcaaaagattcgtctcataagttatatgcaagctgtgcaattagtatttttttatttaaatatttgatatgacagaatctttagaagttcgaagagaataaacactgcccaactcgaacggattcaccgtgacacaacggtgcgtaacaaagttaaatccggttgagtcgatgagttcccgtctcgtatataacacggcaccgcaaaccagtacaagagcgagcagcgcgcggattgccagtttcccaccggcgaggggagagcccccgactcgaccgcccacgcatcgccatcaccgacgccaccgccaccgccgcaattccgtttcccccgcaccaccgcacgcttcccatccgaacgcaatctgaagcgccatccccaagaccccaaccgaattcacttgcagctgctgctcgtgtcagctgcggcggtggctggaccccccccccc

SEQ ID NO: 103621 - DNA, 1264 bp, Oryza sativa
attccgcttgcaatttgaactttgcgatgatgagttttgctctctcttcctcacctctcttctagtttcgggaattcattttctcttcctcctctagtttcgggaattccttctgtcttctttttctctcttcttttctagatccggcttctctaatagccgcggttctagtaaggattttgagaaatccggcttgatgagtattttcgggggcaagatttgaattgctatattcacccccccccccctctatagctgttcttggtctttcacttcgtcacagcccatggatttccatggaagaggtgtagcatcttttttttttctttttttttgtgtgttttggtggagaaagaggcaaagaagaatggattatgcggacttgtcaaggaggaaggagataagaatcacagactcgtggtagaggagagagaaccaattagaaagatatggataaactatcgatcttgtttactgtgacactagctatttattgtataactcacctacaaacttgctctcattgacatgtctctaattaacggcagtgactctcgctctcccgttggctaattaggaagcatatggattggacttttatcctatcgatcgtgaggtcaccggagaagttgctgacgtcgtgctcaccagagaggggcgtagcagtgcaggagctgaacacggatcctctaacttaagtcattaacatgtgggtctactttgctatgaacccatacgccagttactctaaattcatattacctgtcataggatctcattctgcaggtgcttaggtaagatagggtttttttatgagaccctcgccattagatgcaatctagacgtctcatatcaagcaaagaaacaaagttgcaagagcaaataattattcggatttgctatataacttttgacaaaaaaatagaggggaaacgagtaccctttttacccatcgaatgcatgctaagatttgtgctaggcaagagaaacaaatacgacatgtgtattacggacttggacatactagtggagaaaccatctttgctcggtcgaccaaaaaccacaatagtctcggatgcagtaaaaaccgggactaaagatggtttttagttccggtttataagtagaatgagactacgtgatctttagtcccggttgatgttaccaaccgttcacatgctgtcagatgttgtcaggcccctacaggatctttagttgcggttggagttatgaaccgggagtaaagatcggatctttaatcccg

SEQ ID NO: 103622 - DNA, 755 bp, Oryza sativa
gccaccaccgcctgcatggtcgtcactcacctccgcctcgcgctctctcgctcgctcgctgtctctgcggcaacgcctgtgtgtgaagaggaagagaggatttggaggcgagaggagggaagaggaggagaggagagctcgcgggatgctaaataaagcaggcggcggcggaggatatgggggcgcgagagccgtccgatggtgccgcgtggatggcttcgcgaccgtcgctttgggattttgaccggatccgcgtcgatgtcggcctcctgaccaagccttgcccctgcgggttacacgtacagccgtttctgactttcgattagggtgagcgggtgaggagtggatgcagcgccacagatgataatgataaaatactagtattagtttagttaatattgatattctctccgattcatttcataattgacagccgtaactatttactttttaagcatttatcaaatcaatggtattcttttaatatttacaaatacaagaaaataataacattattaaagtgtgatatgctttaaatattttagctttcctctaacaattcaaagcaactaattgtcaaagcttaaataggaaagttgaaattgacatatattaagaaacggaatgaatagcatggagaatatataaaactcaaatgaaaactcttgaaaatataaacgatggtaaaaattataaaaaattaatatatgtataagctaataaaaaatatttttttaataaattaggtcttgttt

SEQ ID NO: 103623 - DNA, 725 bp, Oryza sativa
tttaattcggaatttcagttatttcatattttgtatttctatatgaactctagtctcctgttctaatattccttatttttaattcggaatttcaactatttctaaattgtatttctatatggactctagtcaactcttctaatattccttattttttaattccgaatttcagctatttctaaattgtatttctatatgaactctgttttttctttttgtccgattaatgtgagaatttctagaccatgagagcgaatgtggaggctcctttttcaattcctttaataatataactagcacggtggcccacgcagattgcgcggctagcatcattatattttttttctcatgtaatagcatatatgttttctcaatgtattattcaaatatattaaaaatgatattctaattttaaattttatactaactttacgaaactactaatgtgtaatatttatattttattatatatacgtgttagttattaattatttttaatatcaaattttagtatttgtaaattatattcctatatggactctaaactcgtctttcaatatttctttatttttaactctgaatctagactctagaccctagactctagactctagactctacttttaattttattatgtttattccaaattttagttagttttaaattcctatatggactctatactctacttctaatattccttattttttaattccaaatttct

SEQ ID NO: 103624 - DNA, 746 bp, Oryza sativa
gtggcagccacgcgggcggcggggttggacggccccgatctaccgggtagatcggacggcggcgggagcacgtggccggcacgcacgggcggctcaagccggcccggcggccaaggcgcacggcgacgcaaggcggcaaccggcggcgaccggccggcggcggagggcggcggcgtcgcggcgacgcggacagcgacatcggcggcgtcgcggctaggcggcggcgcggcggctaagcggcgtgggaggggtggaaggggaagaggtgtctcaccgacggcgattggcgacggcaagtgacggagggcgatgacggcagcgggacgagctctggaaccacctagcgaacacgaagaaaggggttagagagagagaggaagatggaagagggcgaggacgccggccgaaggtggcggccatggcggagctcaccggcgcgcggtgcgaacggggttcccgcggcgtaaagcggcggcggagaggaggacggcatggccctcgggcttgcaaacccgacggcggcgacggtgcggcggctagcggctaccggagcggcggcggcggatatgagggcgacagcgctagggcgatagagggcacgggagagctcggcgaaatggagaaaaagagagaggggagagcggggatgcttaaataggggagagggggctcggacgtggccgggagcggcccgatttcaccggagtagtggggagggggtgatagggcgtggccggcgggattca

SEQ ID NO: 103625 - DNA, 528 bp, Oryza sativa
aattggaagggaagatgactcgacgagtaaaaaaaaccaaggagcagtttctcacggagcaaacgcgtacgctaacgctagatggccttttcttctttttttttttcgatcgtcgtggtacaatgcgtgcacgtgaacatgtacaacaaccatcgtcaaagaggataggaagaacgacatactactgcagtactagtgcagtagtgctacgcatttccgcactttttactcttcgtgggatccgtccgggcagttggatccttccagatccatccgcgttcgttcacattgactctggccttggccttactgcgtctcacacactctcatgtgcgctcctgctggcaggcagcaacgaaacacacacacgacgggcacccgcaccagcacgtgtcggccccgttccgccgccccatcggacgtcctaccaccaccaccggttggattcttgtgcagcggcgcggcgcgcgtacaagcggccgtgcacggtgaacgagacgggagcacgcagcggcggcaggggggtca

SEQ ID NO: 103626 - DNA, 608 bp, Oryza sativa
ccttctttgtgatagcacttattactacaagcacaataaaaaatgattccagcgctacagacccatggatgatgcacggcctaaagaacatatgcaaattaaactttaaatggccgttgcatattttttaagataactaggtagcccacacaattacaacgcgcgggaacctctattttttctaagggtgtgtttggttcccggtcaagattggataggatatggcggtccatattttgttggatatggcggtccagtttttttgtttggttgtgtgaatatggcgatccagtttcttttttggatgtagggacgaaggtggatttggtgatccaattttttttgggttggagggagtatgatggatttgtaggtgtggtcacctctccacttgagatggtgaatatacccccatcaaattaatacatgatacaattttacaccactatttccattataaatacacatagaaaaaagaaaaaagaaaaaaaaacacggctggatctggggcacgtcgccgccgcctttttccgccagccgccttcttctgccgggcgccgctcgccttcttccgccggcgttttctcccaccaaccggcttcttccgc

SEQ ID NO: 103627 - DNA, 1589 bp, Oryza sativa
  unsure (1)..(1589): unsure at all n locations
attggcattgtgcatagatcatctgctaattctctgaatagttgcaagcatgtactgaaaatttgaaacactgggtacaactgatgattatgcacgtattaatgttggtccttttggatgttctcacattttacatgataggtttgatgaatgctccctgtctcccttgacactaannnnnnnnnnnnnnnnnnnnnnnnnnnggatgactgcagtgcaggaggccactcttcctattatacttaaaggttgatcttagtagttcttctttgttatgtgctcaacattgtagttttatctatagtatttcacattttcttttgcaaacttgtctcaagagtttataaatctatcagactcgtattcactaacttccttcacatttttaatttcgaatctgctatcttcacatatttattgaacttcaaattcatgtttatgtttgttaatttacaaacatcatgtgtgaagacaacgtattagttcccatcctgtgcatttgcaccacagtaccacacaagcagatcacacaaacttgacctactgagctggcatagaaaaggaaaccactgctacattgtgtctatctctaagcaaaaaagaaatgcataaccaatagatttaatttcaaagttgttggaagaggtgtagccatgtaggccccatttgcaaatgaagaatcttgtaggaatttcatagtaaactgttcagcatcctgtactgcaccccaaataggccattgatgaaaaatgaaactgcagtgatcgagctgttgaaatccaattcatgcagggtattgtattgtcaacatagtttctttctgaacaacctttgcaaatgcttgacaaatgtgattatactaacaaaggtggattgaattgcattattgcaatatggtctttagtgcttccatgctaatagtgttgaggacttgaattattacaaccatttatcagattaagtttttttttttttgggggaactaaataatgcatgaaactcttaaggtaccacagccaaggtgcctttagtttgggacctggctaaagcaagttaagaaacaacaattgtggcccactttgaatctgcattttctatttgtatgcttggtggtggggcctatacattagggaagaattttgcctacctttggtcattgatatgattttttgggtgaactggttggtgcatggaactaaataagtaattatgagcttttgattggctcctactagtgtgaatcatgtaatttacgtagatcccttaatttctaacgcagtttatgagtctccttggtaatagataatcttgattgatgtagtttggtaggtgttaaaaaatggaagagttaagttttttttattgaggaaactgagcatatggtctgtaaaccttggtaccacttaaaccctaaaaagtcatattgccaggtccaggaattgatttggtgtgagttaccaatgggtttgaagaaataaatttggtgagttggggttcgaaataaagttctcgattagcctcgtgtaaatcctcttcttctatgacataacaaaactcatcactacaactcctattgtgtttcatacaat

SEQ ID NO: 103628 - DNA, 1030 bp, Oryza sativa
tccctgtcacagacttgtggattttggtaaaattcaacgtgtcatttctgagttcttggcccattcatctgatttccgacatcatctgattgattgatcgtctgttttgattttgattctcctctattttatgtttattctctgcaagaggttagtaatcctagtgctaatggaatatttattattctaacactatttctcctttattttggtagtattgactgttgaaactgatcgttaacgactgtcaatagtcatttctatataaatttgatggtcaactgaggggaagggtatggaaagcatcaaaatcaaatttcaagggcatacaaggaagtaagcaaaattcaagagcatataaggaattagctaaaattttaggggtatacaagggattaacgaaaatcccttatgtacctataaattctcacgtaatcccttatgtgcccctaaattatgccttatcctctatgtacccttgggttttcatctttatcccctatgcgtattacatgagttgactaatttttcaaaaaatgtttatatcacccttgtgtctacttattgcttagagttgattgaagaaaaacacccttctcaacataaaagttgattcatttataaaaacaaacatgacataattactttatcataaatttgataactaaaatttagatttcttttaaataagtttcaaattagatttgatgaaatttgttcaaaatttttactgaaatttaaacccaaataagaaacaattttggtttttcaaattccgaataaaacttcttgtgtatttcatttttttttaaaaaaagcttgaaaatttatattttggtttggaaatccggtgtcaaatatgtcccttttgatttttatcatagattaagattatttttataacaggacttgtttttaaagtaggtaccataaagtacgggtaatatagtcattttgggataaatctaatggtcaattcatagtcaactcacgacaagggtatagaaggataaaaaaatctggagcgtac

SEQ ID NO: 103629 - DNA, 586 bp, Oryza sativa
aactcggaaatagaaggatggaacaataaagaatatagagggaaaagatggtgaggccataaaaataaaaaaaatatttatgttacagtaagcatatgattctctattatatatcttagctataatgtttactgcagatgatgtgcccacctattacagccggcaattggctttgttattgatcttgctctaagagagatgggtgctatctctaatcttgaccgtatcatcgactcataaatataaatgcaacatgtacactactccaatatttatttgccagtctactcttactctcttttcttttgtcttgaatttggtgtagaggttgtctagggtgacttattatctctattctctctcatctttttctctcttccacctcactatgtaaacttatgtggcatccaaaagattgtggttggatgcttataatacttgccctaagctcttatcaagaagtccaattaaagattgcaaaaaaaaagaagtccaaataaaacaaatggaacttggtgacattgtattcccttccttccaaaataaataaatttaaaatataataaggtatttcacattacactga

SEQ ID NO: 103630 - DNA, 538 bp, Oryza sativa
tcccgctactgcagctaccaagccacttgctgttgtgccgtgtcgtcgctgctgtgccgtgttgtagccgtgtgacgcttaaacctagccgccgctttagcccgttgctcggtagtcgagttatctagctataggtgcaaccctaggttcctaccggcctatcgtttgccgtaccagggctttaccgttaatcgtgtctagctcactagtttagccgcagctgttgttgagtcgttcgcttgtttgttcgaacgaggtgttccccgtgcttcgttcgttcgtccgtgtggagtcgtcctttagtttagagccgttcagagccgtcgttccgttcgccggtttcggttgatcgtttgggtgatcccgtgtcacgtagaatttactccttgagtcggtatcttgcgtggctcgcttgccagatcaatccaagccatctgatcttggtcgactcggtcaaaattaatctcagccgtccaaaatcaatataaatcctggtatcccttttcaatggcatattagttctttttactataagtcg

SEQ ID NO: 103631 - DNA, 697 bp, Oryza sativa
ttggtaataatttgcttagctcctggtttggaatggaacattcctatttggagatagagctgtacaatcgggtatggttgtccaggtttggttgggcttgtgcagcatgtgtgtcatgttcagtgttgattaatagtgatgattaattactttactgttttacaattcttaaatgtttattaaatgctgcttttgcaaatgagcctatattataccatcctttggtatccttgtgcacttgtatatttgctatgtggcttgcggagtattccatgtactcaccttgtaataatcaatcaaacctcagttgaagaaaagttgcgaagaagaagacgtttggcttataccccagttgagctgcctgtgggagtggagccggagcttcgctagaccgtaattccaatgttgtttacttttcttttgtaagtatgtaatgttattattttgatgaatctgtatattaaattgtcagtttgtgtatcttggctgattcctggacgaggattttatcaaacaagttagttcagaaattactagtgaattcctgggcgtggcaataatagagagatccatactaataatttaaatattacttgtaataaccaaagtctaggcatggattaatataattcgagggtagagtgacactaagcagaagtatttatactcattcgggtaccgagctcgaattcgccct

SEQ ID NO: 103632 - DNA, 1084 bp, Oryza sativa
ttgtccaaacatccaaatagaagctacaatagttggcaacatagtattaaacatttacaataaaagagcatcgaaacctccaaatagaagatacaataattggcaagtgcaactacaaggcgatgcttctatattttgtgtgtgtgtgtttttgtgttatccatatggagcacaatgacagaagaccatcacaaggataataaaatagatcatgtacacatatatatagtccactcatgagtgggtaggccacgatagtgaatcaaaaggaagtgcaacttcctgaatccacaggttctcttcacaaattttattgcattcagatttaatgtgacgaattagggatacggctattcgacatctttagggaccatctaaggtgcaactattctgatgaagtcttaaaaagacctaattgaaacatcttaagttggccaatagcaatatagcatccaagaagaccatgacagcaatatgtgtgtttgatcaaagtagtatcaagtaaatcatcatacacattcatcaagatataaaaagtacaatagaactggcatgtttaatattatgggatccacaatggtttagtaatcctatcttctaggttacaaaattgtgaagagaaaaaaacaaaaacaaatgctccttgcacctacctccaagggaaaagagagaagagggacatggaggatggggagcaagggagtttaggactaacctgtggcggggaagagtggggttgcggatcgacggcggcaagcaccaccggtggcttgtgccgacgcctggcacacagtcaaggcagtttggacggaggcggcggcatcgggatcggcatcggaggagaggacagcgatggcggcggcggcggcggtgactgagagcgtgagagggcagggcggggcgagcccacgttgaaggtgtaaagaagtgaggagaagagggcgaggagagctagagagaggagaggaacagagcggaggaggccaaggcgaaggagccaccacttttgtcatgtggcatcgggagcaagggcggcggccgcagagggacacggcggcggccggagcagcacggtagaggagaa

SEQ ID NO: 103633 - DNA, 576 bp, Oryza sativa
gccatctcggtaggtgttcgacatgttgcgcatatttgatctgttcatgttttactgcttagtttacatgtgtagatctaatgatgcgttcaatctagtttacatctgcaatgtcatgattaatttatggaataaattaaattattatgtgcttataatttcaacattgcttcctcttatttttgtgacctggctaagccctctctgttcagcttcacgtgatctgatctgagaatactacaaaactgccccctttttttttttagaactgtacaaaactgactgcagaaattgattcaacccagtaaggccagggaggcaggggcagatgcacgtgttcacgcccagcggcgtggagaggactgtggagtccatcgcttggattattccacattgcatatttacaaataaaaaataatttataaataaaacttttatatatgtgctattaacgatctgaaaaataaactacgatgaaaaaaactttaaaatcaacttaaatttaaggttaaaagttttagatttttgtttattagtactcctccgttctagtaacaatctattgtaagcataaaa

SEQ ID NO: 103634 - DNA, 644 bp, Oryza sativa
gttgatctgatctagctagatgctactatatattgaggtagtcttaaataagacattattaattaattaacatatatcttaattaatctaggcacacaaggattgggaagaggcaagcaaaactatggataagggttagtgataccatggagattatatatggtggagatggaggtcctacttcatagaagttcatcaaagccctggtggaaagggagaaagtgtagtataattttttttaaaaaaaacactggaggggaggcctccgctgttaaattaaactttcttgagaaagaaaagaaaaacaaactagtctaaatatacaaaattacattaaccgaatccaagtcttgactacatcctaagcaacaaaagagagaagtctcccctaaagaagctgcctccaagaaagtaaagagggtgacttgttattaagaaaaataaaaccatttctttgcttacatatgttccaagcccctacaagaattttttccataaagcatcgaccttgatagttgtttctggcctccatcatcatattgtccatgttcaaaaaggaatcccaaaatataccgactctgattgatagcatagaacacgtgtcaagtgtatttcaatcctccccaaataaaaatccatttatc

SEQ ID NO: 103635 - DNA, 639 bp, Oryza sativa
tttttaataaatgatttaagtgaaaaccaatgatttattttgttcataaaatttcaaattattattttgctaattattaagatgtaacacatagcgacttaaaatttttccttcaattcttccttctaatttttaagatgtaatacctaattagaaaaataattacccctcttttgagatgagttaggccgggaatattacttcttttgttctttgctttaacttcccaacttattcctctttttttttttctagggcacacttttcaaattgctaaacggtatgtttttttttaaaaaattctatacgaaagttgctttataaaaatcatattaatcattttttttaaaaaatagctaatattaaattaattatgcgctaatgagtcgcttcttctggtgctctagagattaggtcgtaacccatggaatgaacacagcctagttatgttcattttactcttagaaatgtagatctaaattaattatcgtgaagttatgtaggatgataaatatttattattattggtttttatatttcttctaatagtttgaaatgcatgcaaaagttaaaaaatatagcccaaaagtaacatatttattttcatattttagtaataggggaatttggtctttaacc

SEQ ID NO: 103636 - DNA, 605 bp, Oryza sativa
ggtatgattgggctcccactactcttttttcagtaagttttaatgtaactggtatatgtgaatatatttgtttggtatgcgataatgatgatgataataataataataataataatattttgttaatgaaagataggtaatatttattaattatcctatataaagttacaacccactaaaatctaaaactcaacatgcaaaaagaaggtcacatcatcttccactagcaactattacatttgaacatctgtacagaatgttatattacttattttataattattaaattttagagctttaaaatgtaagcatgttaaatcatcatgtcacataaatcacataatattttaaatctctccatcattttttataatatcctatatatctatatagttcatcctcacttagttcatgttatttatctcttctctcattaagccatatcacaattatttttagtttttgaatgattaatctatggtccaaattatcttcctcgttttcttctctcattaaaccatataaccttaattatttttagccctttgatcgtaaatgtatagtccaaattatctgcctccttttcttctgttatagagctacat

SEQ ID NO: 103637 - DNA, 1078 bp, Oryza sativa
tttaatcgtttttgatacctctgagaaatggagacgtggttatcagctttgcttctggtttgatcactgtaaaattattaaagcacattctgcaccgatcagtgaaggcaagtcagtgagatttgatcatttctaatagagattttttttacttgagtacgtacaaatcgtccatgtagtttatagttgcacgcaaatcggggaggtagttgtgccagttgatcaataattttcagttacgattgtaacctgtgttttcatattactccatttgtcgcaaattataggacatcctttaaaggaaaatcagactcgataactttacacttaaccaatatcactagatttatatttatattttaaagtattttcatgtgatgctaatttcatttttgttggaaacataatatgagataaattaatggttaaagtatgtcattaaaaaccgtgtaaaaaaatatagactttataatttgggacagcgagagtacatcacagcctatatatagggtgagtttgaggagaggaggatagagaagattgagaagataacgaggtgagccattagcgcatgattaattgattattaactattttaaatttcaaaaatggattaatatgattttttaaagcaaatttcctatagaaaatttttacaaaaaatgcactgtttagtagtttaggaagcgtgcgcacggaatacgatgtccctttctcacccaatcccccagaacgaacgcacccataatgtacaaacaagtttgcctccaaacaaagttttttttttattttttagacttttttatttttttttattaatagatcatcccaacaagcatttccaaatctgaaccttggaaatgttttttttgtaaaagtctattaataaaattaaaaataaaaaagttcccaaacaaacatgtggcagttctccaatgtttcgtgtgggtaaaaactgaaaacaaaattgacatttcctttcttctttcacaaccattccttacacagcccaaaatgccgccccgactaaacagaagacggttgcagatcgcaatcataatgcatgggtaccgagctc

SEQ ID NO: 103638 - DNA, 602 bp, Oryza sativa
cattggtaatacctaatctagatttggcatcatctagaatattcttcactataattttcacattttggctctaggttggtagcaaaccaaatatgatcaaaaacaatattaccttaccaaaaatttggtagtgccaaaacttgcctgtattttggcactacaaaaaaattggtaggtaaccgtccaaataggcccaaaattttacatagttctaaaaaaaaacacgcatgaatcaacagatctgtgtaaaatttgtgagaattatgtaaaagaaaacacatgaatcagagtattgagcagagctctctaaacacaaatgaatcaccaacgcaattttacatagttctacaaaaacacacacacacaattttacatgttattacgtaatacttcaatcatcaaatccatccaacgctctatatttatctacatcggatcaaacgatcctggtcgactcgacctcacgtgcctcgtcgcgtcgtctcgctggtctcctcccccagctccccccgccccgaccagtgtttctacttttttttttaattcaaattcaaatttaaatgggtatataaacatttgagttataaactttggttctataa

SEQ ID NO: 103639 - DNA, 1030 bp, Oryza sativa
ttacttttaacttttaccactcgtccttttttttcaaaaaaaaatgtagtataaacttggaaccatagcctcgttaataacaaattaaatatgtaaaagttattacattgattaaagttgaaacattgatgcttaatagtgacagaaaaatgagtacggatggagtacgctcatgtaatatttttacaaagttagtttaatttcttttaaaaatattttagaattcttcaagttgatcaagtttatagtcctaaatgtggtcaaacttgttcagaacttttagaatcctatctcaaacttctttcaggtcaaacaagtttgtagaagaacaaatttcattaaatccattgtatatttgttttgtcaaaaatgtcattattaccttcatctcagaataagtttatttttggttcctcccgtttgttcaaaaataagttagccaaatcttataattttatttagtatgtaactgaggaagtatggtaattaattagacagatatatagttatatatgcatgtctataacaatagtagtggtaatatggtaatatagtaatcggttctgtatctacctataccattattatctaaaaaagaaatctacctataccattaaaaaaaataaagaaaataaatccacgagtgatccacgggagcatggtatatccgtatatctggagatgcgccggccacgggcagcaacttgctccgatcccacttggccacttgagcgtctcaccttgccaacttggcaacttgcaaagggaggcgcgcccctcctgtcgatatctttcgtgcagccgaaagccatgtcaggcccataaatccgggcccacatagcgcggtgtctgcccgcagcccaggcccacgtacgggcgtgggcccgatcggccctgtgaaatgtactgtgcataataattaacttgatcgatcatattaaatggaacatttttttttcttgttgttattattaacacattggcaatactacaagtaaatttgttcattataggggatcctctagagtcg

SEQ ID NO: 103640 - DNA, 944 bp, Oryza sativa
ttcgtctcctgtaagaactggtctgtggaaggaggagagcaagttgcagctgcagccgccgccgcgctcaccgctgctgctgctgtccaaattccaactgctagtgagtagtgaccgctcgataggctggagtgtctcgcgctcatcagaacgggctgggctggcaagtttagctgcggcacattacggcccaggcccatactgcgacgagatgcagcggggtgtgcacggagcccttggagtggttggtgaactggtgatcgggccgtgcggccacctacctggactggacagactatcagagtctccagctcctcaattgccgatggccgctgttagctttcctttctcttttcctgcataataaaaaagttgtgtaacaagtcaccattttcagcaacactcagcaaattaccactaaaatttccaaagagctttattctcaccagaaattcagaaacaacaccatctcccgagtggccaaaatagttggagaaggttaagatagtgagtaatgtggatatatcgacagcgccccttctgcgaattatatatgtgctagactgttgagaacgtcaattccaaatctagtttcaagaagatacattgcaaagacaagccatgaatcacccttcaaggtcgcttcaacagatctgcttcaacagatctggcatcttctccctttcatggtcttcttcccttctgttggaggcgtgaaattggaatcgatggattggattttaggctgtggagagaagtgcaaaagctatacgcatggaggcggcagtggatctcagggtggagagatgatggtgcccccgccggcggctgtgcgacgggaacaggatggctcgatgtatccctagacagggggggggggtcagcggctccccaagttttcggcttggtttgttgttttgagtctttcaacacatcggctcaac

SEQ ID NO: 103641 - DNA, 1102 bp, Oryza sativa
aaaaaccttcttttttagaagagtgttttttttactcggcctctatacccaaccggatactcaggctacatgccctttcgctcacgcctaaaaacctatttagggatcgtaaaagcataattttaggaatatattttttgggttttttttgtaacatacacatttacttctcttagccaaggctcaaatttgaacatatgaatgaatttagcagaaatttagaggaaatttactccagaataattagggactgaatttcaaatggaaattgactaattaatattaagctcttgattgtcaaaaggataaaaaaaagagtgtcctgaaatatttcagattttcacaatgtgtggcctaaactttttttttttgagggtaatgtatagcctaaactgataaggcagaaatctaattttatccacgagactatagtgagcctactcttcaagctgggcttcaatttatgtgggccaagtgttaacgaagagacattttgggccatcatattcggcttgtatgggccatcagatgtaacacctacgcttctctttacggcccaaaaacacctacgcttccgtagttctcgaggcttctgtttcctcgtctctcgtcgtcgtcggcggcggcggcggccatggaggacgacgacgagtgccctcccctcgccgtcgagctctcgccggagaagccgtacagtcctccgccgctcggtccctccgcggcgtcgccggtcggagtcaccgtcatcactggctacctcggcgccggcaagtccacggtgagcttttctccgcaggctgtgccctccccgcctccccgccccatgctctccctgcaaagtgcttggaggattgggggcgtcagattactggaactatgtaggatccgagattggtctacggaagattcctggaggactggagttgtggctggtagtttgatccgatcgagttgcatacttgcctgtcgccatagctcttgctgttttcttaggtttaggtagttctcaacatgctgggttggttggagcagtgtccttttctatttggtgagctgtcatgtgactcgaactcgcttcgagggcttcgtttctcataggagc

SEQ ID NO: 103642 - DNA, 655 bp, Oryza sativa
tcaaaactttcctggaccaggatgttgtgatattgaacaaaattgacctagtagaaggcagtcttgaggatttggaaaggcagattcatgaagtcaacgctcttgttacagtggtgcagtctgtccgctgccaggttgacttaaataaaatatttgatcagcaagcatatggtgccaaggtcaatacctagctcgaaacttgcattttgttatttctttgtattcaatgcagaggaatctgtctttgattttgtttttggacaaaaaaaagactaactttgattagttaattgattaagtatgacatcaattagtcatgtcaacatatgggcactaaatctagtcatgccaagacatggaaactaagttattctcaggtcattaaactctatggcacttcttaacaaaagctcgaatcattcagcacgaaaaatcagtgttggtgagacgttttttcagcatctgcttgctcatgctaactagcaatacagaaatttgcttacttgcttttggtacttattttgtagttattgcttttgctggcgatggcaccttgtgctcaacaaaatctgaacaccttattcagggatttgattctgacatgtttttaatttattttccatagaattcatcgcagctgcaagaacttctggag

SEQ ID NO: 103643 - DNA, 735 bp, Oryza sativa
ctgttctctcctttatcattgatgcctcatccctgcttcccctaattgtaaccgagacaccaatctcctgtcatgtcctatatgttcacagcacgtaatgtggtgtttatttagcttaattggactgtcaaaaatataaaactggtgctcatcacatgcatttcattttcctgtctgttcctgctgcattacttttgagaattaaggcatgctggttcattgccatacatagccttgccatttttttcggtaatggcaaacattggtcattgcaaaaataaaaagaaaaattggctaggtcttcattcgttttgcaaccaaagtcgtattcccattcgtttgagcaactcgggtcagattagaaaatgtcattagcgaatgattaattaattattaatcattataaaatttgaaaaatgaatttactttacttttaaaataaaattcttacttataatttggctcggttgggtttgctgtctttggaacacccattctgtcctttagagtttgaaacgttttctttccttttttacttcgttcaccacaaattaccagggattcaaacattcaaaattttgtatgaactactttgtattatctcctctatttcccgaacccaaacgcagctttggacgcgagattcctaatgggcgatcgatcgccccgagcgatcacccctcctcatggttttctttttttggcaccgcattattttcctattttagtaaattt

SEQ ID NO: 103644 - DNA, 1294 bp, Oryza sativa
ttcggccggccggcatgaccggcgaattagaagagaagagaagagaagagagagagagagaggaggggaaagagatgacgtgtcatcctgtcatgtggggcccacgtgggtcctacgctgactcaggcgccacgtaggataaaaccggtgtcaaaaccaccgaaggacatattgtaaccggttttgattagttaagcgacgtcgaatatctggttttgcagttgagggatgattttgtagctcgatgacaagtcgagggaccttcggtgtactttttcctcaatttgcggttgtgcaaattttcttaaatttgggaaatggtttacgcggtgacaaaataatttctccgctgtttgtttgttactccagcttatctccgctgcatccgaactttaaatttcgaaaaattttagagtttatttttttcacattagcaattaagttgctaagaacatcaccaagtttttttttaacgacttgcacaagacggtgcaaaattttattgatagaacaggaaaaaattacaaagattacaaccatgtaaggtcgtaactaggaaaaacgaaaaaatataccaccacccacacaccggtagcgccaaactacaagtcttggagaagactagcatcggaccgaccgccgctaagctaacaacggaaacaaccaagatcgcccaaaaccttatctttacaaacaacataaagcccaattcatccacgtcttcaggatctagggagaaagggtgggagagaagatggaacacctctccccttaggccctccgccgtggccaacttgttgaaactaggacaagttttttttttttggttgctacattgatttctccacttatttatcagccatagagcaaacgatgagaggctattaaatgctaatttgttttatttttgtaggtcatggttaatttgagtttataatccaaaggagataatttgaattaggatgtatgatttgctagtataattcctgtcacagtgaaaaatctcacagaacattgctgaaaggggaaaatccaaataccccccccctacaagtcactgctctttctactctccccccacaactcaatattgttcaaaacactacacataaattaatttctcttccaattttccactcctattcagtttttacgctttctcgtgatgcgctcaatttctcgttatcgtgggccttcagcgcagcccacgggtggagttgtctcgtgccacattggcggcaaaagcgcgcacaccttcttccactttccatctttccctgctttaatttcacga

SEQ ID NO: 103645 - DNA, 766 bp, Oryza sativa
agagatgatggtgcccccgccggcggctgtgcgacgggaagaggatggctcgatgtatccctagacagggggggggggtcagcggctccccaagttttcggcttggtttgttgttttgagtctttcaacacatcggctcaactctaaagaaggcttggatgcatgcgtcagctgtctacgcggtgtcgcacatgaggcatggtgcgacactgctgcaagaatttttttcctcgtccaagtctgctttgtcgacgaggacaagatctgctgccgcctgccagtgcaaagcctcctaccgccccccccccccccccgcatcgccgacatcgaaaaccagtcagggaagagtggatgacttctggttcaacatcaacacagtggcctacttcgaggcggtgaggattgtttgcatgaagaaatccttttataagcccaaggtatacatcctttatataagttgttgggtttgtaataagtgaaatattaatcacgttaacaaatcgttgttgaatactgagttaaataaacaaaaaatgaacaatgaatctctttaatttatggtcttgttatacaaaaatattccaataaacaaacaaaatctgtcaacctttaggttgagatgacatgaaacagttgggttgatcttattttggattctgtttggttagagaaactagaggccaaatcatataaggctagaagtcagaccggtcaatgcaaaaccaagcaacaacaatacatttttctcgggggatcctctaaagtc

SEQ ID NO: 103646 - DNA, 679 bp, Oryza sativa
cccaaataatgagattaatgattgtcccattgcagtgtgaacaaattagatgtacaccgaaatgcttaaaagaaaaatgatatttcatcgattaaaatcagaagatgaataaccatctaagaaaagatgtgcgttggatcgcaaaatcagttggcataattgccaaggaatactcgcaacaaggattataatttactgttacaattaaacagtttctttatataggaatctttgtagtgagttatgcaacaaggagcaatgatattggtagagtcagtgatttacattacagattgaaaccatcattatgtattgttttccatcgatcatggaaactggcttgagtactgctcctgaaactattatagtgctaagctgaataaagcccgcacaatcgattcaaaaaaaaaataaagcccgcacaacgaagattgttacatgacttgtctctatcagtctgttgcatgaaatttaacgagcgcgcttgggagttggactgtggttgggtagatcacggtgaaatttaaatgatgcgtgattggaggaaaaaatagtactctagaattatacttacgtttttcaagttatgaatctgttaacaggaaaattggtaagatagactcgaatttggagttagatatagacgcggaattgaaggagattgaatcttactaaatac

SEQ ID NO: 103647 - DNA, 554 bp, Oryza sativa
cccgccggcctcatcggaggttggcgtgaactgaagcagaattggccgcgtcagcagctgcacggagccaaagatttcttgatccgaaaatcgaggcgatcaatggggaactgtacagattcaattcattccattcattccaatctcgagctccaagctttccaagatcattgaggaaaaaaaaatcgacaagtgatcagagttttctcaggttattccaaagttttcttcatttttgtttcttcttcttcttttttttttaacatttcctttatttagttttctctcctttgaacttctttgaaggggctaaatcacaataagcctatgatgataagagctcacagcatctgaactgattcagttattaatagcttaagattagctcaaagcaactgtttttaactctgttatctgcttgcttttagcaactatccctgtgtcagtatactaactgaatcccccgtgaatttctgggtcaatgctaacctttgctctgctcctacttttgctgcactaatccgagatctgccttgggggaggcaggcagcagc

SEQ ID NO: 103648 - DNA, 1714 bp, Oryza sativa
cagtaaactgtgctgctggaaaacaattttttgtaggtccatatgtgttgtggtgttggttatcatgtagctcttgtcgaaaattgaggtgtctgaatataatgccaaaaggcaagcaaaactgcaacgcttgatagttaagaattttgggccggcagaggctaaatagggtgtgtgatatcaatgacaatcagatgtggaccattcttgtgctgttcttctgcggccccatccttatttggtggagctctcgatgtatgttggcgatccacttgtcaggcaaagtctctttgtttcttttgtggtgctaactttggatgttggcctgaattgaccacaataatctactagcatgtctgatcagtgatcagttcgtggtttgatggtaattaagaagctcaaatgtgcacaacatagttgaactgaattatggctgatctggtactgttctactgaactcaattctcagtttagtcagtgattaggcacaatttgtcctgatgtcagatatgagtagcttccattttgcttttacgaagcacataaattgtgccatagtcttacacacactcatcactaactaaatttaaagttattgccagtgacacatccatttgcagtttttgcattgacttgaactgaaggccccaatcaaacaaaaccttttgtttttcctcaacctccatccctgaatgagttagtttacaattccaatttcgatccaaacaaaacagcacgatccttgtagaggatcccccaagtccctagaataataatgccactgtttttcttttaagtctcagaacgagcatgcagtccatcacccccttggaagatcagacacaacaggccaaaatctagaaaagaaatgagctgtcacaaagcttcttctgcatctaatctagccaaagcatcaggtcatcacattccacaacttgtgagaaagatatacacctgcagagaagaaacaaagatctcccggattaatgaccatcattgcaagaaaaacaatgaaaagatactgcatcaataaagccatgagaggtcaggtgatgtgcaggccacacctctatctgtgggctgtggctcccacaaaagtttgcagcttaaccagcagaagccattgctctcctgcatgcctgcattgcattgcaacaatgcagccacttaaccaacctttctttggtctcaaaaaaaaggaagaaaataaaagagaaaagaaatcttttattagcagtcagcacagatccagatctgcctgcctgcctgcttaggtgatcagtacaatgttgctaaaattagccaagtgaatgctccgaaagataagagctctaattggctgtatgtgaccaggtaagtaagcagccaccaacttaacctgacattaattgtagctaaccattttagcttgtttgtgttttttatttgtggcctaaattaaagtcgttaataattcggtacattatttgatgatatactggtctaccagaaacaaaggtagactctatttgtgaattcaagaatgtaataattgggaaggccgattaattagttagtataatgaccaagatcacaccagccaagcttggtggttactctttcacagaaaagctgaagctttttacatgccctgaaatatgtgacaaatcatagctctatctagcaatcagcaaatgctgctttaatcagctaccatctcatgccatgctacttg

SEQ ID NO: 103649 - DNA, 610 bp, Oryza sativa
tgtttttaagtttctggatatcccgtcaattaccaccacctactcttttatggtccggccgctgtcctcctttcttatgttatttttcacctcctcagctcgctcttatgttatttatcggtcatccacttgtctgcatgctccatcatttagtttttttctcgacatcttattcttcccccgtcccattttaaatgcagttatgggtttctatgtccaacgtttgatcatccgtcttgtttaatttttcttataattagtatttttattgttattaaatgataaaatatgaatatcactttatgcatgacttattatttttatttttttcataaaattttcaagtaagacagaacagatacacttaaaatgggacggagggagcactattgaacaaggtaatgttgtaaaagctatgaagttggtggtgggaactaaccccttgcgcatgcaagacgaagcgattcattagcacatgattaattaagtattagttatttttttaaaaaaagtggattagtatgaattttgaaagaaagattttttttgttcacaatacacgcgagagtagaggttgggaaagttgagtgaagaacgtagcttagtcatg

SEQ ID NO: 103650 - DNA, 866 bp, Oryza sativa
tgcctgcaggtcgactctagaggatcccctgcagcacatctcccgtactttgtcaattaaggatcaaaaataaaactttgagtaatcaagcaggcccaacgaaacatatactccctacaatcataaatgtttgatatttaacatagatttgactaaactttaccgggtttaatattaaatttagatttcaatattggcatgcatgactaataacgcataatttttcatcgactcaacatatagaacacattaatacttatacacatacaatttaaagtttatgttttagttttcaaatttaaatctaaattgttctcacatgtatgccatatgtagtagcggtttaaaagcagtatattcatatcttttcttacaactggaaaagctaagcattaatttgtcagcattggctgtacgatgtatagctaatatatatgctactctcttttttattttttttggaaagataatatatacttcatctatcttatctcgtacgagtttggtttactttgcgacgtaggaattatatgcatgtagtactctgtccttgtcatgcacgattcacttacttcccactaccctcatatcatgtggccacacaagtacccacaaggacaccgtccgttctaggtttctatagcattcaccaaccaaatttcttgggtctcaatttttcccaactaattaatcaaaccatgcatacacaatcaaagataaggggagatcacacactgagtcactgactgattaaatcgaaacaagtcaaacaaccaaaaaggggtgcagatcacctacgtacctaccagtaattaatcagcaggctcactgtaatcaaatataatcatgcattagtagcttaactg

SEQ ID NO: 103651 - DNA, 589 bp, Oryza sativa
cttccagaaggatcattaacaagaactccagaaggtgactttctgttccttcctgaagaaaataaagggagaagtatcattgacaacgcatagaggctacactgatcaacctgaaaagaaaaaaaaagaaaattcagaaatctagcactagttgagtagtccttggcatggttggcaattggcaactttattaaattctttcatgatcttactactgggataagaggtatgaaatctagaactaacaattttttattagtatgctacttgtgtatgttgagctattatctaaaagaaaaaccttgtgtgtgagctattgagcaaagaagtgtcaaattgtacttataccgtttttagtgagtttagtcagtgcgtacttaaactgttgaccagcagtgctgggtaatgattttcccggatgggtgatgctgtcatagtgaagaacaagtggggacaagtgtgcctacatctgtgagacattcaagaacaggactagtactactagattaactaatgagctgcattcatgaagaaacacaaatgcacaatgcagttgcattggcagattgagtagcaaatgacaaataca

SEQ ID NO: 103652 - DNA, 732 bp, Oryza sativa
ttcgtcgcttgctcatagtgattcctggtgtactgtatctatccattgctgaatctattcagaggtacacgctgttttcgttcagggcacggcttcggtatgctatgtaaatattggatccgcattttggtttcttggtttgcaactatagtagcatgagagtccatgttggagtgattgccaatctctagcttcgatatggcagcgtagtaactactctagtaaatatgttcttgtgcttgatatcacaggataatgtcatcttaattgagttccccaaattttctgtcagtagggcttatccgttgctttctttgcagatgtctagtagctccaatggcaatgggcattatcctgttaatggtgcaaaggttctgcaaaaaagagagaacaatcaagaggtacctgacatgtgtttcgtgatttattcgttgtaaaacttaattttttgggagcactggtattttttagtgttgtgagaaaccagtaatctgacattctttttgttcaatggtaactctgatattggcacttggaagattttctcccttaccctgcaaattaatgattgatacaaaaaaaaagagagatttttctcaagtttccagaacactttcttctcagcctatttgtctactcacttggtcacatgtgtaatgccaaattacctaaccatttcttgatatgcattgaggattaggttgttatttacactcaggtgtcagttcatat

SEQ ID NO: 103653 - DNA, 999 bp, Oryza sativa
ataagaaatgctcatgaaaaagttttagtaacaatcataacatttagaagattgggatgtgtgcagtgataatccgggacactattttaacagctcgagtggacgtccaccagtttattgcatgtcatctaaatggttataaaaaaaattaaaaaaatatgaccaagataggttaatatgtaatatatcaatccacaaacatgcaagttaaaattcaacttctacaaattgtaccaaaaataataaacaaaaattaaattactatatgtatatttacaactaaatttgttatttttgttacaacttatagaagttgaatttgaacttgcatgtttgtaaagtgatatattatatattgatctatcttgtcaatttttttgaaattttttcataaccatccagttgacatgcaataaacgatcgaacatccactcgagttattagaatacatctcggtgataatccatcaaccataaaagtctcatacgaatggagcaacattttctatcaatatggcactttagttttacttgtctggctgtctgagaacgtgcatatactgactttaacaaccaaaggacattggtgagtaacacaactttggtgtgcaactcaaattgaagattcaggtgagaaaaaataatattcaggctaggctaactgaggtgtaaataggttctccttatgaacctaggcataaggaagatagaatgacacagttaattacaagattgtaaactgtttattaaaaaaatgtttcttcccccccaaaaaaagaaattgtttctgtttggaacaagcaacaaatttatatgggaacttatctagtcatgggaaacactgagtccactaaatggaactacaggacagcaagctgaataaactagtgcttcatgttgacatttttttgggcatcaaaaacaaacctaatcaagcttttgccaatagctgtgcagctcttcaaaagggagtacaatacgcaaagctagtactacgtaa

SEQ ID NO: 103654 - DNA, 600 bp, Oryza sativa
tgtactctattcgatctggtgctattgtcgatggtcagaagctgcatgacgtcttgtgtgatgtatagcatagcggcaaggtactacaatgcggatttcttatgagttcaaattatgaatttgggttgtatggtattatttgggtttcatattggatttaatgaaactaagctgaacaacgttctcaaggaaattaatggagcattgcacaagccaatcatgatctacaacttacgaactgcgtctcttattttgcacgttattttgcacggagccttctttttaagtaaacaatattatcttcagtaaatcatgatgcatttacacgatgagcggtctattattaccttcagtaaacaatattgctctccaatgcaatgtgctagtactaattcgtttgaagtaactatagcaattccaaaaaaacaaacatcaagagtatacataattgacatggcatgcagtataggaataaataacacgagagccgtaaaaaaggctggaactgagagataagttgagcaaacatccattgattgtaaaacatggtgctttgagcaggcaaaaaaaaaaatctattaggacccttattctgaaatc

SEQ ID NO: 103655 - DNA, 4301 bp, Oryza sativa
atcctgataacatttgcatatgaaagtttcttatcaaaaccgttactcactagcgaaacttacaatgacctaaatgtattaaaaaattcagtgtatgaagcaactcagtgtagtggtggaatggggaataaaatgattacgacttgtttgaaaactcgagggaagatgattggtagtttcaacgagtaaattgatggtgagattaacatggaaatttgatttttagtcccaatcttttgtttggtagaggtggtgggaattgatagatgattggtagtttagttgaagattagaagttagaaaaaaaacaggtggttgagatttttttttagataaagtataggagaaatttcctctcaattaccaccactatccagatattagaaaggagagagttcctttatcaattcccatccctatcccaccacaactccaatatctcccaaccaaatagcatcgtctctcaaaactcccaactctatatagttggtacctactaagatcattaacacctataaagcagccctcacatgaagccacgtcaccacaaattccagaaccgttagatttgatctcaacgtttgcaaactccctcagctctccgttacatagctcggttgcagcagctgaggcccaacccagcttaagcgattgatccagcccatccagtctcctcacttccttctcctcttgcggcatgcgagtggtcgatgtgaactccgatcaccacgagtaaccatcgacggcggcaagaacaattacttctgaaaaccgatgccaccatgataggcagacagatggtcattcttaatggctctaatgccttttgttctcttcttatcccctctttccatttacttataaattcataaaatcataatcattatcaagcgggatagttaatctatcaggccgatggtgtttcgctcaagttgctggagcttgctcgctggaaaaatatgcatcactgcaccatcctcttcaattttctccaacgatctagcacaggttaccaacttcctcttgccctttggttgattcatctaatttgtttccccaaaataggaccagcattctaatttgaacctgtatgtgttcagtgtttatgcaagcatggcccaatacatattagcattattttcccatttttgttatcaaacagttttcccatgcatttcaattccttccgtttcctgtcccaggatccagatacttgatactgagtcaattcttttttttatttgtcctgaactgcagatcaattttcattattccagttgaaggatacggccaacaatatcacgtagatcaattggttgatttgtcatctacatattcagatctaagaagaatataactcaccaagtttgcaagttgagtaacactttcaaattggatgggtatgttcacccaattatgttttctaatttgtatttcagttctgatctttacctggtgaggatatcttcaatcttagaaatagattggattggcttctgtctcaaatatatatgtcaattcatttcgctgtcagagcatcgagctgctcccattaaggccgtgtgaaatatgtgaatggatatgaaatatgtgatcaaaatgaatgttatgtgaatatggttgtgttaaatatattgatggttgtgtatatgaatgggggtgttggggtgtgacatcctggcctagggcttaataggattaatagaatactcataccaacaagttccaacaacttgtcccttaatctaatgcttttagctggctgagggaattaataccagacatatcacacgcatgtttttagttttgttgcatacatatacaagatatcatatggtagatatcaaatggatctgatctaaacatttcacattaagtaggcgtggatgtaactgggaaaactaaagacatcttaaaagatttggaacatgatgatgcaagttgcagtacatgaaatatatagcgctgataggacaatattaaaatatggacatgtattgggccatgataagttattaacgaccggttgataggcgtaccgacaagagctgattaaggtcacaccactattccatgattgaggtcacaccactgttccatgatggagcctaccggcgagctgattaagtaattgagataaaaaaaaagagaaacaatcaatcaataggacatatcgtcttcaatgacaaggcacatctgtgacagtaccatacacagttgtatcttgtggctggataggttattaggatatgtaactgccacctactcatgttctacagacgtggctgtgattaaacacacattatataaggccactgttccatgattgaggcaaccgatgagctgattaagtaatcgagattaaaaaagagaaacaagtaatcaatagcacatatcgacttcaatgacatggcacaaacgtgacagtaccatacgcaggtgcatcgtatggccggataggttaaaggacatgtaccatccatctacacatgcttaagagtcgtggctgctggttaagcatgcaatctataaggcttcacgatatgttataagcgaccagctgattgatgaatctatcggcaagagctgaataattgtggctgcatcactgttctataacggttggtgtacttgctcgtagaatatttattggggatttgagtgagttaggctaccggttatttatttttatgatgactagttctgcccatttttatgtaagtataatcattcagaaaataattgggggttggaattaggcctgccacatagaaatatgtgggtccacatatagaaatcgaccaaaatttgtataaatttgttttccatataataaatcatccctctaaattttagtcaaattttttgaagttatttaatgtgaacgcgagtttctgctaggagggttgttcccactatgaatactttcatatagcttagtaccttggcacttttggatcacagtataaaccctcgagtgggaacaactcactgagatccaagagtgatcataggacttttggttcacagtggcaactcggcagttattgtattatatatctatgcagaaaactaaatgccctctgcagtctccaattgagacactagtcctatgtagaagaaaaacacggtcaatagatccaaagcaactaagacaactggcagcgactaagaagtgcattatagatatctgttctaatattaatgtgattgtatgattgaaaataaaaaatatcctggaagaaacataacctagatatatatcccttatttaattagtgtccttgggagttggacagtggttggagagatgagggagaaatttaaatgatgagtgattggaggaaaaaatagtactctagaattggacttactttttacttgtttttaatcatatggaattacagttaatttattattataggagcgagggagtaaataattgttagatgaaatatgtttgtaccatatttttttaaaaaaatcttcactgtaggtcctcactgatgagcatgttttaagcccccagcaaagcatggtgtggatgttccactgccaaagcgtgtttacctggttcaatcattccatgtggttgttaggtgcaagcatagtacgcaatagtgatgttgttgcttgtgtattttcttagctctccaaacaactacttaaaaagagttatggtacagtgcccaaataatgagattaatgattgtcccattgcagtgtgaacaaattagatgtacaccgaaatgcttaaaagaaaaatgatatttcatcgattaaaatcagaagatgaataaccatctaagaaaagatgtgcgttggatcgcaaaatcagttggcataattgccaaggaatactcgcaacaaggattataatttactgttacaattaaacagtttctttatataggaatctttgtagtgagttatgcaacaaggagcaatgatattggtagagtcagtgatttacattacagattgaaaccatcattatgtattgttttccatcgatcatggaaactggcttgagtactgctcctgaaactattatagtgctaagctgaataaagcccgcacaatcgattcaaaaaaaaaataaagcccgcacaacgaagattgttacatgacttgtctctatcagtctgttgcatgaaatttaacgagcgcgcttgggagttggactgtggttgggtagatcacggtgaaatttaaatgatgcgtgattggaggaaaaaatagtactctagaattatacttacgtttttcaagttatgaatctgttaacaggaaatttggta

SEQ ID NO: 103656 - DNA, 543 bp, Oryza sativa
tttttggatagtatgcgagacacacccccccttacctagattgacgagtagcttgatggttagttcgatgcatcttttggatgaaccttatttggactgcgtatgtgtgcagtcgattgcatcatgatttatgtactatttggggaactctatgatgttatttatgatattattggtgttgggttataaatgagtttattccaccatgcttgcaaaacaaagttcacatcgaaacaactcccttaatgggataaaaccataagagctagttagaaaattaggatacttacttaatcggcctacacagatggcaagccgacgtcgggcgtcaaccagcaatgaagaaacttcgacacctgacctaaccaccctggccagagttatggccactgaaacccaacttctacaagccattgcgaataaccaaggcaaccgcggcggatcgagctttggagagtttatgaggaccaagccacccacgttcgctacggtagacgagcctatggaggcagaagattggctacgtatcatagagaataaact

SEQ ID NO: 103657 - DNA, 695 bp, Oryza sativa
cctgtggagtggtgttcccgctgcagttttagtcaaggcttagctccggttgtctttcttttcttccgctgcatttatgtaagacttttatgatgtttgtaagacgtggatctgaatgtcaatattgtcgtttgtgtaccccggtcggtcctggacggggatgttaatgcacattctgcttgaaattctattcgggaatttctgggcgtgacaattacccctctgttctttgttaaccaatccatacccaatatgacatctgtcacaccccgaagttctcctcccaagcctaaaatttaatttttaaaacgaccccaagaaaatgcaggtgaaatcaagagaaaaccctaagaaagtaatgcaaataataatcggatttgacatgtggaatttttcttgagatctacatgtcgaaattcattaacaggatttccagtggaattttcagagctctagaaataattttaaccaattaaaattgagtaagcaatattttaattccagggaaaatcctttttcctttttctttttctttttcctctctttttcctcctttttttcgaatgggccgtcggcccattccctccttcctccccctcctccttgctgggccggccgcaggccgaggcccagtcaggccgccccgccgcctcctctctcggggtcgccgacaggtggggcccacctgtcgggtc

SEQ ID NO: 103658 - DNA, 669 bp, Oryza sativa
caatagataacttgctaagcaaagtcagtttagatgatgatcttcctaaatgtacaattcagtgcactgaagatgttgtgaagacacgtgtctcttttagagttcctccacacaaaaaaggtctaaattctaaaagatcaaaaagtgtacttgatagaggaagaaatacttcaaataagaaaacaagaaagaaaagtaggttctctaaactaaattatgccttctcttctattttgttgttaacttatacttttgttctctattttaatctcataggaaaagatgttacggcattagaaaatacacaaacagatggaccttcacaatccaccttaagatcaacaaagccagtggcggatccaaaaaatcaattcgttggtgtcataacgtgtctattagtgtcataatatgctaattatatttagattatggtgttatattatatggataagcaatttcgctatagtttttgctaaaaatcatcggtgtcgcctgacaccggtcattacactgtagatcctcacctgaacaaagcaagtttctcattatcttcctataatatatatatgtgtgctcacatatcttaaattttctgcacacctttgattcaggaacaactccaatcaaatgcatatgaagataactcaatgcaagtgaggacaaatggca

SEQ ID NO: 103659 - DNA, 646 bp, Oryza sativa
cactaaattttctctggatataagggttccattagtaagctgcaaataataatattattgtagtataaaaacatgaattaattggaagagattaatgaaggttggatagcatatttcatgattgtaatttcatcagtaaaacaaaatacaatctatttgcacttatgctaattaaaactttctatgaactctcacattagctagaaattgatttgatgcatcggattattgtgaatgtagttcatgctgagagtcatgttaaataaacaaatgacacaaatgaaaatagcacagactctaatttagtaataaaattcataattaaaaatatcatatcgtatccatcttatactctgaatttagtatttattaattaaaatctagaattcaaaattcataagtagtaacttgtaactaacgtggaccctaattttagtatgagcagatcaatatcaactcacaaccaacacatgcaatgtaataatataattttaatattaaagagtagcctatgtaatgcatgggttagcgactagtggttataatttctaatttccgtagaaacttttatgagattgtatgtgtacttttcatgacatatgtacaacacaccatatgttttcaaactaagtattattactttttt

SEQ ID NO: 103660 - DNA, 1663 bp, Oryza sativa
ccacgtgtccagcttattggctaacagtatgctccgtatcagtgtggtggtgttcttttctcccgaagataaagatgaaaataaaaattaagttttttatgcaaaacgaggtgttattaacgtatgattgattgagttttaattattataaacttgaaaaaatagattaatatgatattttagaacaactttcatatagaaagtttttgtacgaaacacaccatttagcagtttgaaaaacgtgccacacgaaaatcttaatcttcatccaactcttgttggagaaaagaacggggtctatatgtaatattgtaaactactcccttgttactccctctcccatttcaaacacaactatgagtttacgtgtccaactttaatcatttatcttgtttgaaattttttttaaaaaaataataagtcatacataaagtattattcatgttttatcatctaataacaataaaaatactaatcataaaaaaattgaaataagacggataattaaagttggacacgaaaactcataggtacacttaaaatgagacgaagggagtattttcaatgacaagtcaaatcaccggtcaattatttgcccctagaactctgaacaattataaaagctaaattagtcagcatttgtactgttctaataaaaaggtggcactcgtaccacagtgctacttgcaatgctgttcaagttgaccggttgtagtatgttaattaacctgaaagtcctgagcgaagactgcttatcactattgttatgaaataacaaatcattgtttcggagttttgcagaaaaacgagctcagtttttcaactgaaaagttcagaagatagctccgcgtgtcattttcttcagaagttttgaaagaaaaaagggggctcatcagctcatgccatcaggtttgcataagtacagttgacctatatatagcacattaataaaacacaaaattcaagccgaaaataaattcaggtcaaataagcatttaagtttgactctgatggatgctccaataaaaaaaaacggtactacgtgtaggttgcgtattctccacaactgcacctactagccataaaaaaaacaagtggaaatcgtcgcacagcaagcacaagccaaggatcgagtccatgcatgcatgcatgaggacggtactgggcttttcatctaaaaaatatagtacacatattatcaattttcaatggcaatgagatcgatctgaagacactgatgaagactggtccagtttctttcagaagcagggaagccacaataatgaacaattgtataatgtgtaacactatgcagatagagttgtgcctcttgtagactttgcttgctgaaaaaccaaacgtggatatataaataagtagcatatgcagaggagaacggctaatatataagcaaattattaggtatcaatggaggcttcccagcggcgccagtattcctggggcctaaatatattttaaagtgtcaatatgtatgtaaacaatagtattatacttccttcgtttcaaaatgtttaacaccattgactttttagtatgtgtttgaccattcgtcttattcaaaaaatttatgtaattatttattcttttcatatcatttgattcattgataaatatactttcatgtatacatatagttttacat

SEQ ID NO: 103661 - DNA, 731 bp, Oryza sativa
tcctgcagcccttattccttctccatatattgggccagatgactaaatgggccggacacagactttctttctgctgctctccctgtggtctactggtctcgtcgcagagcagcagcatggcagttggcctgaatgcaacgcagaatgcttactgtactacttgcttattgcagcatattcattcagggtttcagaaattcagtctcagaatgcaaacagttggattctctagaaatttcaggaccaacacatgtaatcatcgatatgaagcataaatcgcattgggttaaagttcaaagtcaaggatcacaaatttgacaacaaatcacggaaactatcaccagttgttcgagcgtagccagtttgcagtgccatatatactgccatctcttgtttccatcagaacctacaagctaggaggagtaccgattaaacttgctttgtaattgcatcccaccaagatatagttatgaattcatgacgaggagcagcacaaggcttgcattgcatggctgcatcatagcttaccatactccataactgttactcctagcccatccatcatgatgcatatgccttgccatgctctcttcagacttcagatcatggattgattcatcgatcgtttcgtcagaaaccttagttccccaaaaaattttcctaaaaacatcacatcgaatttttgacacatgcatagagtattaaatatagatttaaaaaactaattacgc

SEQ ID NO: 103662 - DNA, 608 bp, Oryza sativa
ttttttatctgactttttgtttcttcgagcacttgggttcagaaccgcatggtttttgtttttcgtttcgagaaaaagtggagctctgttccttgcttttcaagtgaacttctgcaatttccatcctgttctgcttcagaattttatttgtacatacatgaatgtgaaagatatcaaatgtgtacacatgtttgtagtcttgtagagagtatgatcaatgatatcaactagctgctgcattactagaaccacatgcagataaggtcgaactaaaccaaatcaatgataaaattttgagttattaaaactaagtactttggctggtgcaatgatatcgacggctccaatacacgacgacataatacaggcataaaaatactctggcaattagtttaccaaccggcaatgcaaattatacgacagtggttaggagatccctatcaattaatcatcggcagcgactgtattattctgacgcttgaccaaaatgggggctggcctgaacattaatcattttcaggaaaatgtacttatctgaaatctacaaaatatcaatgtgtttggttaaatttaaccctttctataacatggattagttggagtacatt

SEQ ID NO: 103663 - DNA, 680 bp, Oryza sativa
gttgtttgttataggttttctgaattgtgagttcatttcctgatgtcatgcgtgagtctttttttcatggcttgccttgagtgaacagtgatgctcttttattttgccgacgaactttcactttgtaagtattttcagtgaataaaaacaaaagagcaactaagttctgtcttgtaaacccccgtaaaataaacttgtcgttgtatcatcaacgccctcacacttcagtggcttgggtttcatacgtggaataaatatggattgtgttttttgtgggttgtggtttttttaaattttaattgtgccatctattattaaagttcccagagtactaaacctcgccaaagaaagttgttggaacgaagccaaagatgctatccaggtgacaacccttgtgaaatgttgttaactttggcagtgcattttcttttggtgctgcaactttcccggtgaccaatcaaagtcttcttgtggaagaggcaggaggaggttaatgagggcattgtttggtagttggtacctctccctatcctacagtaatattatatgtttttcctcccatctatcataaaattagttcattttcaagcaaccattgcatccgagtttgtataaaagtagaagataaaatacattgaaagtggataaaaaataaggtattttagttacattgagagtgg

SEQ ID NO: 103664 - DNA, 787 bp, Oryza sativa
gcccttacgttgtgcacatgtaccctaaagcttaaattaaaaaaaaaaagttcaaaaaaaaacaaacaaactcctgagtacagtttttgtgctgagctcacaaagagattacagaatgaacaaatcaagattcttctataagactgaagtgctggttaccaactttcctggttaacattcagcaaagcattttctctctaagtcctcgaactaggatcaggatattttcttttgtaaaattcacttgttactttcagaccaaagttgtgttttacataaatcatgcgatcttggcactcctgattgcttggttgaaaaaatatttctgaataaaaaatattttaaatttgccattttaaaataattgtcttctttgtacccaaatgttgttttctactatttgtgattctggaaatatttgatccaggtccatcacggtggcacatatgcaactgtttgtcagtggcttctgccctcgggtctacaagaaacatccccccatgttgaacagtttttccaaaacggtttccttaaaactaacttagaagtcattcttacaaaacacatatgacacatatgaaatgtgaccacttctcactacctctgtcaatactgcctgaagtcaagccaccaacatctcataacctcctgatttccctgtctttcttcctcgtcagggctgctgggacaatttatcttatttatttatttatgagaaggagtcttgctctgttgcccaggctggaatgcggtggcgtgatctcggctcactgcaagcggccaaggg

SEQ ID NO: 103665 - DNA, 623 bp, Oryza sativa
ctctggatcgagaggtaaaaggcaggtgatagatttgcatggtgaaggtgaaggtgaaggtgaaggagttggaggaaggcaggttgcagaacaaattgaggacaagcagctagtaaagaagatgaatgttttgatagaaattggtagtgaaatttttctgctactgaaatgttttgtagcttgctgtgtatgtattttggccatcaatatatatgctttgtttaggaacggctgaatctgtgttgagaaatgtagtggcatggattaaatgtaatggcataatttgtgcaatgatatgatatggctatggcctttgctgaatggaatgaaatggcctttgctgctatattgttctcatgagaaaatttaacctgatttcacatgaatctcaaaaaatttagctaactgaatcccagaaaaatgagctaattgaatcccatcacaattctaagattactactggagacaggacatacattactagataaattgcagtgccattactagataaattgcagtgcatcacaattatattccaaatcactactggagcttaaaaccactgtgaattgcatgtaccatctcactaaacaaaatattagattacttctaccatcccagga

SEQ ID NO: 103666 - DNA, 2096 bp, Oryza sativa
cccccctgctgcattagcactggtcagacttcctccgcccattttaaacacaacctcaagttttttttaactttaattgtttatcttatttagattatcttttttaaaaacaataaacttaagttacgtataaagtatttttagtgtttaccatttcataacaataaaaatatttatcataaaaaaattaaataagatagataattaaagttagacaagaaaaaggagagggggaaggagtattactattcatctcggattctcggaggcaagagcaacgcacgcagatgcagccgtccgtctctcatctcctttcctccctccctcctgtgagcgtcatcatcctgaccagccaacatcaccgtagcagcagtaatgatcaaacgagcatctcgcgcacccaatttattactcctcctcctctctctcacacttgtgccttgcagtaaaagccaaagcctcttctgaccccctattcccccctacctattctcagactcatcagtgcctcccagctcaaaacgtggcctgctacactgtacacttgtaccctctccccctctcgccttgtcacgtctcgctgcttccgttttttttctctttctttctttcgttcaggtttactgttcccgtttgaatacagtgaagatgaagataaatttacaatccacaaagaaaaatcattagcacgtaattaattacttttaattattataaattttaaaaaataaatttatttgatattttaacttatatatacaaattttttatgaaatatatcgtttaacagttaaacataaatcaaggaaaagtctaattccttcatcccattttaagtgtatttatcgttttcgtgttcaacgtttaattgtccgttttattttaaattattttattagtactatttttattgttattaaaaatttataatttttaaataaaatagacgatagaaaccataaataatgggggcgaagtataatgttaagggcccctttgattcgcaggataggaaaaacatatgaataggaaaaatgcaggaattaaagtactctctccgtcccaaaatatagctatttctagtagtgtcttgtcccaaaatgaagctatttcttcacctacctcctcctctcaaccaatcacaaccattcttcttcacttactttctcttttcaactaatcacacacttcctccaatcattctcatatactttcttaataccgtgccaaccttaaaaatggtttcattttaggacggaggaagtagtaggtttctcaaatactacatgaatcagcaaacacaggaaagacaatagaagtcctttgatagtgccatgggaaatacaaaggaaagttcacaaggaggtcacgtctcttgctatttttcctaatacgaagcataggaatacaatcctatagaaagtttcccttaattcctatgaatcaaagggacatatagaaaagaatccataggaatttaaatcctatgaaaatcatttgctaatcctatgaatcaaaggggcctaaaagatggtacagctatcttaacattgggcttgtttggatgcttcgggctattaaatatcccttcgaaatcttgctatttaggagtattaaacgtagattactaacaaaaccaattccataacccctaggctattttgcgagacaaatctaacgaggtatattaatccataattagcagatgattactatagcatcactgtagcaaatcatagattaatatatctcgttagattcgtctcacaaaatagcctaggggttataaaatggattttgtcagtaataaacgtttaatacttctaaataataagattccggagggctattaaatagccctccggatccaaacaggcccattatttatctcactctctttctagctcggtttattcttatctcctcgcctccacctcctcacctgtagttttcctctcctcctccttctccttgtccttctcccatggatgataaaacccgcgcggtgagctgagttgatctctctctcaagaaccgagcgtgctctggcgatggaggccgtcgtctgcgtcaagtacaggccggtggtgttcccc

SEQ ID NO: 103667 - DNA, 573 bp, Oryza sativa
catctgcattttttttccaacaactatactagtccgcatgccctttttgaatgatctccaactattttaaacattataaattcctgcccatagtttgtgaatctatagttgtacaacctagagaataatttgagagtcaaaagctcaaaaacacaactttatcatatgagaaaatccagaaaataccaccgataaacatccaaattcaagaaatgccatcgatgaacatatattcctaaaaatgtcattgtacaatcgtctttgttccataaatatcatcgtcattagattttcattaacagcactccgttcagtgctataaaaagatcattttaaccctacgaattgttgaaagctgattaaaacttttgttcttttccattgggttgcacaggccatccctgggccaggccaggttctgacattgcccacaagcagcccattagctgtctcggcccagatcttccaacgcctgaactgcatggacagttgggtacacaggtcagcgctccgaagaagaaaatactttccttcacgttggcgcccaaaggtcgtcatcatcatcgatccaaa

SEQ ID NO: 103668 - DNA, 541 bp, Oryza sativa
tcttctgaatccatgcctacctttattgagaccttttttcttgattacaatcttttgtttcaatatatcttcagcaaatcatgaattgcttacggttgggagagacaacagcgcttcttcaaaggtgcattattgattcccgtttgctgttctacttcttacacatgaatgcacctgctgtataagtttttaaagtgtcgtgctgcttcacatggcaaaattgcaaaatactgaatacctgagtaacttacatgtcatcactagtcataagtcactactgtataaacgagctcttataccttttctgttgccattgctctggtatttcggacaaacagtttttcttgtgtttgctcatgaaatgacgttattgaatgttcctttcagtcatcttttctcggtcgaacagccagtggttcattggcatcttcccacagatcggcctatagaacctatgtatttggtcgtgacgacagcaatagtagcaacaagagctgcttgtctacttccgtagagtaatgcagatacggcaagtttgaag

SEQ ID NO: 103669 - DNA, 651 bp, Oryza sativa
gtacaacagaaattattactgatcactcatgtatcagtagagatatgtaggcagttggtcaaagagccagtgttcatagaagaatcttccaaaaaaatgaaaacaaaaacagagtcgttgcattctctgtcaagtgtcaaccagttctaggtttgatttggggaaggaaatgcaggaactgcacattgacccttgaccaaagatttcattcctatcgcgatattcagatcttattctctgatcatccacttgacataatttgataaattggtcaaataactctgattcgttcattcgtttttgttaatccatgtagaaaaaaaatgtagcatcaagaaatgccattttgactgtctaactgtagtaggattaagtcaaagttatcatttacctgaccaattttactatttcatataaatatttgttcatgttgaccttctgaatcttatataatattctgaaccgatgattgctgagtcttctggtctccatactatccagagagatcaccactgcattctacgaaagagtttgacaatgttcaagtgaactctaaaatatgtgttaaatcaagcttatccttgtaaaaatgtgcatatgcattcagaatgtgaagttgactttgaacaagaagatgatgggcttgacctt

SEQ ID NO: 103670 - DNA, 675 bp, Oryza sativa
gtgcttaaacgtagagttatagatgctggtgaagataagacacaatatgtgactgaaggtggcattcgtgtataatatgaacccattgtagattaaaatggagaacagtataatcagcatgtggcaaacaaacccatatatatccagtctgagacattcatgcaataggatacatgcatatatacttatacaagagcatgttttgcaaacaatcaaagcaagtagtgcagacttggatggaattatgatctgtatcatagaaatccactttttatcacacttagggccccttggaagacccaaaaccccagcccatcccatggacgtgcccaggattcagcccccgaaaaacacctctaggaaacatttcattccggttcaaacatgcgttctgatatttgttcaacatcaagttaacaaacattctaggaggaaacagtcataaggaatttagaatggcatttgcaacaggggttacgacacatacccatcaggcccgactgtggagttgtccatctgcttatcctgtactgcctcatcaagtgacaactgatgctctgtggctccagcagagtatggcgccacacaagacgtgctgaaatcccgaagccatggttcaaccgagaagctcaacttgtaacttggcccaatcgcatcggtccaaaatgctctgct

SEQ ID NO: 103671 - DNA, 1014 bp, Oryza sativa
aaagctggaatcgaattccatccatgcataacagtccgtcgcacctttaatttcaagaatatctttagacaaaatctttgaagaatatgatactttatgtctgtatttcctcatatatcaaaattaattgcctttttgtttgttagcttatctcgaagtgcttatcttatgcttccaggagtgagaattggcagcttctagaatgctgcaatcatacatttgctcgtgaaaagaattcaacttttcttcacctattgagggtctgtttagatccttgacaaaatttttcaccatctcacattgaatgtttggacatatgcatggagtatttaatataggaaaaaaataattatgtagattgcgtgtaaattgcgagacgaatattttaagcctaattgttacatgatctgacaatgtgatactatagtaaacatttgctaatgataattaggctttataaatttatgtcgcagtttacaagcggaatctgtaatttattttgttattagtctatatttaatattttaaatgtacccgtatatctgagatgacacatcaaaactttttacccctggtctaaacacagtctgagttgtatgcaagtgccaagagcttaaaccggcctatcgattttacagttgaagatacgctagcacatccaactcataactggtatacaaaagcaaattcgatctattcatctagacaagagttatgtcagacaccactgaagtgcatggttatgctatgtcagacaaacgatgaaacaagacaagctaaatggacacatgcaaataggttagtggacgttaccagtagcactccatgattggcttcaaggtttgagctttgctaagttaaatcattgtccatctctgattctctgtcagctcaacaccatgaatccatgattgagggcaatgttgcagataagtaatgttgctgtttactgcaactgaagaaatactactgctattgagctggggttaaaaaaaaatcttccaaaacaaagcc

SEQ ID NO: 103672 - DNA, 633 bp, Oryza sativa
ttacctttttggcatgatataatccctaccccgacattaatggaacaacgtagacgtgtctagattcgggccacattcagttgtctcctagctagtccagggccaaatcccgggtcctgttgctaacaaggggtctacctgttgtttgatctttggattagagctgaattgaaccagcccattttaaatcaaatagattaatatgaaactagtttataatgtttttatgccaacgctagcttatggtttcatttcggccccgatgctcccgcgggcatggggggagatggatgaggaagacgggagaggagagaaataattagtttaaatcatatccctccatcgtaataccgaaaatcttaatcccaacctaagttagatctcatagcagtatggagagctatttttgctgatgtggcatattagtcaaaaatatttttagaaaacttgtgaagcccacatgtcactagccacaccacagcacaccttcttcctctgttccaatctcctttcttctgtggaataagttcatcggaggtccctcaacttaacagcgatatttttttagtcccttaaccacaaaaccagaaatcttcaccctaaactataaaaaaaaccgtttaattggggtcc

SEQ ID NO: 103673 - DNA, 789 bp, Oryza sativa
cgcggtggttttgctctacactagtggatcccccctttcgatcggcacctcttcttttggggggataatttgatcgataaccaccttagaaacaaaagttcagtcctttttccttgttcattctcggagatctcaacattttctttccaatcaagcataattaggattaccatgcatgcgtgcaaacattcatttctgaagccgaagccggagagcagagctctggtcatatccaaagggggtcggagttttgaactccgatccccttcgacctctttctttctcacgctcctgtgatctagaagcttaaaatgcagcatgttggtaatgcctgcgcctgtgctttactgcttttcttctgaaagaggaatatatgaatcagttttcagtttgccgacagaaaacataacaatgacaccgccaacaaaaggaaaaacaatagtttcagacttttaagtgctagtagaaaggataaaaggaacatttgtatgaattttatataacattcttatgatttatttattcctttatggcagtagaacccagcatacaaaaaagaaaaagtaaacttcagagaggggttcggagagttaaatttcggtgcatgtctctcgctcagccacacccacacacctctctctgtctcttctcctttgtcgtgcatgctttgatgcacacacggtgaactactcgatcgatcaacagttgagcttcaggaccttaagaagaaaaatgcagtccttgattccctgaaatgtcaacatttttctgccgacgaagcgtaaaaaa

SEQ ID NO: 103674 - DNA, 676 bp, Oryza sativa
tagagttttcaagtcttctcattgtaagagtaaaccctgaactatttgatcgccttcgttcttcaatcttgacgtcttgtggttgtggtgtagaggattgaaagcagcatgtgttgataggcctgagcctgcacctctcttctggaagagggatacgcaattggtttcagtttcctgtcagaaaaatagaatagcaatagcgccaacaaaaaagaaaagaaaagaggttccagtgctgctgatagaaaataaaaaagaaacattccatggattccatgcacgtgcttacgatttatggtagattccaaaacacaaaaaatattatgaataaactcatccttgatctatactactactcgtacaaacataagatgaatacattctctcctctttttttctctgcggatttgctactgaacctgatgaaatttgaagttctggactggtctgaactatgaaggcttaaaccccacagaaacgaaaaaaaaagaaaatacagtaataaactcttcagttctcaagtcttctcattgaaagagtaaaccctgaagtctgaactgaacatgcaatttccttctagttagttgatcctgacaggtcaagtctgaaccgaagcttcagtttctatcatcctcttcttccccaggttgatgatcctgtcaagcaacggcacgag

SEQ ID NO: 103675 - DNA, 537 bp, Oryza sativa
ggatccccggtgttgatttcttcttcccttactttcagggtgagaaatggttgtggtcttatccgaacaggaagtatgacggaaaattcttgcatacactacctccgttttttaatatattatgtcattaatttttttataaatatttaactatttatcttatttaattttttaatataaaaaataagtcaggcttaaaaaatatttaataatatatcatgtcataataaaataaataataattatatattttttaataagatgaatggtcaaacttatctgaaaatcaagagggtagtagtcatttctatgagtaaaaaatgcttgtacaaagtgaaaaaaaactaactattaatctttcgatagatttatatcttcaaatcttgcagaacttttaaccaatagatataacccatttaaaataaaaaaaacatgtcaaaaattgtaaatctagagagaattgtaaggatctaattttgacgcaagttgaatatataagaacacaaataatgatgcaaaatccaacggacgaaaaag

SEQ ID NO: 103676 - DNA, 721 bp, Oryza sativa
ggattttaattattaattaatccctaatcaggaataactaaatactaataattaattgattgttaatcaaataattaattactaatcaaaaggagcccattggacagtgtcgctgattgcttgaacggtctcgctctttcagtccgcgaaaccgcgcgggctcgcggtattgccgcgggagaccacccgcgacgtcattcctgcgtcattttcgcgcaatggttgtgcgacaccgacggtatatttctatacaagtttttgcatcccgaatattcttgagaaaaaattgaatgaacagtatattttcaaatttaattctctctcaagtgatctagctgatgcatgcaacttaatatggcctagttagtacctcttccatcctcaaatatactagcaacttttagttacatgtctaaataactaaattgttaaaagttgttaatatcctggggaccgagggagtaggacaaattaaacgctcactttacttatatctcaatttcgagagcagtgttaagaataaacgtgaatcgttcattcctttttatcatattaaattctccgaacaaataaattagttggtgtatacaactcaatggtagataaatcagttgggtgtacaacacacgatagtggtcacggcgccgatggagtcgttggtccaatcagtctcaggttctataggtaggcgcctgtacactaaacatgtggaagtgcggcg

SEQ ID NO: 103677 - DNA, 663 bp, Oryza sativa
tttatgctctcctaacttctagttgttattcgcagcgaccaaatggcggccgacggcggagcgggagctgcggcgcgctgggaagaagcgggagagggggagaggaggcggccggcgccagagaaggggagagaggcgcccggcccgatcgcccatgaggccgcaacggcaggagcggcggccggcgccgcctctccccattcggaggcgggagcgggtggagcaggcgggcggcgcgcgggcggagcaggcggagcatcggcgtcagcgcgcggcgttagcgggcgagcgcggccgcggcggtgggcgagcaacggctctgggcgcaggcggcgcgcggccggagtaggcggagcggcggcgtcagcggtcaagcgcggctgcagcggcgagcgagcaccgactccgggcgcggccggagcagtgcggcgggcgagcggccgacgaggtagtcggtgacggagaagaatacttcaataagcttcactagccgccgcctccggagacggagagctcctcgtcggagttctaatccaacgtagctactgcctcacaatttcaagcatatatataactacttgtctaaacgattgattatgttgtgtttgagaattaagatggcggatccagtgagtagcatgaagcatatcacggagatggctc

SEQ ID NO: 103678 - DNA, 505 bp, Oryza sativa
cagctcaaggacacttgttaaatgattcctttcgttttgcaatcgatgaccttcgtttgcacaaacaaatctacatgatgtaacactaccatctgacggccatctgtttgtataccttttcctgacctcaaaacctttctgtccacagtagctaagccaaaatgcccaagccacatctgaatttgtaaattccatgccaacttgaggtaccaaactaggcatcaagttatttctgtattgaaaaaaaaaaacactactgagtatgaaactagtgcatagatatgctaacaaaaaaatcgccaaaaccatgctgtaaacattgattacatattggcacacatattcttagagaacattcatggccttgtagttgtattacacacctatgtgcttccatcgctggactatttgacatagtttgatggcaagcctcaattgcttcttccatgagaaaaggggaaacttgatcgatttcaaagcaacctaatggtggaagtttgattca

SEQ ID NO: 103679 - DNA, 582 bp, Oryza sativa
taaataaaattgttatggtggtaatgtagtcagagtgtccaagcatttcaagtttgtcatctttcgaattacaagcttctaattatgtacctaatacatttgatattaccttttcaaatcaaatgaacgaagggaaacactcgatcaataaaaactatttggaattaaaattttgcttaaaccgtatttgttttgtatgcacagctgagcacagcattatgccgcgcatccccttctagtcggtattaatctagattcttcaactgttcataaacatcatctggcttactggagctgtactgataggcgagagcttatgagagaaacaatgtccacattatactaaacttctttcgaggccgggctgcggacggcagagttcgagaagagtttacccacgccgtgctcaccaacgaccgacgtccttgactcgccgtcagttccagccattgctgcccaggtgctttatttgctttaagacaatatatcatgctgtccatgtgaaatttggggatcatcttgcatagtagtaatcagtaatcttggtggttaaaatacaagtcttgtctgagctttcaagtc

SEQ ID NO: 103680 - DNA, 593 bp, Oryza sativa
  unsure (1)..(593): unsure at all n locations
atgcaacctatatgncgaagaaatgttaacgatgccgtctgataattagggggcttttaactatttgccactctaacgaatggtgcttaacgatttgccactaggcccacatgtcatagacacatgagggcccatgtgtcattgacagagcatggcaaaatcgttaattgccaagtcacaagagtggcaaatagttaaatttcccgataattagtggcccctactccccagcctgactgttgagcgcgcacgagaaaatgtatcaaggcttcacaatttacacatgctctcttcaaataatttcacaattcaagttcagactttcagtaccagaaaatggttctcaataatgcagctttatttattatgctagaacatcacaacaaacagagagaaaactccaagaaaggcaagtaaaccacacacaaacatagcacaaaccacgtcagcacacatatgtatatagttttggtaggaggataaatttaatttcctcagtggtaatattccagcctgggttgttagtgcgccctcctaccatcattctccaatgccatcacattaccgtggtgacgaacctcttgatgcatgtg

SEQ ID NO: 103681 - DNA, 1075 bp, Oryza sativa
gactccggcaaccctagctccgtgtcgcagcccgccaaagaagtgcgcagtgggcgggggccagctgccgtctccgccccactcgccggccggcgcctttttccctctccgtgcgcgctcgccggccggcgaggatggatgccgggagggagagacaagaggcgtcggtcgctccctctcccagtctcccgtcgtccaatcgtttgtggatagagaggatggtaggacccactgacaggtgggtccactcttttttccttttgtctaactgatatgtggacctcatatttttgtttttgtttttaatttttatattttccttccagtgccacgtcaccgccacgtaggacgcaaacaggacacgtaaatgccacatcggccaaaaccactatcaaaaccgctgagggacctgctttgcaccggttttgatagttgagggacccgttgtatctggtttttcggttgaaggacgaaaatcggatttgttgataagttaagggatctcaagtgtacttattccgagctgataatgaaacacaacatagtctgattaaacagagcccaaaccatctcacacacagccaccagtcaccgcgtgatggtgaggcccatctaattcatttgtggtccagctcgacattgagggattttttagggtttcctttggattagtggggtgtcctagtctgagggacggcggcggctgctatctttgccctcaccatcgacggcaggtggggccctaacgcacggcgcacgtgatgcggcaccggggaaccttggcacaacggtcggttcgagagatggattggcgcgcgaattgacgtgccctggcgcgacgctcgtttcgggagatggctccgtcttttccggcgtgcgttgagagccccggcaccaccgatggtgcgcgtcaaccgcgtgcctggacgagacacatatgcatcgaggacaccactataaaataaaggagttaatttagattttgtgaagaaaatattgatggtttgctaatgttaatttagagattttataagacgattgattttatgaagtgtgcagtttcggttgaccttgg

SEQ ID NO: 103682 - DNA, 844 bp, Oryza sativa
agcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtagaaccatgtgtcttctagggacttaagcacatctgttaaagcagtgtgcgcatggcgtatgctcaatactttggaaatttctttattcacaacatacaagcttctttatagctgttttgctatgtgaattttcaatgatgtagccaactttaggttacactcatcatattttacaaagcagtcggtatattacttggatcatattattcagggattcacaccgcatatgctacatattaatattaagtcgcttggttgaatacaattatcgaaaccactcggtgcatctagtcgatgcacctgactttattttttcaggccctccacagtcttctgatttggaaaaagtactcgggagatca

SEQ ID NO: 103683 - DNA, 606 bp, Oryza sativa
ttaagaggtctcaaagttttattgctcgtaaatttatttattttaccatcctgatagccctcctttttaattgatcaaatatatatctaatatagtgcctcttttaatatgtgagaccgtacggtattttaaagaaaagacatagtcaacatgaatcataaattaataattcattggaaaagttaacttttaatcatattattaaaagaaagaggctattgattttgtattgccaccttataggcttataaatgcaggttgtagagaaaaccatggagctactttaattcattgctttatcattgacctttgcctcttggtgtgtttaatatgacttatgcagagaaatataaaaattttgaaagaataaaatatcattatgaggttaaatgagctatgcttttccataacgaaaggagtatttattcaatactatcttacaggtttagtgcttcactaaagtagttttatgtgtaaaaacttcaacgctatattgcgggtgaagcattctagtaaaatagttctgtataaaaggattataaaagttattttcaaagatgatccatgagtttgagacaagaggctcactgcataggagggtgcaca

SEQ ID NO: 103684 - DNA, 534 bp, Oryza sativa
tgcctgcaggtcgactctagaggatcccctttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcataacctcccctcttttttgaagaaattttgaagcttgctcgggcagctggaggaggaagaagacatatatataggggtgggactttagtcccggttggtagcaccaaccggggctaaagatcaccgggatctttagccccggttggtgctaccaaccgggactaatgtcccacccctatatatatgtcttcttcctcctcccgctgcccgagcaagcttcaaaatttcttcaaaaaagaggggag

SEQ ID NO: 103685 - DNA, 601 bp, Oryza sativa
gggggggtgactggcacctgtgatgtttctgtttttcagagggcatggctagcaattcctgaggctagccaatatttagcatttattttttttctggaattaactcatcagtgacggttcggaagaaacatccgtcacaggtaacctcacctgtgacggactcgcaaacgtcggaccgtcacaggtgacccacctgggacgggcctttactttcgggcccgtcacaggggggtcaccctgggacggcttactatataccggagatcatcacctctgacgggcctttatttaggggctcgtcagagatgagacacctgtgacgggtcctaacaagccctagtctagcttagaccaacacctctgacggccttctattaacttgcccgtcagaggtggatgtcaccactgacggacggccacccgtcaaaggtgactggacttaccagtgaccactgatcattgaccaagcccaaaaccatttaaggtgaaggtttgggcccgtcacaggtgaccttgaccagtgtattggtaataaccattgggactctatgtttcacgtggctgggtggggttgcaattactattttttaaatgttacatt

SEQ ID NO: 103686 - DNA, 2732 bp, Oryza sativa
cgacatgatctctccaagcggttaagcctaattaggagattaggctctgataccaattgaaagtgtcaattaggcttagagggggggtgaataggctaattcaaaaattcaattaaaagcggaagcagtaatttttggatatttccgaaattttcggatatatccgaaaattttcggagtcagcacaaacacaaagtaaatcctagatctagttgcctacaacaagaatatgttagcacaaacagcaactagacctatagcgactcaaacaagcaaagctagtggagagggaggaagtaaagtcaccaaagatgaagctcacgaagttgttcccgaagttcgaatccttgaggggattctactctcagttgaggagctcactaagagctaggtcttagctaaccctttcctcaagaggttgcactaagcaccctctttccactaagggtatctcttccctttcggaggtgagatccgaccttcacaaacttctcccggccaaccacaagtagatcggtggctcgggagcgacacctagccgcctagaagtcctcaacctccaagagtaacaaatggtgcaatgaactcccggagatgatgcaagtgctcacaaatcttcacgaagtcaacaacaagcactcacacaaactcgaatccacaactcacacacacaccaaatccgaatcgaacacgggtgagaggggaaacaagaaagcaaggctcaaaagtgaatctcaacaagagcaagccaagggcacaagaatatccaatgtgaccagcagccctcacaagtgaggggagggtgctatttatagccacagcccaaaatctgctcgttatgcacaataattgagattttcggatatttcgaaagattttcggacatgtccgaaaattccagctcagcactaacaataaagtcaacgaaagatttttcggacattccgaaaacttttcggacaaatccgaaaatttccagaaccaaaaaccaccttctggatgtttcggaaagtccgaaaatccctttcggacaagtccgaaaatacacagaagcgattttgggacaactgatgattttcggaaactctaaaaatcaatttcggaaaagtccgaaaatatacataaccatatttgccttcatagtcattttcggaaagtccgaaaatccttttcggacatatccaaaaatttctagaagcgcccaacaggttctgtgtattttttggaaggtccgaaaatgagtttcggacaactccgaaaaaatccagaacacttcaaactgaggagagacactttcaaaaatagattttgagcactttgatcactcctcatatgtcaatgcaccatccctcttaatagtgtggcattcctattgactcaaaggaaaagaaaaggtacaatataccatttgctcatttgctgcatcacatcatgtcaacgtatttggcgggatatgcattacgctaactcattgaggacataacaaccttgacatttgcttaaataaaaatgttagtcctctctaatcgcattgtaattaatcaccaaaatcattaggggcctagatgcactttcatgaaccatcctttatattgttacctttattatatccatgttgcctgagtctattatttatgcatggtcaattattgacattgcttaatattgcttatgatatacactccatagtagttggatatggatgtgttggtggcggtcactcgtcaagagtgattgccagaaggcgggtggagacatgagcgccacccgcagcacaaaaagctttgcgaaaaccaaaaacctaatgaaacaaaatgttttcgactggggcggcatggatagaatatgggtggttctagaaacggctagtcgccgaccctagtcagttaaagaccgagtcaagaagctatgcaagaaacaatcagagtacgaacgcacttctcgagtgggtatagacccggtggactaagaaatcctcgtggggcggcacccctgtcatggtggttctgatgtgagatgttgtgatgttgtgaagggatatggattggttaatgatgccaaaaatctaaaatgcacctaacctatatgtaatataacccattgtgatcctgggagtgccaggactctcctcactgccggctcgaggtggtgtgttgtgccgggagtgcaatggggatccatagtccttggagcgggtgccgaaatgcaagggtgattgaaaaaccgggccgtggcaagtctcgtgggttgggactaggctcatgtgttgggcaagccgcggagtgcgggattaaaagcatacatccactgcagtgtgagtaaatcaaatatattcgaatagccgtgctcgcggttattgagcgccgggacttgtactacacttgactagcctcatagattttaaatcttgcttagttcaggaaagtggtgtgaccttgcccgatgggcgggaaggtcatgatgatgttgggaatgtggaaaactggatgcgagggtaaaccgaaccaaggtggatgaaccctcgcggattaatgacaaattcaacttaacgttgttttcagttaaagctgctaggtcataggtttgcgaaatgatttgtgaaatctagctttatgcgaataaaccaaccacccttgaacccctgtgtgcactaaatgcattatgtagtggtggcttgctgagtacggttagtactcacccttgcttaactaaatcttttagagaggagttgg

SEQ ID NO: 103687 - DNA, 1374 bp, Oryza sativa
gagggtgggttgtgaggggagcgttttaactattacgtatcctgggtgaataacagttctataccccctcctcctcaagagcccaacacgcctcccccttcttttgttgggctcaaaacccacctcccaccccagttaaagcgtggtcaaaggacggtcaaatcgctgcctgttgatggtcattattgatcagtttcgactctcaatattactaaaataaaggaaaactagtgatacttgcaatgcatatatctgttagaacaataatattccactagtattaggtctactaacatttttgcagagaatgacaataaagtggaggagaatcgacatcaacatagacgataaatcaatcggacgatgttgagagttagacttatgcatgaatgggccaagaactcagaattgacacgacatactgggccaaatttcacaagtctacggaggagaacaacagaggaggccacctgccgaatatgggccaggttgggccggcccctggttcggccgaacctcccccggtgccgttggatccaggttttggctggaaggcgtggatcactccccaatgaaggttggagggcaattccgaccattccaactgccacaaccgtcattggcagcctatttaaggagctgctctcctcacttcactcatacacctcaagcaatagctctctcatttctctcaagtttagtttagtagtatctagctggtggaataggaatagagtagaaatcaggagtccggaagccttcggaagagttcgggtatagctctagcagatttcctttcctcttttgtaagctttgtacttttattagaatactcttctaaatacatttatggtattgaaatacttttcaagtatatgaatacctactttacattatgttcatgttatactgaatatacggctagcttatctgggagatcctttggggcgggtataatgtttgcttatgcaattactctatgtcatgacgatgatattagagtagtatctggtagtttaggcgtggtgtctagattacaggatatcattatttggggttatatattacggatgagaggtgggccgctgatggtgacagctcagtacgggtattccttcgcgccggtatataatcctaagttaattccctgggagggtattactccgtatttagccccggttgtatggtcatgacgggctgtcgtaaggaactcggcagtcaggggtggcttctcgaagtactaggcgggcatcggatagagggtattagctagtatattagttaactagaatgtatgtatactattagaagtataggaatagattttctttctcttttctctccacttagcttagatgatatattatgagaatg

SEQ ID NO: 103688 - DNA, 710 bp, Oryza sativa
atctaaacataaagccataaggtaatgatgggataaacccccaattcacttaaaaaagttcaactgaaaaaacattttaaaatcacatagattttatagcacatcatctggtaggtaattcaacgttgcctgcttgtgtttgtgtgctagaaacatattagcagtccaactagtgatcatctctgccttgtgcgtatcgaatattccgtatcgaaccgagactgatcaggttgacttgaatcaggcactgaggcatacagtactatgttgcacattcacattactgtttcttgtcaaaaaaaaattagtcattagtcagtgttgcactctggtggaatctaaacaaaagtccaaagacttgactatccggagactaattgtgccttaatcactctctcttacatttttttttcgttctatatatatggctatgaaacatgcacaaaattaataagcccagcaactaaattaaacccatgagactacaaattctcatttcggattaacccggtatttgaagtgtcacagaattttaaatctaagttcactctgcaagaatataaatatctaaaaatgtattatggatgaaacttaattaacttgcttgacttaatgcaatatatgtgatgggacttattttagtagagcaggtattcctttgctgcgcttgcttgtgtgtttgtgctaggaacatactttttccatccaaa

SEQ ID NO: 103689 - DNA, 967 bp, Oryza sativa
gttacgaaccgggactacaaagggtttctctaccagtgttgacttcgaattttgataaggttacattcaaattcatagttaggagtttgatttatttcggaacggaggcctaatttcaactagctagtagggatcatgtttgcctagctcgtgcctgtgaagaaatttcatatattccgtatcaaaccgatagatacggagtacttactaaagtcaggcattgtgaggcacacacaagctgtttcactttcctactgtacgttactgtttcgagtcaagaaaaattaagtcatatcagttgatgttgcatttcctggtggaatctaaactaaagtccaaagactacttgactagtatatccggagactaattatttgctgatcactctcatgcaggagggatgctgccagcgctgtgcctaactatagctcatctcttgggttatatggctataaaactgcacaaaattaagcaacccagcaactaattaaaactgcataaaaccacgtagattttaacacatgacacataacccaaagtagtatgatcgtaaagttttacaaaaccacaatattaaccatttcaacatactgatatatcaaatttaaaaaagcggatataacaaactcaaagaaacagatgtaacatttatatgttggataaaatcctcaaaaatttgagatgtgattgtgtcactcaaaagtatggtagatcaaagtccaaatgattgatagagtggttttatgaaattttaaaatcataatacctgggtttatgcgccactttccaaaatacatgattttggacaacttagaccataatatgtgggttttataaaatttactaaaaatagagagtaatctgaggtcaaattaatagaaaaaggaagtagtgtgtactaaagctaatgtattgatcgtgttgtcactaattgattaatatgtgtggcatggataaaattagagct

SEQ ID NO: 103690 - DNA, 571 bp, Oryza sativa
ttttttttttaacggaaaacagcgctagtgtgctttttcattgaatagagcttgagaaaatacaacccctaatgataaaaaaaaaagtcacggtaagctacacacgaacgcggaataaactgcaagggcctagagactagcctcctctttgatcttcgttaaaagaaaactcattgccatctttttgtggtcgaaaatctgtcggtttctctccttccagatctcccagacaactagcaggatcagagatcgaagtcctttttttgggacagcgaacgtgtttgctaggttcttccccgcacgctctcttttccattttttccgcattttttttatttagccgcccccttccttagcgcatttttcttttttcgtctcttttcccattttttaaatctttaatacatgtgttttaaaatttttgagttgaaagtttttaaatcttgagttgaaagttttcggatcttgacttgaaagttttctaatatgaataaaaagtttcaaatctggagttgaaagttttcaaattttgagttaaaagctttttaatctaagttgaaagtttcaaatt

SEQ ID NO: 103691 - DNA, 819 bp, Oryza sativa
agaacatagtctatgactagcagaggcatgagatggtaagcaactctcattatggaggacaatatgttggaagatgactgggtttattttgttctcaactctatggtacacatgaataaatacatctacttatctactcgatctatctagttattcccaacatccgttttagtcaaacctttgaaacctcatgatttttttaaagacttgaaacgcgtttgaaaatgatgtgtatatatttgtgttgaaaaatatatattttctacgatatcataattctattggatttataaatataatctatctatctatttatctatctttatacctctatactattgagcacattttttttactctcacgttaaccagaaaaatctgatgactactgattagattactcttattatgatgaccctagattaaatatctcacctaacgggtcaactttgaaggcccaatcaattcatataccaactcaacctctatgaataagggtcagtcctgagatttcggtggtctagggtcggtcctgagaagtgatatccatataaaaaaaatcaaacatattggccatttgtaggtgtgaaatcattgatgataagtatcactatcatctgtatttcttgaagtatctattttactccttaaattttaatttatccattgctcaattagcccaattactcgttctttttttaatgtatactttctcgaccacattatatccatacgggcaaattagtgaaagggaacattttaaagttgaactcatagcttaaggctatagaagtactgtattaattcagaaaaatataa

SEQ ID NO: 103692 - DNA, 686 bp, Oryza sativa
gctcgtgtaccccgtctgtatatatagggcgagcgatgcaagtggccgaggcattcggtctctatttcgtcttcctatattacaccagtagaacgtcgtcaaagccggagctctttggacttttcaaacttagcgaactgaaacattgagtagctagaaaggaaggaaaatcaaccgagagcccgttagtagcggcaagcgagagcggaacaagggtttttatcaaaagaaatccataaaaaagaaaggaacataagaaatgtcatctatctatcttctattatatactaaaattccatcaaacctcctataaacactctcaaaccgtcgtgtggcttcctacaaacgctcataggttgacacgtggcattctataatctcaccatcgattttcttttaaatcgctggacccgttaattttaaggacgcgactacacagctagtggtagctgatttgtctaaatcagctatcactccatatatgagagacactatccacctatagttcaaatacaattttctcttaaactactcatccgatctacgatccgattacaccgttgtgttcgtaacaattaaatctttataacaaaatctcatatgattatattttgatgaaaaattataaattacttttataatatatctaaattacttttagatatcactaagttacttgttacaca

SEQ ID NO: 103693 - DNA, 556 bp, Oryza sativa
tttggggacggtgtggcaactactaaacaaaaacgtaaaacaacaggtaattactttgtttgatagaaaaaaggaaaaactacaatattctgaaaactcttgagacaaatatatcaatattatctttgtgcgaagaataggaatccttaaatatattatggtgaaacttaacttgctagacttaatgcaagtacaatattatggtgaaaactctttttgtgatggcactcgtttctagtagagtaggtactcctttgctgcctgcttgtgtggtttttaataattaatagaaatggtttacatatttagtaagtggcggagccacgttcagtttagatggtgcacaggaacccccctaaagccaagatttctcactttaaaaacactggaacgtacagcgtttatattgaagttttttaggttttcaatagttgtgcactaccaccttagttgttttggtgctagctccgcctctgtctttactctatgttgtaaaaactcacatcaataagctttggtatctaaacataaagccataaggtaatgatgggataaa

SEQ ID NO: 103694 - DNA, 672 bp, Oryza sativa
ctatagggcgaattcgagctcggtacccccatcagagaatcgtacctccttggtcccacttctttggaaaatggagatactgagggcctattttaggcgtaaattacacagattacatgtaagttggaagacgaatcttttaagcctaattactccaataattttacaatgtgatgctacagtaagcatttgctaatgatggattaattaggcttaataaatttgtctcgcagtttataggcgaaatctgtaatttgttttgttattagtctacgtttaatacttcaaatgtgtgtccgtatatccgatgcatgtgacacgtggaaacttttcacctctggaacttaatggggcctaaatcaataagggacaattcatggagttggatggaaatttcccgcccaagcagccaaaaacggacaatgcatgcgatgctccatatccctactggtcgaggaaccaaatcaggagcgaaagttccgataccagttcttcccataggccgttagtgatatgactctactggaccatcctttctgttactagacggtctggacagttaacttccctatcggcccatatatgaattctgtagtgattctgttacaaaatagatagggctctagatccagcccccaacctgagcatatagcaatcattctcaggcaaaag

SEQ ID NO: 103695 - DNA, 707 bp, Oryza sativa
gtgtgggacatgctattaaaaaatgtagcaaacaacaactatgatagcgaactaaacacatgcctaacaaactgtgactgctaaaactatggcgtggtaaagctagtgtggccatgatccaaacaactcctaattttttcctactgaattaagtcattgtatttcttcttctcacttgtccctagcctatatattttctacacgactacacataaattttatacaggactaatagtttttctacacaaacttcgtatgtgaataataaattgcctgccctgcatgcatgcttacatacatacgtacatatatatagagagagagacttttcgtacaaattctctactcataaacattctacataaacagaaaaatctactcagagacatgctactcgaccaaaattaagaaaatttgtccgaaattgtaattgttttaaaaaaataattcagaaactaaattaatcataggatgtcaaggacagttcacatggtccatggacggtcgtcgtctgcttggtagtagagtgagcaccaacctctccgttcatggttttccaaaaaaaaaaaaaaaaaaaaaaaaaaaaaaaaaagaaaaacctctctgttcatcgacggtccgaacatgtgaggctttagattctacgataaatttgaacaaaattaaatatctatgattcaaggctattttaaaatccacataatgaa

SEQ ID NO: 103696 - DNA, 726 bp, Oryza sativa
ttgactattttaatttttaaatattagagaaagtctacatttgattcttattgaattttataaaattggagcatttttttatccttattgaattcttttaaaatctgagcatctttattcccattcttttcaaatttatattctaaaaaataaatatatttgattttaaaagtatttcaaactcctaaaaaccattatttttaaattatttttaaaattcaaagaccctcaaacatttctttttagattttatttcccttttaaaatctatttaaatccctcgttagtttctatttcctagatatctttcttgtcaagttcaaaaagcctcaagcaagttctcttcattttattttcccttcaaaatcatatcccattgtccaaagttcaaaagtccacacgcatccattcatcctttagatttcatctcctttgaattccattcaaaaccctctacacaaaaattcctaagagtccctattcaatcgggctgaaacttctttctttcagcccatctagctcacggcccagccggcccaggaggactgagctgccgcctctctttccgtgggcccaccgccgtcgaacaccttgtggacgccgacgccgctcgccccttcccgatgcgccgccgctctaccgcaccacctgtgccgccccaggcactccctactgccacactaccaccgcgcctcggccacaaaaccggggccatccggtggcgcc

SEQ ID NO: 103697 - DNA, 845 bp, Oryza sativa
atcagggcaaagctccatggcaaagactatgcggcgaagacggcaaaggatgaagcctcatggcgaagaccgtgcatcctgggcgaaggtcaaagggcgaagggtatacgccgaaggaggatgacttcgccatatcgaggccagcaccgggaaggcccaaggtgtcatccaagccgcttcggcccattggccattaggccagcgatcgccgatttggcccattagaggcccatgcacctcaattacactgtatgcccatgtaaatgtccctttcataagagcaaccatgtaaattcccctgtaaaacctaaacccaaatagggggggcttgtaatagggttataaatagacccctagggccatgtaaatgggggattttggaagaaaaattctcagtttaatacatttttactgctttccaaccactgttgaggtaccacgtccttcgacgtatgcagttgtcatttcgacaatagctggcgccgacgttggggacctccgagcgaaaccactgagagtaaatggcaccgaagagggtcgtgaaggagaaggttgcaaagcgaatggggagtgaagcaggagaggagatggccgccgaagagggagccgagccttcggcgccatcgttgaaactgggggagcaccgtcggcttcggcacctgcgccgcaaccgccaccttcagctcttgccacttcgtcagggctggtgccaaacacggtcgacgcggcgaaggcagctacggcagcaagggcgctccagatcagggcagagatcctttcgacgagccagctgctggtgccccaagccgcttcgtcacagctggggtaccgagctcgaattcgcc

SEQ ID NO: 103698 - DNA, 1005 bp, Oryza sativa
ttcaatagtgcaaaattaattaagtattaaatattacaaactcaaaagtaaatttatttgatttttataaaacttttatatggaaaatatttttcaaatacggaccatttagcaattcggtaaacatagtcacgataactaagtgagtagccaatcaaataagcattttagaacttaaccataaatttattacttatgtacgaaaacacttaatatatagtataaaatatataatttgttaatcaagattatcctaatagatcaaccgaatgtctccactaattaatccctatgtatataggttctatatacagatcactatccaccaattgctaagccatattgcttacatgacatccatgcacagtgtgtcctgacattcaatcaacatgtttgtcatgaagcacggaagataaaggacgatactaattaggcaacaatcaataaatgatatgtagtaaatagaggataccaccaagccaaatcaaataaatagctgactacaagtaaactgtgagtatgaataatagcattcctatactcctacaaacactcctaagatgctatgaaatgctcaaataaagaagagaataatccaataaaaagaaaaaaacatgaagtcatcaatttacacttaaactgatcaatccatgattttcaaccattagattagatctattataatcacttgctcctaaaaatcagctaatctatccctatatatgtatgcacacaagagatatcaaaaagaagaaaaaaaagaagaatgtgtacgatccatcccatcttgatagttttctatttctttctttgtagcccaaacgttttgttttaaattgtacatatatgtagcaaacactcctggcgacgttgtcaaagaagcaatgccgccatggcgccgcttcaagccctcccaccaattttcttgaaagtatttttttattaataatgtaaaaggcaatcataggcgctcatataaacatgtacatacctacgccattaata

SEQ ID NO: 103699 - DNA, 1493 bp, Oryza sativa
  unsure (1)..(1493): unsure at all n locations
acgtatatacacgccttcctcgccagctactccaggactctgcctccagtactgctcctgctaccctcgcctcctacgcctgccgttgccaccatagactagcgtcgaagcgtagcaagaggattgcggccaagcttgcgctcgccggcccgagtgacatgaccttatgtgcgcagcacaatttgatgcgcaagcttgggttggtgcctgagaagggtcatgtgttggccgaggctgttacggcttacaacgccctcttctcccagcccctccctctggatcacgccatagccctatcttcactcttccccagctccttgcctcaaacgcaggctggagtgtagtgggatccccaaccccaccatgcattgggataggagatttttcttttttagtagcttatcttctttgtatttgttttctttttcttttttcactactagaggacccctcttctatcccagttggcaacctcctttacttccgggtaacgaaccaggagaaagaatccaggactaaagaagcccagtatacatggactatatataaatgaacaaaacctctatctcatctttcaatcctgccgctccaaccactcatgcatctcaccactagcgtgcgccgctcattcatccctagcccctcatcccgccctccacctgcttccgcacctnctcctcaacctccatacaggacagcgcctggcattgtaccagccattgaacgcggtagggctcattcaataattgtgtcctggcttgttggcatgtggatgatccagccaggcccctgtcttccatgcgttgctgccccccagaagagcaaaacgtcatgccgtagttccgccattgtccctctaagcatcgtctctacttctctaaccaatggagccctgggcggggcttagtgacccactagggacggtggtgttctagctgacatgttatgaccgccatctcgttgctaaccctaccaggtaagccctcttctttttgttttttattcacaatctacctcagtgatcaagaaggagagagatcagaaaagagataccacaagcaggtaactgattcacaatggtgtcggtctggggacaatggcgacaggagggtccatgtgaggaacccccaccccaacaggtgtatttttctagggaatttccttattctactccctccatcccaatttgatcataacctaagcaaagggcaccaagaccaagaacaccaaaacatccatctttctgaaattaatcctcatcaatcaaggtgctccgttgcttcgtgtccaacaaaattttaaaggttgtatgtgttgaaccaatataaattaaacttgattggttgcatacatgcatgcaaggcattccacaatgcacatttactattagcataaataaacaaagagccactttgttagatgataatcatttttgaaaacgcaaaatctaaaccgagagcgctctcgatttagtcttaaatagcgacacactt

SEQ ID NO: 103700 - DNA, 1124 bp, Oryza sativa
atgtaagttattttaacattgtccacattcatatagatgttaatgaatctagatatagttttaaattaaagtaactttcccttttgttataagttacttctataatatatgtaaattacttttaagctttactgaatttacttttatatgtctaagaagtaacttagtgaaatctagaagtattttagaaatatcataaaagtaatttatgatttttcatcaaaatataatcatgtgagatcttgttgtaaagatttaattgttacgaacacaacgttgtaatcggattataaatcagacgagtaatttaagagaaacttctctaagaagaaaaaaaataaatagatattgagtgtactagtagctttttttttggaaagaagggtgtctctctttagcactatccaggtagcactctcggtgtagttgtgtcctttttgaaaaacctcaaaaatcttaggtgatgatcaaattaggatggagggagtatattcctttaaaagagatagtagttgagtagtgaatctgtcaccctacctacttccattgtaaattttataaattacctgttgaacttcttaaatattaatattaagagtcaatcaaatctgaatgaatagtcacatataaaatcaaaataaggtgaacattccctatagaaaaaagatgtataatccacacaaatatagtaaattatcactgggcaatataaattcttcttgtttgatgatgcctcgcctcatcttctaatagcatgaagccatcttttgccgccattcttcaatttgagattcaaaagcctagtgaccacctttccacaacccccccacccgtctaatctgttggcatgatattgtgttgattaagctcgataagagagtccatattagagaactagagttttggctatatcaaccaaaactgtttcccaacggagttaccaaaaggtgtattaacacagaaatacatatcgagcatcttgtgtgtaattcacaatggacctagatacatacggatacaaggggtagaatggtagatgttgctgaacaatcactcgggtgggcgtgggagggtggcgtgggggatgataaaacccatgagggcaagcgcttgtcagtttgtgg

SEQ ID NO: 103701 - DNA, 637 bp, Oryza sativa
ccactcatctctgacgggtctttaactaacacacgtcacagataacgttatctctgacgggtggtagttatgacccgtcagtgatgagtgaaaattcaaatttttaaattttgcaaaaaaacctcggattgaaacatgtcctatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatcggatgaagatattttctatgtaaaagttataaaacacgatgagatctataactatttagttgataatattttcatttgaagtcatttacggtgttaaatatatgttaaatgattcagacaagcaataacaaaataataacattgggttagtagtcaatatgtgttgagtaggtgagttggtaagggagctctatatggaggg

SEQ ID NO: 103702 - DNA, 683 bp, Oryza sativa
tggcaaatgggaacttaaaccaaaatttcaaatcaaatttaaaataatacaaattatagaaatttgaaaggagcatatacttctttcatattagcactcaaaatcaaattcaaaataaaataaatttacaaacgaaacagtcattttgtaaagaataagagtgagtagtcaagagaaaagaaacttattatgtcttactctcctaatattatgtagatttttatagatagtaatctaaataatatatattttaagttttcaaatctgcgatgtaaattgaaaataaaaataaatttacaagtagaacattttaatttgaaaagaatggtaggaaagtaagctaggaggaagagaaaaggaaaaaaaaggagggatagcaggattcaaacctagcaccctagggctcactgctgaagacatcaaccaccaagctatcacagtttctgttgcaacataatgcttgcgcatctatttaatctcattgggacctcagcaacataatgactcagcaaattcatgccacctcggattagagctcagcgcctaagttattggcgctaggacattatagctcagcgccaaggtccatgatactaagtttacggactatttttggttgaagttttttatagggactagtttcaaaataagtttttgaaaaggacaaatttgtcaaaaaaagg

SEQ ID NO: 103703 - DNA, 1548 bp, Oryza sativa
actgagaccactctcggtttagccttgacgagagacacccatacgtgagagcactctaggttgctactagtacacctaatagtgcatatctttctttcttcttatagaattttctcttaaactatttatccaatctacaatctgactgcaccatggtgttcgttgcaattaaatctttataacaagatcttacaatattatattatgatggataaaatatttatgttataaattacttttattatatatgtaagttacttttatcatatatataaattacttttataattgattaaattacttgttagacattcagtgaacagattactttattggttagttctataatatgttaattaaatataatttctagatagacgtatgtttttaccccataatagatttactcttattgtcatgacaagttacttcctttttcttttaagttacttctataatatatgtaaattacctttgagctttattgaatttacttttgtatgtctaagaagtaatttaatgaaatctaaaagtaatttagatataatataaaattaatttattatttttaccaaaatgtaatcatgtgagatcttgttataaagatttaattgttacaaacacaacggtgtaatcgtatcgtaaatcgaatgagtaaatcaaaacaaaaattctataagaagaaaacaaagagaagcactcttaggtgtactaatagcaaccgtacttgagagtgaggtagctagttatgacaatccagctaccgtctcgtcgtaatcacgtcctttgtgtaagtaccttaaacaaggattagatagaacttttaataaaactagaaaggaagcccgcgcaaatacgcgagaaatttatttattgtttataaaaagaatactaaaagaaatcatatatgactgtattcaatataagaaccctagattaacatataatcgtaaaagaaaaaatatttatactgttaaatagaccatagactttatatactgaatggaaatcgctatcatattcaaacagaaatcactttgtctcagttatatgcaaacttgcatatcacatctttcgcaaacataatatgggctttgatttttttttcttttattatatatctcattcacctatgcatttttatgggtaatatatgaaggaataatttatattatcgaaattatttgcactaattgttagcgctatttacatgagaacggcataataaaaaaggatataatgtggtttcgtatgatatttccgtttgtatgtatgtatgttttttttctagtgaatagtagtctctcgtacgcgcttacttttttttgtggacaaatatttttctctcatatggggtaggttgtgcatatatgtattaatggcgtaggtatgtacatgtttatatgagcgcctatgattgccttttacattattaataaaaaaatactttcaagaaaattggtgggagggcttgaagcggcgccatggcggcattgcttctttgacaacgtcgccaggagtgtttgctacatatatgtacaatttaaa

SEQ ID NO: 103704 - DNA, 1167 bp, Oryza sativa
acagttgtcttccattaaccatgatatgtaattcttgctgaacggagctgctatgctgctcttggagaagcatcgccggctcctgctcccagcttcactgccttgagcatccgcccagtttagtgttatcaaagcaacaaatatatgtggcttgaggaatacatcccaactgaagctcaatacataaagaacatagtaaaaatggtgtaaaccatatatatacattatttctgcacacggtccatcacttattctgcttttcctaatgcctgttcagttttaagcaattaaaaactgatatggcaaaccagaacatgtcgttcttcagttgaacaggggcagatagcggagttggtgctgccctcgacctccttcagatttattgacgcctctcggaaccgggttggtgacgcgtggggatgaacatcgcctgaaagcggtctccgaagtggccaccgccgtcataatcgggcacacaccggaggaatggatcagagggcgctagcggagctcttgcccgcgcgcgcacggcggcgaaacggggtgacaaatgatggacaagaagttggggaaaagaaccgctatgagagcggccgccggaggccggagcagattgctgcgtgcgctaggatgcaccgtcgagtaggagagcgatacaacctgatgattaatggatactcttctttactctttttcatttacgaagtagtactgataaaatcatactccctccattccaaattgatctacatatttcataggtataccaagaccaagaaaaactaataactctctcatactatatttactctagcaacaaactcgatgcatgcactatccctaatatttcctagccaatagcaaatcaagatattgcatgtgggttataaatacttgtgtgcatagatgtatgcatcaatgtccatttactctaatgcataaataacgagacttaatggattaacacaaatatgtagatcatttaggaataacctcaaaaaaactatatgtagatcaatttggaatggagggagtaaataccagcattaccatgatgattattattaaagtacttatatgtccttacgaaccaatggtctaaattgattctactgatagtataatactactagtagagagcttcctttattcatgggcttccgatgg

SEQ ID NO: 103705 - DNA, 1231 bp, Oryza sativa
tttctcttgactactcactcttattctttacaaaatgactgtttcgtttgtaaatttattttattttgaatttgattttgagtgctaatatgaaagaagtatatgctcctttcaaatttctataatttgtattattttaaatttgatttgaaattttggtttaagttcccatttgccatataatataccactttaatattttttacaaattcaaaaaaacagttgcaaataaagcatatcttttgaagataatattacgagacaaacagaaaaggaaaaatatagataaagagatagaaaagaaaatgagagaaccgaaaagagaaaaacatataaataaagagagaaaagagaaaggagaaaaatatagataaagagagagaaaagaaaacgagagaaccgaaaaggaaaaaaaacatataaataaagtgagagaccagagaaaggggaaactggaaagaaaaaaaaagaaaagagaaaggggaaaaatatagataaagagagagaaaagaaaacaagtgaactgaaaagaaaaaacatataaataaagagagagaaaagagaaaggggaaaactgtaatgaaaaaaaatataaagagagagaaaagagaaaggggaaaactgaaaagaaaaaaaaattgggagaaatgggaatcgaacccggctgaaacttgctattattgtgctataggtggttcattgaaaatgaatacctccacattaatttaaatcgctagggacttcatcgccaaataacttagctctgagttaggatgacccagcaaatccatgccatctcggattagagcttagcaccaatatcgttggtgctgacacgttatagagcagcgccaagatccgtggcactgagtcgacggtctatttttggttgaagttttttttaaggactagtttcaaaataagtttttgagaaggattaatttgtcaaaaaaaggtagtttatatggaactttggctagctagcaaggagccaaggatgcgtatcgacacaagtattttagtcaaacaatatactagctcgtgggcagcaccagatccaagggataggtgggtatgcatgcactgggttagagaagataagtccacaggaaaataccaacattgctcgtagtttgatctagtcaatacttctacttttcgctgccagtgcgatgtatgtgtacgtagtgaacgcactttcttttccatttcctccgtaccaaacaaagag

SEQ ID NO: 103706 - DNA, 1296 bp, Oryza sativa
atgggaatttctacaggaacggaattggtggtagattgataaactctaaaggatgggtatgttgactcaaagagggattgaaaaggatattttatggactctggggatatttaggtggagatccaaaggaaacgtatcaatatttcatgtactctagagatattcgggtagagttcaaagggagagtattaactctgaggaaattggaaattgtcattttatgactaaagatggttaaaaaaggtaacgggcatatttgatctttagtcccggttggtaacaccaacctgatctttagtcatggttcaaatgctgtcagggcttgtcagccccccgggatctttagtcgtagtttgatctagtcaatacttctacttttcgctgccagtgcgatgtatgtgtacgtagtgaacgcactttcttttccatttcctccgtaccaaacaaagagtccgttcatttgggatgaaggggaagatttccgtttgttttcgttagcatattcaaacggctcaacacttcaacagtatattttgtgtgaaaaaattctatataaaaattgctcgaaaaaatcaaataaattcatttacaattttatagtaattaaaatttaattaatcataccctaatatcttatctcattttgcatctgctgaaaacctccatccaaacatcggtttcaaactaagcctaactctagtaaaagcattactcctttggttttagcggttacgcctcacatgtacggctcatctaatatacatttcccactcttccaagcatccatgtggggctaaaattataacatgtaactattgatcagtgtcagtttattaaaaagccataaaaaaagtaccagtgttcgtttataaaaaaaatatctgggacatcggtgttggtttatttagaaaggatctatctaaaaatatgacaatagatttttaagtaaaaaaatatatcaaatataattatagtataaatctagtgtaaaataaccgtcctaccattcatcttcctcctcctccctctcacatagagacacctttcttcaacttctctttgacacaacgagttggcgacaatgcaccaccaacaatgattcaaggtcatagaggaaggatgaagatgaatagggcagagcgacgtagggatgatctccgggcttcctgaatggctacagaggagatagatgacctcgagcgtctccatcgctgggtcatacatcctaggattctttgccccacatcaaaggagatccaaccttgtcaccgtcttgcaatatgtcgctagggtacc

SEQ ID NO: 103707 - DNA, 2133 bp, Oryza sativa
atcaatatttcatgtactctagatgcctgcaggtcgactccaaagggtcccgagtattaactctgaggaaattggaaattgtcattttatgcactctagggaggttagagaatgatatttcatgtattctgtagatagttgagtggagatcaaaaggaaagtattagttctggggaaaataagaattggtatttcatgtgctctagagatggttgagcgagaattgaaagggtatttgttggagatgtttgggaatggattcaaaggaaatatagtttagagacaaagttagagattaaaaaataaatagaagggttttgtaaaatttgaaataaataaacaaaatagagaataaattatggattttatgaaattcagaagagagcatttaactttgcaaataaaatttaaatccaaagtaaaagagattaagagaaagcaagattattccaatggaagaatcgagaagaatgcaactaaaattttttgcaaaaaaatttcccgaaatttagagtctgttacaggattgcagtgtagttgttggaaagcgcgcataaaacctaaaatatatatgtagtaaatatttcctaatcccgggagcgccaggactcccctcactttccggcagtaggtaggttggtgtgccggtgtgcaatgggggctcatagtccttggagcgggtgctgaaaagcaagaacgactgaaaagtcgggctgtggcgcatctcatgtgttgggactgggctcttgtgttgggcaagtcacggagtgcgggattaaaagcgtacatccactgcagtgagtaaaccaatatatttgaatagccatgctcgtggttaataagcgtctggacttgtactactcttgactagactcatagattttgatactgcttagtttagatatgagaaggcatgagtaaccttgcctgatgtgcgggaaggttagtatgatagagttggtgtaaaatggaatgcaagggtaaaccgaaccaagcgaggcttgggaaggtggatgaaccctcgattaatgataacttcaacattaacattaaaactgctaagtcataggattgtgaaatgaattgtgaaaactagctttatgcaaataaaccaagccattctttaaccccctgtgagcaccagatgcattttgtagtggtggcttgctgagtacgtatgtactcacccttgcttaatttaaatctttgagaaaggagttggagtcgattatatttatgcaacgctgccaagtgcatgtcgaaaacgatggattagggaccctaggttcactagtcattgcctgtggagttcgatggaccgccactgcttcgcttccactaccctagctatttcttttggtatcttgtaatgtatatgaccatggttggtctattttgggacccgtttgggctatcctgtattgttaatgtagaaacacctgtaaatgatgtcagcttgtgatattcaactgtgctatgtgtgtaccacctactgatccaagtagtgatattgtaagacacatgaggtttccggtgtattaaacctagggtccccacaataccggccaccaaaatggcgagcagatatcgctcctttagggtcttaagatatgctacaacatctttgagcttatccgtgaacaccagctcttgctccagctcctgctgatctgcccaccgacaagcccaaggaccatgaagcatatcttaaggccttaaaggagcaatatcttctcacccacttggtggccggtatgttccttctttgatctacttcacttatttgatgttcatccttgttggatcaaaatgcttgtttattttgtttcgtttgattgatcgatcgtgcgatgcgatgccatgtctatcttattagtcccacgctaattaattgtttgttacctgattaattaattagctaatgaagtgatgttactcaattttgtgattattgtttttgcttaatgttgctgattgatgcatccatcatcaatatactactagtgtcatgtttcttagcactactgtggtaatcagtctgaagttatatgtctgtccgttgtttgatactcataatttattattctcatgtctttaaataaatgtgctgtactatatataaattagtaatta

SEQ ID NO: 103708 - DNA, 1252 bp, Oryza sativa
ttacctgattaattaattagctaatgaagtgatgttactcaattttgtgattattgtttttgcttaatgttgctgattgatgcatccatcatcaatatactactagtgtcatgtttcttagcactactgtggtaatcagtctgaagttatatgtctgtccgttgtttgatactcataatttattattctcatgtctttaaataaatgtgctgtactatatataaattagtaattactatatactaactacaagcagtttgtactcagtgatggtagtaactttcgaataaaatgatggtagtaattcattgtgcaagacagctggtggatgacaagtagagttgtggagtacgtcgacaatactctatactgtcactaaataaactcaatcaccacctgcggaagctcctcaccaagcactcacttatgggagtggggtttgcacgtgcagacatagccagagccagagctggacctaatgtcgacgaccttatcttccggtagaagcactaagcccaacatgagattcaactagttgaccgcgtaaaactggagtggtaagaaataacctaatagtcaagtttgtgttatttgtcgtttgttacttaatccttagtttgtcttacttttacttgttgctatagattaatatttattcattgaagtacagtggagtaactattcgcctctgcttgcttaattgctactatccaccaccgaacagcagctattgacattagcattatgtgtttcaacttagacataggagtatgttcgatcccattggaatcttgattccactatatagcaagtagtattcaccatctaattgactgaccgaccattcttagctataaccatctaaattatgctgaccattcttcctatctattctcatctcaattataaccaaattaatctcaattataaccaaattaaggaagaaaataaatgtaaattctctcccccacagttatgtttatttgacataactagcattcccaagtctaaacatcaattatcttattaaacattatcagagggagcggggaaaaccatatatccctatacaaaacacacacacatcgactaatgtcacttcatttcaattctggtctatatgcaaaacacgcctaacattacaaaaaatgctgcctgaaaaccggacctatcaaactatatatctcggtgtaggacctatcaaactatctatctcggtgtcaatggaagcattaatttcatgggtttttag

SEQ ID NO: 103709 - DNA, 868 bp, Oryza sativa
aaaaaaaaatattagaaaaagattcagtcttcaattttttttcatttttttatttttttctttagagctccattccatcaagcttcccttaaatgtgtttgatctctgcaatttggaatggaaatataagtgggttatggccatacaacttggcatctcttaaatgttttcaatttgttgtctatgacaaatagatcctagacgggtacatgttatgacgttaaaaaatggtataatcaaaagctttttctctaatctattagtggcatcagatatcatatgtacaatttagatgttatgatcatcttagaaatgtttatttatttctaaaaagatcatttattcttaaaagcgcatctaagatcaagtataagtaaatagcccctatatgcatgttaatagaaattaactacttccattgttgaggaaaaatatatcaatatttacaacaacaaattatttatattgaatttgaaattgaataggtttttataatataattgttttgtgttaaaatgttactatgttttttataaactaatgcaaataacttgacatagaagataattagatgtctagcattctataaataatgggttgactgtttattaaaaacataagatgcgatattttaatttttaatgataaattttaatattttattttatttataggaggcttcaaggtgaatagatgtggtcacgatactcatattaaattatttatttaactaaaaattacaatagtttagaaatatcataaattgaatatacgatttaaaaattcatgattattttaaactctaattcatgttgtttctatcagtgctagcttgtggagaaaaagagaataaaagcacatgatagag

SEQ ID NO: 103710 - DNA, 3038 bp, Oryza sativa
aaaaaaggaaaaaaaagggacgccgcttggccgcctagcatgcgtgctggccaccgctcgccatggccccgcgggcgccgccgcctgccaatggccgcctgccagcgcacggccgcgccggccgctggccgccggatgggaagaaaggagggggaggaaaggggaaaggaggaggaggaagggtaaggaggagaggggagtggagaaagaggggatcggatctgagaggaggagaggagatgatccgatcttatctaaatactttgtctgggacttaaccgatcagatatgggagtaaatacggttgaagttaccaactgagactaaacataaatctaaatacctacattagtcccggttggtactaccaaccgggagtaaagatcctcagtcccttgacatgcctctgacatgggatgaaccgggactaaaaatgatctttagtcccggttggaaacatcgactgagactaaagatcagaatttttttaatcgggactaaatttagccccgattctttttggaaccgggattattgtagaaatcgcccgaccctcaaaagataacttctccagtagtgtttccttgacccctggcaacagccttattaccatgtgcgttgtgtaatcaaattttactctcatcttctaatatattgacgtacaatcctttttgccgggatcccagcaggcagcagtgccatgattggtgtttatatcagtggcgagatcgattcaagcattcagcccagcacagcggccagcaattgatgcggcaccggcgacaccaaacgtgctcatccagcacgtcgatcgtcgatataagtaagcatgcgggcatgcggctgatgtgctgcgcgcatggcgtcaccaaccagcacggcagtcgtcagatgagatcgatactcgcacgattgcaaaatcatggagcttaattaggaatgccccctcacgtgtctagcggcagaagatcgttaagtagtcacacacctaggaatcgggggcaagagcggtcgccccgctcagggccaggcctatgataaggtcccatctcgattttccaggattgttgctacgaggggacacgagcgttaagctgcggccatgtcgtcgatgttgaggtgcatgtcgacctccttcgagtttgcctgttgaccttcggccagtttctggagtcaagctttgattggtacttttaattttcaattagctggttctttacatgttcgtcatctaaaaagaaattaacttacagactgtacacacagaacctctaatacaagtcggcactatagacgctggaaatagctagtaaaaccgacacctatagtgccgttcccgcccacgcccacaccagcctacttaaaccgtaaaaactagcacatttctcttcaaatagttaggtgcctattacccttgtcagataaaagtgtcggtttctatataaaatccgggaccttttattccccatctcatcaaagtagttggcacggggcccaccctaaaaccagcatctttgtggggaaagagatatgtgttggttttatttatagaaccggcacctttcaccctccacctcctgaactagccgttggggggcccaacttataaaccgacacctctgtactgtcagaaataggtgccagttttatgtctagaaccggcacctatcagtcgaccacatatataggtgctatcccacccgcccagctgattgagcaagaaaagagcggcgtctctcatttttgcctgatcagctagaggagggggggggtggttttgctctatttttttgtttggttgaagattaatgtctagaaagaaaatattcattatttctcactccgttcctctctcatttgatgatttgaattattgtgtgctccatatgcatgcaaaattatgtgttgtttttagggataattcttcttatctttttggtgtccattaatatcattagatctattctcggatgacatgctaaatttgaattaatgttttctattctcattagatctactagtagccttactcatagagtttatctattgtttctaaaagtgacacatgtgattatttgataaggtggagtaaagaagtgggaaagagagaacgaacaataccccacatataaaagataatatctacacaatctctaagaaaagtttaaagtgaaatccaagaaaaatataaagagaatgtgaaatagtatgagagtgaaaaaagttatatattatacatgttatcctttaactagtgaaattgtaacatcccgattgttgacggtcgttatcgattagtttcgaccgtcaatattaccaaaatagaggagaactagtgatgcttgcaatgcatatatctgttagaataataatattccactagtattaggtatactaaccttttgcagagaatgacaataaagtggaggaaaatcgacatcaactcagacgataaatcaatcggaggatatcgagaatcggacttgtgtatgaatgtgccaagaacgcagacttgacacgatgaatcaggccaaaattcacaagtctacgaagtgaagcagcggaggaggccaccatttttcgtcacctcggacaatatctcaacatcaacatttgtggtgctgagatattagttcggcgctgatctcgattgcactaagcaaataacttatttttacaataaatatttacacggttaatttactctttaaaatttaaatttttaagatggtcaaattttcggccaaaacattaggattagctcaggtcagctcggttaggtaaatgaggtaaaacatgggcctggctcagctcgtttcacggctggagccagcttgcgatggctctcgagccttccaatgtgatgcatctctccccaaatataattcgtaaactatggctagtataagaaaatttttcttaaggatttcaatcctccacaaaatctttgaaatttctttcaatccaaaagaagtctaactgtacatgctggttgagctatgtaattaaataaactgacccacaattttctctcataa

SEQ ID NO: 103711 - DNA, 2580 bp, Oryza sativa
tttactctttaaaatttaaatttttaagatggtcaaattttcggccaaaacattaggattagctcaggtcagctcggttaggtaaatgaggtaaaacatgggcctggctcagctcgtttcacggctggagccagcttgcgatggctctcgagccttccaatgtgatgcatctctccccaaatataattcgtaaactatggctagtataagaaaatttttcttaaggatttcaatcctccacaaatcctttgaaatttctttcaatccaaaagaggtctaactgtacatgctggttgagctatgtaattaattaaactgacccacaattttctctcataacattttcaaaacatttaattgtacaagatggtcacggtcgttgatggcgcagactcgtaggcttgtaagtcttctcagtgaacattagtcctctcttttagcagagaggccagatatcctattccgcgcttacgcgccgggaagagaaatcatgtgcacgtggcacgcggttttcgagaggcagatccacgcggtagcataactaaccttgttagatttagataatgacgataattaagttaatattttttttttctctagcatattgaaaaaaattctataagtgaaattggaactttcaaaaaaaattatgactttctattgaaaaactaaaagacataccgaaaagttgaaactctaaacttaaattttaaaaatattcaactcgaaatttaaacattcaacataaaatttgaaaactttagactcaagatttaacgttgaaatcaaattttgaaaactttcaacttgaaatttaaatttgtaagtcaaactttgaaatattttaacttttcatctcaaatttgaaactttcaacttagattaaaaagcttttaactcaaaatttgaaaactttcaactccagatttgaaactttttattcatattagaaaactttcaagtcaagatccgaaaactttcaactcaagatttaaaaactttcaactcaaaaattttaaaacacatgtattaaagaattaaaaaatgggaaaagagacgaaaaaagaaaaatgcgctgagggagggggcgctaaaataaaaaaaatgcggaaaaaatggaaaagagagcgtgcgggggagtgctcctgtttcagattatttgttgttatagcaaatcttgaaaaccgtggcaaaatcaacgtacttgtttaccgtcagtaccagtcctcccagcgacccagtgcttactgctttcgaacaattttgggtttaaaatcaatttccacgagagcaactcttctgtttttggctaggcaaatgaactgtgtagagcaatattcccaattgtttggtgtcatatacgggatgtttttcttttgggtatttaggccttcctatgcattacaggaatatttgggtatttagtcattgtcatgtcattgaataacaagttgaaaagaaattaagtagttggaaagaacatatgtccctggtcggaagacttgtcattatcaacttagttttgacgagccagcatgttttctttttagaattacgctttctccatttagttccatatagtattacgtatatattgagttttttttttggcagcgtgcatggtaaccttaaaaaatatatagactgataaaatagaatattaatttgccaaaaaaaatcaaggaggttcatgtaattttgctattcttgagaagatatatcaggactatatttgtcatagtaaaacttggtatcttcaggtattagatatctcaaggtgtcaaattttttttgcgtaaaatttaggtatattcagatactttctcaagtacgataaaatttctctagatatattagtaaaccaatgtcttgcttttcaagttaataaatgaagattgctatatgtggctaaacatccttaggaacaaatatttagtcaatttccttgagcttctatcgaagaaaactacactaacacataacaattaataaatacatgacaccacccaaaccgatatatacaagacattttctgcccaagctgagccacttggggagcacacttgaaaaccggcagagatgagacttgactacatttgatcacaatcaatattcgtgcatgcatcttccgtatttactgtgggaagactttcaagtcggtcaatatacattattccatctatttaaaaatataagcagcctttgtttccatttaaaaattttaacatattacaaaaaattaatagttgaagtattatatattttggataaaaaaataatattagagaccgtgtataaacctaatacaacttatatgttcaaacggatgtataaatatttatatctttttgaaaatatataagttgtattaggtttatgtttatacttccatttgaaaatataagttgtattaggtttatgcacggccactaatattatatttttgaaatgtgtgtcgacctgaaagcttcagcagcatccgtattgcccgccattaatccactcgatcaacattaactatggtatcatcacaacaaaatttacgaacatcattgatttacgattttttcattaaaaagg

SEQ ID NO: 103712 - DNA, 638 bp, Oryza sativa
aaaaaaaaaatgatatcacaatctacatgcattgcgttccgtaagcctatgtgcaaatacctttttgcgcctatgagtaactgggtagtaggggtggaaatttccctaccggggcgaggccctacccatacgggccaagggcgactgagattcttgccccgtaggtccattggacaggggggggggattttcacctgtgagaaaaccatgcggccttgtaaagtagcaatgttgtagatatagcccatataatttggcccgataagcccagtatacatggactatatataaatgaacaaaacctctatctcatctttcaatcctgccgctccaaccactcatgcatctcaccactagcgtgcgccgctcattcatccctagcccctcatcccgccctccacctccttccgcacctcctcctcaacctccatacaggacagcgcctggcattgtaccagccattgaacgcggtagggctcattcaataattgtgtcctggcttgttggcatgtggatgatccagccaggcccctgtcttccatgcgttgctgccccccagaagagcaaaacgtcatgccgtagttccgccattgtccctctaagcatcgtctctacttctctaaccaatggagccctgg

SEQ ID NO: 103713 - DNA, 727 bp, Oryza sativa
ctaagaatggccggtgaggaggttgagcaaacaataggcagcggagctgctcctcgagagtgcaatactcaccatcaagatcggcacactagcggcaacccatccaagcagcggcggcgactcatttttcctggcaccatcggcaactttttggggatgcggtcgatgaagaagggtgagggacaggggtgcaaaagcaggatgagacccttgttggccattgcgtcgccgcccccgatgaggtatggctccagttgctactggaggtggagcaggttaaacgatattgaggttgtcgtcgcaggttgtggccatcatccttgagctcgtcttgctaatgaactcccttcgatatgagcatgatgatgaaggagtcatcgacattgggaagccggcaacaatccattcatccaatgccacctccaaggtcttcaattgctacctcggtcgacggtcgcctcctgtgcctaatttgggggttaccatcactcttttttttggttgtgcagtaggatagtttcatgttggaggcacaccatgtggggcttcggttgggcctactgaaacactccctgagaaaatagtccggcaacaaggcaccaaggaacgaaggggattgctgaaaggggttcgtcaaccaacgaagcaagccaaagacaagagtcgaagggccactaggcccaacgaccatagaggcccaagtgcaccacaaggaagggatattggg

SEQ ID NO: 103714 - DNA, 651 bp, Oryza sativa
ccttactcacgcagcgattacaaggagggaacaatagtgaggagaaagtacgtgccgtaattatgctaattataattgactagaggatttttaaaagtttttaacatttaatttactagcattcctatgctaattataattgactagaggatttttaaaagttttaaatcacgcaagtggcaatttcatatgttaattagagtttttaacatttaatttactatcattcatatgctaattataattgactggagaattttaaaaagtattaaatttaatatattcttaaaactatcattcatatattagagtttttcacaatttaatttactatctttcatatgctacttatatatgactactcgaatttttaaaaggtttaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaattttattaattataagtcatatatttgcttataacgatttatccacttaatttcttacagacaaaaata

SEQ ID NO: 103715 - DNA, 1298 bp, Oryza sativa
aataccgtttagcagtttaaaaagcgtgctcgtgagaagttcccaactctaggtctgggtgccgaactcagcattctagaacaaaatccagaccaggggttggcaaaacaacggccaatgccccctatgctagctggcgagaaggtgagacggccttgcaccttatcaccacgtgtagatacaccaagagaatctggcaccttgtgtctagctgggtgggctaccaatagatggaaccaggtcaatgggaaggcccagtaagtgcaatagtggtgggagaacctagcaaacacgtccgctgtcccagaaaaaggacttcgatctctgatcctgctagttgtctgggagatctggaaggagagaaaccgacagattttcgaccacaaagagatggcaatgagtttccttttaacgaagatcaaagaggaggctagtctctaggcccttgcagtttattccgcgttcgtgtgtagcttaccgtgacttttttttttatcattaggggttgtattttctcaagctctattcaatgaaaaagcacactagcgctgttttccgttaaaaaaaaaaagaacacactccactccccacgcgagctacacgaatggagtagaaaacaactttcgtaccgagcccgaaccctccgagcggcggcggaccacggacgcgggagaagggcgccgagagggactcgtcgtctccacgaaggcgcggcaggtgaggggagaacgagtgggaggtctctcccgcgtgacagatgggagattagctcctgcatttgctgcttgccacaggaagcgaatgagatttgcgggcggcgatctgatatcacctgaactcagcaatcatcttccgcctaaaggctagaggtatgtgagtggtgtggtgcggccgatcgatttgtgctcaggacgccgggttgtagcatccgcctacccaattttgacaagccttaccgtgcaggcaccctgttcgacgttttgcccaggagagccttcagagtttggtcaagttactgtttacgtcggtgccatgctgtgatgatgacaatcatctttttcttgaagggtacattctgattatcgtgaaatttaattggctttttcatgacagtttattgttattctgatcttgtctgttatggtcatacagattttggccaaaagggactgcacaactcggtaaaaactcaaactgcacatcacagcgtggatattgttatatgtttgtcatcacccgcagaaccacaccatataattgggatgagtggcacttcacgtttctggttgggtttcttt

SEQ ID NO: 103716 - DNA, 616 bp, Oryza sativa
agtgattcttctttagaaaccatgtgttaacttaagaaattcggctacagcgcaagtgtgaatcgaaatgacaaaatagcacagaaggcaacatttgtgtcttccgttagacttgagttgggcccacatattggtaaatgataccgtgaaatcaacagatttgttttgtttccttgtggttaaaaagggtctatttctacagacctatagtgtttcctatatgcgtactatagatatcttctgtgcttttaaaactctcactgataaatactgagaactagtagaacctctggtttctttcaataaataaacagtccgcaatgggaggaggtggatcaataatgtgttcagattttgattagttccagaagtactatgctgaattgatctgttgatttttcacatgttgattactgatcagttggtaaactctgaatttatgtgccaaacatgcatgccatttaacttgcacaacaatagagaccacaaacaaagaacaaagtgatataatataatgtagaccacgaacttctctgaatattctcaacctagcattacatgtaggacagttgtcttccattaaccatgatatgtaattcttgctgaacggagctgc

SEQ ID NO: 103717 - DNA, 776 bp, Oryza sativa
agcagggtttcccaaaccgcctaggccggggttaccgcgtcccggcggtaagcacagttaccataaaaaaccgtgaaaaatttatcgaaaatttaaattattttttaaatttatttgaatttaaggatgttaccatggtatttatattactgtaccccgcggtaaacccggtaaccacagtaaccacgtggttaccgacggtaacataaacctgtacggagaccagcatgcctgcagtgaaaaactggagatcgagctcacaattatttttgttcaacaaactttccttgacttggactctcaacaaatttcgggtcaaacttttcttggcatttcttgacatagcctgtcttgacacttgttttattgcactgttagctaggttgcagaggctaagtaagaagtattggatccagaatagcaccgtgctgcacatggcctcatggttctctttacctcgatcgttagaattaatgcattgtgtatgtctgtatgaagcaaattggtgaggtaaccattgtcttccatgagagatgaaataggattgttgtggagttgtgcgcgctatagcctcgattcttccttattctattatcccatatgtacctcaggaaaaaataattaaaacatcatatttcttatgttctgtatataggtaaccaagttaaccgatatttacaataatcactaaatgtttctgatcttttaagttatagagattttttcaaatgttaattttttaagaaaattagccctaatatatatggctcgtttgt

SEQ ID NO: 103718 - DNA, 1487 bp, Oryza sativa
atgagcacagaactagaagcaatcatttgttaatcgctcgggattatactaattgaagcacagtaggatccaagccagcctcctaaaaacatgtggccagggatttttgggcagcaaaacccaattttttttttgtaaggaagatgagaaaaggccaaggtaaggtgagggtgggcccgtgatagcatgcagcagatctttctcttatttttattgtctggaaccctctggagccaagagggcaagaggaggaggagaagggacacgtgtcgtgaggaggagtgacgtgtccgccaaaaagcgtagagtagcaaaagaaagaaatcttgtggctgcgctttgctctcctctctccgatatttcccaagctggaccaacaacgcccacccgtttttgcctgcagctagactatgacaaaagtttatacaagtggataattattactagtactatatctcattttgtgtgcttaatcacgcaattttccctttgtggttttttcatcaaaaagaaaagaaaaatccagtcggttgtttctggtcacaaatatctctctatcgattcactcctggcctctcctgtttgaacggttgtggatattttcagcttattatctgtctgtcttctttttccccaaccccaaatagtaacagttttccgcatgtgcaaaacgccaaagcatatacatacatatatatatatatatatatgtatatgtatatatatatatatatatatatatgtatatatatatatatatatatatatatatatatatatatatatatagactgagaccttttcttttcttcctcccaacatttttttttcttccttccaacatctttgttatgaagtttttttttctctaaaaacatttccccccccccaaccttatcgtggtcatagtactgtgtattcactcatgatattttctttgattaatgccatgcgtgatgccatcaattccattgtctcttgacatgccaagagttcagagggacgcgggagctccttaggtaatcaatcatcctatgatgaggaagatatgaatttctcaataccgtagattaaagaaatgctgaagaacatgggtacagtttagccactcgaatctagaaccagccacgacacaaacagaattcaatctgatagtaattgatactaatataataaatttgtagcaacatcaaaagaggtgttcagatttcagctgctccgtttcttggccaagccaaactaatactaatctagtggtacagattcagtgattcctccttgtataggtctaagccattccaaaaacacatcacgttgatgcatctgccttttgcttcttgtccgtcccatggaatttcctcccggcttcaaccgcctccctgtcaatcagtttaagtaatcaacttcacttgtcgcatggaataacaaacacatacacacatgagttccaaaccaatcataacgacaccctatatatgtctatgtta

SEQ ID NO: 103719 - DNA, 1237 bp, Oryza sativa
ggagcagggggacgccatagatagctggggaagactagagtgatcgatctcttcgagtcgaaggaagaagacgaccaaacaactactagtctcttctctcttgtaacagtgttaactccgattagattagaccaacaagtctaacaacttagttagttggtgactttgttgttggcgagagatatacaactctttatcccgaaattcattcaaatcttcacaattttcactctaaacttctccatttagcatactatctccgtctcaaaataaataaatctattatccgtagtaataaaaaaaatacctgtgcgttgcaacgggtaaaaacattttttatcatgtacattaagctcccttgattttggaccgaatgcttccttgtttttggaccgaacgttcattccttccttccttttcagctgctaccttcactgctcggcatatctctcttcggctcagcccacaagtgaagctgtaggctcagctcaaacagtctcgtgtctggcctacctcttttcagctcaacccacaagtattgttgtaggccctgctcgaacagtctcatgtccgtaccatgacgaagtcgatcctctccatcaaatgcggtcgaatctttctcaatctccaaaattgttgagatattttgatccactcgatcctcttttttgattttttttatcaaaatcgaagtgatcctctttttcgattttttatcaaaatcgaagcaatccataaaactcaggataaaaaatgacgaactgaaaagaaaattctgaactgaaaagaaaattcaaaagaaagtagtggagaatcgatttttgcaattaattggatgaggcaaatcgacgtggcggcggcgctaggcatacatagctgggcaagagtgatcgacacaaatcaaaggaagaagaagaccttctcttctctctctgtaacagtgttaactcccatcaaaggaagagttcaccagcaagtctttgctgttggtgatagacgccactacaactctttaacccgaaatccattcaaatctccaccatttacactctaaacttctccatttagcatattcccttcgtctcttaataaacaaatctaatactatatgagtaatatttgattattttagtacactttggtctaaaatattcgatattcgtgataagattttcaaatttcaaccataaaaaatctttaaatattcagtttaaagggggatcctctagagtcgacc

SEQ ID NO: 103720 - DNA, 808 bp, Oryza sativa
agactgtgcacaagtgcagtgatgatcctggccctggccagtgtaggggggccagctaaaacggtggcaggaaccgcagcggcagcatctttgcttggttattggattcttggtgagtgctcctcctcctcccttactcttgctctgcctgcgcctccgtgtcttgttgtcttgggaatacaattaaagaggtcttctttctcactggtgatggattattaccagtgggaaatgcattttattagccactagtagtagtagcacctccactcttgaaaactggtgtccttttcctgtcagtgttgtctctctttagtttaaataaaatggacaaatgaaaccgaaaatgcaacctgctgtttcttcggctacagctttatttctgaatgagcactactacggctgtgtggatctaaacttcactacttttctatcacatcaacatgtcatacacataacttttcagtcacatcatatctaatttcaaccaaaacccaaactttggatccaactaaacacagcctacatctatttttttttacaaaactcttacaaataataatatcaaccgtttaacttaaatatataaaaattatagataacctgaatgtatttacagcgtgacatgtaaatggcccaagaataatttatattaaaactaatctactaatataatagatttgctgtaagattgttttcgacatgttagcttctccacagtagcataaaaggcggagcgaaccaacaactagggcctgtttggtacagctccaactcctaaatataactctaggagttaagtctggag

SEQ ID NO: 103721 - DNA, 667 bp, Oryza sativa
acaagggtcaacaaagtacttgaggtcgttgcatgcgttgatgagtcgtattaacgatcacttcttctctttatttattgatgaagctgctatcttttgcaggaagccggtcggttatccgccgccgaggatgaagagctgttgaggaggctgcgactgctgcggccattccgccgccactggaaaaaagatggacgacgacgaccatgaccaccacggcaacggcaacacccccttctccttggccttggcgcgctcctgcggtgaagttcatctcatcgggccggcttgcagtttagcccagcccagcaaggcccattggcccactgggagtgggaggaacaggaaaccgacctcctcatcctcgaagacgaagacctctctctctcgctcgcctggcgccgccttcttccaccccactctttcctcttccgccgccgcatcctcaccaacccccaacagccctccctccctcctcgccaaaggtaaaaaaaaaacttagccggatctctcatctggagacttgctcatccttatctatcttttggggatttcttcatctcattctcatgcatggtgtaggccaaagtttattgcgatggatctgatgtttgcttacatcctttcctagtcaatttcctactctgcctaggagtatattagagcg

SEQ ID NO: 103722 - DNA, 728 bp, Oryza sativa
tacagagtccatcacatcgccgcgcgccgtcgccatcgcacgcgcgtcgccgtcgctgtcgcgtcgccatgcgccccgcgccgcgccgcgcgccgccgctgccgctcgcccgtcgcgtcgctcgcgccacgcagccgtcgcgtcgcctcgcgccgcgcgcccccacctcacgccttgcgccgccgtcgcgtctcccctctccccattatctcttcccctctcctatataaaccccactattcccactctttccctccatcctcaccccctctcctctacccactccaccacgccgccgcctccacgccgccgcgtcgtcgcatagagccgccgcgccgcgccgcgccttggccgtgccgtgttccccgccgccatcgcagtcgccgtgcgccgccgccgtcgcagccaccgtgcgccgccgccattgccgttgccgccggtaagccgtgccgccgccgcctttttcctttcctcagccggtcgcggtaggcaggagagaagagaagggaagaaagaaaggagccgggaggagagaagagaaggaaaaaagaaagagaaagagagggagagaaaaaggagagaaaaagaaagagagggagagaaaagagagaaaaagaaaaaagaggagagaaaaagagggaaaatagaaaagaagaaaaggagaaaatagaagggaaattgggggagaaattaggaggatttaggaaataaaaatggtcggggttaat

SEQ ID NO: 103723 - DNA, 934 bp, Oryza sativa
tggggggggcctagttggggcgtgcgcgccccccacgcgcgtttcgggactaaagataggaggtatagttaactaatcaattaattagttttagataattatagcttaagataatgacagtagtagttaggattttctttttttcacaagattttttaactaacaaattgaaaagaaatctatttctgaagtcaaattttcaaaattttaaatccagatttgaaaattttaactcgaaatttgaatttttttttaagtcaaattttaaaaacttttaacttttcatctcacatttgaaaaactttcaactcgagattcgaaaattttcaagtccagatttgaaaattttgaaaactttcaactcgagatttgaaaactttgagctcagatttaaaaactttcaagtccagatttgaaaattttgaaaactttcaactcgagatttgaaaactttgagctcagatttaaaaactttcaagtccagatttgaaaatttttagctcgagatttgaaaactttcaagtccaaatttgaaaatttttaagttaagatttaaaaattactagtaaactaatcagtagtaaaaataggagactaatcattactccctccgtcccacaatataaggggttttgagtttttgcttgcaacatttgaccactcgtattattcaaattttttttgcaaatataaaaaatgaaaagttgtgcttaaaatactgtggataataaagtaagtcacaaataaaataaataataatttttaaaaaaattgaataagacgagtggtcaaacgttgcaagaaaaaacttaaaatctcttatattctaggacggagggagtagtaaactaattacgattttttctcccgtgtggcagaaaaaagaaaaaaaaaaggaaaaaagaagagacggcggtgcgccaaaagaaaaaga

SEQ ID NO: 103724 - DNA, 740 bp, Oryza sativa
gtagcaatgttatgggactattatcacgttagattccccctcttgtatgatgtatcaatcacctttttattgagtagcccaacgacatatagcagttcacatgttcacatttatttcttaaaggatgaaataatatatttgtaaccggacacaaaagaatgggttgtttggttcatgtgctatgagaggacaagcgtatactaatatcctcttctggaaggaggaagaagaagatgacaaggtccttctcctccaagaagctgtagtattattcaggtttaaggtactgatctaatgaagacaatctatcatcaaattgagctttgatctggtattgccaatgccatattattattccgaggactttgtagtttgacctacaatatgctttacaataatccaatgtactactccatttaaaaaaaaaacctaatatagtattcagattcatggtactctagtactatatttgttttcctttcgaatgaagggagtattattatttgcccttatcaaattaccaaaatgcctctatacttatcctaaggccttctttggttaatcccatcgggattaaggtgcggaattaatcctactcaatcccttctaatccctgtctcacgcggaataatagaacagtctagagtgagtaaccaaaggtgcttggacatgaataaaaggatagtaaaaaaaaactatcaactatgaaaataacacacgtgatcttttctgcttattca

SEQ ID NO: 103725 - DNA, 1157 bp, Oryza sativa
ctactgctatattgattatatatcttataactcaccgtcacatgattcctttcccccctagtttgtcaagaagcatggaaacgaagggaaagatacatcgtctaacaccgatacacacaccgctcagctattatctcaggtcaaccatctcagacaggagatacaatctctaggatcaaggcctgttacagttgtcaccaatgctgctagatcaggtaagttcctgctgactagttactatgttttagttacagacttatgcatgggtcacagatcatacaaacataaatttcacatgacactagactttgtgtatgccccgatgtcgacatctcttgctaagaattaatgcgattttagagtgttagatatttctattacctttcgatttttttttcagacttggtctgttgtttttatatctacatgttcgacagagctacaattgcgttgtctgttcatatacagagtataccattttgcgattcagttcacatgttcttttctttttctttccttattattatttgtcatggtcttggctatgcactactgattatcattatattattcgctgcattataaaggttcttggacacgtgatagtttttataattgctaataaactttcatcatgctcttttgcctttaaacatacacaattacatatgtttgcccctctaggttacacacattctttctcaaatgtccttgaacgacattcatgtaaatccttcttctgtaggacctggtacatttactataacagcggtggttgttgctggggctgttggctacgcctacattaagtggaaggtaatgtttgattctttcacctcaatggaagtacagaatgaggaggacataatctttgattattctagttgctatcttgatgtttattgttctgtccgtcattctagatcatggacgcaagtgcatattattacaatcctatctgcttgccatttcttgtttcactgttctagctagtttctaaagttacatagatttgcagggctggaaactttctgatttgatgtttgtcacgaagcgtggcttatctgatgcttgcaatgtagttggcagccaattggacaaggtttcagatgatgtcactgtaagtttttaacttctttcagcaacgctgaactcaa

SEQ ID NO: 103726 - DNA, 680 bp, Oryza sativa
gaggaatggaaatggaggggtcttttgttggtgcctttgcaagttggctttcctttaattgcttccttcctttatttagttaggaggggagagatatccccccattggctaggatcacaaggtgggttattttaactgtgaatgctaaataaatggctgcaattaagaggccagggcaaggccaggcacaggtagctagcttctagaaattgtgcagtgcctggaattggtcgcactactgaggaaagttaaaggggatgctaaggttgtgcatccatagttgtgctactaattaatccatgtttggtctcttaatattttttattcatgaagaactgatatatatactttctataaaatatatatgccattactcatctttatatttttctagcaatttttagaattttgtattaatttgcaccaacgttacttcaaagtttcaatcatttgccatgatttatatattagacatatatagagacatactgaaaaaaataatcacatgcctagttcattaatttcacattgaatttttttcctctacttttttttttgcatatatataatactgcatttgtcccaaaatataatgatgtcaaaagttgctatattttggaacaaatgtactatatacaaactgaatactctaatttaatttaatcttactcaaccataaa

SEQ ID NO: 103727 - DNA, 1287 bp, Oryza sativa
atttcttttttagatagtggaaaatttaagaactgcatactagtttgaatgtgactatttgacttgtaaacatgtattcttaaataagaaagcatgtaaataattaaaatagttctaaaattaatcgtgctataactatatgatccaatttatatctagtactataagtatttgattttaaactagttcatgattctttttctattgcgactaattatattttgcaagttgatcaaccaaaattggatcaaaattctggtaagtctctaaactaataagtactagtataatgctaaaacacttgttctaatctaaaatagtatcaattacaacaggtctatattaaatttacagtgtagtaaatatgttattctatcaaaatactactgtaaattatgtaaataagtaaactttattccccacataataaacagtagaagtattgtgatcaccttttttgtttgaatagatgctatccattcgaagcaactctgtattctttgaaatgtttatttcctccaatcgacctgtattttgaaattttgatgtatgataatccaaacaaaattcttaataatgaaaaatgaacaatcaactaaaactatagatttgatgagctaatcttggaaacacaaatatgaattacaatgtttttggcaaacagcgtggtagaagaatgaccagtaattttgttttgaagtgagcaaccttgcacattttaattattttcccaaatgatgataattaacatttttagtaaacacatcagtgttttgtgggttatctggtgagaaatactaacctatagttaacgtttgttttcccatagcattgtatctttctgtgatatgtgaaagtaagtgtattagagctctctagttttaactttaatatgtggaataaactgaaattgtcattttgattcatgcatttgttgtctatggtattcaagttcttatgcatttgatgcatgtgtcttcatacaactattgatttttccctccttgtttctttctttcctgcaaataacgtattgtaattgttaaagttgacttatatgatgcttctatcaaaattatagtgtttttttcctgtaattgtatcacatatgtactgtaattgcataacttttgagtttatacattaggatgaaaatcgaatggtactctattggtgctatatttgaaaaataatatggcagattcctgaaattaaaatttgcattagtaatcagattttgcagatccctgaaactttgttggcaccatcatgtttttgaaataaaaa

SEQ ID NO: 103728 - DNA, 740 bp, Oryza sativa
ctctactatggctggatgcatgctgtcatcatttttccatgggcaatttaaaacataaagcctactactctctctgtattttaatgtataacgccgttgactctttgatcaacgtttgaccattcgtcttatttaatttttttgtgcaaatataaaaatatttatgtcatgtttaaagaacatttgatgataaatcaagtcataataaaataaatgataattacattttttttaataagacgaaaggtcaaacatttattaaaaagtcaaaggcgtcatacattaaaatacggaagaagtacaatgtaaaattctttacatgtactccatccgtacttgtaaaggaagtcgttttggacagcgacacggtctccaaaacacaactttgacttcttgtttctataaaaatatttattgaaagtgatatatatgtatacttttatgaaattattttttaagacaaatctattcatataatttttatatttttaaactcaacaacttgagagttatttctgatttatatttccaagacttgacttaaacattatcataaacgactttctttatgagtagtgaaggaatacatgcatgttcatccatgcacttttgtacatctaaatgtagaacttcatctccttaattagctggtgaggtcaggcatctctatcatagctaatgaggtggtcacacaaacctcggcatctctccctaattaagctccgtttcgtcttaaacaa

SEQ ID NO: 103729 - DNA, 1856 bp, Oryza sativa
cctcgtgcacctcgccgccctccggcggcggcggcggcggcgtctcccgaggcatctcgtcgcgtcgcgtcccccaccacaccacccccaccaccaccagtgtaccgcctctccactaggtcgcggggctctttcttttggtttttgtactggaaaaccgcgtccgcgatggagaggaaaatggaatggagtacttgtctggaaaagtggatctagcagacaagcactgtgactacacccccaagtgtgtagataaattccttctttttctcaagcatcatggttataaaaatgtccttttcagctagcacaaatactccttattacacgtagagagcatttattgaaatagattttattatactaaaaaactactaagatttttatcttcggagtacaccttccatacacactctatcgccgcacatacacacgcacacgtgtaaatatattatgatgcgcgtctaaataggattacacgtgtcatgtccctttttaaatatatgatgttgatgatttaaccattcgtattattaaaaattatattttatttattttctcatgaattgctttattattgcaagaacataagcgctaaaattaataagacaaataattatacggcatatttaaaagttaataatgtcatatatttaaaattagaaaagtactacttttcaccttttgggatttgatcccgagaaaaaaaatgtatgaatacattcgacaggtagagtttgaatttttagaatatatgttcataatataagatttatcaactcttgttcattttcctttttttaaagaatgaatacatgattaaattttgcagacatagtactagttaacatttctatgttccagcataatgttgctcacataaaaaaagtagacttaatgcaatatgtgttgtggaatattgtatacaggtttgtaaatacatgtcatcgaagtgctatttatatgtaaactttgatcaattgtctttttttcaataaatttactaataatatttaaaaggatatcgtagtaacaaggcgtgttacatcttaaacataaacatgaaactttcattagtcgtagtacgtataatcatagtttgtgtatgatggttattttcaacagatatttgcaagtgcacatctccatccattgtggttgcatgattgtatctatgttctttatgaaatgcgcacgataccctccgtaattattgtaaattacttatataaacaaataggtcacataaacatattataaaggaaaaaaattgcagcatatagcccccttgcaggatttgccgcgtcaattttcttccgaagaaaaaaaaagtaaatatatgctacaaatactaaatgttttgaactcgggaatatatcctacgcataaaagctttccgtgcacaccaacaaatgaatgttacacaaaattctataaaaaaaaagacacatacttcaaatagcattacagctatatgtgaaattttatgttcaaattcattatattttagcctaaaaaagacaaaattctgacatataattatctttaaactgttagatttttcatttgtttatggctaaaatataatgaatttgaatatgagactttggggatacgtgtaatactattacgagtaaatatccaattttttttagaatttttcgtgacatttgctagttggtgtgcacgaatgtgtacgagaaacttgtgtacataggatatgttacatttgaactttgacgctcaaatttttaggatgaattctatgcaatttacaacgatacacttgctcaatctttataagcacgcttcccaaactgttaaatagcgtatagaagtttatttaaaaagatttt

SEQ ID NO: 103730 - DNA, 1935 bp, Oryza sativa
taattagataatgtttactgtagcatcacataggctaatcatggattaattaggctcaatagattcgtctcgcgaattagtccaagattatggatgggttttattaatagtctacatttaatatttataattagtgttcaaacatttgatgtgatagggacttaaaacagttttagtaccatctaaatagggtctaaagctaattttaaccgctccctccaacggctccttagacttcctgaaaagtttctcgccgggcttacccaaaattgctcccacagtgtgctgtgtgcagggaggagggagcaaatacatactgtatttttcttttaggaaaaatgcatatcgtttttgcggtgtactatattggctcaatctggttttaggtgtgtcatcgtcttagagcaattgccataaaaaaagtggttattaatactatgagctactagtggtgatgtgatgtggatgaggcgagaactctgaatctctacatgctatgcagtaagttcagtcaacgaagctaaaaaaaagtttttaagaaaaactagcgccgaatcaaacagttcagctacacgtttgtttcgaattagatggacattccccgaaaaagaaaagaagaattagatggacattaaagaagaattagctgtatgcggggagcgcacgatcacgcgaagaacgcagccaggacgacggcaacggcacgacgttctgtgcaggtctcacccctcttctcgccctgcttgactgaaaggaaccttctcttcttcccaagaagaaactaagattcggattttagcttccacgaaacacacacttgcagatggtcagatatgatttgagacattcgacgagcctatctccatctatctctgcattttttttcttcaattggagtttttctccattgttccgttttaaatgatgagaggaacgcatcaactgcatacctttactccctttaaatggacaggacatcgcaaagccgatgcaatggatagcttccagatactcctacctgctaatgagcctgctaatgaggagatgctcctcaatcgagttagaagtaaattttttttcttcgaagtgacaattaaaggcatgggccataagctgtacctgcgagatagagagagcttcatcaattgcacgagcaagacccgccgagcggcgaccactttgttggaagaggagagtagctgaaaggaaaagatctcaaaacatgtgggctgtttgttttcatgccaattgttacagtggagattgtccgtagtactactaatgcagtaagagtgactgacatgtgggttcgggttcccacataaatcactactattgctttcagcagtactgcagatgatccacatcccaattgttatctacgctgccacacgcacacaaaaaggctaatgaaactatcccagtgtttttttttttttgtggggaaactatcccagtgttcctgttccttgatttgacaaaggtatggtagctacatcaaattttggcagttgtgagtgacgaaattagaaattattaaagcatgaggctaaagtagaactcaactaataggatattaattttctcaaaaaattatataataatttaagataattcatgattatggagacgtggctagggctcaagtccaaactacctacggttgccttcgctccattgctcatgtttggctaaaatcatcagcttgcaaataaatggagtatatatgttgtatttttcttgtcggcggcatttttctttgtgcacctgcacattctgcctgtcaatttttgccaaactaagagtgttcaaggggaggggaaaagagaagatgtgtaaaatgagatgagcgattagtatgtgattaatttagtattaattatttaactataatttgtctgcgaggattttaacttagaaaattgaatttgtatg

SEQ ID NO: 103731 - DNA, 1198 bp, Oryza sativa
gcatttggtcaaattttaaccggccttgaaaattttaccaaattaatggattcttgcttccaattatttaatttaactaatccatgttatcctttagaaataaatgattaaaaattaggtatatctgaagaaaagtaaaacaacagtagaaagcatatgatagaaaatgctctgaagttcatatttgaccataataaacaaaataacaggatgattatgcacatttttatccagacagatcagagaagaaataaaatattacctgtcacaaatgccttctgcagctgtccactgagcccagtcttccatggacctattgtcgccactgatttgttgcggcatagcaaaaacatgcatgctatgccgataaacagcagagcgattgatgaaatcacaatggcatacaaccatctcttagatctttgtggaggaccactggacatgggtggactacttggaggacttagtggtggaggcaccttgatttccttaaatgctgaaaatgatccagttccagtagaaggaacagaagcaacagctggaacaggagcatttgctgaagctgcagcaagattggtatcctccaatagtctgcgccggctaagttgtacagttggatttcttgcagcaaattgtgaagaaagatgagctggtcgaaagatgaaggtatgttatgtactagctaatgtatacagggttctatgaacaaacttgaaaaagataagagcaggttaaattaccagaaagattgttattgtcttttgtgttctcttctgatgaagaatcagactcgaatctacaatggttcacattcacaactgttaccatcaacacgcactgataatttgttttataaaaataaaaaactggtattgaccagaatgtatatcaatctaattcttcttacccattctcagatctttgatacacatcgcccctctcatcatagacgtcaaaatcaatttcctgatcaaaattcctgtaggaattttggatgagaggccattgaaagttattgttggaaagcaacctgcagagcagtagaaaatatatcatggctatattacttgatgttggtcaaattttggcaaagttaatcagtcagacgacctacaagtgcttaattgattgcatttctgctatctcctgcggaacttcaccagtcaaattgttattgcttaaatccagtatttccagc

SEQ ID NO: 103732 - DNA, 916 bp, Oryza sativa
cggaaaaggggaaactccaggtgtgataggaggggtatatcgtcatttagtagtgaaaaaaccatttttttccttcttttttgtctcttcggatggaatatgatcgatgtcagtgtaatggattgtaatggatgaccacatattgatatagccgggaaaaaacataaatgccaatgttaccctaatcactttattagtaaatttttgatttacccttaatactattggtagtattataccatcgatagagagcaccagagcatcgttcatttctatatatatgaagtatactatatgtattataatattcgatctatattacttagccataacagtaagtacaagtttcaatcaacctgagataaacttttaacgatctatttgcagcgttcgtgtacataaatagaagtcggcagtattgtttttacctcctgctaccttacttacatggtgtagtgtacatatatatactctctccgtcctaaaatatagtaattttttgagtggataggacgcatctgaacagactatccagattcatactactagtatatgtcacatcctactaaaaattgttatattttgcgacggagcgagtaccttgtaactaacattctgagatatattaatatatatagctctctattcctcctagattaaaaatgtctcgctattgttaattatagacttgtcttctaataatgtaattagttaaaccggttttatgtttttacctttcaaacaatatgggtaggtatatataaagctctcgaacaatggaaaaaaaccttattttttttcataaagttggaatctttttagtgtaaaaaagaaaacagtgcaataactggggaaacgaaggaatacaaacttcatagtagtatatgctatatagtactgctagtaagaaatagct

SEQ ID NO: 103733 - DNA, 4041 bp, Oryza sativa
cgttccctcttccgttggggccattgcaggtagtgacatgatcggagttgtcgatgtagaaaaagaagaacatgacgtagaggatatacctgctcgtgcaggttcttaagtggacgaagttccggagacctgctcgttctcagtacctgtgcacgcaggaacttagaaccggggattgatagaagctgtgtaggaacagagaagaggggggattctaccataggaggagaaccagtggaagctgatcagaagaggggatcttctgtctatcccagaggataagattgaacacctgagaggaacgttacgagattgatagcgcattattctctagtccgttactagagtaacgtgaccattcatacctgtcggttacacctttcctcatagggtctagcccatttaattctaacaatctccacaaaatttcagagctcataggaaacattgtcatttttgcacctatttgttataccagtgtttcggtggagactgttaagttgaattttcacctagaaaagaagctatatttgaccacaaccgaacaatgggcccacgggaattatcaatcctgtactgtcagtctttactcaattacttaactgatactgggctgtcgttagcacctaatttgtttggagcatataagtcgtactaggcttttgcataagtatctagagatcacccaaatctcatggactgtgactagctgtcggagcgtgagctcttcgattaggggtccgtgaggcccccctttgctagttcggccgggggcagcgggtgagattcgaggattcagtggaatgtgtgatgtggagggaatcggacccctcaaggaagacgaaacaaaagggatttatacagtttcgggccgctgtgaagcgtaataccctacttctgtgcttggttgatcttgtgagaaattataagatctccttgttggagtagaaggtgttgatcatgaggagcagaagctgctctagagtctaaaatggctcatcccagagaaagggattcctcctctccctaactaggcctggacctccttttatatctcaagggattaccacatgggcccatctagcctattaagggaggataatcacataaaatgcatgtcttgttgctttccttgtaagtctcttgcatgccttgctatgacatggagtccaccgaatcttaaccagctaacagaagggacgcacctgtcattcaacatttaatgagttaggacttttggatcctcactgcgccgggaaacgggaaccctaccctaaccgggttaggcaagccgtctccggctgtgatgagaggctaagacctctcatcatcatggctgatgggacagggcaggacgcacgccgcctgacacacgcggtagtgctcctggcactctgggtcccatcggtcaatcaaccggtcacaggccggttgagtgcactgcacgctgcattaaatacggcgtggcacagctggtcaggtcgccataaatgcaggtaggtgggcgtgtggagttggccacctaacccaccacatgtggtgtggtgacccacggagggtttcgggggagcccgacccatagtcacgggagggagcggccgccgccctacctcgggcccgatacaccctcgggggagggggggaggggccatgtgacgcctggggcagcctcctccctctagtctcggtcaggacggtcccgacccccaagcgaggagggggcagccgccgccctacctcaggcccgatcccccctcggggcagggccacgtggcgcctggggtagcctcctccctctagtctcaggtggaacgggtgttggtatttcttaacgatattcctagaaatataattcccaacaatggcgcaaaaatactcctggtatattatggttacagagttcatccgcaagcgcacggatataccgttgtagcatttcacccgagagtattacaaggatatcgtatttatttaatcctatgagaagatcatggtagagagaacttaactaataatttatatgttacttgtaataatcatagtctaagcaggggttaagataatccaagagtagagtgacacacaagcagtaagctactcattctcatactaaattatctaagctaagtggaaataaaagagaaagagaatctactcctatacttctagtttacatagtatatatacattctagttatctgatatactagctaatattctctatccgatgccctcctggtacttcgtgaagccacccctaactgtcgagtttcttacgacagcccgtcatgaccatacaaccggggctaaatacagaggaataccttccccaggaaattaacttagaactatatacacgcgcggaggaatatccgtactgagctgtcaccatcagcggcccacctctcatccgcagcatataaccccaaataatgatctaagcaccacgcctaaactaccatatactactctaattgatatcatcgtcatgacatagagtaattgcataagcaaacattatacccgcaccaaagcatctcccagataagctagcagtatattcaatataacatgaacataatataaattggcatccatatactcgaaaagtattttaataccataaatgtataaagaagagtattctaaatctagataggtgaaagcagcaagctgcttgaaagaagaatgagccacgtcctctgaaattgcaagcaccatcggatgagactggtaaaacaaaaggaccgttggatcaatatatgagaatataatccattgggtcaatctggaggcttctagacaaaaggtcaaaaatactccatctttgagaactcacatgtctagggtatttaaaacaccacgtccggctaattgattaactgatcaaataaagaaaaaaatattgaatgtagcctcacccttaattttcaaggtaaaatatttttttatcaaggtaaaaaatattgtagtccttccagtccttcaaggtaaaaaatattttcagtcatgtgaggttaatattttttcaagggtaatagtccttccagttatgtgagcgcatccacaatgtagtctaaaagtggttcataagcaatacaatatttatttcagacacctagcaacattgtggaactagtccatagcaaagaaataataaaagctacccataagcatataggctgcccatagagaataaaatatattatttgtctctacctcttctttcctcctaatactatttgctatctatatacattgtgaatgttacaatagttaaagttcatataagtgggtcccatctatatggactacttttgctatatagattgttgttgctctaaggctacaataccccatcaattttaccttgatcaataaaaaaatatttaatttattcatttactttgttaggtacatcaatcacaacctttcatttttaatttaccttttttcttaaatgtagtccatctcaagaaatatgaaaataggtaatattatcttcgcttttaaatatatgacgccattgaattttttatatgtgtttgataatttggattattcaattaattttgcaaacataaaaaataactcactcttaaaaaacttagataataaatcaaaccgactcaatttattttacaatagaggcagtagtatactcaccaaactgactattgattgcatgcccactactatagacatgttatgccataagttagagttgcgcgaagcgcaactgagtggctagtaaagtacaaagcttacaaaggagaagagaagagctactagagccatacccgaactctcctgaaggcttccggactccgatttctactctattcctattccactagcttaagaatactaaactaacttgaggtgtgtaagtgaagtgagaaggtgagctccttaaataggcaggtaatgacggttatggtggctggaaaggtcggtaataccctccaaccgccatagggaggaaatccacaccgtccatcgccaaccctgcatctagcggctacacggcgggttcggccg

SEQ ID NO: 103734 - DNA, 1750 bp, Oryza sativa
  unsure (1)..(1750): unsure at all n locations
ttccttcccatctctctcattttctactgggaaccttggccaagggcactctccaacttcactctgacgccatcctccgaacccagtgagaaggaaataaacaggcattgagggccggatcggggcagtatcatggctcggcgtgggcgctgtgaagcgcgacgaggcatgggcatagtgctggcgttgcagcggctcgcatgggaagagtggttggtgcagacttaccgtggctgaggagatcagtggacagtgggtgggtaggcatgggctttggtctatccatggcagcagagatgaacatgagagattgggagaagaaaagaaagaagatgagggcaatttggtctaaagtttttgtcaagtgtgttgaaaggtatatagtggtatatttcaaatacttataaagttataatgtcatgacttcaaataggtaaatattaatggtatatttcaaaacatgaaaatttataatggcatgaatccaattcaatttcttatatgaccctcgttctctcttctctgaatgatatatacatgggtctagagcccatatgtgtgtcattgagacaacatggacaaattaagaattatttgaaaatgacaggagcaaattagaatgatcaatatataatatgtttgatttttaatgatttttgatgtcccacttaaccatatttgtttattataataaaatttataaagtataatatatttatgatcagattatggacgtaccttntgagctagaaatatgcatacagtttctatgctatgatcagattatgaaagtaccttttgagctagaaatatgcatacaatttttatgttttcaaatgaagtattttgtaattcataggtatagtcaatatttgaaaagcttgactagatatcgttcaaacttcaaaacatcatatatttatgaccataggagttgcatagatcaaataaaaatatttgaacggttctgatattaaaatattttaagctttacatgaaacgtgatcaaaacaacgtggttttgtgtctggagggacacgtggtaatgtaatgtgggctaattgtggtctgttgctactgcaggactagagacttgtagtacctaaatgctacaaagaatactacagtttcgtgacacaacggaatgctactgtagtacctccgaatatttgacgccattgacttttttaaatatatttgaccattcatcttattcaaaacttttgtgaaatatgtaaaactatatatatatacataaaaatatattttaccattaatcaaatgatagaaaaaaatttattattacttatattttttttaataagacgaacggtcaggatatttaaaaaagtcaactacgtcaaatattttgggacggaaggagtattatggtgtgggtttcagactttttagttgtttctcaagatatgcatcattccatactgcggctatatgcatggtttgagttttagctattccttcaagtattctatttaccctggtcatgtgttaataaggctacatatgttactcacgatttgtaaattaaacaggtttagtccttcctcagtataatatccatgcatattccattgttcttcaaattgcatgcgaatacaatgcaatgcatgctctgagaacatctagaaggacaaaatgctctgagaagaagttctccctgactcccccgggtgaataacgaaatcgtacgccccaacctgctcagtgaaatgcgcgtgagcaaccgcag

SEQ ID NO: 103735 - DNA, 908 bp, Oryza sativa
aaaggccccaagactagaaaaaggattattattacttttccaattaaattaatcaatgaaatgatctttgaattgttaaaaataattcctatgctcaaataattccaagaaaaatcttgaacatacttggagacccaaagtatttaacaatattaaaaacagaccatttaatgattaatttaatatgtgggtaattactgaaatgctctttgtatgattaaaagttaagaattgagctccgaaacatctgagaaaatttcagagagtgtaattaatcatggagaatttaatcaaaattaaatccatccatgctttatatttaggaaattttatttcccacatttaacttcacttgtaaattaatgaacatttaatataaattctaataataatttattaaataatttataaatcctgaaacaaaaatcaggatgtgacatttgtgcataaaatcctcgtccagaaatcagctaaggtacacaaactgacaatttaatatacagattcatcaaattaactaaaacgataaatacttacttaagaggcacttagtcctcaccatgaagaaaactgcagcggaaaataaaatctagcgaagctccagctccactcccataggtagctcaactgggtataagccaaacgtcttctccttcgcaacttgtcttcaactgaggtttgattgattattgcaaggtgagcatatgacatactcagcaagccacacagcaaatatgcaagtgccccaggatacccaaaaatggcataatacagggctcatttgcaaaaacagcatttaccaaacatttgagaattgtaaaacaatagagtaattaatcatcaatattaatcaacactgaacagcacacccatgctgcacaggcccaaccatcctgaacaaccatacc

SEQ ID NO: 103736 - DNA, 668 bp, Oryza sativa
tttttaggtttttctttttaataaactttgataattgtttttgttgcttaataattatttccggtgttctgaaaattcaagtaaaatttgagggctcattttagaccaaggagaatttaacaaaaattctccgggccacatttgaatttttcttgtacgtattttagtgtttgccaatttcttttcgaattttaattaattctattattccttttggaaaatgatttttatttcgggatgaatttatcaggacgtgacaaatccaccccccttacaagaatctcatccccgagattcgaggaggctagcatgaagataggttgggcggtattctcttcttgtctgacttcttccgtcgcgtcttttataacaaacttgcctagcaaaacttctccactctaggctgcttggctcgatcccttgttgtagatggaatcttctcttcacctgacttgtccctggttgaacctttagctgacttcgactgggttgcggcacttgaagatggggcttcagttccagaacttcgcatagttcatatctttggagtcaacctcatacaagttacccacttcatgtcatgcgtcgagatcagctcgtcattactaggataccatgcttgtcatcatgagaataccatgcttgtcatttacttctaacttgccacc

SEQ ID NO: 103737 - DNA, 2049 bp, Oryza sativa
ttgacaggtgggcctggcgactttttaatatttcctgtacttagtgttttggccatattgattccatgcaggctgtatgctgcctatgatttctacatagcatgtgagataagtggttactcattcctatttcttgtcccgtgttttataaacctttcgaaattgttacaatatctcccaccagccttatccacgcggtatgggtataacataaagtcaagaaaaaatttctcttttttaaaaaaactgtagcactggctaccaaaactcagccaaatttatgaattttctttctattctttcaaaattctaatttgaaatttaaattctcaaaaaaaagataaaacacaaaaaaattgctgaaagaagtgaaaattcaaaagtggtatttcgcaacctgctagctatgtgctgacaagttagcaatcattctttcatcgctttagcaaagacgatcatccattggcctgtaatgtgacgataatatatactccctccgtcccataatataagggattttttgaccactcgtcttattcaatttttttttgaaattattatttattttatttgtgacttactttattatctacagtactttaagcacaaatttttgttttttatatttgcaaaaaaaaattgaataagacgagtggtcaaacgttacaaagcaaaaactcaaaatccattgtattatgggacggagggagtagcagctagtggatgctaacaaggaaagtagcaagatgcggatacccttgataaaactggtataatagaatactacaaaggttgatgtaacctgcgaacctgcttttaattgcaggcaatgagtcagtcaagcactatgaaaggtcttcttaaaaaaaaaaccactatatggaaggatgcctgtgaagattatggatacatgatacccacattatctatatatgtatccaactgctaatagaaggtgtgctatatttgtacataacttggttgctagggtttccttgccggttaaggcaggaccgtacacttcgattgggtttatctcttgtaatactaaagggaacttaggccgaatccgactgggtttcatacttgtaacctctgcccctaacctatataaggagagccagtaacaccctcgaaggacaacatacaacataagtcaccacaacaagatcgtcagatcaatacaacacccgacggattcaatccctcaacaggagtagggtattacttctcattaaaaggatctgaacctgtctaaacctttgactccacatccatccacttttggacttcgtaccactatgcaggatcaggtcatttctgacagccctaaaccctcacctctgacgggttcaaccttggtcaaagataagtggtcactgatgacgttgagtcacctgtgacgggtaaaggcccgtcagaggtaagagtcacctctaatggtccccaactaaaacccatcacagatgagggtcacctctgactggtcccaacaaaaacctatcatagatgagagtcacctctgatgggtatatattttaacatgtcactgaccgtaattacgatccatcactggtgtgaaaaatgggaaaaaaaagtaataccgtcctcctaggttaccatcacattcatttggacggtcatagatcgcatctggcattcacaaataaaataaatcatcaaaattcctcttgttcccatggcattcatcccaacaaaaccacatgaatgtcaatcaccagaatcaccacatgaattggaatcatcgatcatagtagcaagaatgtgaacaacatgaacaacacaagacaaagtatttgggtgaaagaggactggcaggcaatggatctgaacgcctccacctgccatcatgttcgttgtgcttgtccctgagacaacgcagattggagcttgggcgcggaggagacaacaaaacaatgggcgacacatgtggatggaggtggcggcgacccgagctcgatggtgaaggagacgaaaacacggcagtcggtgcatgtggatggaagccgcggcgaccggacccccatg

SEQ ID NO: 103738 - DNA, 3279 bp, Oryza sativa
  unsure (1)..(3279): unsure at all n locations
acttagcacgtgcgaagtagctagctactgttttggagtggcaaacaaagcaaaagttcgatttaaaaaaacaaagcaaaaacaaagcaaaagttggtgcagaatatatgcctttgttttcttctgaaattattctgatgatttattcctgatggggaacccacctaaaaattatccgtgctctgtggatttttcaacctcacagaatgtcgccagtctgattgctgagtatatatagtttcaaaacttgcgtactagctagataaatttacctattctagaatgctctcttttatacgctttcttctgtttaatcttggatgaactttggattgacttgctttaacccacattcaggtctcaatatataatatgaaaccgggtaatcctaatgggcgggtgatcgctctctcccctccccagcgancacccgcccctccccttactactttacctccccttcttctcttactactacaccataaaaatttgaattaaaattcaaatttgaaacgggtatgtaaactttttacttataaaatttgggtctatagactaatatttgaattcaaattcaaatttgaaacggcaaattcaaatttgaaacgggtatgtaaacttttgacctataaactttgggtctataaactaatatttgaatttaaattcaaatttgaaacgggtatgtaaactttttacttataaactttaggtctataaactattatttgaattcaaattcaaatttgaaatgggtctataaactttaggtctataaactttagatgtatagaaatactatatataaaaatatttgagttcaaatttaaatttgaatcggatatataaacttttgacttataaactttaggtctataaactttaggtgtataaactttagatgtatagaaatactatatatacaaaatatttgtattcaaattcaaatttgaatcggatatataaacttttgacttataaactttgggtctctaaactttatatgtgtaaacttgatgtgtataaactttaggtgcataaatttattaaaataggaaagtaatacggtgtcaaaaaaagaaaaccaggtggagggagggagggagggggaggggggggagtgaattgatcgctgcccccatcgccaggtgagcgatcgcccatttgccatttcgtatgaaaccgaccatgtatcaccgattctatccttttaattttatgagcgatgacgatgctgatgatttatgtcttatatagttaggaagtacaaattttgtaagtataacttatagcgccatctatttatcaatttaccaatttttttcttatttatcaatcactgtttaaacagtagatcaatatgcaaccattcacatttatacatgatttcttgtggtgaagcaaacgatgttctaacctactctagtgcaaattcttactagcatgaaacataaaatatgacttacgtaaacataataatgcatctggattaaccctgaaaataaaaacaaagtaaagtaaaatatgcatttcatttgtgttgaagttgcagtaattttattttgtgcatgtttgggccaagcaggcttgtgcaagtttaggcgatttattgtccaggtgtaggtgactgacagataagaaaatatcaagcgaatgataaataactaaacggataatttcttcatccaatacatgttgaattgtcatcattttttagtgtctcgtgtattatcgtgtgggaagagagctggcctgaaagtaaaaagagccctactcatcttgcataatagtgcatacatagcaccatttcgaagtagggtacgtccatcaaggccaggaagatattgtatatcatttttttttaaaaaaatgtacttaattaaagatggattttttaattccgtttgaatttttatttctattttttaaaagtatgagatcaaaccacaagtacaatcaaaagtcaaaaccatgcatgtatatctttagctgtactgaaatgccagaaattcggtgattttttttcagaatatatgcattatattgttctaaaacttcccaaaataatattctgccctgattttagaaacacctcccaagtcacacaacaaccctagctagtgtgtggcatctgaagactgaaaatagtttttgttttgcactagaaccagagataatgccggttaattttcgtccttattggctgaggccagcgagtgtctgttgaaaatctactactagctagtgtgaaaaaaacaattcgggttcaccaaggtttcaggagaaaaaatgattttccttaccaatgatgacacggaaatttaattaaatcacccgtaaaatccatgcgaatagaccatatatacacgtggtgctaagtttaattatggaacctccatagtcatatcatatcatactctccctccattccaaaataatcatcatattacataggtacatcaaaactttaaaaaaaataataattttctcatactatatttactccaacaataaacccgatgcatacaccatccctatattttttagctaataacaaatcaagatattgtatcttagttataaatactggtgtgtatggatggatgcatcaatatccatttactccaatacataaataacgaatagatttaacgaataaacacaaatatgatgatcatttagtaataacctcaaaaaagttatataatgatcattttgaaacggagggagtatacagcagttcacaaagggaaccacttgtgtgtgtgtggtatatgagtgtagggtgtgttggtgtactcaattacgctctaatccataccccgcagagggcgccaaatttaaaagaaaacgtcatagctaaaaagccaataccccttcagccacaaattggttccactaatataacactactggaaacagatttttgcaaataggtaaaatagatttttctaagcggccatctatcccgcttgcacttaaaaacctgcgaaaaatacatgacatttgtaggcggcgatcaacaccacctacaagaaatcattttcacatacgacatctcaattttcataggcgcaacaaccacccgcctacgaaaatattcttcgcaaacaacaaaaaaaaaacaatccgcccaccacccccatctgccaccggcgtcgctttttgctgtggcggacaccaccaccatcgcccctctgctggatctgggagggagggaggaggggagccgcaccgctgcctccggttagatctgggagggagggagggaggggggaa

SEQ ID NO: 103739 - DNA, 627 bp, Oryza sativa
gttgagaaaagaagcagaatattctccagatgtttaaaagaacagataacagtgtggcaactcgaagtgtaaaatatcacaaaaacaaaaactagaaggcatgaaaaagacaagaatttattcacagaaggtactaacattttgtcattcaaaaatctatttttcaaaaagaaggaaatagaaaatgttaaaaatatcaagcctcaatacatgaagcacggatatgaccctcaatagtcaagcctagcaaataaaagcaagctcgagccaacatgctaatttaactatgtgcatatcacatcaagcatgagtcataaaactttttaaacaaagaaaatgtatagtaaacgtatgcgtgcacaaatgaagtagaatctgaaatagcaagaagaataaatgactgaagtattcggagggcagaaatcgaaagaaacagacttcaaatttagaacataaatgttttacactgacctaaatgaggccatgcattacacaagaaatgcatcacagctcaaatcagttccaaaactccaatacggagagagcctgttgacctcctgcttccagataacacgagtttcataagtctactatttttctagttctagtgcatgaaatgatccaaat

SEQ ID NO: 103740 - DNA, 598 bp, Oryza sativa
attactattctagcgtgtatgacagactagttcctctaaggctggatggattcagtatgttgtttgtctcagtttttgcatgttgggattgtccaacacctatttttattcctactgtactcttggctagatgtgctacaacacagacagacaggagaagtattactcatcttccattgtctaagaaaaaggaacggagggatgcaaaatatagtgggattattcctataaagtacttttgcgcacaaaaacatccgttagaagccagtgttttctcttcttacgctaaagagtgagatgagagagaaaattcctacactatagatcttttggaaaacatgattttaaaatgtaggaacaagaaaaacattttccacgaatatgatggaagtgaatccatgggatagattttgaaaaaaaaaaactcgtcgttcggtagcactataggaaaacatatgaagtttgagagacggagagaaaacattataggtcttgtctcttcgtaatttttcttcaagattcatatgaaatgagcaattccataggaatttcaaaagatcgtgtgaaggtattagtccactttacacccttcaactat

SEQ ID NO: 103741 - DNA, 504 bp, Oryza sativa
tttaaataaaatgaaactaaaagatgctttaggacgtgttgagtatatggaagatgttgtaaaaaacaatgaagtgctttctttccccaaatgtcgtaaaagcaaaggtgtaatggtagattgtgaaaattgtgctaatttggaaaaagaggtttcttatttgaaaaattccttgctaagattttctgatggcgcattttttcttacagttttttcctcgtatgttttttttaaaaaaattaccgacgatggaaataatatttctcgcacgtttttatttttttatggaagatggaaaacctttttgagcatttttttgcactttttctgacttttttctcacgcatttttttgaactgtttttatttttctcgtgtattttctctttttaaatagttagattagattagagatagagaagagatatatactgattagaaatcggaatttgttttgccctttctatttttttctcgcgcgtattttttattttgtatgaactag

SEQ ID NO: 103742 - DNA, 686 bp, Oryza sativa
tgaattcaccctccactgttacgctcgcagaagaatcacaggcgctgctgtcaaaaaaaaaaagagaaaaagtcatagcgctgcgtgcgttgcgtcgacacgggcgcacggcctcgtcgtcgtcttcctcccggcgagacccatttttttttttactgctccccgcggccgcgatggatggagaaggacgagatgctgacgcgggcggcaggtggggcccaccaccgcgtgcagccacgtcgtcctctctgacgggtggggccctgggcccgtccggtccgacgtggcggggggtctccccgtaccctcgtgctcctgacctcggatgcctttttcccgcgcggctctcggccggtgctcgcgtccggagtccggacaccggacagcgcggcgctcgtgcgggatgccgccacgtggaggtgtgtcgtggtgtcgaacgtgtggtgtgtgttcggatctgtggtcatctggagaggttagcgaagcagttggatttgggattttggtgatcatttgatgatgggttcttcaatcttcaacggcgacgtgcggggtgtgagggcttgttccgtattgccctccgtttggagggggacctgcgggcgtgagccggtgacggcgatatgtcatgtgacgtgctcgtgcgctttctagagatataggaggcgtcatctgagattggacct

SEQ ID NO: 103743 - DNA, 662 bp, Oryza sativa
atgcttgcttcagtttaccaaatttctatagctaaggtgtggcatgccacaatttatgtggctaagaaattcttggccacaagttaggcaaatgttggcaaatgtatgtgcctatgataagtggggtcacaaaatcaaaaagtgtggcatgacaaagatgtggcaatcaagcaaacactaggctaaattggtcaaagtagcttgccaaagttgtggcaaagtatgatcaccatccaaacaacccctatgtatccgcctctctgcatctcgttggcaccacgacgggtgccatgccaattagggtgagattccgcttatccctactgaacggatacgggtttgacgcataacttcgagcgagccggcagcgactgcaggatcgccaggttcgtcaagaaatctgacctgcaggaacatgcaattcgccggattcggttcactggcaacgacagcttcaagatcgagtgttcgctgaccgtcataagcgagtctcgcgctgaagacgtgagcacgatcccagtcccgccgtcgaacctgcaccagcacctcgccgggatgttgcacggcgtcgagatcgcggatgtggagttcagcgtcggcggcgagccgttccgcgcccacacgtgcgtgcttgcggcgcgggtcgccgtgttcaaggcgga

SEQ ID NO: 103744 - DNA, 628 bp, Oryza sativa
tttctagcattgtccacatacatatagatattaatgaatcaaacacatacatatgtctagattcattaacatctaaatgaatatggggaatgctagaaaatcaaatcttacattgtgaaacagaggaagtacctaaatatcacatcagatatacctgaagaatgtaatcagatattactgaactacacttcttttcagccacaccatgcatgtaaacactagaaaaattatgcgactgtaaaatctgaataactaatgacggatcgacaagctttaaaatgaatcatgtcaacagaacttagtctgagaggctgcagtttgctagtagcatgaaatcaagaactaacttatctgacaagagggagtatcaaattaacaaatcagagaaggatgagcacatgcgtaacagcaacagtttcttaatttactcctacgtactaacagtacatggatagaaaacagttcataaacatctagcatcagttcctctgaaaaccagaaaaagaaggtctctatcacattgttgaactcataataaacgagtacaaaaccataaacctgacagggaaagatctaaacggattaaaagaaataatgaaaaaaacattcttacataaacaaacgagca

SEQ ID NO: 103745 - DNA, 671 bp, Oryza sativa
tgcttccatcgtccgtaaaaaaagtggacgaaaaaaagaaaaaaaccaaacatatccgattaaaaaaaccagaaaaagaaaaaccaaacgtaaaatagggggcaataaaaaaaaccagatcggtccgataaaaaaaccagaaaaagaaaaagaaaaagaaaaaccaaacgtaaaaaaaagggcgataaaaaagaaaaagaccagatcggtccaataaaaaaaaccggaaaaagaaaaagaaaaccaaatgtaaaaaaagggcgataaaaagaaaaaaaaaagatcggtccgataaaaaaatcccgggcgaaaaaaccgggaggaaaaaaatgggcgaaaaaaataatccaattccgtgaaaaacaaggcgaaaaaaataaaaaaaaaagaatcggtccgattctaaaaaaacgaaatcgggcgaaaaaaaacccgtgaaaaaaaatcaggcgaaaaaaagaatccgattttgtgtaaaaaagggcgaaaaaataaaaaaagttggatcattggggtgggggtggtggggggttccctgagagccggttaatgaaatagagaatattggagcattttttttgtcatgtcaaatacctttttcctttttggagagtagcatgttctatgtcaatgagacactggtaaagaagtagatagtaaattggttgttt

SEQ ID NO: 103746 - DNA, 674 bp, Oryza sativa
caaacttttatgatttatactatcaataactttaaaaatatttagtttaaagaaactagaacaatatatatagatttgtcttttaaagtactataataaaagtaaacatgcatttatttattatatatattatgatataaaaataagatcaaagatatatcttgtagaccgtgtcattgtccaaaacgtcaattaaaatgaaaccggagggagtatgttattttcatactgtcgactggaatgccctacgataatcggattgtccggttctatagttgttttctaccggtgttgcattgaccagactgtcctatagctgtaagataatccaactccagtataggctgtgtttagtttctgaaattggggagaagtttagggaaagttggtagtttggaaaaaaagtttagagtttatgtgagtaggaaagttttggatgtgatgtggtgtgatggaaagttgggagtttggagaaagtttgtgtaaactaaacaagaccatagttggactgtccggttagttctaattctgttaaaagttttttgaatttcaggaaacatctattctaccctctaggcgacaacaacaatactcaaggcccttttcgtgaatgtctgcctttttttttttttttttgcaggggaactgatactatagccgtgagctataaaagg

SEQ ID NO: 103747 - DNA, 663 bp, Oryza sativa
tatgcgttttaaccagtgagataacttatacgattgataaaaatcgaaaatagacaaataaaacaacagcaaataaagttagaaaccatgtatagcattgcgggttacacgtgcttcatgcatcatggaacgaacaatcccttatgtacacttttctataatctcacaaatcaatcaagtgtctattacataagttgacgcattttactatacctcgtcaatcaaatgttgaaattttgtttattcattagtaaacattcttttactctagatggaaaggtatttgcaatgtaacaaacttactacatttcacattttaaacaatgataaattcaaaaggaaaatatttatgagaagaggaatttcgaagagaaaaaaaaagaaaagagatgagattggaagtagagggagagggtcaggattagcgagagaaaaagaccgccggtcggagaaggtgcacgtggcgtcgattggagacgcatgggatggtatgggtcggtcgagttagggtgggagagagaaaagttgagctagttgaagtgggttggtttactcaacaaccggtggatttgaacgctataccaaaatcaactgatgatttcgtgttttttcaataactgcataataggtggtccctaaaagtatatactagttattttagac

SEQ ID NO: 103748 - DNA, 651 bp, Oryza sativa
tatgcggtatttcaaactctcgttgctcttaattgaatttggtataaatattagtcgatatagcggaacgataactaatcttcccgatcgcttcagtcattgaccacacaagacatgctaggtgacgacataagaacacacaatatttgttaacaaactttagctaaagtctacatctctagggttctgattatgggcaatcctccacaaccaatatagcacctagccgctacgagttcatggcctcgccgccatcctctccctgtgtgtctacactacattgcagtcctcataattacattatggtacccctctctatttaagagagttgccggttacagagccagagtccgactttaactctacccctaccatctattataactctaagtccaactataaccatatacacctattctaacataatcgatttgatttaaacatgcgcttgtttcatccaataaaagaagtgtcttttgtgctagattagatttgacaaacaaaatagcacaattgcatcctctttttgtcaattcttgcagtggcagacatgttgacttcatcggcttgccgtacggtctcacggagcgtgtgggagggcatcaccgggacgcacgacttcgaggtggtcggctaactcgtgatggacgg

SEQ ID NO: 103749 - DNA, 616 bp, Oryza sativa
  unsure (1)..(616): unsure at all n locations
tcataatgtattcatgctcttggattgggagacaacactagtgatactttaagacacttcttgctcttatggtggaaatcacgtgtctgattcttgattttggtaaagcactgtagtactaatacactacaactagaagcctagatcagtgtagcagcaatattattaatagatttcactgactaaaggtctgtttaggagtttaatattctaagaagtagttagttgatagctagtttctatgaatctggtttctagtttatcttctgaaatctacaactacatatttttatattctagacgaaatgttaaattgcttgggcaaacttttgattctgaaaaaaaagttatagctatcttaaagtcagtatagacgttaacaggtgactgcttgaaactgggcagtcggcgagatctaacatggaatgttccagaacccagcagggagagatgccgatccaccggaacggcgaaggcatacacggctctcgccatccatccgatgtccccatccatatctncccccaaccaagagcagccgtccgttgcaacgcccccttgcccactcactgacgcgccaggttttggccgttgcaaccccgcggcccccttcttt

SEQ ID NO: 103750 - DNA, 648 bp, Oryza sativa
  unsure (1)..(648): unsure at all n locations
agttaaattagcatgttggctcgagcttgcttttatttgctaggcttgactattgagggtcatatccgtgcttcatgtattgaggcttgatatttttaacattttctatttccttctttttgaaaaatagatttttgaatgacaaaatgttagtaccttctgtgaataaattcttgtctttttcatgccttctagtttttgtttttgtgatattttacacttcgagttgccacactgtttatctgttcttttaaacatctggagaatattctgcttcttttctcaacatacattatgataggcttgcaatgtatctctcattttatctgcctctaacttgacatggaatcgattggtggggctgtatttcattctgtattgtgttgtgtattcagcttggttgagattctatgtatacaatacttaaaaaacagtgttctgcttgcccttttccttgattgggtagtcttattagcatttttggccacttaactccattataagtctgttaagtgaaatcttgtctacatgtgtactattagcttggtggtttcgcctccataatcttatcaaactttagcatggttctgatgaacatgttcctggaatgctgagctatcctagntactctattctaaatgtcttcag

SEQ ID NO: 103751 - DNA, 565 bp, Oryza sativa
cggtccgtcatccgtgtttgagtcagttataaaaattaaagatgtttccgtggttcgtcatccatgtttgagtcagctttaattttatgttttggttttaatctatatctctatgtcatccgtatatgagtcgatttttaagttcgtttgcttttgaaaatacatatccgtatttgagttggttttaagatcgttcatttttggtaatacataaggaatcatataagagatctatttaaaaaaaaaactcccatgctaacttgagatgatcgaactcctaactgcagctcatgattttctaaaaaaaatatatatccaagcgaactcccacaacgaatttcattttaactaaaccatataacaataataagattaaaataaacttcacccattgcaacgcacgggcattttttctagtaccataaaaataaaacaaaaaaatacattatcaaaatatattcaatgctagatttaatgaagctaatttgatattttagatgtgtataaaattttatataaacttaatcaaatttaacaaagtttaactagaaaaaaatcaaatgac

SEQ ID NO: 103752 - DNA, 583 bp, Oryza sativa
aatggttaaacatgtactaaaaagtcaacggtgtcaaacattttgaaacggaaggagtatgacacattctaatacatgaatctgtatagagagcccgtctagattcatagtgctaggatatgtcacatctcttatattatagaacggcgggaataagtcttactctcctattgtttcacatatcagtgtctctaatgatattgttattatgggaaaggacccgatatgatcaacgacgttcgctcgttcttcaccgacgcagtttttgtcagccatccatttttttcgacggggacggcggaacgacgccgacaagtcatcagtcatctagttgcagcgtgcaaacgacgtacgcccgccgggctgaactgaaactccggcccgcttacgcaagggttagttgacctgggatgaactggctccatcatccatgcatattcgcgattccgtagcggagttggtcggatgaattgcgtgtatattcagacgattcacgcacaggatgatggaggtgtttcgcccaacgctctcgtaggtcaagtccgttgggagcttttccatttgcgtaacgacagtgaaactg

SEQ ID NO: 103753 - DNA, 615 bp, Oryza sativa
tcctacacagatgcacaacaaataattttccatgtttatggcatgtgactagtcaaagtcctaacatactagcagccacctagcaaagcaaaacatttctagtatgatctccctatagtcaaacaaagcccttggagccactgacagtgggctccacttcacaaatacaaactccctggattaaataagcaccaccttaaatacgtgtccatcaacaatcaaaaccaaccaacacgctgttcaactccagaacctcactaagtttctggcaaggtctaatcttaaaataaattttcttaatgggtcaatttatcaaaattgctgccagaaccttctctattagctctccacaaccacacaaagcttcgcgccacgacgctctctcgcctctctgctgctttagcgttcgcgcgcgcgcgctgcggctggctggctggaccaagctaatagctatggacaccgtcgtggcggccgcgacgacgggatcgagacggtggctgccgtgggcgcggcggcaggcggcggcgtacctggcggcggccggggaaggcgacaacgggtgggcggcgtgcgcggcgtcggcggtgcggatcgtggtgtgcttcgtgtccatga

SEQ ID NO: 103754 - DNA, 669 bp, Oryza sativa
  unsure (1)..(669): unsure at all n locations
gacttggtatatgtggtgctaatgtgcactatgtagagatgtagcaaagtgacagtgtgacacgacaccagtagaaagtgatcggtgtgtgttcctattttaattaatatatttcgatgtgatcttttaatttcacttcgttttttcaaatttcctctttctgttccactgaatcgagtagaaagaattattttctctctgctccaataaatgttcgatgataagatgaactgtattccgtgactatgataagaatgtgttttccaggtaataagaatcatatctcaattttctatttagtgagaaacttaattactacaacaatagctaagcattagattgatactagttttcctaatgtatagttggagggccactagttgtcatgaagattaatcaaagagcagtggtagtgtagagacccattccaatatattaaaaaattatacagtcttggtacattactcccttcgtcttagaatataagcatttttagtatagggatagatcaaacattttcaactctaactattaatagaaaaaaatatcactcatataaaaatgatgttactagatgtatcattaaacaaattattataatatataacctttttatttaaaacatactacttttatagatattggtagntaaaagtacatctcggaaat

SEQ ID NO: 103755 - DNA, 677 bp, Oryza sativa
cgagcagggtactgaacatgtgaatccacaaccgttatctgctggggtacctattaaatcaggtcaacctgtattggcatcatgcaaggaagtcgctggagggaaaactgtcaatgagattcaaacagtctctgaatcttcaaagcacactgaagagtcatcaggtatgttcgttggaggaatgcaatttgatctactttgaataatatattacctctggatagaaataaagcttaaataatagatcacattttttgtgtcattataggggaaaggcatctgcttaatgttccagtaatggatgctataaaggaatctttgggtaagatttagatgttgtatgctcgattcatgtgtgtcacacacaagtagattcagttattttattttggggcatgacaaattcagcacgctcgttgtcaagatagcatctgtacaacactatatatgccccttctgccctcgatgacttattttctatcaagaacaatcactaaatggatttgtatctttaggtcccaaagagcagcctaatgctacaaatagcaagcaacaaacttttatgggaccaccgggtaatacataattccattatttgacatgcttagtattaaccctctatgttaatgctgtgatatgaatatttagaaagcacagaacaagctgtgcagctgaca

SEQ ID NO: 103756 - DNA, 672 bp, Oryza sativa
ctgaagtggattgaggagaactccagtggacaaccaaccaaattttgactccctagacctgattacttcatttttgatgtggaccacttcacttgtttaatctgccttgctgatgagcacagagccggtggctatttataagtgtatgtatgactaaagagtaagctagctagctatctgtctcctgtggactgtggtgtgtgtgtgtgcatatggtcgtccttgcaatgcggttggcatatattggatgaacttggcaacggatgcacctagccgtgatgcagactaagttagaagatggagtgtagtgaggagaatccaatgtgatctttgggctgcactgatctccgaatcgtagaaagcatgcatatgtggagcaaaaaagtgcccagccctgcaaatttcttatcaccagcagagcactgtgtcgtcgcccggtttctgtccacgcacatttctttcacctcaacaaagatggagagaaatcgtcctgaccattgacttgctgcaaatgcgtgcaaattgcaagccccgggaggaaacatgtgtatgtaagaatggatcacgagtaatttgcttaagttgtactaggcttccgagcacgtcattgcgttcgtcggtgcgttgcggtggttcctggtcttttctgatgtaatcggttgcaatatgccc

SEQ ID NO: 103757 - DNA, 642 bp, Oryza sativa
acttcagtcttcagatacacacaaagcctgaaatgaaccaaccgaccggaacaaattctactcctagaaagtagaaaccaatcaaaggaacggaacaaaacgcctcgaccacgcatggcctcatcttctaaagcggcatggcctctcagtggtagcaccaattaaatcagaacccggagaacacgaacaaggaggaggccaaaaccgacacagccgcacccaaacagctccagagacgcacctgcgcgaagccagtggcggccgtcgccgggcggacgacgagcaccggccggctccgggagcagagcgggctatgcgccatctccattgccagcgccaaaacctccctcctctccccctgatcccctcctcctccctccctctccctctccctcctcagagctgactcccttcccttctttttcttttctggtttccaaaaactcgcatcgaaatgcgcagctgtgtgctgtccggagacacacacacgcgcgcacgctcgatcgaaggagaaagaaaggctcccgtgctttcccgtgaaaatttcgcgatctttttcttttttattttctgcggcgagagggaggaattgtgcgggatttgtgtggacggtgtaaggtgcccaggtggttgggcccttaa

SEQ ID NO: 103758 - DNA, 639 bp, Oryza sativa
tttatccaattttcaagacttagcagatgggagtgtggaatatgtgaaagaagattttgctagtttttctaaggaaaagctacaccttgctgatagttttgttttaaatcttctgagtaatctatatggccttgtattattagctggtagttttggagctaactactctaataatgatgatcaatcccttgagtcactgtttggccctccgaagctactgcttgagagaatactactgttgttcaaggagaagtttggactctgcatggagaaaaagaactttggactgtttttgccaaatttttacatgttccgtacactggcaaaatttgtatcttctgtcagactcctggaacttgcaaactggatgttctcaacggttgaaaggttcagttccagttcacctgcatatgctcccgctgcattttggtgtctatacactgccgatattggcttcgaaatgctatatgactatttacaacaaaatgatcagagatcaggaccctgtcgattatggggcttggggaatcatattgtgatattgccaccattcagcaagttataatatcattcttcattttgctactaaaatgaatctttgaattgctgatctttgcttgctgagatgtaaatcgtatc

SEQ ID NO: 103759 - DNA, 676 bp, Oryza sativa
ctaaactattgagaatagatcactcgttatttacatctcatctaaatggttataaattttttttaaaaaaaatcaataaaataaattaatatatgatcaatcactccataaacatgcaataccaaaattaacttctacagattgtaatggaaaaaaaacaaaatttaactatgaatatacgttaactatttatagcttaattttttttaacatgtaatggttgaattttaacttgcatgcttatggaatgatctatcacatattaatctatttagttaaatttttttaatttttttcataataatttggatgatatgcaaataacgaaagaatgcctgatcctaagaatttagaatccactctagtgtgtatactgtagtgtagcgcccacttttttctttcttactatgcttctatatttgcaatggtattactaattactccctccattccattttaatcatcccctaaggtttttaggtcttgacattactaattactccttccattccattttaatcatcccctaaggtttttattgaccattgacaccatttaaattcaaagaacgacgagtcaatatttatttccttattaattacaacaagtagtacgggtactaaggaacaacgttacgtcatgggagtctattgacgctattcaatcaaagaacgac

SEQ ID NO: 103760 - DNA, 1036 bp, Oryza sativa
tgaacccatctctatcatgatatcatcctggccctaatgcccacctctaccgtcagacagatctcctcggttccatggcaatgatatcctcttatcccctaggtccctcaatgccaccccctaggaggtgttgagaaaattaaggggagagagactggagggagggagaggaaaaaaggttctactatttttctttatttttgttcgagagacttatacgagggtttcatctaactttttttattgaaaactaaaaaactggatcaatataatattgtcgagtgattttatttgcaccgttttaaaaatttagaggataacatatatatggttttacagttgagagatgtgaattaaattcgaccatagttgaaggatttgaaatacactttttccttaagttcacgaggagtgtcaacgatgacctggctcggcccagctcgatccattcagcagcaattctaggcccactctcttattctctatgctgactgcagtgctctatccttttcgctagtcaggcctcgttcggatgggccacactcccagaccatttatgtatgagagaattccttatatgccactctaaattaaccggttttcttatatgccactttaaattgacttctcccttttatgccatcggttcaagtttctcctcccttttatgctattgccgtcagtccaccgtcagttgaccgttaacttcattgtaaaaagacgcaattgcccttaagaattagtatacaaccaataataggtattttagtactaatataactactggatacaacatatgaaaattgatttttttctgcatcacatgcaattttagccattaccatcacaaataaattttcaatgtaagcatgaatcatgcagttttccaacaatatttttaatataaagagcatttttcactagttctgacaaaattttgttcactcaaaaaagatttaaaataaattagttatgattttttgaagtttacacattttttagttgagagggcatattggtcatttacgaaaaaaaa

SEQ ID NO: 103761 - DNA, 672 bp, Oryza sativa
acaatgtgtgacagtctattagatgcttcaactcctaagccctctctttcaaaacctttggccttgtaacacggcaagaaagccaaccatgcatcaatctctgcaatgttctgatcaaaagcgccagaactcgccacagcagctttaactaaaatatatgctttatcacggatgctcttaacttgcgaatgcaacataatgtcaatcagaggttgcaaatacttgtacatagattctggaactttttctgggcaccaatatccatcagattgacctgaatactcaactaaaagagataaaagggactgctgttcatccatggacagatccaaaggattaggcggcataaccttgaagaagtcaaatgatccatcaaaagagctaggcattaccctctgaaaagaaattgaagttaaaagttagaataccaaaagagtagattgtgaacgaaacttaatatatgcatttgaatatcaaaacattaaaatcataaattgtgaaggaacattatcgatttccttttgctagtcacagaaaacaaaaggagacagagcaggaatggagggattaattaattcgagcaatgaaataagccaatatagatgaagtggagggaatttaactgtcctaccagatagaacctgagaacatcaagcaacttgagtggaaaca

SEQ ID NO: 103762 - DNA, 841 bp, Oryza sativa
attccactttcattctgttagctgaaagactaagagaatgcaacagttctgccatattatttttcttttgtagtgtgaggccgtggaacataaataggtcttcaaattaatgagacaagataagaacatgagtgaagaaatttgatttcaggccaatctgcaaattacacatggcaatattaggccgtctaaagaccttcctgagtcctgacattgactagagaacgataataccctaacagtatagtcacaagacaatcatttgtgggctttctatgagttcttatgagctaaagaccagaacaaaaataaatgcacaaaaaacagtaggcaccattatactataagcattcaatcaccacatcagtattgttcatgggtttaaccacatcaggtggccaaattcgaaagcactaacagactgaaacttgagatttgttcaaggtatcaccatacttgcagacagtaattgcaagcatcatgctaacatgactaattaactaagatgtgatataaactgagaagaaaataatgtcattaattacaaaaggcggataggcattaagcagctcctactagggaaatactcgaaggattgcgacatttgcacttcaacagaaaaacttttagcaattatgccaagatgtaaatgattcaacagcaacacaccatggaaatcaatgtcgaccagaccaattcataaatggatcagtaatatcagttgataatatgtaaaacccccctgcttactaaagcgatcaactataaacttaacaagatgcaaaagaaggaaacccaataaagaagcgaagtagaacgtaccatccgttcttaattgtct

SEQ ID NO: 103763 - DNA, 563 bp, Oryza sativa
aataagaaacggaaatgcctagaaagataagtaagcacaaaaattcaagaaagtagggtcagtggttccctcacctcgcatgaatctctcctcgtcggtgaaatcctcgatctcatcctcaaagctcccaatatcccccaagacggccttcgagctcaccaccggagaagcctccatcgtagccggcgctggtgtcctatgaggaggtggtgttggcgcttgagatggcggcgcggggcctctccgcagccgcttgaatcgattcatctctggcggcggcggcgccgggtcggggacaacagtttcgtgccgccgttgctgttgctgttggccgtcggcgaggacgaagtcgtcgtcctcctcctcgacagtcccgagctcgtgacggctgccgccgatgagaacatcgtcttcgtcgtcatcgaacccgagggagaaggagggtgcatcgggcgcctcgtagcgcggagcttggcggcttgcgttggggaggcggggttcgtcgtcgccgtcgccgaagtcgatgccgagggagaaagaggcgcgtcgggcgcctcgtaacg

SEQ ID NO: 103764 - DNA, 649 bp, Oryza sativa
aaaatcagtgtatataccaaacaaattgaagcacacaaattcagtgtatctaagttcagagtatgtatgcgcaaaaaaagtcagtgcacataccaaaaattggcatctacccaaaaatcagtgtatataccaaacaaattgaagcacacgagtttgtgtaaaatcagtatatacactcaactttactagtcttgaaacatgcgtgctcagagtttagtgcttgggaaaaatgtagctagtgtagtatatactgatgtgtccttttagcaagaaatatatctatctttactattataaaaattgaaaatgtttttgctgaattttttgtacatccgtatttgaatcggttttcggttttaattgaatatattttattgtcccatctatttttttcgacggttttttaaatctccgattgggcttctttttttttatccatccggttttttcatcatcgcatgtttccactcaatccgatacgatcgcccctttttaccgctctcagggcccgggcccaaaccctagcaccgccgcgatatcgatttgtctccccgcacgtttcatcgtattattgattgtaaaaatcgattccccactcctaactcattatttttcctatgatttcttcctttaaatctccaattgaaga

SEQ ID NO: 103765 - DNA, 642 bp, Oryza sativa
ctaaaattgagcttaaatttgaatttgagggaattttgcgagggcatttggaaaagattttgaactttaaattgggtttgacctatgtctttggagattgactcaaaagagttaaattggtgatatccggaccaaaacttggacaaacctaggacagagataagcctttcttttcaagagagaagattaagatttactcttgagaagatccgtggataatacaaaaagtcaaatatactccctgtcccataaaaaccaacctagtattgaatgtgccttgattcgttgtattaaaatatatcacatctagttttagattcactttttttttatggagggagtacgtaggtagtgccaagataaagggtttaattttagcatgcataacatgtatgcttgtatcaggaaatcatggtctcattatcaggaattttttcctcgcaggctataccaacaggtgcatggcatcacatggtgtaagttgaacaaaatgctttcaattacccaaaatagatgcacagaacaacccactacgcccccataacagcaacccaaacccccccccaaattctggtacttagccggaaagatgctaccagtaagaaggtaagtttgtgatgggggaaattaagtgaagcttga

SEQ ID NO: 103766 - DNA, 652 bp, Oryza sativa
aatatgagcatatggcaatcagaacatgattaatgccttatttagctgataaggcttaataattaatacgatatacactgcgtccaattggactggtcttccgcgcgaagccgcggttactttctagttcaatatagtacttgtagtaatacattataggcgcattcactatcagcaaatacagtttcatcacatagagtttcatcacatacattataggcgcagtcactgtcagcaaatacagtttcatcacatagagtaacattatcatttactggtctctgggagacgcagtaaatacagtttcatcacatagagtcatcgaaatgaaaactttgacagctttaaaaccgaaactttgtgcagccaatcatgtgattttcagattcgaagacggaatcttcaagttccatcaccttcgtatgaatccgtaactgctaacggactacacaaaccgaggcggcggatggggaggtttgatcacgccggcggcgaagggcagcacggaggtaaggggggcggagtcgggaaagagaactccgaaaccccattattgggccgatcgacgagttcccgaatgggccgcatgtaatggcctgttagaaaagtaaacgtgagatgcacgtaagggaacagtatcatggcccacgtg

SEQ ID NO: 103767 - DNA, 724 bp, Oryza sativa
agtaatattatttacaaaatttatatatctctctcatagtttataaactatataagagatatgtacattttgtgaacaatgttacaattcgctttgtcggatgaaaaaatgacccaaataaaagttatatatcttgatgagttataccacttgttattgatgacttttttaagtggaaatcatgtagtatttgaaaatattgtttgaagttgtcataatttgaaattcaaattcatattgttcaaaccaagtcatatagaaaaatgaccaaaacaaaagttgtaaatattgatgagttgtacaactttgttgttgatgaccttttcatttgaaataatttattatttgaaaatattgtttgaagttgttataatttaaaattcaaattcaaaattttgaaacaaagtcatatagcaaaacgacccaaacaaaagttgtagatctcattaagttatataactttgtttttaacaattttttcacataagtttatttaatatgataaaattcgatttgcagttttaatattttgaaattaattgagaggagggaggaaaaacagacgctgggccggcggcccgaaggagcagctggcgccaaactttcagtgtggcaggatgttgatcaaaatttcaatgtgaaatgaccattttgtccagatattttagtggtaacttcggatgcaccatgggtattttagtaaaatagccaatccaaatcagat

SEQ ID NO: 103768 - DNA, 1037 bp, Oryza sativa
atttcaaaacattaaaactccgagtcgaattttaacttttgtgaaaaagttatcaaaaacaaagatgtataacttaatgagatctatcagattaaatatggtaaattctccatccgagtttgaataacctatataaatttggtatataatatataaaatacttcgtcggatgaatcgatgaccaaaatatatgttatagatattgatgttttaaacaactttgttattcatgtctttttcagttgcaatcatttagtatttgaaactattgttcgaagttgtcataatttgaaattcaaattcaaattattgaaatgaagtcatatagcaaaatgaccaaaaaaaaagttgtagatcttgataagttatacaactttgttgttgacaatttttttcatttcaaattatttactacccgaaaaattatttgatttttcttatattttaaaattcaaattttatataggttaatcaaactcggatggagaaataaccataataaatttgatagatctcattaagttatacaactttgtttttgataactttttcacaaaagttaaaattcgactcggagttttaatgttttgaaattaattaagaggagggaggcaaaatggacttctcggcgagagaggagtaaatgggcaaggccggcagcccgaagaaggaggaggggatggggaagccggcccaaggatcaggagagaggctgcgggctgagggagagggagagtaacacttgggccgaaaaggcacaaggatagggagagggattttaatttgttttctatttattttaataggttaaatgaactttgtggtattaaaactagttattgagctctaaaaattcacagaaaattttagagaataatttagaccacttagaattttacaaaaatatttctggccatgatttttaaaggaaaattttagtaaggtgatggatttaagtggaaataatattaatattcagtccactttggattctatggtaccttctcctaatactattaataatggtaagagggtac

SEQ ID NO: 103769 - DNA, 604 bp, Oryza sativa
ataaattagagaaaacattagaaattcttaaaaaaattcaattaaagcggtgaacccattattctaagtcattagattaaatctattaaaagattgcatcccacctaaccttccaccaaataaaaaaacggttttactatatttctgtcaccggaattctggctccatagcagtcagttttgtggccactggatacgctataagtttcgtgtcaagttaaatccattgtgctcataccatcgctgcccgctgttttgctgcgttcacacttacatgtatgtgactgctggggtagttatttatatatttacaaatttacacagtagttacaccccacttacatatgtattaggatgtaattttgggatttacatatgtaattttaggacttacatatgtaattttggtatttacattgtcaatacactaaaattacatatgtaatttagagacttataatgtaaatacatgtcgagtattttttataaaaaatatgacgccataaatataactactcccataaaaaaatagaagaagaagcagataaggatgagcgagggaaagagagagagcaaattgataagatctccagaacgacgcgact

SEQ ID NO: 103770 - DNA, 581 bp, Oryza sativa
atttcgaatttcaattacttctaaattgtattcctatattgactttaaactcttcttcccatgttttttcttaattttgaattttagttatttataaattgtatttttatacggactctaaactctatttttaattttattatgtttattccaaattttagttgttttaaattcttatatggactctgtactctacttctaatattccttgttttttaattctgaatttctatatttttcttaattgtatttctatctggactctatactctacttctaatattccttatttttaattccgaatttctattatttcctaattgtatttctatacggactatatactctacttctaatattccttatttttagttctgaaattatattatttcctaattgtatttctatatggactctatactctacttctaatattccttatgtttaattctgaatttaagttattttctaattgaatttctgtatttctatatggactctatactctacttctgatattccttatttttaattccgaatttcagttattttctaattgtatttctatatggactctatac

SEQ ID NO: 103771 - DNA, 996 bp, Oryza sativa
gtcaataattacatactaagtctaattacaaataaagtaatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatctatgctaagtgtttcgtgcgtatatgctaagtctaattaagactacaatagtcaattgctacttgtcgcaccaattccgtagtcaataattatacatactaagtctaattacaaataaagtaatcttatattaaaactcaaataatattagaacactacacaatcttatatgataagtccaattacaggtctaataatcttaattaattgcattacaaatataacaatcatttatattattacgtcacttgcctgctccaattccttctagggctagctcttccactcaggcttgacagacgactccgacaacacgtcttttctgcaagatacaaaaagatgtattaggataaatgcgaagtaacatatatatatatatatatatatatatatattgcatttcacgttaacgttcgtcctcgttcgttcgctcgttcacgttcgttcgctcgttctcattcacgttcgttcgcttgttctcattcacgttcgttccctcgttctcgcttgtcttcgatcgatcattctcgttctcgctctcgttcgttcgatcgttctcgttctcgttcacgttctcgcggcaacgtacgttgacgtgttcgttctcgctctcgttcgttcgatcgttctcgttctcgttcgttaacggtggtgtggcggcatcggggcggtggttggcgcggcggcgtggcggcggcggcggcgtggcgttgcggggccgtggcggcggc

SEQ ID NO: 103772 - DNA, 512 bp, Oryza sativa
ccattgacggagcagcacgtcaccgggctgctgctgatctccatgggcatcgtgctgaagctcctgctggagaacaaggagaacgtcccgcgcaggcaggtgaggaagacggtgcagcattgggacgacaagcagcgggagatcagagaagtagaagaggagaaagctcccttggtatgaccatttttttagttggcccaagcaaaggctgaacgaatcacaatacaccaattgcaggacaggatagaaaatgctcaaaaaagagtaacaacccctctccctctgtctctctcatgtaatgttttgctgttgtgagattgttttgtgggtctatgccaaaggattcgattgacgataattacagattaatttggttggaggtgatatcgcatcactgccagttcttcattgtttctcgacaattttgcactcaagtaacgtcgacaggatacccggaaaaaaaaagagaaaaggaaaaacgagtgacgtcacagaccacaaatgtgtgacgt

SEQ ID NO: 103773 - DNA, 561 bp, Oryza sativa
ctatagggcgaattcgagctcggtacccaatcaagtcataataaaataaattataactacataaatttttttgaataagacgaaaggtcaaacgtttgtcaaaaagtcaacggcatcgcacattaaaatacgaaaggagtatttgttattttaattaaaatataaaattacagtcctatataactaaaattacatttgtaaattccgtcgatatgacatgtaagtgcactgtaattttgataaaaaatattgtgtaagtaaatatgtatttgttattttctttaaaatataaaattacagtcctatatagctaaaattacatttataaattcagttgatatgatatgtaagtacactgtaattttgataaaaataccgtgtaagtaaatatatatttgttattttcttttttagctcgttggatgtaaatctaagggtagaaaaaatttgggtgatttttttgctagaaattacccgacaaatggataggcaatcccgaaaatatttgacgcagagttgcaaacacatatccaccaaaatactaattgaatgttggatgtg

SEQ ID NO: 103774 - DNA, 627 bp, Oryza sativa
tttgaggagtacactgtggagcctccgaaaatgtgcgagacgtggaggtcagagtctggatatgctgagtccgattcctgaggagtcgcctccgcatccttctcgaccactcgtactcgcttgcctttttccaacgccatgtgcttctcgagcgactttttgaaaacaaggcaatcttccaaagaatgtctgtccgtcttgtgtatggggcaccatgctttctttgcgtcgctaccttgtgggtctgggcgcttgggtgggttcgcgtattctgctgcgagaatttccgcttgagctttccttttcccactcttgcgatttttcttcttgcttgactcaggtgcgtccgtggctggtttcttttctccccggttttcagcttgttgttcttgcatctcagcgcatcgtctacgtgggtgcatcgctcaacgatctcgaataatctccgagtagttgtgatgcgtcttgtcgccaactcctgggtagtatagcgatctcggacaccggacttgaaggcgcgaattacagaagcgtcggtgatttcggggattgtatttctgcactcggtaaagcgccggacatattccctccaggatccaccttaggtctgggtcaacgcatgtaggt

SEQ ID NO: 103775 - DNA, 626 bp, Oryza sativa
ttaatgtgtctggggtaagatagaatgatcgctttaaaaaaatgattcctctagatccaggttagcttcatacctcaaaaattgatggaccaatccaacctgtttcatttctctcgttgacatgtgaaccacactcccattcctaaaacattggaagcattccgtcacttatcccaaacaagtagatgaggccattccatcaaaacacaaggaatgaattcaatacattctatcttatccctaaaccaaatgcttaattgataaactaacttcttgtttgcaattcgacaacttagtttaggtgttttgtcgatacaataaacatcttacgtatttactagcttggtggttgctttctcgataaatggcccaattatctcgatataatagggggaatagtggcattgctagcagagaaacaataggacctacttgaaagactttttttcgtctcgtaaatccaaattaggtaggtttcgcgttgtctctgtttaagttttctctgataagttttcatgtgtatacaaacagattaggtagttttcccgttgtctttgatttgaaaaagttgtaatcgtgttaaatccaaatggacaccggcagaaagctgatgccaggaatggaaa

SEQ ID NO: 103776 - DNA, 512 bp, Oryza sativa
catcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttatttgggagtatcccataagggataatcattcaaatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacaatgcatcttaaaaggtgtcaaacagtaaa

SEQ ID NO: 103777 - DNA, 678 bp, Oryza sativa
ctatagggcgaattcgagctcggtacccaacacgatcgattaatgataagaaatgccgtcattgcatatatatatatatatatatatatatatatatatatatatatatatatcagctgtgccagcttgcatgtgttatccgactgaaaaacttcctaaactatttcaatccgggtggtcaaaaactgtcaacacaaactcaagtaacaggtcgagattatgaggtatgcagtgcagcgtcagagatgggccggtgcccgtgccgaagatacgtaggtagtagtaacgtacaaggaacagtccaaaaaaaaaatgtacgcggagaacggcgtaccaactgcctagccagtagccactcgatggtgccaactggtcgatctcatttcagatgagagttgagagaggtccaggctattgaggatgctatacacacaatccaaacagcttgcattgcttgaatccgatcgagccgtgccagagccgccgcgaggaccaccccccaccccagaatccgtcgcgattccccggccgtatacgaaatccaatcattcgggggagaaggcgaccgatgatcaaccagacaaaattccagcgccggatggacaaaaggcgtgcaaaacgccggggccgcgcgcgccgcgcgttgttggatggatggacgccacacagtgaaacaca

SEQ ID NO: 103778 - DNA, 788 bp, Oryza sativa
  unsure (1)..(788): unsure at all n locations
gtggactgatggaatgcactaccgcagnaccncatcaagctggactgggctctctccccctgcctacggggaagtatccggtgcaatcacctaattcggtgcaactatgcaattctcatcctacaccggtgggggggggaggggaaatacctgcacagctgcaccttaacatcatcttccatgtttctctgactccatacatggaaatcattctccttcttatcatactctatctcctacagcacacgttatgatctccttgttagctcgtcctttattattgacgcctatgttatatcacatctcagactgacataactacaacactaatcctcggccctactccactctaccgcctatctctatttttttcaccttcatacgtaactcttctcaccacacctttgattagccccttctttcacttctattcctgacttttcaacaacccccgcttaccctgtgcatatctaatcccctctttctccctcttctacatatcttaactttactccgttctcactctcgattattctcactttgctccattgtcctccattgtcttgtttcttccctgaaactcccttatcctactcctatctcctacatctacgcgcttttgttattacgaattcctgacccattttactttatgtcaagccctcctctccacgattgtgtctttttataactgatccctttccagaacagtcataatcccttctcttatcttcacgtgccacaccatctcttcccttacgtctctatcactctccacacgccgttcg

SEQ ID NO: 103779 - DNA, 2887 bp, Oryza sativa
tgtagatcttgccttgaagcctcttcacagttgatagcatcacctgcgaggtatcagccttgcccctcatcattctttgagaatcataaggacccattccggtagtgcgaaaatctgctgcactgtcttcactgccaagctctagtaatagaaaatcaaatcaactatctaatcgagcatcaatcctaggaattttctcctcacggagagagatcagaaagcttggcaccggattccgaagtaccagtaccgaagaaagcaaaagctttcgagcgagcagcgactccaatgtttggtaaagggaatgaccctagatactcagtggctggaaaaacacatccatttgctcgatttaacgaaaaagcgcacaagtcacgctcgcctgttagaagtgattttaggaggaagttggattggtattttctactggatttgtgcctatagaccaaggataaagtctctctcgcatagccggaaaagtaagtacatagtgtagagggaaagaaatagaatctcgtgtcgacttggaaatcaatagtaaatcacaggcagtatgccctattttaaaacatgcaatgagggtacgagcaacactccccaaacttggcatgactcatcgccatcttgtattcatgatcttacctcgccttggtcacaaatgcatagcataggatcgagtggatcggcacccaataggccagattttcctatctttgatggtggaagaagaattgcgataaatattttcttatgttccacactccttacactacttggaaagattactccaccatgtatttcacgggtcaagctaaaatgtggttacaatctgtagaaaataaggtagagagtatgaattgggatgagttctgtgactttgtgtgtcttaggtttggtaaaagatgcagtatcaggcactgatccggcgcttaactcatgtgaagcagactggatcggttcaggactacattgagaatttcaagaccctaatgcaccaaatgctagcacacaacctcaacattgatcctgaaatattcactactacttttgttttgtggatgggttaaaataagaaattaggagagtagtgcttattcaacgccctgccgacttggatactgctggctctcttgcattacgtgatagaaatgaaatgacagcagccctcgctgaataccgttcaatatccgttattagacaaatcaagactttgagtgtatcggtatcgataagttcccgtcccgatatccctgggttccttactattaatggacaagttggtaacattcaattgagaggacaagttggtagacgcatcccactctctttgggaaaagcaggattctagcttgctcccttaagtctaagaaaaaagacaagccctccgaaagtaaaatgagctgactagaccagtaaccatatcttatcggtcatcctattgttgatgaatcaaagcgagatcagattgctcttgatgacgagggttgaagaggctttctattgatccacctactttcaactgaacagtagttagttaaggagtgccgggtttgcttgataagggattcttgttttgactgctacattaagggcaacgcaactacctctcctgctttcaattgctaaggcagtagagatctgtttaagcgagtgctatgatggttgtccaactctagaccttacgacaaagaaagagccagaaaccatgttttctcgacttctaatgagcgctttctagcagaactatctatcaaggcgggagaacgtagtatctgccatttctgtagcgccctgaccttacctcgaaaccagctacctcttatagctacctaacctaatccctagtacaccatctatctctgcatccgggctcgcctccactcttgttccgggttgatgaatccaactcaagaaaccatacctacttcctgctttcgaaagtgcttgctttcccttcgagggtggcctccactcgggctagacctcgttccggtcttaccctccctcgagtccgatctcgggagggcgcttgggcagggcctattcccaggtgcttgatgacctataccactaatcacaactactttacttattcgtcaaaaacctattccccaccaaccaagattattattcacgcacctacgatccctttcttaaagaaaagaattattactaccttcacatggagtgaaagggacgcagttcagaaagcaggcaagaaacgccttcctacatctgcgccccgctaaaagctatcgcaccaggtagaacagagacactcgacaaaagacgagcagcagcccgtgactgctgcctctgttccctctcgtactcgatcttctggcgttctccctggatccagggatgacgggatcgatggaacccggggtgggttcaaaatggcagggacttgcactgcaggagcaaggggtgcatccgcgggttgagcctgatcccctgctggatttggtaaaacattctctccgtcatctaaaaaaacagtctctaaacaaaatttataggtaaacaaaaataaaaaaaaatgaaaatccaattcgttgggggaacgggttccacgatgaatcatccccctattaagaaaccaaagtaataataatgatacgaaaatcaaaaggagaaggaaaaaacagaaaggcaattctaggacgctgggaaaatgaaaaaagattttcccgaaaaaccgtgaaataaatagtacaaaaaggtgattcatcttacaactttacaaattcgcttgatcgggcctgacctggtcgaccagatcaaactatttcacttatgatctggcctggttgacccaatcatgatattgaaggatgggaccttttctcaaaggttggaaagttccattcgtttagtacgagat

SEQ ID NO: 103780 - DNA, 877 bp, Oryza sativa
attgatgaactgtaaagcctgcaactgctttcgcaaaaatactgtagtctgcacgactgccggaaattgactttgatgctgccgagagttcctgttctttgatcataacaacttcgccttcatatgttcggtaaagatgttccgttgaaaagtgtcataccctgattttcgtcttaggatttataaattatttaataaattattaatagaatttatattaaatgttcattaatttacaagtgaagttaaatgtgggaaataaaatttcctaaatataaagcatggatggatttaatttttattaaattctccatggttaattatactctctggaattttctcggatttttcggagctcaattattaatttttaatcatacaaagagcatttcagtaattatccacatattaaattaatcattaaatggtctaattataattttgttaagtacttttagtgtccaagtattttcaagatttttcttggaattatttgagcattggaagtatttttaacaattgaaagatcatttaagtgattattttaattggaaaaagtttttaaatccttccctaagtcgttgggccgatttcggcccaactctttctctctccgcgcagccaaaccggcccaatcggcccagctgcagccgcccgccccctcctctctctctgtcaaagtctagtttgcctccctgctacagtgtcgtccctaacctccagccggctgcctagctgagcccgagccgcgcgccgcgtcgcctttccgcctccaaatccgctccaatccgaccccgtttcttccggatttttgaggggttttgatcctctcgttctcctctatcttttcccccaagaatcggagcaaatcgttggg

SEQ ID NO: 103781 - DNA, 632 bp, Oryza sativa
accaaattttatttatgtgatataaaattattgcctgaagaaagcatttttgaatacaattataataacaacagttttgtggaagataatatgtgcaataatcgtgggttagatcttgttctaataaaactaggtgggcgacccgcgcatttgcactgctagcatcaatttaaaattatctatttttatacatgattttattttaaattatcattcccgtggttctaataattttatagtttttaaaagccacgccagtcgctatcccttactcctttgtcatctttttatttgcttactcgatctaccactacttctattcatcctctttagaacttaaaaaattaggccttatagtttttagagttcattgtctttgttgggtttcgttttcatatataattctttgaagtatcgtcaaacattaccaatttactactctacagcccgtccgctatcatctctctttattatcattgggattttaataatcgaacataattattgtttgtgttcttttaaatttctataagtctccataatcgttagtggcttcgccactatacttctctgcagtccacccgctgcctcctctccttattgtcattgagatttcaaaaattgaacatgat

SEQ ID NO: 103782 - DNA, 535 bp, Oryza sativa
atcttcaagtgccgcagcccagtcgaagtcagctaaaggttcaaccctggttcgagtcaggtgaaaagaagattccacctgcaacaggagatcgagccaagcagtccagagtggagaagctttgtaggcaagtttgttatagaaagcggagcggaagaagtcagacaagaagagaagaccgcccaacctatcttcatgctagcctcctcgaatctcggggacgagattcttgtaaggggggtggatttgtcacgtcctgataaattcatcccgaaataaaaatcattttccaaaaggaataatagaattaattaaaattcgaaaagaaattggcaaacactaaaatacgtacaagaaaaattcgaatgtggcccggagaatttttggtaaattctccttggtctaaaaggagccctcaaattttagtggaattttcagagcacaaataataattattaagaaataaacaaagttaaaatggtgttataaaaagaaaaagccctaaaaagtcctttttcccccttcccttcttggg

SEQ ID NO: 103783 - DNA, 527 bp, Oryza sativa
actatagggcgaattcgagctcggtacccaaattttgactgagaaatctgtcgacagatgcgtaataaattcgattttatctaatacaaccctctatattttaagaaaataatcaatgtatttaagcatagaattacattttagcttgcacaacgaaagagttagcaactagctagttttgattaacggacgtatgcaatgcaaccatgagaaataaaaatgtactttcaaaacaaatatttgtttaattaataagaaaagaaataataacaatatcgcacaagattcggtagactacaatctagcagatccatacaatctgcacaagaaatttcttatagtttgtaactatgtaaacatgctaaaaaaattatctaaaaaaaaacatgttagaaaaaatgttgggtgtaaactccatatagacatatccttcgtgaatacgccctagatcagagaaagttaaagttggcatgattgtctcttttttccaatcacaaacgaggttgccagatatgttcttttctcat

SEQ ID NO: 103784 - DNA, 687 bp, Oryza sativa
ttcctgggacggggattaatacactagcgttcgggaaaagcattttccgggtcgcgacaagctggtatcagagcaaagaaccaggtcatttctccagagattgtccacagccgaagcgtaacgtgcgtcatcactccgcccattatgcaagaagaagacaagtcactcgccttgtggtcactggagcaaacgccgtacctgtgaggcctcatgttaattctaacccatagtagaaacaatgtaccgatgttaagcaccttccctttttgtttaagacagtgccttgtattcatgtaatatgggagaaattggtaataaaaacaagttctaagaggattcttttggaagatgcggatatgtgatcatgtgtataattgtttactgacaaaggagacctagggtctcgtgccagaggaactatattctaacctcgagctaataaccaacctgaggatggaaaagaaaaatcaagtgattaaccaaagagacatttgtttggactaagagttacagatgcgtccttttcggatcaaaggcaacgacagttagtatagcttttggcgaaacacttcaaggtttcacggaaaggcagcaagccaaaggacctcatcgtcaccagaagcatccacaactctcggagtgaagagtacttggttgacaaagtttaagaggtgattgatagaagat

SEQ ID NO: 103785 - DNA, 1543 bp, Oryza sativa
ttcggggttgaactcgacgatagatcggggatttgagatctgagatggcacggacactagacaacaagcaaagaaacaaatttcgcaattaggatttttaagagataattttcccgctaggcgccacgacggaacgggcgctacatattctttctttcattgatggcatgaaaaagaaacatgaaattcacaagtacaatatttgcttctcagatcgattctatgcaatatgaaaaagcaccgcaattaagacttcttaattaatacatttgtgtgcatcaagccatcaagctttgatttagctcttcgaaccaagcatacccaggatcaaaatcctgggtccaccactgaatgaaagggatattttggaacataagagggattggtgggggaaggaaagagtaaacatctgaaagacattattgatgagtataatttggattttattggaattcaagaaactatgaaataggatttcaacaataatctcctgaattatataagtggaaagaaattgtttgattggaccttgttacctgctagagggagatctaggggaattctctgttgataagaactagtgcttggtccaaaaagtggaaatcggggattactgtctcaaaatacatttgcttaatcaaaaagacaaatgggaagtggaaataataacagtctatggaactgctcaacctgaacagaagagtgaattccatctggaattggctagattctgtcagaaattgagcaagccagtaattataggtgtggacttcaacattactagctaagaggatggaaaaaacaaaagaggagggacaaacaagtggagcttcatttttaatgcaattattgaacaatccaatttaagagaaatcaacatgggtggtagaaggtttacttggtgctataatcgtgatcatcccacttatgagtaattggacaaaattttcattaacatggagtggtagaatattcacccacttacaagagtcaatgctttagagagatttctttctgatcatgtcccacttatggtagaatgggggaaaacagaacttctaatcttcattttaaatttgaactaagttggttcataagggaagacctgtcaaaagtagtaggacacacttggcttcactctgggaagggaggaactaatgtagaaagatggcaaaatagacttaaagcattgaggagagtcctcgaagggtggaataaaaattgggaaggattatacaggaaaaagaaaaaggaaattttggaaaaaaaaatggacgagattgattagacatctatcaagataaaattggacaacatatccaaaatcacaaaaacaggatgcagaaaagttggtgaagccttttagcattgaagaggtgaaaaaagtggtgtttgaaatggaaaacaataaggctcctaggcctgatgggtttcccattgaattttataaaaaattctggaacctaatcaaggctgatctaatgggacttcttgaagattttcataggggaactggatattgaacgtttaaatcgtggagtga

SEQ ID NO: 103786 - DNA, 839 bp, Oryza sativa
ttccgagatataattgccacgtgagcgccacgtcaatgccacgtgggacgaagaccaagtcaaacaagccacgtaggcgccacatcagccaaaaccgccttcaaccgccgggggaccacgtttacccgtttttcgtaagttgggggacgggtcatacccggttttgcggtcaagggacgaaaatcggactgggcgacaaatagagggacccaaagtaaacttattcccatatataagtagcagcagcacttcgaggaaggggcgaacagatcattggccaagacggcgaacggcggcggcagcgacctggaggcctgttagctccttgttgatcttttctctacctcccttctctactagtctagaaacttctagaatcttttagcctttgtatccttccatcttccacctcaaaagcctccaatattgcaatagaatcaattgctccttgtactggattggtactattatttttgaaactgctattgtttcaagtgagtgaagtgggtctctaacaatctggtatcagagccaccaatccctactgagttcaccaagcaagttgccatggcaagtgaacataagttggatatgattttgaggcgaatggaggagttcgaacggaggcgggtggaggcagagcagacaaggagagctgatttccaatctctcaaggtagcgttagcatcatggattccccatttagaatagcactgaagactcacattttttagttgggaacaagcagtacaagatgacgcccaccatgtgttcgacaaaatgcttcagccccgatgtcgagcccaatctcactgttgatgtggttgttacatgtgcca

SEQ ID NO: 103787 - DNA, 708 bp, Oryza sativa
ctgaaccaagctcgctcctcaaattatttgtttcttggcacactagtaaggatgtctctagcaaaaaaaactcgagacattgatgggctgttgatgttcaaggagtgagacttgctgcttccatccccaaattgcagcagttagcctggtaactttctgaaagcacaagtgctcgttgtttttgatcaatcatacatgaaacaaaatggcactcctatggttatctgtctactcaaaatgtatgttcggctatatatactggcaggagtcgtctaacaaagtagcattcttttgtttttctcagttgaagagggcacgtttatgatgtcatatggttaacaaagtctagagttctagagttataatgaggaggaattctggaacctgaaagcttggtagtttttagccaagatgttattatcatttgctctggtgagggtacatatcaataaggtggatcagtctgattctttttttgaaactttcctcgcatttgatgccatctattgttctccttttatgtttgtctatcgttattcataaattgttgttttccacacttaaccacccccaatggaagctataaaattattcaagctccagaaggggtagtagttggactccaatctgtaggcaacatcaaaatttgcctggcacgtacgaatagtggattaatgttttatcactttatttctttcctttcttctt

SEQ ID NO: 103788 - DNA, 3539 bp, Oryza sativa
actattccagcactagtaaccattgttttctaggaatagaaggccagacgaaagacttcaatacatcagttctgcaatttacatctagacagttcagcaaatgacatgataagaaccagatattacctcaatgggccagccatcaacaacaaaaacatcaagagaatagttgtcaaatgtcgagaaaacatgcgcttccctgatgttcaatccaatgtcagatagcaaagcagacagctggcataacatattgcagttagatgataacgatatactgtgagcaaaaagtcaaacgactagtaagcacatgcttaaattggaacaatgatttagaaaatgccaatgtatcatgaggttaagttagaaggcacataaaattgctgacctgactaaggagctttggcttgtcaacagtggagaaaaccacctcatgaatgtgtgcgtatgatgtgtcctgcctgcacaatatacatagccaacttagcaagcctataaaaggtcaagatatctcaagcttctctctaggctatgtgcatgggcatgtaatagtgtgttcatgcaagtccacaagtggtgttgacttattcaaggagatttaggggatacataacttatgtgggatggtttacttcacaaatacttgaggttagtaccgatattctgtatttatgcatattctctatttttctggtgcagagtgcactgactatagaagtaaatgtatacaaacatacaaacactattgtgttaatctgtatggttcctatgcaataaggacttaagataactataatgaagatatgatgtatatcgaagctacagaactttaggtgcaacatatcagaagcatacaaaggaagcagacaacaatgagtcaggaaggttagtatgtaaattcttgagtgcaccaagctaaatgtttaaccctttcttacttcatttttttctgtaaagaatgtctgattacaatgttcctttcccacacataataatgagtggaagacattttatctacaatgacacatgattttaggaccatcaggatctccaattctctacggtggcacccacttgtcatggagagattatacgggagatggggtatagttttttcaacaagcagtgccaaatgccaatttgatccaagagggcaccacctcatggaccaaaacacccccatgacaagcagactctaccaccacattgtgtcccatctagacgctacataggccaaaaccactattaaacggacagataacaagttttacccggttttcagagttgagtagcaggttttagccagctttggagttgatggacgaaaattaaaccacaccaagagttactggacaagaaaaataatctttccttcctaaaaaacaatggaagcagcatcctagcactgtgcatgattaccttacagagagatcatcaccatcatcagccccatcttcagatgcgtcagagtcatatgtcggatccacttcttcaatctttgatcaaagtttagagtcaatttgacaactccgatttctattggtgatactaaagataaacaatcagtaatgcatggaacaaacatgtagcattggcaagataagaaaacataaaatctaaaagctagagtaacttatccctcccaatttctctatcaagatcatcaaatattgtaatgttatatgtagtatgccacataaaaaccatttaatatcatagctaaaaatgtacttctcacggacagtatagtaggtgtgagcatcatcccacctgtgctatggcatttttcaccaaagacaaccagctgcaatatatcatgtatatactatatgaacaatggtcaagcatgtattgacaaatacaccttgtcattttcttcagtatttaataagacagttcagaaaatcatggcaacactagtgtttgtctttgtacgacggccacggccctgtttacatatcatgtagagaagctcccaatgatagctacacacagttacttctaatgaaagaaataagaaaattgtcagtccactccatatctttttagattgtctacggcaaagcctttatttagtacaaaatcgagtgatatacacattgaactgaattattccttgcttcttgttgtgctcatctgtttcaccataaaataatgtgtactgttcattcagaaacctccttgaaatagtgcaatgacagctgtaccatgaaataatgctctaaagttacatggcaaaattcataatattggtgttacactattcttttcaatctagagttctagactttcctggccataataccattaagtatgaacaatatgcaacccatcatatgtaaacagaatacaactagtagccaccaatccactaaaggtgctatcattatcgcataacacaaattagttgcttctacaatagtccagatcaacataagagttttaccctcaagaaacgaacatggaacgcagggcgcctatcaggatcttttgcttctgccaagaccttctgatggactaagacgtcttcagctttgtcgacattgatatccagttgatagctacatagtgagaaaacaaaacaggaaccaatatttaactttatcattgcacaaagggcagaataatggaatagataatagcctatcaatactaaatccagaaaaaagacgattgcagttacaccaccttcctttttcagttatgacacaccataaaacatactcaggataactacacaggattatccaaacaagcaattacacaggatagctacaaggacaactccacggctgaaccaatcattccatttaaaaaaaatctatgcaagtataggaaaaaaaccattgcctccagaatcagaatgggctattagtcaagccaatggataagaattcggaatcagaaccaaataaaagtactttttggaagtgagtgatcccaccccaaaacaaacataaatgggttaatcactaattcaattccaagcttaactacaatcccagaacataccagtcaaaaatcgaagagatccagctctactcaataaatcacgcactgttccattcatcacagtagaagaaaagcactgaattcaaccatactgaattctaattccttggtcgactcaaacagcattcctaccaaaccaagcaccagataaaacttaactggaatgtcaccgcaactacaatttcacaccagttacacatgcatcacccagaagcttcatgagagcacccaaacccaaaacgattccaccacctacgtgagccgcgacaccgaacagggtttcaacgagaggaagcaaacgaacaggaggagcagaaattaaccaatcaaaccaaatcacctatgtggaagccgcatgaaatgggcctcgagctgtgcgcggaagtccggcgcggccgcctcctcgttcccctccgcgacgagccgctcgtacacctggttgcagatgttaagccctcccgcgccaccgccaccgccaccgccgctcccgcccgacgccgcgggcgccgccgcggggtcacgcggcgggg

SEQ ID NO: 103789 - DNA, 867 bp, Oryza sativa
ttgagtcgctgaccagtgggccccgcatgtgggcgccgcactccccccctgtgctgacgtcagccctggttaatattgcgccataaattatttaaggatttttgttatagtaataaacacagtgaatcttctaaaattcataactaattcatccgagctccgtttaatcccactcaagtctcagtaaatcaagaaaaatgtgtagaatccattaaaaatggttttgttctctgtttcagtagtcttatagcctgtttgcaatgtttgctttgtatgccgctagattccgatccctccgacgctccggtgtacttcgagatagtcgccgaggttcccccagcagcagagcaaggcaagtcatgcttgtcacttgaacatgttgatcctatattgccaatgctctattgtttcctttcaaatattgtattgttttataatattactatgggatggttacctattgttacagccatgctttttggataccatgctcctttgttagcttgggttataacatgattagagtttggactaggaattgcttagccttgcttagttcaactagatcacaatggggaaaatcatattaatgtttagactgttagttctaatggtaatgttggtttaataccaccgctctggtgttggttaaataaaatgaaccacatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctttagtcgacgcatccaggcaagggtgggcgtgatggagcggggcgggccctgcgacggcctc

SEQ ID NO: 103790 - DNA, 942 bp, Oryza sativa
ggggggggggggggggggggggggggggggggggggggggggggggggggggggggggggggggggggggggaggggggggggggggtgggggggggggggaaaaaaaaagggcaaggcgggtgtgtttgggggggcccgggggggggggggggggggggggggggggggggggggggggggggggggggggggggggggggggggggggggggggggggggggggggcgggggggggggggggggggggggggggggggggcggcggggggggggggggggggggggggggggggggggggggggggggggggggggggggggggggggggggggggggggggggggggggggggggggggggcgggggggggggggggggggggggggggggggggggggggggggggggggggggggggggggggggggggggggggggggggggggggggggggggggggggggggggggggggggggggggggggggggggggggggagggggggggggggggggggggggggggggggggggggggggggggggcggggggggggggggggggaggggggggggaggggggggggggggggggggggggggggggggggggggggggggggggggggggcgggggggggggggggggggggggggggggggggggggggggggggggggggggggggggggggggggggggtgggggggggggggggggggcgggggggggggggggggggggggggggggggggggggggggggggggggggggggggggggggggggggggggggttggggggggggggggggggggggggggggggggggggggggggggggggggccggggcgggggggggggggggggggggggggggggggggccggggggggggggggggggggggggggggggggggggggggggggg

SEQ ID NO: 103791 - DNA, 580 bp, Oryza sativa
tttaattaaaagagaaagggaggagaacagttctacttttccaatatttttagaaggcttctatgggtaaccatttggcataacctaaggtcaagggctctgataccaacttgtcacgcccggaatttctattcaaaattccaaacgcttacatgtgtgtgaaccctcgtccaggaatcagccgaggcacacaataacaaattgattatagagtacaaatattactctaattaataagcgaataaaatgtcattacagaggtagatagttcctcttaatcaataaaaatctaagcggaaaaaaaaaataaacggggcagacggcttcactccacaggcagcttgaccaaggctacacctaatcctccacaccatcagcctcattgtagaactcttcctctgatgaatgattgcaaggtgagtatatgacatactcagcaagccacgcagcaaatatgcacgtgcacaggataacaaaggatggcataataggggttcatttgccaaagcagcatttagcaaacatttgagaatttgataaaacagttagtaatttaacaatataatcccacgctttacaa

SEQ ID NO: 103792 - DNA, 1049 bp, Oryza sativa
gcagtactgaatgaggagaaggctgaggaaaattctcaactatcctgcagaaatcatgaaagcaatcagacatgctatcaaaatggagatcgagaccttgagggcacatctcaatcaggatggatcgccgggctggagccttggagggatgcaacacggaggagcgagatcgaaggcatggctggccggtggagctcgatttttcgcgtcgtcttcggttcaggcgtggattaagctgcgtttgggattttctcgggatgcggtgctagggttttgatgttgggtggcatggcaaactcatcagcgacgccgtggcggcggcggcgcagcgccggagcggaagccgggagcccgaaggagtttaaggcccaccaaaggacacgaatgaacgccgactaaattcctgtcaatgaattcggcctgcatacattcagccctcgaattccactcagcgaattcgtcccacctaattcggaaaaagtacaccgaaggtccctcaatttgtcatcgggataaaaaacgtccttgaaccgtaaaaccagatatgtggggtccctcaactatacaaaaccggtcactcgagatccctcggtggttttcaccccggttttagcctacgtagcagctgtcagcgtgagacccatgtggccccacatgtcaggtgtctacgtcagcctcctctccctctttccctttttctctcccttccttgtctctctctctctctctcacttctgacttctctgcaatgggcggccaccggcgaggaggatggcgcgacgggcggccgcggccgcgtcgggatcctcgtcaacgtcgcggcgaacccgtggctcggcgaggccgcgctccggcgggtcggcacgtcagcggcgatggtggaccggctggtggagatgcccacctggaaccagtggcgaacgcagctttaaaatatagatgggacggagaacggcgatgttaactcgataagagcaatcgaacacaacacatatcgtattaatagttcattcgtataagtgtctcaatttgttagatgtttatacctt

SEQ ID NO: 103793 - DNA, 655 bp, Oryza sativa
ttgtcaaaggttatatgaaaaatcaacaacgccatatgttttggaaagaaaggagtatatatatttacaacattcatcttaaaccactttctaagatcatgaatatgcttttttcttttcttgcatctccactgtccatgttctaagatcatgaatatgcttttttcttttcttgcatctacataataactgtggtcaattgctgatttcttcattctacagggagttttacagtttgtgatactagcattacagtcaatctgtaaacgagcacaggataagaaggctgcgtcacacgcatatatagaagtttgtttaacacacaagtgtgcttcacaattagcatcagtaaatcagtatgaacaaaaaatataggacctctagtaaatactcctgcaaaagctcctcttagtcttctatgcgtatcatgctgtaaattatggtgattttttttcttaatcaagtggctgaaagagaacagggtgaattactacttggtgaattgagtttgctctcacaccagtaattcaggttgcactaatctgcaaagttcaacaagcatggcaaatagcacagtccaccgtatgctggactatataatataatattaatggtattatcaatgttcgtgtcagcatatgctatgacatcatgg

SEQ ID NO: 103794 - DNA, 1030 bp, Oryza sativa
aaaatatcacatcgaatatttggacacatgcatggagtattaaatgtggatgaaaaaaaatcagttacacagtttgcatgtaaattacgagacaaatcttttgagcctaattacgtcatgatttgacaatgtgaaattacagtaaatatttactaatgatagattaattaggcttaatagattcatctcgcaatttacatttggaatatgtaatttgttttgttattagtctacgtttaatactttaaatgtgtgtccatatacttaaaaaaaattggtcaagaaactaaacataaccatagtagtagagaaataatacgagttggatttccatttcttcggctcccaattattttgtttgattgctggacaagaaaataatggcatacgtattacgaaagcatacatacattgaaaaaagtatttaagcagcttatctatatcgatttatatgtacaagttcacatatcaggtgactgtagaaatacctgttacttgcacaaacatcatagattatggaatttatttaatttcattccgaaatgagaaatttggttaggtattaattaatctgcacgctgtattctgacatcagctctgacatggctgaattaccattaggtcaagcttgtgaaaaactccgtgtgccttctaaaagaggatgatttcgacagctaaaacgtcctttcaattcaaggtgatgccttgattatatgcagccgtagaatttggctccaccaactcgcgaatttctgtcccccttatccatctttttcatcggctattttagtatttttttatgccttgtgacttgtgagctgtgactttaatttcctagtccagaatgctctagattttttttgctatttgattgtgaagtgcgaagacaatgacgctagttaattagccgctgtccgatggaaatactctcaagttttgtccaattaatgtcccaacaatggaaaaaagttcatttaacagtacgtttctcacctacgtgcagtaaaaggtacagcatggagaaacattt

SEQ ID NO: 103795 - DNA, 654 bp, Oryza sativa
aacaagaaagaaaagagaaagtttgtccaaccaccctgaatgtagttcaaacaaaaaagaaatatgaataaagaattttcatctgcaggtagaaacttttccaaaagccaacatgccttgggaaaatggtaagaattctaccaatccttgtcgacataaagtttcaaactcacaatacctcccttgtgacttcacattatttttcatgacaaacgaatgaaagaacaaacagggaaagcaagcagaccagcacccagcagcaatgttggtaattgccgcacaaatctccacgcatgaccgtgaggaactcgtaacgccctgagatttttttagtattttttaaaactttttaattttttagttttaaaataaactctccaaaaactttttttaaaaatatgatccttttgatcacgccagaccatctgatgtagcaaaacaatattgtcatgtcttgtatgtcatgccaaacaacaacgttgtcacgctaactagaccagcatggccaatgttaccatgctagccagattgtcgtggcaacactgtttcgttacgtaagtctgattgacgtggtcaaaagattaatatttggaaataggttttattagagtttatttttaaataaaaaatttaaaggtttaaaaataaaaatat

SEQ ID NO: 103796 - DNA, 514 bp, Oryza sativa
ttagcgtaaaagaacaatatacatggtgaaaaataaaccacaataaacaagttcttaaaatagttttaaaatttaaattttagctatggagcataagctagagtaatctcctcctaacagctcgataaatggaacaggaaggtccaggtttcagtggacgccatggggataacttcagggcttcaggcccaatgctacgtacgttcgccagggaaattcttcacatccaaacaatgttgccatggcactggcaccactctgcatctgaaaaggaaaaagttcactgcaggtccctcatcttgtcgtcgagtttcaaaatagtctcaaaaccggaataccaaatatatcgcatccctaatccttcaaaaccatgtcacattgaatcctaagacaaaattgagagcggttttcacggccgtggcgactgatcagcgtgggacccacatctcataagaaaatcatcaccgcccctctcttccctccgctcccgacgcggcgcccgtgtccgcgccca

SEQ ID NO: 103797 - DNA, 570 bp, Oryza sativa
cctgcagccctaaagccagtggttatgccagcttttgattgggccacgtggcgcccctagcttatcaaataaatcaggaatgttgtctaaggaaaaaaatacagaagatcaagcaaaatagaaaactacagtgttatgtgatattctaaaagcaagtagtaccttagcagtttcttttaagaaaaagttgtaccttaacaacacagcatccagaacatctagctgttcccacccggtaaaaaaaaaaatcagcttccagaagcttctaactgtacatcacttcgcaataaacatagagactttctagaaccactcaaatataaatcataatttaagataagtctagttaaagtatctagatccatagacttatacatctagattatagtcctttgcaacaacatcactcctagaggcattcaaatatccgatagaagaaaactcagaattattaaaaaaaaaaagggaaatccaataaaaaatatgagcaacagggtcctcagctatcgtatcaccgtgtagcaccaagtcaattgaccatttcaattcctccttttttcagtttccagt

SEQ ID NO: 103798 - DNA, 583 bp, Oryza sativa
tttttttataaaaatatataaatgacatgcaagaacgaaggatatgctctaagggtattaacttcattgccattatccactgtgtattaggctcatcttaaaacactgtactatttttttttctttaaaaacactgatcacttatttcgcaagcgcatactccagttcggtcctcgtgacagctaggttgaaggtagagcagcatcagctattcgttcaatgtggtagaattcccagggccctgccgtactctacaaggtcatcgagtatgtcgcccatattcgtgtacttgaactcgaacccttccctgatcagcttctccgacgaacagcagactctcggtttctcaggcatcccgtcgaagctgcaaagatacagagacgatcactcgctcgtcagatcgaacacaacaatatttatctattttggatttccaagttggtcaacaattcgatcgtaccggtcggttttgacgttgtactgcgggtacctccggccatgaaacgggcaagcgccaagacggtggtgttgaagctgcagcagatgtacctcgccgacgactctgccgacgacaatgacgaat

SEQ ID NO: 103799 - DNA, 1867 bp, Oryza sativa
tcgttctccatctcgtcgttttgaaggcgtaatacttcggtccactacttatttttcaactttaaactttttctccctcgtttctgttagtatgccttttaaactattaagtgatctgttatttttttaatatatatataagttatttaaaaaattaaataaatcttatttttaaatttataattattaatacttaattaattatgtgctaacgaattttctcgttttacacgctaaaattcttgtggtatactccctccgtctcaaaaagattcaatttctaggtttccgtatataacgtttgaccatccgtcttatttgaaaaaaatatgaaaaattttaaaaaaaataaatcacacataaaatattattcatattttatcatctaacaacaataaaaatactaatcataaaaaaattcatataagacggaaagttaaacgttcgacacaaaaactcaggaattgagtttttttaagatggagggagtacgttttattatttttataaatcttgatcggatgaccccccttatttttataaattttattattcttttaatttttacttttaccctattgactgctgtacttctgttggtccttcggatgggatacaaccacaatgtggcaaaaaaccaggtaacaagcatttatttcaagcctactacccagtagtaagcattgtgggaagaggtagtagttactacctggtatttgtgctattgccggcaacaaccaaataaaatatgaagattctgacaggatccaggtaatggagggttaggatggatggattttttcaggtggaccccaccttgtttaccactacactcatataagcatttgcagcttactacctcctggtcatggggccatcttatttactagttgggtaagatacattgcgcatgccggacctgcaacagcttggcgggatttccgagagagggagggagactgggagagtggtggaaacaaatcccgggttccctgctcggtggcacgcccaaaactccgaactctgaacaaacctttaaaccctagcctcgtgtggcgtcggcttcccccggcgattccaagggagcagtcccctgttccctccattgctggtgagatcgccgtcctgcagttcctatttatttcttttggtgtgtgtgtgtttcgcatcgcgtgatagtactcgagcgatcgagctagttcttccccacttcacccgcaagtttgcttaagcctgttctgccagcgtacatgtagatgtaggcagaaccgcagaagccagtttttagcattaccgatctttgatggtttttttttgtctaaaaaaacttctttttttagtttgagggttttttgttggtttagaatcatctttttctttggtggtttgagtacccttcaccacctgggagcacaaagattatggtgtgatcttacgatgaagggaccaacccgccctaatatagcagggatgcaatctttcaaatgaaacattggttgcagttgtttttttttctcaagaatctatttctctaggctccttatggtttagtattcaaagataaacataataacggttttgaatttcggatcggtgtaccaaagcctgagtgacaacgtttgatggtaagtgggatttatatcaatctgatccgatttgctactgtaagagaagacttgattaggtgttagtggttttatgttttatcaatctgataaggtatttaagcaatggatcattctattgtgtgctgtgcaaagcagtttaggtctgctagagattgccctgctctgtgaacacaaatttggtggcccagtcattgcaatcatgatgagagtccaccaaacttcattgcatcatgaagggg

SEQ ID NO: 103800 - DNA, 2138 bp, Oryza sativa
agaaaaaactctctagtggcgatatatatagggtgtgtttagttcacaccaaaattgaaagtttgattgaaattggaacgatgtaacggaaaattggaagattgtgtgtgtaaaaaagttttgatgtgatggaaaagttagaaatttgaaaaaaaaagttggcaactaaaccaggccatagtgaactgttgcatggtcaatgacactcatatgtgacaacattgttgttattattgtgactgatagcactcttgggaatcatcttatttttgtatgacgtagctatcggataatactttggctgttggctaaaactgcagatggtgtcggtctataatgagaggagtaaatctatctattatatactaaaagtccattaaatttcctacaaacgctcctaaactgccacatggcatcctacaaacactcctagactgccacttggcattattaaatctcaccgtcgatttttacttaaattagtggacccgttattttataccattggattagatctattattaaaaaatttcaactttctctttatataatttaagcgctactactgttgtcatgtacgtacaggtttatacgatgtcttctcctgtacgtacttatgtgcacaaaaacaaaacaatagtttacgtactattcgctggaaagaaaagaaaaaaaccatgcgcatatacataaaaaagacgacaaaaaaatacatcataaaaatcgatgatctttaaataaaatatgattttctaaaatatattacatcacaaatataaatatatatagttaaactaagatctataataataatataaaatatccaaccaatgttccttgaaccatcttctaaattatttttaaattatatatctaatttctgattccgttgttttcctttaattaaattataagttatattgtggtcttaaatatatcacgacacatggggctgatatataatagttagtttttgataatctattatatactaaaaggctattaagcatccttaaaacattctcaaaccgttatatggcattctacaaacactctcatctcaccatgtatcactctagaaaaattatagaaaaaacaaaacatctagccatcgattttcactaatatacggtgcacccgtattttctaccctcggatttccttaaagaaaaaaaaaagaaagacccacaccccactgcttccatccattacgttacgttaggtatatgtacgtagttacgtactccctctgtttcacaatgtaattcattctatcatttctcacattcatattgatgttaatgaatttagacatatatatttatctagattcattaacatcaatatgaatgtgaaaaatgctagaatgacttacattgtgaaacggaggaagtatcatatatccctgccctcaccctaatatataagggcaacatgccctcctattttcaagcattttcttaattaatattggaaaacatactttgtaataaattattttaaacaactatatcatctaaatagctattttttatccgtgcatgggacgagattatttacaataaaatttagaattcaatacctacattaaatatattttaaaagtaaaataaatgtatttctttgggtcatataatgctagagactacctattggtcactcgatatatattaagaaaaatcacatagatttttaaaccatatgagtggcaacattttgcttatattagtaaatacaacacccgacacattttctaataggtctaaaattatatctatattttaaaaatagataactaaagactacgacccgttggaatatgcctcagaaaaaaatttccgtcccttgtcctgctgtacatatacctcctttgatcctctcgccttattatttttaactaacaacctaatatttaaaaaacatagctaaatgacttataatttctaaaattatatttgatatttaattttttttaattattgttttatttacagttaattaaataattcaatatccattatagttgtattttactatatagaaattaaaatactcctatgcagggcaactgaatgaaattgaaaaattataacagaatgaaaacatgtattatttcatattaaacaatctacgcaata

SEQ ID NO: 103801 - DNA, 602 bp, Oryza sativa
gattcaacaccggtcagaccggcggcatccactcggtcagaccggtagatcaatctcggtcagaccgacttccgtcgatttcgagggtaacttttatttccgctaaaaattttcggtttttgggtataacaactattcacccttctctggttggcttagtttttgtgattcgatcctacagcttccttcacatgcttcattccgacgactacagcaaggaagcaaagcagcaggatgaagggatctggcgaaggcagatgattcacatacaaaaatgatggtggcgagatggcggcggcttcgacttctcgggatagctacagcgagaacaacggcagtagcttctcgagacagctgcggcggctgcccgcacggcaacaacgcggcggcggctgctcgcgacggctgcggcgacaacgcctgcagcagctttgtctggcgacggcttcgtgcacgcgtgcagtcgaatggaatcccctcgttcttcctgcgtggaagacggattacagtagcaaactgaaatcgtggatgcgcccggaccttagccgaccaattatctatctatctatcgatctatacttatacttatactaattggacac

SEQ ID NO: 103802 - DNA, 658 bp, Oryza sativa
ctctcttatttctcctctgcatcgatcttcaaactcggactttgtgtgcgtttgtgtgaaagttgtggatttaagttcgtgtgagtgtttcgtgttgacttcgtgaagatttattgaggacgtattttatcccattgagattcttgctccatcctttacttttggaggttaagaagtgctagaagactagttgttacttttgagctatcaatctacgtatggttagctagcataagtttgtcaaggccgaatcttacctccgaaaagaaagagatatcactagggaaaaaaatagtgaagtttatgaaggtcgaatctcacctccgaaagagaagagataccactaatggaagaaataatgctttgtataagctctcgaggaaaaggtcagtgaagaccaggtttttgtgagctcctcaaagaaaattataaccccctcatggattcaaacttccaaggaacaaatttcagtgatatccttttccctagctttgctattgtttgtgcttgatattttttattgtgactagctagatccaattttctattgcgtttgtcgctgttctgccattttcagaaatatccgaacctccttcagatatattcgaaaatttcagcttccgcacctaattgagtttttaaattgggctgcaggaat

SEQ ID NO: 103803 - DNA, 1813 bp, Oryza sativa
attagatggtaacatagtttaaagcaaatacacggaagatcatttagcttgcttggattattttagcacatattttttaaaaaaaatcatgaagtaatcggattttctctaactaaagccattggattttctatgcattggtggtttggacttcatattttagttagttgtatttgctgagacaatgtatatctcatttagctatgcatgtttgacaaacaacatatgatgatgcaacctgtattggattatttcgtaattcttttacagcaattcaaatcacacgtaaaagggcagggtgttctcccttaataaaaaaaatgtttcatagttcactttgtaatttttgtttggataactattgatttaatttagctatacatgtttgcagaatgatgtatagtgatgtaatatgtgcagccaacttgtttaaggtatttgaatcatatttggatggtatgcaaagcacatgggctgaatgtgtgttgatgtgaaaaacacacactggcctaggagatctgcttaactccagtgcagatcctaaatcttacttctgggttcgtcgtcaacaatgtggtcgaatgccatattttgtatataggaaaatataaggatacggatcttaaattcctagtttaattataaatagagcaataattatattagaaatcagacatgtagcttaaaaactatggttgttttaacatattgattatttctcttttagtttactcctacccaaaaatagggatgggattggcagtggtcagcgcgcatgtgaagggggcgaggaggtagatgcgatttatttttataacttctccaaataatgtaacttaaaaccaatgatgataggtttaattttttctcaaaatttctaagattatttatgattttcaggacatgacacgtggcagcgtaagatttttcgtaaactaaatctaatggttgaaaataatgggtccatcgatttaattgaaatattttataattttaaaatgtgacatatggtgacttaagtgtgctctaaaggtgtttaattggttttcattgcgtagattgtttaatatgaaataatacatgttttcattctgttataatttttcattttcattcagttgccctgcataggagtattttaatttctatatagtaaaatacaactataatggatattgaattatttaattaactgtaaataaaacaatagttaaaacaaattaaaaatcaaatataattttagaaattataagccatttagctatgttttttttaatattaggttgttagttaaaaaatataaggcgagaggatcaaataaggtatatgtacagcaggacaagggatggagatttttttctgaggcatattccaacggatcgtagtatttagttatctatttttaaaatatagatataattttagacctattagaaaatgtgtcgggtgttgtatttactaatataagctaaatgttgccactcatatggtttaaaaatctatgtgatttttcttgatatgtatcgagtgaccaataggtagtctctagcattatatgacccaagaaaatacatttattttacttttaaaatgtagttaatgtaggtattgaattctaaattttattgtaaataatctcgtcccgtgcacggataaaaaaatagctatttagatgatttagttgtttaaaataatttattagaaagtatgttttccaatattaattaagaaaatgcttgaaaataggagggcatgttgcccttatgtattagggtgagggcagggacatatgatacttcctccgtttcacaat

SEQ ID NO: 103804 - DNA, 2228 bp, Oryza sativa
ggcctcacgtggaaggaggaggaagaagagaggagaagggggaggaaggggagaggagaatggatggaggaggctaaggctgagagggataaggctgatagcgaagggatggagaggacggtgggatcgaagggacaagggataattaatgagataggagaggacggtggactggcgcacggttcggttgacttttgatcccagttggtataaacaaccaggactaaagatggatctttagtcccggttatttataccaaccgggactaaaaatgaattgggcctaacttgacccgataactttttaaaccgggactaaaggtcaaaaagtttttaaccgggactaaaaatcatctttagtcctggtttttattcgaactgggacaattgtggattttgggcgaccgagcaaagatggtttctccaccagtgttggcccgttagtataatggatccatcctactagctctcaagccacttgttaagccaattatgctaatagccaagcaacaaaatgttagtccttgttcgtgaaaaataatgggtaaatttcatgaaaccctatctgttatagttaaagttgcacaaaacaaacaaaattttggtatgaggtatatagccccatgtaatatggtcgtaaaattttacaaaaccacaccgttaaccaatttgacatactcctatatcaaaattttaaaaagctttacttacataaatacaacatttatatggtagatgaaaaacctcataattttgagatgtgactatagaagccaaaagtgtgatagatcaaattcaaaatgatgaatggtattccctccattccaaaatataaggcataaccacatctaacccaaataccaggaaataattattatcatcttatagtttggatcattctaataaatataatgcatgcatccaatagaattacagaacatgagagtggaagatttaaaaaagtaataatttaatgatgaagatgtcatagttaattgcttgcatgcatgcatacttcatattaacatctaaaaaatggttgtgttttatattatgggatggagggagtatggttttatagaactttatggccataatatatgaggttatgtatcacgtgttaaaaccccgatggttttatgcaacttagaccataaagaaatttaattaaaaataatcaaaattgttactcccaaagcattgtcaaatagcagtcgcctcgttgctagtatattccctgtacattccaagcctacacttgacatgccccttcactaggacaatggaagatgtgatgtttttgttgtttatgttttccatatctcattagcttgtgtgtcaaagcataaatctggtgtgtggttagtacagctaattatgtatacttggttcttcgcattaccatccaaaacagatctgtgaggagaatctccaagcaccgatgccatttttagtttaaacaatattttgtgggatagttgtcattcattagctttaactaatcaattggtaccaacaagatgaggcgctaagtttcatcgatcaatcagtttgtttagcagaaaagtggaggcttggctcggtgaaggttctgctctcttatctaacataaaaaaataggtcaacttggaaaattctaacctttctgtgttctttactccgaatggaatggagtaagaataagcatgcttcctgagattataaagggtgcgaattttttgcaaaaactttatatatttgaatttcttagaaaaatgttgttgatccatttttctaactaggaaggtagcccacgcattcgcgcgggcatgtatcgtgcactgtatttgaaaatggatcatatttatcagagagcctccgccatgttttggaagtgcatttcctcagcaaatattcttcgttgcatcactttgataatttctctatgctatatactatatagtatttaattaatatgtataagcaattatatataatcttcatcatcatctaaaaaggagttagacctagtttgtttagaaaacatgtttatttaattaaaagcaaggtgtttttttctttgtttgttgaatgctatgggccctattgatgaaaatgtaagacctagctaaattcattgttccttttcccccgccatacggttttatgcagctcctagtcaccgtgttgagatgtggtcattgcacctacagaggttgccttgtgattcatcgcagttgtgatcacat

SEQ ID NO: 103805 - DNA, 1966 bp, Oryza sativa
atatatgtctagattcattaacatcaatataaatgtgggaaatgctagaatgacttacattgtgaaacggagggagtacgtaactacgtacatctacctaacgtaacgtatggatggcagcggtggggtgtgggtctttctcttttttttctttaagtaaatccgagggtagaaaatatgggtgcaccggatattagtgaaaatcgatggctagatgttttttttttctataatttgctagagtgacacatggtgagatgtgagtgtttgtagaatgccatataacggtttgagaacattttaaggatgtttaatagccttttagtatataatagattatcaaaaactaactattatatatcagccccatgtgtcgtgatatatttaagaccacaatataacttataatttaattaaagaaaaacaacggaatcacaaattagatatataatttaaaaataatttagaagatggttcaaggaacattgattggatattttatattattattatagatcttagtttaactatatatatttatatttgtgatgtaatatattttagaaaattatattttatttaaagatcatcgatttttatgatgtatttttttgtcgtcttttttatgtatatgcgtatggttttttcttttctttccagcgaatagtacgtaaactattgttttgtttttgtgcacataagtacgtacaggagaagacatcgtataaacctgtacatacatgacaacagtagtagctcttaaatcatatacagagaaagttgaaattttttaataatagatataatccaatggtataaaataacgggtccaccaatttaagtgaaaatcgacggtgagatttgataatgccaagtggcagcctatgagcgtttgtagcatgccatgtgacggtttaggagcgtttgtaggaagtttaattgacttttagtatataatagataatagataatagatagatagatagatttaaaatatggttttgagaacattgattggatatttatatagatcattatttaactaaatatatttatatttgtgaagtaatatattttatctaaaatcatatttttaaaaccatcgatttttatggaagtatgttttttctgtctttttttttcatgtgtacgtttttttttgggttcgagcaagattaggaaagataatgtacattacgtttgtacgtatggaaagatcagcagtagtatcgtacaaacacatacgtacagatcatgaggaggttattattttttaataatagatctaatctaatggtgtagactaacgggaccaccaatttaagtgaaaatcaacggtgagattagatagtgccatgtggcgacttaggagcgtttgtagagcgccacgtggcggtttaggagcgttcgtaggaagtttaatggacttttagtatataatagatagatagatagaagatttgtactatttatttaattagtttatttgtaccctcgaataattatcacaagtcattcagttattcattcattcagcactgaccctactatcttaggcaatcaacaagaattgattggactccaccaacattaaaatagttgttgatggaaccagcagaaacttgcatcaacaaagcttacaaaccataaaaaaaattggatgaattcagagttttgcccacagcttttggcatcaatgtaacttccaatcctttggcaagatttttattggataataacgctggtgaaattagtccattagtgtcatcagcatgcttaacaagaacttgcccactatgtccaaaactgctcgagaggcagccaccaagatggttccgtgacggatattccaagatgacaaatggaatttcatcacgatttgcaataaaatggagtgaaatccactcatgaattcagaaggatttaggctttttttactagcagaatgatgacagcttctctgcat

SEQ ID NO: 103806 - DNA, 1785 bp, Oryza sativa
ctttggagaagaagtcctaggtggagtcctggcttataccccagttgagcgcctgtgaagatggagccataggcccgctaatccgctactgtttatttttgattgttaggcctgaagtgcctttgtaataatgtaaatattatcgatataataaagatgtgtcttttgtatcatgtttgtgtggtgtaccccggcttttcctgggacggggaataatacactagcgttctggaaaaagacaatttttccgggtgcgacaagtaaacatttgctaatgacggattaattaggcttaaaacatttgctaatgatttgacaatgtggtgctaaagcctcgtacctagaaactaggacaagaacttccactgctctgaggatttaatacacagttaacaagttgctgtaaccccaagttacttttcttttttctcaaaatggcagtcaaattcgtgaaaaatgttcttatttcaggaagagaggaagaccactcctgtttctgttacctggaaggttaggagtaaacgttcttacagccagccaaataacataaaatcgcaattttcactccctttctgtgacaccatcccatcacatggagttaaatagacctctaagcagtttgagagaacaaaatgcaaaccagaataactgtttaactaatgacagcttcaacatattcggactcaaaatgagacagctccaggtgataaaaaaaaataaaactaatttggttactctcaaaaacttcaggcatgacatccccttccactttttttttcctacattgaatccttctttccatggttcatcttccacatgttttggctgctgcaccggctactgatgtctttgtgaaatatggtaaactaacagaaacatgctaataaaaactagcatgatctgttcaaagggttgtatgggagtctatgctctgctaacatacaagccgatgcagcatacgttattatatcctgtctcctcccaagcctaacccttctctgcaagaaatcaaccactataagccagcaaagacacactagctagacaaactatattaaaacttttttttttcattctgtgctgaagcataggtgtaaccttgtagttcgcttgcaccaattcaggggatgcaacaatggccgccaacattatttaaagaagagtctgttgggccctcttcctgcaacagtttatttggtacagtacaaattgttgtgtggcagaagtgtctcgtttgttaggatgaattggtgctcctctgttttcttaatgattattttcatgtacttcacaaatcctgagtattgtctgtatgttcaaattaatgacatcgtcactattacttccattatttacatatgttatcgagtttgtgccgcatgcaatctcggttgaattctatgtagtttgcgctattttgatacaaggtgtcggagaagtgggaaccagggttaccgttcctctactgcctggggcatgatggaggttaatgcggccatctgttggcccatctatcctgagatggttgttagctgcccacaatggcgtaactaatcaaggccacccctgctcctgtttggtgccctgaggtcaacaccagcacatgacttatttttcatttagccaaacaggacgagactccgagcaagagtcccaaatcttatacctatcaaagcagttaccctgtgtaagtgtgggctggtgtacgacgggacgatgtcgcccttttttcttggaccgccatcatgagtcttggaaaggcgggcgacatggctggttgactgg

SEQ ID NO: 103807 - DNA, 2759 bp, Oryza sativa
caattaaaaattatggaaattgttttaactgctacataacaccccccgcccaccaccacccgggcgtgcgtgtaatgtcattatctcggctgaaattttctgtttttccttaattttttgtgaatttggttaaaatttattcaagttcagtcaaattatgttaaaatttcaaataattttgttccaaaaagtgctgaaaatccttttgcctaggtgcatatattaacattcagctgcattaatgcattcatatggccttacattactctggcagctctgtttgatggtcctttctttttgacctgatctgaagaaacatgcatcaaactatgctaaagaaatactcccttcgttttgaaatgtttgacgccattgactttttagcacatgtttgaccgttcgtcttatttaaaaaatttaagcaattattaattcttttcctatcatttgattcattgttaaatatattttcatgtaggcatataattttacatatttcacaaaagtttttgaataagacgaacggacaaacatgtgctaaaaaagtcaattgtgtcaaacatttcgaaacggaaggagtatgtgggaatttggttatagttctagtttttagagtactactgcagtccatgaaaagcatggatcaaagtatattctgggtttaaatgggaatcaattgcaactgaacaaagagtactagaattttattcgttgccctttgttagtacattggtactactctgcattactccctccatcccataaaaaaacaaacctagaaccggatatgacacatcctagtaaaaggaatctaaacagacaggttcaggttcgttgtactaagatgtgtcacgtatagtgctagattggtttttatacgacggaaggagtagaatattgagagaagtgcagcttctcttaatctctcatacacgaagtagctgtatactacactcaggagtacacttaattagtaatctctgaatcagatttacgagattttcttttcggatgagataaatcattcacaagttatatggccttgttagttacctctcgtaacaccgtaagtacaaacatcaggaaaataaattatgtttatatatttgatgtgtacgtaacatggattttgctcttgatccatggagccgttcatgttgtcatgtttttagggataagtttaatgcatattaccccaaaactattgcgtttatctaaaactcactctcgacttaaaccacgtataactcacctctcaacttttaaaatcaactaggaaggtagcccgcgcattcgcgcgggcatgtatcgtgcactgtatttgaaaacggatcatatttatcagatagcctccgccatgttttggaagtgcatttcctcagaaaatattctttgttgcatcactttgataatttctctatgctatatactatatagtatttaattaatatttataagcaattatatataatcttcatcatcatctaaaaaggagttagacctagttcgtttagaaaacatgtttattaaattaaaagcaaggtggtttttttctttttttgttgaatgctttgggccctgttgatgaaaatgtaagacctagctaaattcattgttccttttctcccgccatacggttttatgcagctcctagtcaccgtgttgagatgtgatcattgcacctacggagattgccttgtgattcatcgcagttgtgatcacatttttggtcaagcttagttactcctatttccatgtcttgttatatcgtaaaatctaaatggactccaaagttaatcatttaagtatatatatacaacaaaatatatttgcagacgattaatgttcatatatagggatgattcaccttttgaatggtctgtgcacaaagaaaataaacggagttacccggaatgcttagaaggccaaaacaacaattagatggtaacatagtttaaagcaaatacacggaagatcatttagcttgcttggattattttagcacatattttaaaaaaaatcatgaagtaatcggattttctctaactaaagccattggattttctatgcattggtggtttggacttcatattttagttgtatttgcttagacagtgtatatctaatttagctatatgcatgtttgacaaacaacatatgatgatgcaacctgtattggattatttcgtaattcttttacagcaattcaaatggcacgtaaaagggcagggtgttctttcttaataaaaaaaatgtttcatagttcactttgtaatttttgtttggataactattgatttaatttagctatacatgtttgcagaatgatgtatagtgatgtaatatgtgcagccaacttgtttaaggtatttgaatcatatttggatggtatgcaaagcacacgggctgaatgtgtgttgatgtgaaaaaacacacactggcctgggagatctgcttaactctagtgcaggtcctaaatcttacttttgggttcgtcgtcaaaatgtggtcgaatgccatattttgtatataggaaaatataaggatacggatcttaaattcctagtttaattataaatagagcaacaattatattagaaatcagacatgtagcttaaaaactatggttgttttaacatattgattatttctcttttagtttactcctacccaaaaatagggatgggattggcagtggcctgcgcacatgtgaagggggcgaggaggtagatgcgatttatttttataacttctccaaa

SEQ ID NO: 103808 - DNA, 500 bp, Oryza sativa
aaagctcgaagcgtgttacttgctaaaaatggtgaactatatccaaggaacctatgtattttcacattctgatatactatggttcgcttcttcatgtgttgtaggcttacgggccaaagcaacataggtttctacctatttatctcaaactcgttcggaaagaatgagctttctttctttatgtgatgatattcggatatcaacttagtttgggacttttaatgcttgtatgcagtgcccaatccaaaatttctttagccattcattgtcaactataggtcagcgttgccggttgatcttttagttgattttcaactctgggttgactgccactgatttgctatatgaagagaatattgtccatagcatgtctcattaccaattcttattggtttgtatacttgtatgtgacacttatgcgagtattcatggatatatggggatatgcaatttttttatgcttctattctctgatatgggcatgactatttcattttacc

SEQ ID NO: 103809 - DNA, 2025 bp, Oryza sativa
aaacgcgagtttattgtagtactgctagtaaaattactgtagactttttttgagactagtcggtcaatgcagatacattgactgcaaaaaaaaacaccttccagactttgaacggctgttttggtgggttatacactctgcaagaacattatgttctggttgtacagtggttcatggttggtacggtggttagattggaggacttcagtcaattcttctggtaaacggcgttgttgttagtactttcttgatgatctgcggcgaaggtaatttttactgcctcagcttacaagctactagtatagacacgcgaccgaatcaacgatgaaatactttcagggttcttttggaataaaagattttttaacaaattttagaggaatttagtcttgtacaaaatttcttatgcggtcatttgaatcataggaatggttataaaaaaatcatatgaaattcctttggggctcaaaacgtgcgaattttaaaaaaattctaacatgagaaaaaacatagctcaacctcttaaaaaatatattttgtgtctatcttcttgtctaattcatgtgtctttccgcgtactattcaaatggttatcttttcctatgtttttataatccatagaatttgaggtgttagggcactccaaacatgtattgttttcgtttttgccttataagaaattccacgtttcaaagggggaagacttttataattttacttttttagtgggctaaaagtaaagaccgaagaagacaacaaaacaaactaaattatttattataggattaagttgtaaaaattaaagggttaattgggtcatgcaattataatttctcatgtgtttaaaatatataattacaattcgctaaattcaagtcgtgccattacagctttataaatatatgtcagtacttacttttttgatatatttattagaaactagcatggtggaccgagcagattgcacggctaacatcattgtattttctctcatacaatactccctccgtttaagattgcaagactttttagaattgctcatatcttaatgaatctcattaacttctaaattgtaacatcctgaaaattcctgacattaaaaatcactaaaattttgaactttttaaactttttgcatcatgcctggaaggtatggttgttatttgttgccaaaccataaatcgacgcaatggaaaaaaatcaatctaaagatttacacccgagccatagttacgatttacaacgatacgaatttttaatattaattccataaatatttatgcacattaaagccaggccaaataaagtacaagtcaattattaaaccctgtgggataaatcacaaatcaaattttaataatcaaaccatgttgatggcctgatttcatatttaacaaaaggaaacaacatatttgaatataaattacttgaatccaatctcacatgaaatataagttcacatgaaatgatgatcacatcaatggccccatctataatagagtatctcactagaatatataattaatatttgaaacaccttatcaagctcctcatagcatgaaaatcactcatataaaataatggtcatataaataaattaggctttatacataaataagaatatgtgagtgtttaattaaacaattagattaatgttgtactaagtctcaatttatatttatagaatgagtagacccacgtaaaatgcattgttatacaaataagttcattcaatgtgctattgtaataataatggccacattaggatattttaaattaattttagaaccctcaaagcctccaaaattatctaggttaattttagatttaaacctcatttaaataatacaataggaaaatatataaaatatgggtaatattaaattttggtcaactttcatctaaaataaaacatatattgggcaaaactctaattgtgtgaaatctagtaaattatgggacaagtttaataggaaatatgcctcaaaagtggataattaggaaataatcactgttcattatggc

SEQ ID NO: 103810 - DNA, 1760 bp, Oryza sativa
aatcaagaccttgaccccacctgtcagtcactatagcttgtggataaggttgtattataaataaatgaattaggaacagtaccatttctcaattattagaattaattcaaatttgaatctttacactagcataacttactcatttcagctccgatttgagtgaaacttgaacctaaattcatctaaattcataagctttccaatgatatataactcactatttgataaaatatatttataaatattaaataattaatatcaagatgatgcataatagtcaacttaaaaatatgctaataaataaaattagtattgtacagtagagtggatgtaataatatttgtctctaacatgtcttgccactgtaacaaccacacaaactaattttatgtgatgtctcaaatgaatggatgtataggaaaatactagtacttatttaatattcgatggccatataattaaatccatggcttataggttatttaaatcaagtatagccttatgattatgtaactaaaatataaacacacatagatgaatctttaacctgtttaggagaataataacagagctagatgtggaggaatcactaagtaaattaatcgatgcaataccatatagaatagcatatatatgcctaaattgattaccacttattagtaacccaatagaaccagtgcttaaacttgtcgcatcacatatacaatatcactcatagaaactagctaatgtataattaaactacattatattcaggaatcacttggagcatttgggtagtacactttctaaataagctcatgtacagtaggcgaccaaaaccttatacgttgttgcacacatattgtacatcccattatagttatacaattaatttatctttttcatatattaaactagggagtatataacaaacatgaatagtagataagtactaattataaatcttgacctcatatgatcatagttcaattgtaactccggattgttcattaagagataatctgtaactataatattataaacttcccgaatttaacatatagagcatggataattattagcccttttataatttataatggcaagtaaaatatgttcataattaaagtaaagtttccatcaataaaataataatacaaataattcactgtaattgtttgattgatcctaaatccatctaacaacagaacctctagtatataaccgtcctatttagatagatgcatacatagccataatccttctatagccatttgatagactaaaccaccgattagccaaatatatatgtatcccataaatgctatgttggttaactcctaaataggccacgatgacaatagaaaaattaagaaactttagccttagcatgattgggatccattagcaaacacgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattccttgaacatgtcgatcccaattgcgaaattgttttgtttacaaataaaattacatgcaatgatgaacatcctacttgtgattataccatgctttgattattgtttacccttaaatctttgtaaccatgtttacgtatgagtccctagtcaactatgacaattgcttagaaatgctattctaga

SEQ ID NO: 103811 - DNA, 565 bp, Oryza sativa
  unsure (1)..(565): unsure at all n locations
agtagtagtagtagtaaagaggatgcatggaggtgatagaaaaggagccatgcattgtaccaccaacaagcaagtgccggtgcatcgatctgcagacttttgatggaccggccggggaaggaagcacaaataagataggcgtcgattaaaaacagtcctgtattgcaccaccgaacgatgcgtatgggtgtggtacgtactacgtatatagctaagctaggtcgactctcgatcgacatctnactgagcctccactgctcgcaaagtcttgtaataatgcacagactttacggttgctaaagggaagagggaaaagagagacagagaatacagaagtgatcagattgttcttcttttagcgaatagtgatcatgctatgtacaagcgacatgatgatgatgatgatgataacgggggtctttctttctctcttcatgcacaagggccggcagtctgaattcaaaccccatggcggtacatatccttttaaacttaaaaggcgtaaaagaaaaataaaggagaaaggatatgccataaacagaactcagacagcagccatgaaaat

SEQ ID NO: 103812 - DNA, 711 bp, Oryza sativa
agcgcagttcacccttaactataagcagtcaaacttccatctcataactataaattctgccagtgtattatgtgcacaacaagatgggactcccagtttggtactagtgaattgatattacttgaaatctttgtagtctgtcattagttgtcaagaagatgctgcctaagttataactttttcacaactcttataatttgtagtttaattttcgtttgttccttttgccagaaagagtagctccgcgaccagcatattctgttcacacaagcaatgctgctggatacgaggtatgttgattactgatgttggcatgcttgtttaatttacactagaatatgagctagaattggttaagagtcaatatgaatacagatctctagtgcccacatgcacctcgtttgaaagtttatacgtgattataaataaaagatacctcctggagaagttactaacatttatagtttctactttctggaaataatctttacttgtctgcaataaatgtattgcattccaacacaggaaattgctttaaaccagatgagagatacagttcttggtacctatcaacttctaaaatagggacaaggctctcttttggatgttttttttccttggacaacccaggagactttggatggtatttggggctataaaaactcctttgccacgttaggaatttctgataactttggtgatgcacattta

SEQ ID NO: 103813 - DNA, 718 bp, Oryza sativa
taccttcagaactaagaatcaattagatataacatcattctttgatgttcgccaaaccaacttacttttctttctttccagatccaaaacaaaagttgaacaaaaatagtgtaaaaggtttgcccagaatcaaagagaattatgtgcaccaaaggcttgctaccagacatatcacatagatcatcataaatttattggaactacacaaactctacagaaaactaattttttaaggaatgctttttttcaaataacttcatattttctgacataggataaagtaaaccacaacgtcagaaaattcccatctatccaacaaagcaaactaatcagttatgtcagcaaagatggggtgggggcaatccaatgcctttaggttagcaccacaccatcagtatgatgggtaaaataaccatatgttgtcaacaagtgggccaataggttatgggcaactaactagaatgtgccatgggtacagaagaaatataacaagcagtttcataaaaaaaaaactgttcaataaacattttataattgcgtgattttgtaagagtctggtcatgatatattacctcatgaatccatgcatttttccatggtgaaccatctccaactgcgatgcattccacaactgataatcatttagaaaaaaaataactcagtgtgttagagtaacttcaatatcagcaacagagtacaccacgtccaatagcactta

SEQ ID NO: 103814 - DNA, 746 bp, Oryza sativa
  unsure (1)..(746): unsure at all n locations
taagacgtcgttctcgctaagtcgctaagtcatcattcgtgaaagtcgttaagtcgctaagtcgtcgttcgtgaaagtcgttaagtcgctaagtcgctaagacgtcgttctcgctaagtcgctaagtcgctaagtcgtcgttcgctaaaacgttctcgttcaaacgttccaccatggagtcgncggtggagtcggcgcncgncggcggaggccagtgatgtcgncgncggtggtgccgncgncggtgaaggtgnaggtgaagttggcgcgcancggtgnaggtggagtcagcgcncggcggcggcggcggcggtggagtcgncggtgncggtgncgncggcggtgaaggtgaaggtggacttggcgcgcggcggcggcggtgaaggtggagtcggcgcgcggcgncggtggtgtcggcgcgcggcggcaacggcggccggcggtggagtcagcgacgacgatggcggcgaggtccggtcggccgacgcgtgtcaagatcgatcgagagagagagaatgcgagatcggaggcgcaagatttgcgcccctcaccttgagggaggcaatgctgccgatggcgttggcaagggcggatgagcgcggtgagcatggcgacgacgacggcggaggcggcggcgatgtctggggcggtaatggcgcgagaggaagaagatcgatcgtggagaagtctaagtgtggcgcggggaagccgatgcagtggatgggtaccgagctcgaatntcaagg

SEQ ID NO: 103815 - DNA, 719 bp, Oryza sativa
  unsure (1)..(719): unsure at all n locations
ctcggtacccgattcaccgtgattagtctcacacttaataaatcgacccaatgcactgtagttcaggtgggatggttgggcctgttcaacgtggtgtagtgttgatcagtggagatttaatgttactctaattagtcaacagttttaccctttttctcaataaaatgttttacaaccgcctttatgcaaatagcaacaaactgtccttgtattcccttgcacgtctgcatcattggtgtggcttgctgagtacggtggttgtactcagttttgctattattttccccttttcagaagtgtagtgcttctgagctgaagacgaagttagaagaccaaggctcaaaccccagttgtgttttgcctgaggagtggagctgaagccccgctaggatcgcctttttccgctgctgctgctttcttttcggtgtgaggactaagagcctcttctgtaagtatttactctttatttacgtttggaactgtttattacttgtcttttgtgtaccctggctgattcttggacagggatttaatacacaaaatagtctggaaatttgggctaaattctgggcgtgacacctcccgtaattactcaccctaatttcttctcccttttcttctttttttttctcggcttcttccaatcccttcccttcttcacttcggttccctttttcccttcggttcctttttgcggccgcngccgcggtgttttggga

SEQ ID NO: 103816 - DNA, 690 bp, Oryza sativa
  unsure (1)..(690): unsure at all n locations
acagttttttcgcaattctcggaacgtgtttatatttgcgcatattgatctgtcggtggtcatgtatagtctatgaaacgttcatgctagttacatctgcaatatcatgattatttatggaataaattaaattattatgtgcttataatttcaacaaccttcacgccgccatttagcgagatcgcggtttctctctcccgaagtgcgagattgacatggctgcaacgctctcgctcatcaaaagagcatcaacggtatatttgtgtaaattttccccaaatcagtgtattcttgcgattttggaaataaaaaaaatacataatcttattaccagggccttgacagaggtaataattcgactatactgacaaatgacacggtaaaagggtatttcaaattttgttacaaatcaagaaagctaaagaaccagaggacatatggaagtaataaaagttatatttgcaacaagtagagttggaaatacttaagcgtgaacaatcagtgtcatccattaattaattatcatagcgtagtgaaatactggtgcatcacgtgttgattccctttgcattcttttcatgatagtggtaattaattttccataagaccatgaggcaatgggttacgcaggatcattgtctcaatagtgggtaccgagctcgaatntcaatnatcaagntttcatcacac

SEQ ID NO: 103817 - DNA, 676 bp, Oryza sativa
caacgtcatcaataatatcatggtcgcaatagccaaatgccgaatccatttaatatacattttactttacttcaagtatttatcttttagatattatctttatcgggcagttttaatgaatatatttctaactcgtaggcttctagtgtggttgctctgcttcgatcaactaagttagagtagtaagatcgaccatcggtgcggttcctaattcctatgtaatctaggaaggtatctagatcaacaggggacgataggtggtaggtgatgacagtcctgtccatcccttgtagtcagccacgtcaggtctagttagtaggcgaggcggaggcaattggtttcaatcatgttcttgtcctcttctgtgataatatgttgtgttcagaagtgaacaaaacatattttcgggtttgacttttcaatctttttgaactccggaaaccaacacaaaataatggcatatcttgagttaatctacccacgcaaccaatgtttacagttgcaccacttgggacaagtgttcagcttgattttctttctatgaaacgttttctctgctcattgttcttctggctagttttaccttttccgtatttcttaaggcattgtttatctgtgtgatcgtgatcattgatgttatatcttttatatgtatttaaaatagttcatagtatgt

SEQ ID NO: 103818 - DNA, 732 bp, Oryza sativa
aatcggcgccgccctcgcgtcgcggcccgccgatggaaggaggtcttcgccagccgtcggattttgaaaagttgggagagagaggagagcaccggtttcctggctggtctcgttttttttttcttgcttctaggcggctgagggggtcgtgccattagtacggtgggtccagccagatggaagcgatggacgcgaaggccgaatgaagccctggcgcattgggcagttgacaagggattgagaatttgaaatactcaacggtatatttcaccgcgcttttatcacatggagccaacaacacattagacttatatgttagtgataaaagcacggtgcattgactatagaggatcctgattcgttgacaaaaagatttaagcattattagggaaacaattttaatcatcaaatcaaaaggaatgttcccttgtcatctgaaaattttgataagaaatattaatgattccacgtatactcaaaagctcttatattttgggacagagggtgaatgtgaatagtttttttattcatgtgtttggtcatggccacatattttttagacgatcaacaactaatcagtgtgttcgtttattagcgcatgagtaaatagcatcattgcaatctccacctatgcatgcgcctaacaccgaagtgactccacacctttatcgatgagatttagtttcaaaatgaagagggttttgttgagttggtctcagcatgatttgtgaa

SEQ ID NO: 103819 - DNA, 727 bp, Oryza sativa
  unsure (1)..(727): unsure at all n locations
gtactcaggcttgtagcgcggcatctanagataagtgaaaggagggagttatgacatttatcaattaatagcacaagtttttggattaagtaaaaggtaagtaaataaagtaacccaggcttgcaagataagttgaaacagttggaaacaagatcacaaattttgcacttttgaacaacaggttccgaaagaaataaaagaaagttataaaatcaacatgctaaatttatttcattgcagcaagattaaataaacaaatgttgtaaaacttttgctggtaaatgagccattagtacagtaacagatgtacagtactaataacactggaataaattttcaatgagaaccactaaaagagattatgaagtgcatgtgctattagtttggtttaattaaaagagaaagggagcagaacagttctacttttccaatatttttagagggcttctatgggtaaccatttggcataatctagggtcaaggaggctctgataccaacttgtcatgcccggaatttttatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaaaataagaaacagcgcaggcgactcctctcgggt

SEQ ID NO: 103820 - DNA, 665 bp, Oryza sativa
ctgagaatcaacgagatacttaattgaaccaatccccccatcatacagtttaatgaccttgtaagatgctagtagcagcactgcacaagaaaggaaagcacaatctgaaattaatcatgcaaaaggctgagatgcagcatccaccaccatgacaatgcatcaacaaaacatgaacctccatgagcaaagcaataccaagaaaacaagaaccggcacgaagaaacccaagaagcgaatggatccaacgatgatgagcatatacaaggacctccagcagacaatggatgcggacaccggtaacgggtgcactacatatctaaccaaaaagaaccacatgccgatccggccacgacccgacgacaaccccgggcaacacacctcgagcaacggcgggagagggtggtgattaagtcggccgcccgtcgcctggacgccgccacccttggcagtaggcggggcacgccgccgctgttgaactgctccatcgaccgccgcagccatcgctctcctccttgcctccgctgcgccgctagatccgtaaaaagcggagagagagaggggaaagtgagaggagcattttagctattacgcaccctaggtctatatatatatatatatatatatatatatattacacacatgcatatatgtgtgcactatatgta

SEQ ID NO: 103821 - DNA, 570 bp, Oryza sativa
ttttgcggagttcaaatccttgaggggattccaatctccgtcgagaagcttgcaaagagcccggtcttttttcaaccctatcctcgtgaggttgcacaaatccactcctcctttcactaagggtatctatttccttgcggaggtgagatccggccttcacaaacttctcttggccaaccacaagtagatcggtggcccaagaataacacctagctgtctaggagtcctcaacctccaagagtaataaacaccacacaacactttgacaaatcatagtgctcaagataaagaaaagtgcacactaggctcccaacctgcaaatccacactcacaaagatccaagtcacaaagaacaagggggatttgagatagagagggagagagctcaaaaatccaaagcacttagcacaaagctcaacccaaaacaagatttgaatgaaatgaatttgagcaactctagaaaactgttagtggggggtttataaagatccccccaaaatgtgaccattggaggggaatcttttagcccacgtcagatagtccgatactaaatcggatagtctgaaaatt

SEQ ID NO: 103822 - DNA, 739 bp, Oryza sativa
tcgccattacgccaaccgcagaaaaaaaaagaaaggggtggcaccgcgccgttgtgctcccggggggccgccgccaagcgctcaacggctgcgcgcgcggccaaaagaaggtggaacggcgcaagcgccccgtgccccggcccgtccacccgccgtcccgccgtcgcaccatggtaagggtttcgcccgagagaagaaaagagtggctagggtttgcccaccggttgggggctcgggttttgctctcccgatctccccgcttggccgtctgatcgaaaccctagcgatcggacagccaacgtcggccggaccgcttttggcccaagagggggcgcgcgctaggcctctttcccggcccaggcccaggttgcggcctagagaggggtgagagcccgcatgtgcatataccagggccgccagagtccaattttggtccctcggggccgaaagaaaaaggaaaagagtctatttttagtccctgtttcagatgcatttacaattatagttattaaatgtgtttatttctaagcaatttgagccaacgtgaaaattgtttagagaatagataaatgtgagaaatgcttctgaacatgtattttgtatattttcatgcaaattacaatagaattttgaattgtttttgcatgatttacctccgtttaagatttgaaccgaagggttaatttttacagagtgaataacagaattttgtcagggtaccagcaagggtatcaatcac

SEQ ID NO: 103823 - DNA, 735 bp, Oryza sativa
tacccatcactaaagaaaaataactgaatcaagaaaaataaaaatagaactaactcttcactctaaatctagaagaatcgaaataacttttcacggtattaaaagtaattcttcacagtttcagaagtagctatattggtagatgaagtaactctctagaaaaatagaagtaattttttgtggggttaaaagtatctttcaaaataaatagaattaaccatctagaaatatgtatatactgctagtttattcaaaactaggaataaatttagaggtaattatgattcgtgtattaattaggaataaataaaaaaagattctggccaatgcctacttcgcaaatcaaaagaagattcagagattgcctgttcgatcaattcgactccgaccactagttcagcaaaagcacattgaagcacgccccacgcagccgcctggtcagtttcatctaccgggcacctccccaccggccttctggtaatccccgcccatgcgtgcgcctactggctgcttgtaggctatatgtgacaccaccacattggccacgtcaacgccactcagtggagcgatatttccgttgtccactttcaaggcatcgccaagttgccatcgtcctttacttcgttgttgattcctcaggcaggcaaccactccacctcacctttgccctcaattcctcaggtgactgattcatcgggagaaaaaaaaacaaaatgtgaataagagtggggcgct

SEQ ID NO: 103824 - DNA, 731 bp, Oryza sativa
ttgatagtcgagctcggtacccaagaactcctagattatatgggatccttatacgtaacatctcgagagaaatttggtcaatgcttaacttcaattattttcaataaaaaactaatactacatgtacggcaaagtaaaagttttcaataggctagtctatattatctcgtctatctcacttgtactctttccatcttataaaaactcaacaatattagatatgatacattgtaatactatgaatttgaatgtgttaagattatattgatatttgatgggagggatggagaatttatcttcctactaccttggatgaatggatcacgtgactgtctgaacaggtaaaaacaagactacagatgagctgtgacctcgtgggttggcagataacagtcccggtgcgtgggctatcagctcaaaacacgtcataaaacttccaaatataaaatatttaagatataattatattacacactataattacaatatattttatatttgagatataattatattacacactataattacaatatacgtaattagagtttttctcccgtcctcacttttgtagcacgcggtactggtaccatgaggcaccagtcttcatcccgccgttgattgctgaggggtacgatggggagctatcgcgtgtggtcaaatagcgtgcgcgcctcgatattctcgcttcccttctctgcattaacgccgctgacttgacgggagaaaaa

SEQ ID NO: 103825 - DNA, 1740 bp, Oryza sativa
ggcagctgaattggggggggggggggaggggggctatgctttgtaggagtagtacttaccccttaattaatcatgtcagttaggccgcctggccagtctgatttcattcagagaaggtccaaatcaatcacaaatcaacacaaaggcaaccgctaacctaccccataaacaactaccgcctacttctatttgcaacatggcgaattatttccaaggtaggtttggtttgttttgctttgaattctacatgaatttcgccagaatgtatagtactagtactagtagtatactgcagagaaaccacgatgtttccgtggagcacagtgagcgacaagacgtgcggttaatctcggcgtgccatgggcagacttggcctttcgtcgcacggatgtagcagcagcagtggtgatgtcgcgggagaaaaaccacggccgggggccggcccccatacgggacatgtggagtggaggaggagcacccgaggacacggcctcgtgacagcgtcgttcaattggactggtgacgagtgagcggtcgtcgtcgaggagaggacggccactggccacggcgcgcgtcgtgcgtgcgtgcgagcgaaactccgtcgaccgagtagcagagagagagggggcacggtggcatggcgtccacatctacagatatagcgccgtggattgtgtttcactactccggcatcagttgatagcgagcaggcagagggcgggcgcggtaaaacttccgcgggcgaggtgggggcaccgacccggacacgggaccacgcctccccacacacacacgctaggcaacgtgcgaccaaccgtgcgcgcgcgcgcgcgggcgggggcatggcatgattgtgatctctctctgatcacgtcgcgcggttcgtcccgtgtcatatctcgtctcgtgggatttcgggcttgtccttagccggcgaaacagttggattggacggaacgggcggcgcggcagccggctacagcgaccgccaggccaacccccgcgcgcggctggggcgggggcgggcgcgcgcggatgctgctgcgaccgtgaccgcctcgttatctcctcggcgcaggctgggtctgctgggggtgtgggggctcacaccggggcttttggcaaaagaggccgcctttgctttcgcctttggatggacgttccaaaagatggcgatcgagatcaaatcttgtgggggcaaaaggagggggatgagcctcctcatcggccgatccgatttggtgatcagcctgcctgccttggccccctccctggccatgcttctcccaacgagtacgcgcgcgctgctgttaggtatgcaaagccttttcctatcgttcttttttttttctataaaaaaactattaacactgtgctgtgctctctctggctcttcagtgtccacgcgacgtgttccatattgccatatgcccatattggccagttcttattttttcccccttgaagacgggacaattgtgcttttcctggcttgggggcaatacgtttatgcgcctttagaggagtaagatcatggaaaagcacacgagattgtttccttgtatgcaagggaaggtacgtaacgtgaccgcgacgacggaggcaggccggcggtgaagacgtagacgcccaacagcggcggcataataggccagccgtgtaggcggaggcaccactcggggacgacgaaggcaggccggcggtgaagtagtaaacgcccatcagaggcggcataatagg

SEQ ID NO: 103826 - DNA, 1789 bp, Oryza sativa
ccctgagcagatgcagcctccttttgcagttttggtttgttgcaaattcggattcatttttgttttggaaacgttccgaaagatccggtgcgtgcaaacagcgttccgaaagatccggtgcgtgcaaacggcgtggagtccgaataagttacgcgcgacttatccggttcggttacgcgcagtagagatcgtgcgggcgccctgatcaagcgacccttctttatataaaccgacctgccgtcttcacgcaacatacgcaaaatcaatctagggtttgcttcctactctgtactgcgccgtcgctcgtagactactccatcccgctcgccggcgtgcaccggcgatcgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcattcatgctagttttcatctgtaatgtcatgatttatttatggaatagattaaatcattatatgtctataatctcaacagcaaacactagtaatacaagtagcttacttctatcacatataggaaagacagccacacgtgatatttgcagatggggagaagagacacattctataattttcacttgaaaataagacatgacaagtcaacaatagtttatttttaggttctgattttcaagtcaacaatagataactaggccgcactttgccacggatacagtgaactgcataaggaagaacatgtttgcacatagaaagtaaaatgtgtgaaaaggaagatatctataaagacaatctaaacattaacacctatcagctaagaaagttaattatatgtgactgaatacggctaacaaccatcctgatgcttccaaaaccttaaaaaaacactactgctaacaaccatcctgatgcatgtcaccaaatcctttaaaaaacaacactaaaaatagcactgcgctaaaaggctgtaatccacgaatatagaagcctaccaatacttggtcccattgttatcaatatactcaaaacaactattctaacattgatgatgtactcaaaaccgttcctccaaactggtgtggtgccaaaaaggtttatctagagagtatccctttgctgcagacaccgtgaagagcataacagacaaacatgaacgcatcaagacaacaaaatgtgagtagagaaatatttatccagagacatcctaagtattatcatgtaagagactaagagctaataagttacatgtgccttaatactgtacatacagcttgttagtataatgtgaatataacaaaacctaaataaacaatacctggcccataagtctggaatccaaagtcaaatatagcagcttgccatggtaggagaaccatcgatatactcaaaacaaatctaaaaatatgcaagtacatgaatagcatccaaaaattcagttgaattctatactactccaaaaggtgtgaatctagaagtgcaagttagataaagtaagaaaaaaccaaaatagctttgatttatcacttgtcaagttatcagttcatatctatttctaaaagctatcaaacaaaatagaaaatgcataagcaaaccatgcagtaaa

SEQ ID NO: 103827 - DNA, 612 bp, Oryza sativa
atttgctccaagaattgcatctctccagttccaactctggtaaggaggatctaagggctgcatgttctgatcttgaaatgattagaaggctgaagaaagaggctgagtttcttgaggcttcctttcgagcaaaaacagaatttcttgaggtgagcttaattatcatacaaccttttactagcctgcatttcatctggaaaaggaattactacaagtatgtggacactttaatttctccatcataggactcaggagagtgcattccaataactgcaatggctattaagggccagctatttctcaataatagaaacaacatcctcaatgactgaaataacaattgtcacatgtatagattagatggccctagacccaagcaacacaaccatgctgatgaccaggggccacactacatgggctatggatgattacctagtccaaacacttatgattatttcttgcttaatctgattaaaatccagatatatttttaaatagggcagcattaaccacgcaacgagccacatatcttatctccttatcttaaccaactatacatgttctgcatccagctgcctcatgcttcctaagctcctgttgggctgttcatgg

SEQ ID NO: 103828 - DNA, 1043 bp, Oryza sativa
gatgttttgtaagatttaggatttgtatttgtgatgtaaatgatttgggatgttacattgattgggggatttgggtatatgcatcccacttagatttggggatttggtgtttgatttggttatatacatccaactcgatttgggagaaaataaaaagaaaatggactgccggggactgcccctatcgtctctttagtcccggttggtgctaccaaccgggactaaaagggagatctttagtcctggttggtaagatttttactcccggtttgaaaaccaggactacagggggttacgaaccgggactaaaaagcaattctccaccagtgatcctttggtttgttccttgtatattctggttttgtgataggctcattgtttgccaagaccatagtctagatggtctagactgcacctagatactagacgatgggttattgtctactttagggcctaaaccgggaattggaccatttgaccatctagtggttaaagacgaccctagactatcttgaccacacaattaggaaatatccagacgagtgtagaccgtagaactgtcatttagactatggtctaggcaataggccgatgtatttttttgtgtaacaggagctgaaacttcgagcccagaccaaagctcatatggtttatggttttgacgtcgttccatatagttctgctctactctaagccagtcactgagacaaagtcaagttgtctctcctctactagtcatcaccgtagaccttgttcccacctctctttggcccacagcttacttgagtggctagacctatcatagcactgcattatctaatattttatggaacatgtgtgccaagaaagatataccgatagtatagtgtacggtatatcatatagactgtctagacttgtgtctagacgggctagactctaaaccatgggtcatcgtccatctagcgtctagcatctaggttaacactggataggctttatctctccattctaacagttcagatagctccatctgtaggtgcagtccggcttgtccctccagc

SEQ ID NO: 103829 - DNA, 1978 bp, Oryza sativa
tggcatcggcaagggcatcgctgagccttggcgaagccactgcaggttcgccgtctcctcctctccctcggccatgtcttctccaatcacggcaagccctggagctccatccccgatgtaaacagagccggccacttcttcttcctcattgctgtttcactgccgtccctgcagatcaggtgagccttgccgtcaccctcgcctctctcgtgtcgtgtgccgctgcgccatggtcgccggtggagaccggctgccttgtcctcacacacctctctatccctttccactgtttctcctctctgctgttacagcacgcacgcacaatagtttttcctttactaaactaattcacaaatttgtaaaatgccattcaaacaacacctaaaattcaaatggccatatcttcacggtttgaactcggattcgacccgttcaaattgctaattttcccttaaaaagtaaagaacccatttttatgctttgtttctgcatcttatatggtttttatttatgtttaggccatttttctttgcgtatgtcgtgtagacgctacagattcggaagagccgctctgcctcgaggttgatctagaggattttggttgcgagcatggcaagtcatgtcattttgatcatattgttatcccaatttataaaattatgtttatttaaatcattgcattttgctttattaaattcccacgcatatcactgttttatttagcactaccgattctccttgtaatagccttattatttgtattattatgatccatgataactctaggaaaaataaaactagtgagaactttatatatgtggtgcttactagttaatttaggaatatgcttagccattcttaaatagaaaacaattagactttgggaataacttgtgagtaatggtaaaaatggtttagtggctgtttatccatgacatgatgtttccccttcaaaattcccgtaacatgtttttggctgggctcgaagtgttgggtttagctaatcgcaccctggctgtcataaggatcggtcttcgggcctttgttgcaaagcatattacgtacaaccacatgtctaatgggtaaggctttaatacatcgtctagttcggtcatgagcaaggaagacacggatagggatggatcccttggtagggtcgacatctctggctgttacgctcgggggcatagactgtctgctcgacccaggacacctggcgggggaagtctaatgagattgttaagtcccgatcttccaataggtattgataaacaatcgatttgggtggagtcccgacacaacttgatctggcttctgaacgaacacactactgagccccgcaatcgcagcaccacatctcctctggttattaaccgtgccaaaacccaaatgacctcgctgagaagtccaatccctgcatgcgaatcgaagaacacaagcaagaacaaaatagattgcaatacaattgcatatgaatgattaagcacccgaatttggtgttccacaaaccgatctagcggcgaaactattcttgacatattaatctaagcaaaacccgactctaaataatgatggctattgactaaatatgatcagggatgtcctagggttgccctagggcgcacaccccgttgggctatggccacgacacaattacaaggcccaaaacccaaatcagattcagacaggatgagatatgtggtttgttttgcagattcttagcagatcggtaggaattttgacgtgggaccaaaaccatatgaaagtagactacataagctttccaacaagtacttatgggcctcgaaattccatctagatcagcggctaggtctgtttgaagttgatgctgtcaggaggcccgaatctaaatccaaagcgtgtagaacttgatctcttgtcttctatggaccatagtagaaaaaactggaccgggctagcggttcaacaggaaaagatcggtttcctcaaaggatcg

SEQ ID NO: 103830 - DNA, 850 bp, Oryza sativa
aattcacaagtctacggaggagcacaacaaaagaggccgctagctgaagatgggctgggtaggccagcccatgggtttggccgaacctctcgtggcgccgataatgcagggtttggatggacggcgggggttgatccccaatgacggttggagggtattaccgaccattccaaccgtcacaaccgtcattacctgcctataaaaggagctcctcttctcacttcactcacacacctcaagcaatagctctctcatttccctcatgtttagtttagtagtatctggctggtggaataggaatagagtagaaattaggagtctgaagcctttgcaagagtttgggtatggctctagtagcttttctattatcttttgtaagctttgtacttttattagaatactcttgaaaatatatttatggtattgaaatactttccgactatatgagtacctacttcacattatgttcatgttatactgaatatacggctagcttatctgggagatgctttggtgcgggtataatgtttgcgtatgcaattactctatgtcatgccgataatattagagtagtatctggtagtttaggcatggtgtctagattacgggatatcattatttggggttatttatttcggatgagaggtgggccgctgatggtgacagctcagtatgggtattcctccgcgccggtatataatcctaagttaattccctagggagggtattcctccgtatttagcctcggttgtatggttatgatgggctgccggaagaaactcggcagttagtggtggcttttcgaagtaccaggagggcatcggaaagagggtattagctagtatatcgg

SEQ ID NO: 103831 - DNA, 686 bp, Oryza sativa
attgttgtatttatagttaaaccaatgatttaaatatccataatgcctatattttgaactgttataaaataaagcaactaacagaaaatgtcaatagggtctaaattgaactgtttagagaaaatgtaataagttagtaaaaaaatggttcttacatttcactaaaattggaccgacctgcatgttccatttttataataattttaaaatgctcaaacattaatggtcttacttctatcctatagcatagcatagcattatgagttcctccacatattattacacatataagccgcactaaggtttgtagtatatggtttgttgacaagtttatttgttactgtcagacttacaattttggattcatgttaactatgtattttctgatgaaaaagacagtatagatcacacatatcacaagtaagtgaggtataggatatgtctttattaatttactagcaaaatgcccgtgcgttgcactgggtaatgtcgtgttcgataaatgttgattgaatgatttttttaatcacaaaggttttaaacaattattccacgtgtacgtgtatgatatgaactatgttcatgactcgttagcgtgatgattgtatcatgggaggaacaaacggtgaatgccttacgtcacttttacgcaagagtagatggacaaaaatttgtatgattaaaaa

SEQ ID NO: 103832 - DNA, 544 bp, Oryza sativa
actatagggcgaattcgagctcggtacccagtaaagctattcgaatagccgtgccggcggttatgggcggtcgaccagattcaccgtgattagtcccatcttaataaatcgacccaatacactgtagttcaggtgggttggttgggcctgttcaacgtggtgtagcgttgatcagtggaggtttaatgttactttaattactcaacagttttactgttttgctcaataaaatgttttacaaccgcctttatgcaaatagccacaaaccatccttgtatccccttgcacatctgtatcgttggtgtggcttgctgagtacggtggttgtactcagtcttgcttttattcccccttttcagaagtgtagtacttctgagctgaagacgaagttagaggaccaaggctcagaccctagttgagttttgcctgtggagtggagctgaagccccgctaggatagcctttttccgctgctgctgcttttgtttcggtgcgaggactaagtgcctcttttgtaagtattttacgctttatttacgtttgga

SEQ ID NO: 103833 - DNA, 783 bp, Oryza sativa
aaagtgaacttattccaaaatgaaaagcagaagcaatgggtgggccggaaaaatggcgaaccgtgtgatcgcacgccacgtcggccagccgtaccttgtaccgtgaggcctgtgcgcgagtactattgggctgcatcctgggcttccgcctgtttcagtgaggcggcccgcggcctactgccataagcttcttttccttctaatgctacaaaagtgtgcatggagtttgaagaaacgattttgctaaatatttattgacaaatttttctccaaaaatttaacagatgtaattacagtacaatcgtagtgtattacactgtaacttgcatgtaattacactgtaactatagtgtaacttgtatctaactttcaaaaatctctccgtaacatgttatttcggtaaaatggaggtcgtgggaacaaattctttcatatatgtgtgtgctatgatttgttttcttcctcaccaaaacaaatcttgtaatagatctaacgatttaaaattatgtgaaacttacatataagttatactgtagttacatgcaagtacagtataattatatataagttacagtgtaattacactatgattgtactataattatatctgtcaaatttttgaggaaaaatttgttttgaggaaaaatttgtcgacaaatgtacaggcagtccacaagaaccagctgggtaccttataggaacagctggccaacatggagcgtttcaccaaaaatggatagctgaatcaacatgacccacattcatgaactgggtatgtttttt

SEQ ID NO: 103834 - DNA, 793 bp, Oryza sativa
atcaaggttttcgtatgcccccctctggccggttatttcatcggtgcaggaccgatccgaactgcgccaccaccgctgttgggccacggaagacaactgggccacgcagagttctccccgcattgggccgtcgccgttagatgggccgttcgccgcgcgatcagctcgtgcgcatgtgctaaacgggtcgggccaattttttgggccggttatggaagtaatgggccaaaataaagttttatttaatttcgccgaattaattcatttgattatgtacataattttatttggcattattttgatccatttaaaattgctggaaaattatgatcaattactcagaaaatatatatttatatgtatatatatacctaataaaaaaacacaaaggttccgatttattttggtctgttgttttttttgttttcgtccggttttttgtcgttgttttttcccgaatgcgaactgatctattgcaccgtgcgcctcctgtagccgcccaggccgaatctgaccgattggtgatctttctggacttttttatcccgaattttaagctctaatatggggaaaacagaaagggcatactagcgtagggctaaataagaaggaagaaatgggctttcggtgcaaaatcaagaaaaaaatttcatcaacttttaaattatagtgtatagcaatcccaatattaaaattctcattaaccttttcaatcgacaatcgcaatgtgtagcgagagggataagcctatctaaccaggccactgatatttttttaaaaaaactacaattat

SEQ ID NO: 103835 - DNA, 628 bp, Oryza sativa
cctcgcatctgctgagtgctgaccatggaaaaaaataccagaaccaagaagatatgacatatgcaatacaacatttataatcatttattatataggatctgaattaattttcagtaataatactccctccgtcccataacataagggattttgagtttttcttgtaacgtttgacaactcgtcttattcaaaattttttgaaattattatttattttatttgtgactaactttattatctacagtactttaagcacaacttttcattttttatatttgcaaaaaaaaattgaataagatgagtggtcaaacgttgtaagcaaaaactgaaaatctcttatgttatgggacggagggagtatatattaaggtactacttagaaagtggaatgcaaaacttctacttgcttttgaaatcaatgagcactgtacatttgagtgtaactcgaatattaccgttttttttagaaagaatgtatcaatatcaaagtagcagtttgtatattgtagataagtttgggtgaaattacatgcctatatcaggccttctgacataatatagaagtgaattcgaaattttagtaatggcttagcttcttcttattgactactcaagttttatgagatca

SEQ ID NO: 103836 - DNA, 1116 bp, Oryza sativa
catgtgcctattctgatttgtctttcataagtctcttgcaaacttgataggcgtcttgcaatccccgctgcaacccggcctctcctatgatctatacctccctcacatcaaccgttctgtgtgcaagcctcaaccctgcaccccttcatcctacaggtgcacatcattgcaatcgagtcatgtaaggttagttgtcaaccaacttaatcggttcattgcatgtaaacttatttactgattttatatgtctgaattggttatttgccatgggtactgattttaattcctgaaaaaaagtgtcaatttattctatttggtaaacctgaacttggcatgaattttgaccagattctattggagtatacattatgatttgaaccaagctgaagcattatgaaaggtctatcgattggtttctcccgcccgtcggcgagcgacctgaagcggatgtgggtgcggttcaagaaggcgccgcgcggcggcggtgaccgacatcgcctgggagaagatagagagagaagagaagagagataggagagctgacatgtgggcccaagggcatttttgacattttacacgatttctctctcctcttcaactggaaattattattctaatcggcgcggtgtccattggtaaattagcacgtttatggaatgttttccccaaaaatgagttcggacagtatcctacggctaaaagcacgaagtcgaagtgttctgtagcaaaatttgccataaatatataatagatgtcggttttttcaaaaaaaaattatcttaatcttaatcttaaatatttaaaaaatccataactttctgatcatcacctctctttttttccgtattttcggtcgtaagtccgagagtcggtacattgttctccgccgcttaagcaaaatcaaacaaaaacagggagggcgtatctgcgtgagagagaggcggagagacaacgggaaacaggcgctgacaggggatccacacaagcagcaaagatggcttagagccggtggtcgatctggtggggacaacttgggtggggagggagacagacgaagaaagacggagattggatcagggagagtaggggagaaaagggatttcatcggctagcgat

SEQ ID NO: 103837 - DNA, 542 bp, Oryza sativa
aatacgcttgccgatgccttcgagctgggcgcaggccccattcaaccacaagatgtatccagccgccgattcctcgggatcctcgcgggatactcggagctctctacagactcccaccgctgcccgctcccggtcggcgtcgtcgtcgctggtgccagttccacgaggggacgagccatcgccgcccgctcccggtcgccggcacccgtcgtcattgtcgaattcacacagggtggcgttgctctaggctacctcgtcggtgccgctcgccgctttcggctgctctgctcccggtcgcccgctgtcatcactggatccacacgcgctgccagccgctccatgttgcccgccgtcgcggggccaacaccagatccgcggcgccatgaccgcccgccgccgcccattgtggggccgggagagagaggagagtaaataattaggagaggagagggggagagagaggaaaagtttttataataaaaattgaagttttgagagggaaaagatagtggaggaagattaaaaaaaatgtgaaggggtgg

SEQ ID NO: 103838 - DNA, 718 bp, Oryza sativa
ctcaagagataggtgttgcagccacagcagtctgtgcagagaaaggcagtagtgcatggccgttgcccaagatattcttctgtgctaaagccggccaacgcaatgcctagaggacagtgtgggcgtggatttggaggcacgggacgacggtgccgtctagaaccaaccctgtccgttggtggtaacatctcaaagtggcagccatctttcactctctccctttccttttaacaccagagagatgtcacagagagggtgcgtgcatgctgtatagtagtaaaccggtggtccaaacggctccccatcccgtgcacgcctttgcatatgtaatcacccaaaagttggggccttttgggcgagccatatcgaagagatatatcacgaactctcacgcatgttacggtcgatctgatctgacgaccgtcgtccaacctacgctctcaccaaagacagccgtggaatcgtatagattccctactccgttctaggtcatcacctcttatagattttagctattgttaaagatataagaggtcagtgataacttcacctcatctctaatgaataaagacatgtcagtgatgatcaatacctcggatgtgtgtaagcagtccgtcacattaaccattgacccaccggtgttgccacatactccctccgtcccaaaaaaagacaaaccctgattttccgtgcccaacgtttgaccgtccgttttatt

SEQ ID NO: 103839 - DNA, 4821 bp, Oryza sativa
gagttgttccatccacttttgatgtgattccaagagtgaatactacatagaagagtcaagaccgggctcgctcccaaatagaatgtttagccgatccattccggatggatcgaattggtatgagattttctttctatatgaagatgaaaaaagaattagggtcaaacatttcttacttttattgagtatgactgaatgaggaatccttatatggtatcgctttaccatcatctgaaacgtgcaaagctccgaattaaatgaataaaaacctaggagatgctcactagtatctcttgtctgactatttagaaataattctatttttaattggatttatgtcgtgccaatcataattctatttttgattggatttatgtcgtgccaatccaacgtaacgacaccagatagagggttgttgcttgctcatcataatgctggaaaggcatataatgtcaccggttaacattgctagtgctgtgaattcgatctattaaaaatcgggctcaaagaacacacgcccatataaataaatgggactcctccgattaagaccctcttgtgaaagttatttttcacaagtggtcatcttagaagtattgcgtgtgaaaatagagttattttcatgggcaagccttttagggaggtgcatgtaaataattggacttttctctacggcccctatccatccatgtatctcaaccatctccgcataattttactagatcgatatccctcttaatttactgcattttctcttccctctcccacctctctcggtctctcctcatctcattcctctcaagcagatactgcgacatcagcggcaaatagaaccacgacagcggcgacggagaggggcagcggtgtaggcgccgtatccggcggtggcgggtaaggggagggaagagacagcggcagcggcaaaaggatgagcggtgacagtggaggcattagatccggtgtagtggtgctcggtacctccggatccagcggcgacagggaagggagggagctaggggcggcagtggaggcactggatccggcaagcattgctcgggtagcgctccaaacacctatcaccatcggttcaagcagcaaatagtgatacatacttaagtatcattgcctgttcgtggcctgaaacactgatactccaagtatcattacgaatttacgatcttttgcttgaacaaacacttatgtacttgacatcatatcactgctggttccagcagacagtcgcactgctggagaaatggtttttaaccccggtttgtaacccacaagtaatcctaattatgcaaccgggactatggatccgggactaaagatgggtatcattagtctcggttgaaataaccgggattaaaaatctatttttagtcccgagccaggccagttccagttggtagttttttttttctttttttcattgtttttaactttgaatattgatttcactacaacccaaatcatccccaaatcgattatcacagaacaaaagggatcatctccaaatctctaaatcgatcatctccaaatacatcacaaattctaaaaaaattatatcacaaactctaaaaaaaatcataaatacatcacatattcacatcacataaagatcaaatacatcacaaatccaaaaaaaacaaatcttccttgggcagccgccgccgcttctcccgttgcgtccccggcatggccgccgccgcccccgcccggcggcctctaccgcttctcccaccgcctccccggcccggcaaccgccgccgcttctcccgctgccttcccggccgaccgccgccgtccccgcccggccgtcgtcgaccccgctcggcggtcgttgccgcttctcccgaccccgctgcgagagagagagagagtgagagagagagaggacagagagagacagcgagagaagaggcgcgaggagaagcgctcggtttcgacgaggagataaggagaagtctctggtctcgcgcgctagataaggacatatatatatgcgctaagagataagtatctcatctctagttcgatcaagttaagacgtgggagggagatatttagtcccggttagagatatcaaccgagactaaagatctattttttagtcccggttggtaacaccaaccgggactaaaatcttcggcgccttgacatcgtctgatacaaacccggttggtaacaccaaccgggattaaagtcatagtccccgtgcacttttaaaccgggactaaaaactattgtggattttggccaacccatgaaagatggtttctccagtagtaacgatgatacgagatcgtatataaggggttgtttagatccaggggtttaaagttttggtgtgtcacatcaggtattatatagagtgctgcatggggtgttcgggtattaataaaaaaaactaattacagtatctgtcagtaaactgtgagacgaatttattaagcctaatcaaccagtcattagcacgtgtttactgtagcaccacattgtcaaatcatgtagcaattaggcttaaaagattcgtctcacaaagtagtctcaatctgtgcaattagttattttttaacctatatctaatactttatgcaggtgctaaacgttcgatgtgatatggtctaaaattttagattggtatctagaccggcctaagtttctcaacccactagaaacccagtgctataagtttgacaaccgcggtgccgctactgtcctaattaaagtcatcggcagacgtacacatgcatcgacgcagagagagttgtaaccaaaaggtgcagaaaaatctgtaattttcagcttcttgaaacacttgtgctgctgctgtgacctgtgtagcatttgcctgtgcgggtagcggcggttgttgttaatcgcagacaaacccacgagttaacccactgacgcgccgcgatttgtttaagcgctacgaggcaccgctcccgaccctacgaacgtgcgcacgtgacagcccttgcccttgcctaaagccacgacttaagtggctgttaattctagttgtgtttaccctcctgctgctgcccagcaacaatgaccgcctccaccaccatcgcgtcaaaacctagctccgtccgaaattaaaccctctaggttagtttggagagagtgatgcccagcaatattgttttaaccatattctttctaattgataaagtaagatgatcaccgcgccaagataggatagggtttctaaattaagttacacaagttctactacgtatagtaattgagatttgttccagtccaacaaaaagtacctcgaggtaccggtatctcacggtaccaaatcgttttcgatcgttgtatctaactgggtaggatgtgcattgttagatcatcaaacataaatgattataccgtaaagtactgttatctcgaggtattttttttaaggaccggagctaatctcacagtgggctgttagattagattgtaaatctgcagttgggctgcttttgttgtgccgtacaagaagatatagagagactgaaatagtgtgggaaaatataggataggaaatagaacgaatttataattaattgggtattggataggcacttttaaaccccgcattgatctataaatttcagcaaatttatccacaatgaattattttgttcaccttgttcactgagtattaaaccatgttatttactccacatttataaaagaatatttttttaaaaaaaactttcttcttataaattacttctaccacttatttgaagctactatttgttaagcttatttcttataatatttaatttatcactagaggttgtgtttagttcgtgcgccaaatttgttttaagtatatggacatacatttgaagtattaaacgtagactaattacaaaacaaattacagattctgcctataaactgcgagacgaatttattaagcctaattaattcgtcattagcaaatatttactgtagcatcacattgtcaaatcatgacgtaattaggctcaaaatatttgtcttgcagtttacatgcaaactatgcaattgattttttttgtccacatttaatgttccatgtatgtgtccaaacatttgatttgacgaaaaattggaagtttgaagaaaaaattttaaatctaaacatggccaatggccgaacaaataattcgtgacaataatccgcttaataatctaaatcaaactgaccaaacccaagttggttttacgcaaggtgactttggatacacttttttttcaccaatcgtttacttgcggttttcaatctaaccattgattggaattcaacgcagcttttttttaatttcaataaatttggtttctacttgcaaaattgcaagtgcttttgttggttgggttaagagtaataatctaggttgtagacttgtagtagctcatgcacgtcaatattcgtgcacattagcgtttcccctatgctgttgaatttcacctgtttgttttcgtgtctcttgggaaaaaaagccaggcatattttttgaattgatattaaatttatattttaagtttgacattaaatggatttcaattgatgaagttctagcaatttttttgtctgagtttgttgtttgcattctgttactagactggttcacagctcaccctaatgatactgtagcggtggatctttatagtgattaatttattggttttttgtggcaatataataactccaatattattggtactacggctagcacttaagtgatactgtagcagtggtactttgactcccaacttttaattccacaccttggccactgccccctgcatcatgctagctttact

SEQ ID NO: 103840 - DNA, 542 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgca

SEQ ID NO: 103841 - DNA, 766 bp, Oryza sativa
gttagacatggagtgaacaaaatgaagagcaataggccaagaattgactatctgatagcatttgacttttaacaagttctatgaggtggccgagaagatttaattcttctgtaggagcaagcaatttctataattgggaacattgtcactttttgatggtgatgacaactttgatttcatgtttcagatttgagaatggtaagtgttatttggaattatccttttcccttgaagacaatatttccctttgaaagggtcaattaggcctagaggggggtgaataggctaatttaaaaacttaagtaaggcagaagcagtaatttcgaaactaggcagggaattttcggaacttccaaaaatgcaaagaaaactctagatctagaagtctaccacagggaatccaaagcgcaaacagcagctagaccaatagcggcacaagcaagtgaagctagaggagagggatgaagagatatactaagatgaagcttgcaaacttgttcccggagttcaaatccttgaggggattctactctccgttgaggagctcactaagagccgggtcttagctaaccctttcctgaagaggttgtactaagcactcctccttccactaagaggtatcccttccttgcggaggcgagatccggccttcacaaacttctcccggccaaccataagtagatcggtggctcgggagcgacacctagccgtctagaagtcctcaacctccaagagtaaaagatgatgcaaataactccagaaaatg

SEQ ID NO: 103842 - DNA, 1253 bp, Oryza sativa
ccttcaaatccagcgcaatgagggaacagcagcagtgcaaagtgcgcggcagccaatgggcaagatgaggagcggccggtggtgggctccttcaactccgacgcaacgagggaacggcgacgatggcctcctccagctcccccgcgcgcgtggatctcctacaacttccacaccgctgcgtcctccccgagccctggcgtggcggccaggatggaagatgaagacgacggggagggccaccggcaagctcttctagcattggagggaggaagaagggccaagggtatttccgtccatgatggtattttggcgaatgtcctgattgagaatggtattctagcgaagccaatttaagtgatggtattccagcgaatccaatcttatgcgatggtagacatgcaattttctccataaattgatgcaaatgatgctaacctgcgatgtgaaagcaaagggtaattcagggttgcaccacagtggggtttctcccttgctgcttctctttgacgaagggccaaacgttgccattcatactgctcagagcatctatatccccctgatgcttgtactctatcaaaaccaagtccaaatggcagtctgtccggacccatttaatcgtcaatcgttgacacaagattggactaataattcttgcttctacgatgcagatgaggctgatctggtgtatacatccaattccggaataaagctgtcaagaataagaaatattcagttaaaagttacaagacgtattaaacagcacagaaaaatttcagaactaccagtatgttactctgctaagtactctgtttagtaaattgtaatttgaagtctcgcaactctaaaaacctaggagtttagagaaagctaaatgattgtactggattatttttctggaacctagcatattgaaaaattcaatagaaagataaatcaacccaaatgtttttctcatctattacatgtggtacagagaatagttcaccacaaagaaaccaatttactcccaagtgttgtcctcatcgataacacatgatgatgaggatttatatggcaaccactttacaactgcaaggatatagctagctggaataagttggtattgggggacacttcttgtgaaaccttgagattactcagatatttattttgcaagaatctgagcagaacatcacctgtatccacgtacaagtatttgtcatgttcgcagaatatgtgccaaaccagagagtcagatccaagtcagatttaac

SEQ ID NO: 103843 - DNA, 660 bp, Oryza sativa
agataaatatatatgtctaaattcattaacatcaatatgaatgtgagaaatgatagaataaattacattgtgaaacagagggagtacgtaactacgtacatatacctaacgtaacgtaatggatggaagcggtggggtgtgggtctttctttttttttttctttaaggaaatccgagggtagaaaatacgggtgcaccgtatattagtgaaaatcgatggctagatgttttgttttttctataatttttctagagtgatacatggtgagatgagagtgtttgtagaatgccatataacggtttgagaatgttttaaggatgcttaatagccttttagtatataatagattatcaaaaactaactattatatatcagccccatgtgtcgtgatatatttaagaccacaatataacttataatttaattaaaggaaaacaacggaatcagaaattagatatataatttaaaaataatttagaagatggttcaaggaacattggttggatattttatattattattatagatcttagtttaactatatatatttatatttgtgatgtaatatattttagaaaatcatattttatttaaagatcatcgatttttatgatgtatttttttgtcgtcttttttatgtatatgcgcatggttttttt

SEQ ID NO: 103844 - DNA, 2941 bp, Oryza sativa
aaaggaaatcatgaacctgcagctgctgctcatgcatgcatactagctaattattgatccaatggatgatgtacaatatttttctaaaaacagatttaactaactgcaccaagaagcagatcgagatagtataatcagagctgtcgtttagccacacaggtatcatttccatatgataatgaatagtatatctcatcagcagccatgttgctgataatatacagtgatttttatatgcttgcaagtggccatgccatgttcatatttaattatttcaaccatcatttgcttgcgccgttattagtcccaatctggtctgttgacagaaaatattaccaccctcaggattagctcgctagtcatggtagtgattgagctttcaagctcgttaaatttcctcagtatttcgtttttcattacaaggaaaacactgtgttcttgtagtagaatcaatcactatctttgctgcatgtttgacgggatcgatgagactagactgttactatcagtactctgggacaatctttgaaacaaaacaaatgttaattgcctatatgcaaccagtcgatattgaccgtctcactgcaagaaaacttcatgggaagacgcgttaaaatcataaaatggatgtgttacaaacggtttggaaaaaaaggggtttcatcgtctttcatttaggaactaattttccttactttccgggaaaaaaaggagaaccaatgtctttgtttgagccatgcatgtactccagataaacatatatatttacaaatacacaccaataatttgacactatcagatcagtactatatactatatgtatatatatatctgtagatggaaaaaaagcctacaactttaagtcatcgtctcacccaaccttatgatcatctttcttaattaatcacacaccaaaaagcttaactatctttgagacaaaaacaagtgaaaagccgtttcttagtggggataaaacaaagggtgaagtcagaggaggggctcccattggcgaagcaacgtggaagggccgaccgcgtggcaggaatcttcaatccccggccctttccgcgttttaatgagctcagcgaacggacgaaacccttacgtcggagagagaacaaaaaaaatggcaaagccaaagcatgtggacataattaatcacttcaacactactactgtacttctgtttcaaaatagtataaatgtttttagattatttagcaaatatactaagatttaggacaaaagatttcattttagtcacttaatttagttgttaatttttcaaatttaaattactgagattcccttttaaaatgttagctaatttgattaagtttgaaattattgaaatatataatgggaatcatgcttatatatcgtggtataaatttaagccttagaaatgcttactactccagtttggtaggaactaggaagccagagtagcttgctgtgagctgctactagcatccatcagtttataagctgttggctaagcaagcgtggccttttgtgcaagccgatgtgtgcgcccacctgcgccgccggccgtgtgtaattatcctgcaagttcatatgcacatgtttcagtttggactttagccacttaatttcctagggattttcgttggagtaattaagaacctagcaaaggttttccgtcctagctacagcctgtaagtacacctacatatacatactaggagtatatgttttcttatgtctggattaggatttcatacacaaagaggtccatgtgtaatcccttcattcttaattagatagtataattagatgatttcctaattaagacacttgcagttaaatatttcaaattcaaaataattactacctccatattttaatgtatgacgtcgttgcctttttatctaacgtttgaccattcgtcttattcaaaaaatttatataattatcatttattttattgtgacttgattcatcatcaaatgttctttaagcatgacataaatattttcatatttgcacaaaagttttgaataaaacgaatggtcaaacgttgattaaaaagtcaacggtgtcatacattaaaattaaaatacagagggagtaatatatacaaatatgtgtattttaacatttaaagaagttatataaatatgttactccctccatccctaaaagattattgttttagcctaagattcttcccacaaaaactttagttttagattgggtcacatttttaatactactttttcttcttgttttaaccattgaactataatagtagtccctagttcttctcattttctctacatttttaattttctctccacataatgaaagatatttaacattttacttaatatatgtctttggctagattaaaaaacaaaaacaacggtcttctaaagacagaaagagtaatgaatagtgaagtgcatcgtggagaccgagtcgatgtaaacaggtccagcaaaaagggtcagggaagtattgttaccaaatggtttctcctaatgtgtgcacgcctcgagttaaattttcttgtccactaaaatacgtgaaaaaaaaaagacttaatgattgcgaaagcttgcgctcccactgtatcaaattcatcatatataactatatattacaattgatgatatccgattagtacacatattgtgtatctctacacaatgacttcaggatgtctaagatttgtcaaaggcatagttcagtgtcctaataagcataaatgatgtaccaataacgtgtcaactttaagtgataaaaatagcactccttccctttttgaatatagcaatactagattatgtctaatataataataggttgttatactttggaacagagcgagtaggtgtgtttgttatagaaatccaaatatgaatcatgaacaaaaacagaacaaaaacatcgagccgattcaccgagccactccaca

SEQ ID NO: 103845 - DNA, 557 bp, Oryza sativa
attagggcagatgactgccggagacaatattatctgccgtgaaagctttagagtatctacggcagataactgccggggatttgatacctgccggcaaaaggcattccctacaggactttgtagggcagttaactagtgccgggaatgctttttcctggcagatgagctgccacagaaacaactttctagggtagttgcactgccataggcactatgtcatggtgtagtgccatctctttctctctctctctcaccaccatcgctgctcgtcggccatcgccagcacccatctcactctccggaatcacactcgccatgtcgtcggtgagggtggcggcgcttcaccacccacgggccttcttcgctccagccgctcctacctctctccgccgctagtcgccatcgccagtgagttcgcaggagctcagggcgtttggcggtggtggcttgtggtggcggcggtagtgtggggagggccgtgaaacgaagtgacttgtagctcttccgcacctggagtcgcggctggtgtggagagtccctttctcctctgtcgccac

SEQ ID NO: 103846 - DNA, 3120 bp, Oryza sativa
atttttagttatttaagtaatagtaacaaaaacacattacatttgtaaaaatctattataatgatatgcacatgtactatcactccttgcactccccctaataaaaatgatcaataattataaaaacaaatgattataattctgaagttatatctcttttttagtttgtttgaattgttgtttcatttataactaaataaataattcaacatccatattacccatatttcactatataacaatagaaatatgtcatttgaacatagatacctatcctttgtatagaaaccaaatagaaaaaagaatactaaaaaaaacaagaataagtattatttcacattaaattattttacatcctcagtgttgcacttaaagcgtaatgtgttacgtgttaaaatttaataataaaatcttagattataaggggaaatatctgaccatccattcccacttaaatttttaaaaataaatcggttattacttttcattcaaattggaacaataattgctcaatgttccattgcaataaataatttttaagtgcttagatattaatgaccttccatctatcctatagtgtggcatgttaatgcacatatatgcgacactaagataggagtatataattggttagaaagttatattagttactactaattttttttgacaaaattattactgttaaattaaaacttactcatgttgactaggtattttcttaaaaaaaacatattatatatcacacatatcataggaaaggaagcaaggtctacgatatgactatttattcatatgtaactatgtaacaaattgcaccaatgtgaatcaacaaggaggataacttgatgatacaaaaacttatcttctgcatataagcattctcgtgtacacattgtgcacataaactaaaaagtatcacaaaaaaaatctagaaaatattgtcttacatctatgtgaaaagtcccagcttacaattagttatatatatgaagaaaaagacaaaaatatgatagaattatactcttaaacctgtcagaatttttatcttttttaggctaaatataattaattggaggttaaaactttacacataactttaatactgttgtaagtatatgtataattttttttagaattttcaatgaaaattgttagttggtgtgtacgttgtgtacacaaaatacttttgtatagaatatgtttcttaaaaattaaacatacttatacaaacctgggtacacatgtgtccaggtttatggtcaggattgggtttcatgggacagagggtgcatttatttacaataatattccatctgttccaaattataaggcctatatatttttacacggtcttcaataacataatttgactagcattttattccattatgtgatccaataaatataaaattagcatcacatgaaagtacttcaaaaatatgaatctagtgatataacatgcatattacttagcatagatatagttagtatgactattagtcaaaagctagcgagtttgatttcccttaaaaagagggcgccctctaatttgggacggagagagtaacaatttaggatatgtgaaaaagcccctaaatattgaattaaacaagaaaaataacatacttttaatttataatttgttagacatgttttccaaacaaactaaacctaacctaatggagagtatatataattatttataaggatgtattagtatatataattatttataaggatgtattaaatattatatattttaaaagctaataaacaatatagaaaatttatgtaaccaatgccatgaacaaatttatgcacaaataatactttttaaaatatggcgggtatcatctgattgattctccgctctaacaagctttttaaatggaatctacagtgcacgcggggtacctagttgcttctaatattacttggctggtcaacttccggatttaaaagtctgcactggctaatcggtcgctgaccttctgttttttgttttgacagctcggctcttcataattgatgatgtaccttcccttaatcaaagctatgccaatactagacaggcattattgtctaacattaacgatcaatctaaaaactctcattatttaagttgttaaggtttttttccccctgggaattaagttgttaggggcaatttcgtttctacccctactttgatgtctaatattaattttacccttactttttagggttttcgtttttaccctcacttttttgaactgaatgcttgttttgcccttactttggatggtgaagttaacggtgttaagtaattgataaaatgatatttataccctctcatatatgtacataaattatgttttgccccattttatacatgtagctttggaactttatttttgggagtatatttaaaattagatgacgcacattgactaatataacaatttggacaaattctgaatttgatggaattttgacaaaatttcagcattttgatagaacttaaacaaacttttgacaatattttgtaaaatgtaattatatatttcctttagatattagtcaatgtgcttcatttaattttaaatatactccaacaataaagttctaaagctacatgcataaaatggggacaaaaacacaattaatgaacatacatgagagggtataaatgtcattttatcaattacttaacaccgttaacttcaccatccaaagtaggggcaaaacaagcgttcggttaaaaaaaatgagggtaaaaacaaaaaccctaaaaagtaggggtaaaatcaatattagacatcaaagtaggggcagaaacgaaattgtctcaagttgttaagttggttgcacaaagtctatggttctcttatattgaaactggatggtactccatgcggtactgccggatgttgtaaacttatatactcataaacaaagtcaagtctagaatgtttggaacgtgaactgctttgttatgattagtcagtttatatttttaaaacgagtggtacagacaaattgtatggatggcgcatcaacagcttgtatttacatcattagagacatgttggtgtcatcgcgctaggcgaaaatttggagtctgctactttggttctcgct

SEQ ID NO: 103847 - DNA, 3322 bp, Oryza sativa
atcatttatctttgggccgatgtcatatatgcatcgatcggcagtcatgaataagtaagaaagaactaaatctactcgatcggctgtagatattaacgatatgtaatccttatgtcgatatatacttaaataaagtgattgggatagattggtcgctatgccgagatagtataaatcacttagatcgaaatatatattaacaacaggactatatatgttcatagcatagccgattagatggatctagcgtgtatcggctaatactccgataccactctatattaagatatcaaaacaagtaaaatataccaaacaaaggcctaatatacttaaatgtaacaagatcttaatataaagggcatatttaacatgtcaatcaagcatataagataaatgtaattaaatcaggtaagatcggctgaaaccccgatgctaccctaatcgacaaccaaaggcaggctagagattgagattctaatctcgactcataagatcaaactcaactgatgcagctataagtatgaaaagaaggacaatatctagacaatcaagccgttggatgtttcatagagtggtagatatcatatataatctaagtcaacgtcagtattcaacgccttctagtaacagacgttagccgattaacggttagatagcgatattgccggagattacataagatatatgataactcgatgaattatataaacaagattagagtatcataaagatggaagcactaatcccgagaacacaagccgccataacaagttttacctctagtcgaagatcgaaaccgatgcagctcaacccgaaagcaagaactcgtcgaaacaaaatgaaagtaaaagggtggcgatgcgccaagattgtattaaacgtgtgttgttttattacatggggttcggggtctatttatacccgagattacaaaatatgtccatatcggacacaactcttatctctaacaaactctaagataccataagtttttgcggcagagttttgcccaaacatatatctaaggaaattgcataaaacatcctaactaatagatacaattgcattctcatgactcttatccatgcgtggaaatcctcatgaagctcattgactcaaccagacaacgtattccttgtcatattgtcggattcggctcaatcggctaaccctgtccaactcggactctgccgatataggtcgcagctgattcggacttcagccgatcccactctgtttccggaacgatctccatctcgaactccacttcaattccttctccacctccgatacttggattaccaaatttggtcgttaacacataggtggcggagggacgctggcgtggtgctggtggcaccaaggggttggtttgggtgatggtcgggaggccggcacggccgatggtgcggaaggctgacacgacgacgatagtgaggccggtgaggttgtttggcgggggatgtcggtacaacaatgaccatgtgccgatggaggatggtcggtggtggagcattggagcgttatctatgagtcggcagggagcgggcggcaggtgtacaacctagctcgatcttgccgggccagcaacgacagtgttttaggtgttgttttccctcttggggcactatcaagccatccctctccctcgggtggactgctgactggaaaccttgtcttggttctcctcaagacctcgacagataccgacgtcgatgtttagcgttgcttttctccttggagacgtcatttagtatgcctcctgccaaaatctctcttggacatcctgcgcgtgccctctctagatggatatcctcttgcgctggcgccctagtcgatgcaagcaagccatgttggtgggccttgttgtgggggggtggggggtggggagggagcagttccatcttctctctcactctcttcccctccgaccccaaggacgtggatagagttgtgcacggtgctcattgttagggtttggctttggccggctcaggtgtagcttctttgttggccttgcagcggctagtcacccttagcagcggctagtgctagggcctactcttggatcctatataggtgctgtcaatgtgtggtgtgtggtcatggtgtttttttttcttttcctggttactatcttcaagagtgctagccttgtaatttttttcatactctattcgatgaatcatcgtaccgtcttgtgtggttcgttaagaaaaaagaaaccattatcaaagttcaaaagtattttcaagatctttcatgactgtttgcttgtatagtttaaaatactgtaatttaaattagtctttggttctttcagtctatgtaaatagtgataaaaaatctaaaaattagatatgtaaattgtaatgcatctatcatcctaccaaatttcaatccaatatacgatatatcgactctgttagagagagaaatacccttaaagaataaaatggactattctcaatagttgatggttataaaatgagaacaaaaaagtttaggggttatatgctctgttaaaatagtttgacggagtaaactatactcatttcttaataatttaaaaagagtgaattatactttggttcactttttattatctaagttttactttgaactacccttagacaatctttttactttggactagataagattacctttgttacactttatacccccaaagtttcttctctagttgtattgacactctcatctaactaataatagcgtatgtgtaagtcggggtgattgccagaatacaactaccgatgtgcaccagtatatcgttgatgttgttgaaaaacgattttggggtgatccaaagtgaaacaaaggcaaaataacctaatccaaaatgaaaagatgagctaaaggtgtctaaagtgaaaccactactacacaaatgattttcctggacatggagccttttagattgcgtgtagacgataactcgatccgcacgagaaaatcggctcattttcccatacggtccatttaagaggaccgcacgaaaatttttcccgtaaaatgagctgattttcccataccctattaagagagctgcctataaacataaccatcccatttttccctcctactacttcaaaattttccaaagtgccgtgcgcctcgatcccctctccctttttattcggcgcagcatgggacgtcggactcggtgctcggcctgcgcgtgttgacgagctccgggtcgatgtacccggcggtcccgagcacgactttggttgtccgtgacttggcgccattgtcgacgagcctcgctcgccaggccgaagtccccaagcttgggctg

SEQ ID NO: 103848 - DNA, 1369 bp, Oryza sativa
ctaaaaacacataaaatcgacacctttaagcaattataggtatcggttttaaagaaaaaccggtattatagtataggtgccggtttttatacaaaaccgacacctaaattataagtgccggtttttaaaaactggcaccttaaataaattataggtgtcggttttgtataaaaaaatagcacctatatggagccgagccggccatatccatccgcccgtccttatccatccgccttatccatccatccgaccgagtcgctcacgtctctctctcgctcttgctctctcgcctctctctctcgcctccctctatccctctctctctctctctctcggcggcccggcggtggcccgtcgaggtaggcgtggcggtggctggcaacggcgcgccctcccctccgccggatctagctggaggggaggtggtggaccttggggacggccgggcggtggtccggtggaggcggttgcggcggccgcgccctcccctccgccaaatccggccggagaggaggcagcggacctcggcggaggcggcacagcggctggcggcggacctcggcggaggcggctggcggcggccgtgccctcccctccgctagatctggacggaggggaggtggtggacgtcggggacggtcgggcggcggtccagcgaaggcggtggcgccagcggcgcccgatggatttgttggatgattttatagttcttttagatttttttgtgatttgtggatgattttatttctgaatatgtttcatctgtgatctgtgatatgtgatttgtgattcgtgatttgtgggggtttggggatggagtagtgacgatgattgtgagttccggctcgattcgagtcggctctttttttttttggctcgtgcaaacttataggtgccggttctattttggtataggggtcggttgtttttattggtgccgaccaataggtgccggttggaaaactggcacctatagccggttcccaagcggcacctatgatggtattttactagtgtcaggtgtttggaattttcgaagatatcacttagggtcttttttttttttctgggcatgtggttttgacaagccctatacatatctttgtataattttctcctattatatcaatataggaggcacaacttttgcccactcttaaaaaaagatattaaagaaagttccaaatgcatgcagatgcgaccggaatgcttttgaattggaacagggaccttactggaaaaggtgactcacacggccggacacctctccattttgctgtatcgatagaaccacccacgaagattccatattaccacaagatattgttctccatcatgcgccacatagacatatacactctttgtttgg

SEQ ID NO: 103849 - DNA, 667 bp, Oryza sativa
tttgcgccaccattgattggtggcctccagagaagtgcaattatgaccagtgtccatgggggcaagcttctatcttaaatttggtaaattgctaatttcccaagaatgtgtgtgttttatcatgttgtaattgatatttttgcaaagaactaattttgatccttttgtgaatttcccaggacttgactaatcctttgctagctaaagctatccaaggtgaatattatacctattttctgcgaacaattttctactgtaactaaaaaaaatggacaacagtagggaatttccatactaaattgcaaataggattaaagttacaaagtcaaagactcaaagaattcttgtcaaagatttatctgttcctttgcaactacatatgccagcaactgtgatcaatttcattctaccgtgtggaggtttacttgttacactgactaatataagatattagagggtaaatcccgttttaagaaacatattgacatttgtggttcattctgtacctttatttattaagcttggaatttgtttagagctactttccacaaaatgtatttgccttcttatggttttatacactttcccatgattcatggactttttttcccattcatttgtatttggagcatttagccctcaacgaatcagacgtgtaggttcctta

SEQ ID NO: 103850 - DNA, 1433 bp, Oryza sativa
ctctactacaacaagttgatgataggaaattaattaaacatcgtccatcatgaaaaagggaaatccaaacctagtgagcatatgtaatttgcagccatggggtggtataggaaagctcaaagctcgttgctcggatcgattcgtattgagctgtttgacatcgtagtaataacgagcagagccagattagacttttagctcgttcacttaacaatgaagcccggtgtagaaaatacgttccccgctaatattagttagaatgtgaccatatgtgttcatatctttttatattcagagtttcttaactaggacttaacgaaattccaaattaaactatttgcaattaatgagtagttcatgtttataattatgttaatatatactctctctatccagtttgataatcatctaagattttttaggtctacctaaaatgatcattctctaagagcacccgcaatggtaaagtaaggtgctctctataaaacatgtacatctcagcaatagactagattaatagtaaaccacctcaatagtatgtctacatgggtatctatagctctctcatgtattgcctcatttttctctatagactatctctaagttagtagatagctttgctctatctcttcatttaatatcttccaagtaggaaaatatactgacatggatcttttgtagagagcatatagataaccattatgggtgccctaacaagtgcttctttatttatttgtgcagagagtattctttatttatttgtgtagagagtaaatgagcatcattaaatgcgatgcatgcactcaactaagattaatttctattggtataactacgtgcaatatttaaaacttgatgcaatccatgagatacgaagtaacgtactccctccggtttcattttaattgacgttttggataatgacacggtctacaaaatatatctttgaccttatttttctactataatatatataataaataaatgtatgtttacttttattatagtgctttgaaagacaaatctatatatgttgttctagtttatttatactaaatatttttaaagttattgatgattaaagttataaaagtttgacctcaaccttatcgaaaacgtcaattattatagaaccggagagagtagtagcttaaccggtaagaattaattacagtataatgaatgtttagttgtccttggtctttgcgctctttgtttatgtgatgattaaaatggaatggaggaagtaagtaattagtaaatgttataatttgtagttaagtgatataaatgagacggaactaattaccgagcccgtcataaaccgggctcgagaaaggcttttagcttctttaaagttaacgagccaaactgagtaggctcattattaattattactccatcccgtttcatattataagttatttgaatta

SEQ ID NO: 103851 - DNA, 549 bp, Oryza sativa
tcttcctagcatgtttttttgattttttttactgacgacaaataccatagttttctcccttttttgcttttcttttctcacgcgttttttgcttttttttaatgttctttttttgctttttttcccaatacatgagaatataaaacgaaataaaagccgtgtaatagatggcaaaaaatcgatggatcctatccgactcaagcgtccatcaattaagcgtttttttctgacagttttttctagagcgatttattttttaatagacggtgttttttcttgcgcggttttttcaaatcattttttagaaatggcgcattttttcttacattttttttccttgcatgcttttttgaaaaaatttaccgatgatggaaatagtatttctcgcacgtttttttaatggaagatggaaaaaacctttttagcatttttttgcgtttttttctcacgcattattttgaaccgtttttatttttctcgtgcattttctctttttaaatagttagattagattatagatagagaagagatatatactgttagaaatcg

SEQ ID NO: 103852 - DNA, 1552 bp, Oryza sativa
tcgagctcggtacccgattagcggcaaacaacaacagatggatgcacatgtgaaaccctttctcctggagggaatagatagatcaaataatagaagcatcggtctaaccttgtacgcataacgaacataaaccaatggcctcatcgtttggcatattcatatgcttatcagccaaaatttaaattttcaacgttaaatttatagctgattttaggatttttttatcgaagattatttttcagcctttgcttttagatcgctaagaacatatatataaaagttttattcacaaattgattttcgtttgtaaatatgccatttggcatattcaaacgatgaggctgcaagtacggccaagtacgtcacgcatgcatatgcatgggttgggccaggaccaagcgctagcggcgccccacatgcatgcagcagtgatcgatcagcctcccaatatgcatttgcatgcgagggtttgatcgatattgcatgcatattggtacggcacccgagacatattggtacgccccatctttttcttcgcttttttctcccctccctctccagatcccgactccctcccgtttttttttctttttcttagctttttttctccccttcattctcgacgccctcctcgtgttttctttgctttttcttctcccgttccggtgcccccctatctatccgtctcttattttttttcccatggaataaaccttcattttttttctcatttttttaagaataattcaaaacttggacacatgatctcatagttcatagcaaagccctcctaaccaactcaccctacaacactatgtgttttgagatcatatattgttttttttatctatatatctgttcaaattttgtgaacccaaacccgttatgtactgtaggaatcatatcttgttactacaattcggtagtaacattatcgaacaagtgcagtaacacgacacgttactgcgaaatttacaggtcgttgctatgaaatttatcggtcgttactgtactttttgcagtaacatcatgatgaaactgtagtaacagagaacatatgttagtaacggtagtactatagtaccactgcttatgcattgctaaatttttaaatctcaatcttatgtaacatacaagttgttaatatctatatgaatgttggtaatgctagaaagtcttataacctgaaacggatgtagtaatttatagaaacacccagacatgtgttattaacgtataaaatctatatgctttataggtggattacatgtttgcttgtttccatcgtattatcgttatggatgctctgcttagattaattccctgcttttgatctatatgctatggagaaaaccgtgtgagagaaatcactaaaattgatgggaaatcctggattggagacatgcctaattcggttgagccgaatcggccgactcttccgcctccctcgcatctctctgtttctctctttctctaatgacgccacgccgggaacacggtgacatagtctcagactgtttggctggacttggagacatatcgatcgtcgttc

SEQ ID NO: 103853 - DNA, 693 bp, Oryza sativa
cttcaagtccattagtgttctgcttggcaactttagaaggatgagaatcattaaatactacctgttgtatacatgtggtgtaaacaagatatttatttattttcatcactactatagtgagccttgatatttagagtttagctatgtagaagctaccagtttagcatgtaacgcttgtaaataatggcaagaaaataacagttttatgtacaagatagcttgtccatcaccatccaacacaataacataactgctataaaataatattacccaagaagtgacacaagctttacagtggattccaaagtaaaaacacactcaaaggaatcatgacgttcattctcaagcacaagtcaccaccaacataacctactgagaaactttgcaattcacatgcttggacagaaatagaaaatatggacagtacttcaaaacagggaaagaaacttactgttgccttcagcctaaaagcaaatgaccttaaatcataatcattattcttcatgtcccagatgaattcatcaaaagagtctgggaccttcaaatcaacaggtacttcttcagaatttatttcgtcaagcatcctatacaaatccctcatgaccctctgcgcattagaatatagaaattaaataaggaactaagcaaatccacaaaattgaaaggagaagggtaatatcagaggagatgtga

SEQ ID NO: 103854 - DNA, 712 bp, Oryza sativa
atgatacttaaggacttatctttctctttgttgtgcggcttgatccatcataatttatacatgttcaaatttgttcatagttgaaatttgtgtggtcaatgacttgctactaattcatgagttgttactatcagattgtctaggcagacggttaggtccacggcttcttggtaggggcaacgatggctccatggtactcacatctcctctgatattacccttctcctttcaattttgtggatttgcttagttccttatttaatttctatattctaatgcgcagagggtcatgagggatttgtataggatgcttgacgaaataaattctgaagaagtacctgttgatttgaaggtcccagactcttttgatgaattcatctgggacatgaagaataatgattatgatttaaggtcatttgcttttaggctgaaggcaacagtaagtttctttccctgttttgaagtactgtccatattttctatttctgtccaagcatgtgaattgcaaagtttctcagtaggttatgttggtggtgacttgtgcttgagaatgaacgtcatgattcctttgagtgtgtttttactttggaatccactgtaaagcttgtgtcacttcttgggtaatattattttatagcagttatgttattgtgttggatggtgatggacaagctatcttgtacataaaactgttattttcttgccattattt

SEQ ID NO: 103855 - DNA, 695 bp, Oryza sativa
cgagctcggtaccccgctagggctgtcattctggcaagcggcaacggcggcagtgctggttgcctcctccgcacgcgcaacggcgcgaccggcgactctcctcgccgccggtcaccggtcgcctggcccgcctctcgcgccccgccagccaccgcatcggcgcagatcgacggacgccgagacgcgcagccgcagtcgcgcagaggcgccgagtgcctgagggctcagccagccgccgaccgccgcggccgcctggcccccctgcccgtctcgtcttctccagtctcctccaatccttcgtggcaggtctccaaactccggctccccgctgcggcgctccacctccgactccgattggcgattggacaacactgaaggtcagtgactctgtgacgtaactcaataattttgcctcactgcttattgtcatggctaattagttagctcatagcttaggttgccaatttgtgatttgtgaatggctgaatgggaataaatcgctgctgttattgtaggattggaattagcttattgggtgaaacataaagaggattggggattggtattgacctattgtaatatttgctcattttgaacttgcttgttaaattagtcggctattgatggtataagatactattggtatttatgtgtcgccttttattcaaatttgtacttgtatatgagaattgccg

SEQ ID NO: 103856 - DNA, 698 bp, Oryza sativa
acggtttctagcagtgagaggagttctggcgctcccgggaagggaagactcacacatgcattaagttatagttaagtttaggtttacacatggcagtcctaccgatggcgacaccactgtaggcacccgcccctcgcggtcctaccaatggctgccccaccgtaggccctgcctcacacacatcaagaaaaccactatgcagagatactgcctccgctcggctatttactccgctaggtctatacccatacgagaagtacggttgtactggagtcgtttcatgcttagcttcatggctcggtccttaattgaccagggacggcactagcctttaccggacaccacccaagtcctccagccgccccagtcgaaaacatttctttagttttaactttctttcacaaatcatctcatcaatgtcatggcaatgtggcgctcatatctccacatgccgtatctcaactaccttccccaaggtagttacccaaacataaagcatttgataaatatgagaatgcatagatctaaattagcagtactaagcatttgtcataagtgactagggactcatacgtaattatgggtacaagggaataattagataaccaataatcaaaggcatggcataataacaagtaggacatttatcactacatgcaattttatttataaacaaaacaatttcataattgggatca

SEQ ID NO: 103857 - DNA, 714 bp, Oryza sativa
tttctcttcgtccatggaggaagctggccactgccaccggcggccgcaacgaggacccctcgtccccgtcgccgccattgccgaggatcatcatgtccccgacgcccctcctcctcctcctgctgctgcagcagctggtacgtatatatatcacacacatctatatatctccctctcttctgtataattttcttcttatgtttatgtgtatatatatatatatatatactgtatgtctgtatgcgtgcttgctctccttcttgctcatcgatcagaaattcggcaaaatgtggcgaaatttataattaaacgtccactgctggctgctggtatgtattcaagtgctaattttttcttcttcttcttcttcttcttcaccaatggagatcgatcacttctgtttctcacttgcactgaatttcaattaatttcatgcttcccctgcaccactaacctagctagctagtcccaagaatatgccgatctaatccgccaccatcctaatcactccggccaatttgcttcccaaaatgccgccgtcgatcattacattgggatgaacgacagagaaagagagaggagcagattaattagtgctactacaagacaccgcttcaacacaacccaacggctagtttcaggccactcacatggagtactcctacgcattagttggtgataaatttaatcagcgattttaagcatatatatata

SEQ ID NO: 103858 - DNA, 780 bp, Oryza sativa
tggccattgcttacttcttctgtaaaattgttcatagtatatttttctttgtgtctatggacgacaagataggtctggatgcatttatcaggatgttcgggtgatataattctaaagttgatatctttcaacgttatgaaaccaagtttgccttttgacttgctgcagattcttatctgatataccaatctttaggttaatgctaattgttgatttgaatatacatattaaagatgttcttggccatgtgtagttaattcgtctaaattttcctctatggttccagtagtagagttcttgtttatgaaggattgtgttcagcttactccgaattagttcatgtaagcattgttccactggagtgaggtgcatctcttcttctatgatatccattaggtcaatgatgagctcccaatctttttggatttctaggggtttccatttcttcttgcaactagccttgttccttttaggtttgactgctaggaagcctgcaacatcagtaacatttgtgtttttttcatgcggcttgttgtgatgtatgtgaggaggtctgggtttgaaatgcgggagttctcgaagcggagaaaaaaaagcttttgggagacggtaacaaggaggggaacatggtctgaagttgtatgagttaggctttgaagtgctgagtttggtaggatagagttccatggagtgttgaagaagacgattgatcgatccgggttagggtagggtttaatgtataggctgtaaatcaggggaatttcgaaaatagctagcgag

SEQ ID NO: 103859 - DNA, 642 bp, Oryza sativa
aaatatattaaaataataatttattttctcatataatataatgagactctcccgctggcctagtatggatttcaccggtgcgtacaaacgagcttgctacgtactctctccgtcccaaaaaaaagataaactttaggttttcgtgtccaatgtttgactgtccgtcttatatgaattttttgtataattaatattttcattgttgttggatgataaaacatgattaatactttatgcgtgacttatctttttaattttttcataattttttcaaataagacggacggtcaaacgttgtatacggaaacccagggtttgtcttttttttttgggacggagggagtaatgaataagcatcatcattgtgaattgatgatgattatatatcacatgtgcgatgatgttgttactatacatgtgttaaaaaatatgatgtgcatcccctccatgcagcagctgccatcggcgccgccagtgtcgaatatgatgtgcatccaaacggaggccagggaagaagaaggtcaacaataagaagaagaagaagaagaagaagaagatcagtggtatggaaatacatgacattagatccgtcgggaaacgaggcatcgtgcacctactgcaccaagaagctgtcggctaatt

SEQ ID NO: 103860 - DNA, 672 bp, Oryza sativa
agaagagagcaactgcagattggcaccaaattaagttcacagaaactgatctcagaaaaatgaatgacattttcttaaagaacaaatgtgactaacttttaatgaggccaaaatcacatcatacttaccactaactggtcagaatatacagtaccaactgcacaaaatgggaataacctcaagttgtgcacatgctactaaccggtaagtataactgtataagcaagcacaactggccaccaggctcagtttcacatcaagccatatttcgcaagaaacacccaagagcaaaagggccagtgcactactgtctgcaccaatttaactagcatttatttacccagaaatcatttcaagatatatcagctatatataatggaacagtacattgcaggaactgagcaaaactgctctagcacacacatccaagccatggcctttcaatattaaaaaaaaaaacagcaataacacactcatagatcagtatggcatcacatcaaggctgccataatctaggcaacaaccaaattacacaaacattaaccagaatctttttacacagcaatcatgtcgttactcattagtatatccatatttactgaaacagagaagtgtatgcattagaacatattgttagtagtaaaatgttcatccattgcatgtgactgaata

SEQ ID NO: 103861 - DNA, 549 bp, Oryza sativa
atcggagtatctcgacttctgtggatcaaccgtgctgcatactgctgaagggaaaagggagttggaggtgaggcatctatttcttggccattgcttacttcttctgtaaaattgttcatagtatatttttctttgtgtctatggacgacaagataggtctggatgcatttatcaggatgttcgggtgatataattctaaagttgatatctttcaacgttatgaaaccaagtttgccttttgacttgctgcagattcttatctgatataccaatctttaggttaatgctaattgttgatttgaatatacatattaaagatgttcttggccatgtgtagttaattcgtctaaattttcctctatggttccagtagtagagttcttgtttatgaaggattgtgttcagcttactccgaattagttcatgtaagcattgttccactggagtgaggtgcatctcttcttctatgatatccattaggtcaatgatgagctcccaatctttttggatttctaggggtttccatttcttcttgcaactagccttgtt

SEQ ID NO: 103862 - DNA, 2952 bp, Oryza sativa
gtgttttgtctaactgatgatggttttttgtttcattggtcttcatattcatcggtctgaggtgaaagacatgatttttgtctactggtatatagttacaggctataatactcatactatctttttgtttcgtaagcaacaaatgtacataccttttatgaatggcaaagtccatatagttcctgtattctttccacacttgcttccatagtgaagctgtgttgttcacatagatgcaagtgatgaacattttactactaatgatgtggagttctaatgcattttactttggctttacacttctccgtttctgtaaatggtgatatagtaatgacacggttcctgcgcaaaatgatgctagttaatgtttgtgtaatttggttgttgcttggattaagacagctttgatgactccatggtttccatgtcatgtattgatctatgaatgtgatgttcctttttttttctttgtttggatgttgaaaggccatggttctgaatttgaatgtattgctcggatgcatgctggagcagtcttgttcagtttttgaaaatcacttttccttagcattttcttttcatgttctgtatatgctgatatatcttgaaatgattgttgggtaaatatattcggtgccagttaaaattggtgcagatttctggttcttttgcactttggtgtttcttgcggaaaatggaaatgaatccctttgtagctttgcttatacctacagttagtactatgctttcaaattgggagtttaggtccaatttgtgcagttggtaatgtatatacttaccaattagtaatatccagtaattatgatgtgattttggcctcattaaaagctggtcgtattttcttctttcaaaaaaaaaaagctggccatatttttctgctacgtcggttctgaaaggcacttgtgctgagagcttaatttgggggcactttgtatgcttatcatgataatgtctctgcagtaggtcccttttcctcttaggtgctttcttgtcaaacttcattagttaccaaggcactcaattagttgagataagctcatttcaagttgtaatcctaccttctagaaagagaagaacagaactgaagtcagaaatatttttgtcttttttttaaggaacaaccctgtatgcagtaatcatcctaatactgtatttgacagaattaaatgaaagatgaaaattagatcaaaatggaatgccttttccatcctcttccaccactcttagaatcaaatatttctgtttgcctgtcaaatgcaaatgcagttttgcagggagtgcatatggttgctttctacccagatacagaaataaattgatgctgacttgccagagtgtaagcagaaaaggaagagctgatgctctcagcatgtgctggattgctccaagtaatgatgttctctgaagttaggccagaaggaggttccaaactaattactttgcattaagttagaacttcacatgtgccatgtgataatttttcccccctaaaggaatatatgtcaaatattacatacatctgacatttttctttaaaagaaaaattctgaggtcaataagttactggtcaatccagagaatagatcatcaccatgggccaatgactcaattctaggggatcccaattgaaaacgagtcagattttgtgagtgcatcattcaaaacacctaatcctacaattccatgattggtgttggatgggtcctctaggaacatgagtgtggctctatgccatccatcgtcctgaatttctcaaaatatttcccttaaaaaaataaacaaaatatcatgagtcggtatatgagtttgcactagaacacaacacataatgctccaaaaaaagaatccttcattcgacgactcatatataaaaagtgcgccctctggtgaaaaaagggctaattgtttggcttatgcttatgcttataacccaaaattaaattttagaacttaattttgaatttgatttcttggtttttttcattctactttattttacaacatttgctcttgagtcgctaatgatacatttataaaagttttactcacaattttttttggtaataagtgttttggataagtatatgaatacgctaaacaatggggctttatgtaacgttttgagcaagagactccgacaaattttaaaacttccagccaaatatttatgactagaaagagtatcacgtttatttccgatcatgacgttcatggagctattttttaccattgggtttactttccacgagaaccgataaaaaatcgcgaaatttggaggtttcgacgcacgacgaaagtagatggagagtaaaatttcaaacggtacaggaattcaaaatttaaatagaaaattaaatcaaaaatttgtcgagaactgtcatactactaccaaggatcgggggagccaacactaaattggaaaaggcgaacccctgtgctatcacattcatcaaaattagcaatcagtagtaattaatacaacggtgcatgttaaccagaacaaaatattccctccgtcttagtcgttttgatatttttccctaatcaaacattctaaagtttgaccacgtttatacaaaaatatagcaatatatttaacagaaaacaaacatattatcaaattatattatatgttagttttagttagactaattttatattctagatgctgctaaattttttctctagactttcaaactcaaacaagtttaacaaggagagaaaaaaaatcaaaatgacttatactaatattttaaaaaaagagtaaaaaaaaatctagcaaggctagggtaggagtagcaataataccacacgtgggcagtgggctgggatgcttgtgttgtgtcttctgcttcctggaggaagcaaccggccagccagcggtttggtttggtttgacccaaccatgccacgctggacttcgacccgacc

SEQ ID NO: 103863 - DNA, 674 bp, Oryza sativa
tttttaatacagctgggactattatgaaatctggtcgatcgaccaaagatggtttctccaccagtgtaactgatcaaattattactccttccttttcactttcattagtattttgatttttggaaaatcaaacttgaaagagtttaaccagtaattaattaatatacaaatgcatttagcacataaaatttataccatgagagtcgtcatacttcaaaatactttcacataatatttggtttagtacctatacaaaataaattttataagaaattaatggtcaaaatttagtattaaataattatttgtactagtccatgcatgacttgcttggtaggagtttgcgacgtatgctataaatacaaatacagttatacagtaatcaattgcactactgtactagtagcagccaacccctagaaccacacgcttcaaacatactttctccgtttcaggctataataatttctagcattgtccatattaaatatatagatgttaataaatctagacacaaatgtctagattcattaatatttataggaatgtgaataatgctagaaagtcttataatatgaaacggaggaagtagcgtaagaataaaaattagaaattatacaactctaaatttgtcatcatctcaaatacattactaacatacattatatttcacc

SEQ ID NO: 103864 - DNA, 643 bp, Oryza sativa
tcttcacttgagtgataggagcttttcaaattttcttttgtactgacgatctgtagatcaattttactttgctctacacttctgtgtttctgtaaatgcttgtctgctgaaagaaatggtggtcagaatgaggtgattttaatttgtacactaaattctaaattttgatatatattctactaatcagtcaatattaaactacagtctcaatttttcaagcaaaaccagtatatgatgtttttttttctcatgatagtaatgtgacaagttcttcttgacaacatcacagccgtccgatcatgacacgtgtcctcatcctgcgcctcaccacgaaccccctcttcttccccgatgcgtctctctctcccctcctctctccgcttccgcaaccaaaacctccacagctcgccgcggcgctggcgcggccgcgcaggatgaacctaggacgcggtacagtccaggttcatacgatgcggcgccctataagagcacccgcgcggctcgcacgcgcggcggtcagtttacaagcgccgtccaccgagagatcgagctccaagaatcggaattggtgggatgggtttaggaagctcgattcctcgccgcccgtgaaagcattggtacattggcccccccaagaaccgtt

SEQ ID NO: 103865 - DNA, 1704 bp, Oryza sativa
agcatcccacaatcatgcgtctttttcttcaaccacgcatagcacattttatgttttgaaccaagccgttgctttccatccttacatatttggtgccagcctagctatgctcccaaacatgtacctcgctgctgtccctcgccaccaccgtaggcccaggcggcccgggaggcaacggcttgtttgggttcttatccgttctttgctttgccaaaattttgacaatgaaaaaaaattaacattgtaaaaagaaattattttggcaaaagttggtagggctttaatctgtttgtaaaatttgatgatttgacaaatttttttttgctgttttgattgtattgatattttctattctgacatgtgggatcatttgagtctatgacggtgggttatttggatgtcaattgtcaaatgagtattaaaaaaataatcaaacttctcctttattttccttactaatattgtgttttggctatgaccccaattgaaacaagacaaatattttggcaatgccaatttttttgccacaaaccaaatgggtgactaatttttgaatgcccattttccttttttgtttggttgagtttagctataaaccaaacaaacattacattcatttttatatgtcctgacacgagcttataatatttttccaggaagatttccctttgaattctttcaaggttatggtattctagttctaagcttcgaaccattgagaattaaacttcataataggccactcgattcacaacactttcaacttttgccacttaatttgtaacaccttcaaaaaaaaaatgtcgtcaaaaacacgaatggtttcattccgtgtcactccgtccatccaaagccgcattcgtcaatgcaaggatatacattttttcggtgtataaaccaaaacggaaaagaaaaaaacacgatgagaaaagaaaaacaaaatcgcggacgaatatatatatagcccaatcactgtaaaagccctcgatcgattagttgcccggtgatctggtgtaatgttgtggtcggatggtgatccggtagatggatgctagtaggtgaaactaacatccaagaggtcgatggatcatgcgttgggcctcaagacttttgaggaacgcactgtccgaacataggaacatgccaaataacgccagacaaatttatatatgcaatcaactttttgagcctcgctccaaaatcgatgccgtgaatcttgcacctaacatgtatattgctctaatttgaagactacaaacttattaatcaaccaattaatctgcagcatatatacatggtagcatatgtatatatatatatgctgtgtgcacctggatcctcatgtatgtgaaataatgaggattcactcattcacaacatccgacggtactcctgctattggcggccgcccattataggataattggtaccctttctttctgtttcatattataagtcgttggatttttttttcaaacttctttaactttaccaaatttatagaaaaaatataatatagtattttcaacccaaaacatacatattattaaaatatatattcagtgtttgatttaaggggcaatttcgtttttgcccccactttcatctctaatattgagtttgcccctactttttagagttttcgtttttgcccccacttttttgaactgaaagatgcttttgcccctcctttggatggaagag

SEQ ID NO: 103866 - DNA, 625 bp, Oryza sativa
attgggcataaccagtactatacgtcttattaattgtcacgccgaatccaatctcccgccagaacgcaccaaaaggacaagttgcaaatcattacagcacattttacaactacaaaaacagctattgaacatgtgcatctaaatccaaggaaaaaacatcatgagctacaacagcagaataaaatctcacacagaaataaactgtctcaaaaaacacagaaataaactgccaacataatgatctataactgtcaaaaaaaaaaacataatgatctatatatctgagtcatttacagtaaacttaaacaagtccatattgcccctatgaatttacagataaacaatttatgtgtatgtgccatgtgcatacgatagcagcctacatggtttcaaaaaaggaaataaaattaaccagacaagaaaattttggatatcatcgcgtaaataacatgtagggctgaagaggatttcagttttcactgaacaaagtttttaccatgcaacagctttaggtcggagagtgaaattgaactcaaatcagttgctaaaatcaaataaggagtgggcagtgatgcagtgttaataagatgtggagggaaatttggaagcatagaacgactgtttg

SEQ ID NO: 103867 - DNA, 1274 bp, Oryza sativa
aagatacaagttactctcggtgatggtagcgcacatgagatgaaagatcctcaagaactgcatgatcaacataccatcaacatccaaggctgccgtcgacatcttcgccaagttcctcattgaaagagaaaaggtcaacaacaatggcgatgaagagagatatccatctgctatcctctattcaattagagtacttactatggctggagaagttgagatgaaattaatggcgactgacattgcccgcatatgtgttattcttcaattagtctaatctatagcctagtattgcagctgagatattatcatttctgtaggaacaaattatactttagtttgtagcaaattcctcaagtaatctaatcgagactaaattggaactgggatgatactgctgtaggaacagaattatgctttagtttgcagctgatccttttttaggaacaaattatgccaaagtttgcatgtttcgtctctcacccagcatatgtggtataatatgcatctagcagtctcttaccctattactgtatggtctactggaagtaattgcatgttaaatcttatattttggaattgcaattgcatactaattttttttatctggcattacatttatttttttggaattgttgtgattacaattgagttgtgtggtggattagaatcgagaattgtgtgttggcatgtatccacatgttggtcactgctacgagcattgcagatctgaaatttgaagctgatatgatgaataacgacgagagctgagactaaggacctgtttggagagagcttctagctgctgcagcttctcccagaattagaagctccctcaaacatttcatttttttattcagattccgagaagatatagtcgtaaaatccagaaaataaaatagaaccaaaaattgaaaaactcagtttttccagattctcagaagctggctacaatctccgagcttttgatgatgaagatagaactcgagaaagtgttcatagatgattactcgtttgtcagctgataatttaattgtgatgatttactcagcttgtttgcagtgctgtgatttacttacatatgctagtgaaaacatataaattggcgaagtttgaccaggagcactaaagtttcattgggttttcagttttcacttcattattttgccgtttctctttgaccaaggtcaaccgaactgcggttgagcgaggcggtctccattcccaccgtccgattacgacacgtggcgcgatcccagcggcctaaacccttccac

SEQ ID NO: 103868 - DNA, 629 bp, Oryza sativa
tcatcgagccagtaatctacattgattgttaatttgttccatgtagtaatgatttgaatgatggtcctgagtaatgtaaggttgtgctgtgtttaattcacattaaaattgcaagtttggtcgaaactgaaacgatatgtcggaaaagttgaaaatttgtgtgtgcagaaaagttttaatgtgataaaaaagttagaagtttaaaaaattattttggaagtaagcacggcgatagaatgagaacatacattacatatggcattcatttcatataataatgctactggatctcaaacttgtatatttctgatggtgtgtttctcattttactttttgcagctcaatatttttttctccatgcactcttattctcagattgtttgtcataaaattagtaaaacatcactcatcctgtccaaacatttggaaatgaagcgaacagatattaacggtagctgaggtatgtcgattactttcgctctgaattaacttgacagattctataaggaattataaatgcagctgttaatttgatttacctttgtacatgattcaagattcaagtgcaggagctggaaggtttttacccctgatcaagaagaatatgaaccttatggccagtgttcact

SEQ ID NO: 103869 - DNA, 557 bp, Oryza sativa
aaaaacacttcccataccagcatgtatctgactggaaggaattgcattagttgagtttacctgagtctcatcagcagtttgaggtagagccactcctgactgcattcctcccgtagataaaattggtgccactgatgaaaatccagggggaactaatggtgcaatcaaagcccctgtcccagtagcagcctgtgctcctgcagatacacttgcaccagccatagcctgggtccctgcagatccacctgcaccagccgtcccactagtactcgcaccagcagagtgaaatccaggtagagctgtgcaaatactcttcaaaaggtccttgatttctcccatctcacctctcagattactcagatctgtcatctcccgcctaagctgcaggatctcagctctagcgtcaaatccatccacactatccaaactgttaacggacctggtgcgagccggcatgttcactgacaacgaaattcggcttgagggttatctccaagattcaccctctcccctttttgatctcgtcgtcgcaggtctaccgccgcctgagtcaggtc

SEQ ID NO: 103870 - DNA, 561 bp, Oryza sativa
agctgacagaaaaaaaacgagaatggattaaggagttacagtttggcgtttagagattggtttttggttggcgggtaccttcagtttagtacgttttggttggtcgctgtaggataagatttgggccttggctttcgagaggtaggtagaatgggccttcgagctgtgggtgaaagtctagtggaaaaagtccactttgactcccttaaaaagtcacccgaatctaatccgtgaccctcaaccgtaaaaccggataggatgactccccgaactattcaaactagtgcaatttgactccctgagcggttttgctgacgtggcggtattgacccggtcttcatcccacgtggcgcttatgtggcattacaatgaaaaatattttgtgggacccgtctgtcatttacacacaaaatatattgtgggacccacatgtcatcctttctctctccaaccttcttcctccccctctctctcccttctctctcttttctcttgcagccgcacccgctgaacatgccggtgcagttgaacccgtgcgccacctcgccggtgccggacacc

SEQ ID NO: 103871 - DNA, 574 bp, Oryza sativa
gaagaaatggagaagagtttcagaagtttcagttaaaaattcagaagttcagagttagagtgggataccggttgggtgacgtcgtttaatgaagatgaacggtagagatgaggctattccaaattaccatggtgcatttacggctgtgatcgctttgttgtactatttaccgtttctgtttgtcgtcgcctgcgcgcgacgctgcttttactctgcttcctctgtctcactcgctgctctgtaaaaaaaacctgagatgcctgggggtatataacccggtgtgatgaatggaaaagctatcgaagatcattaaccctagtacttagcttagaaccctagtttttcttgtcttgcggtggccacaaatctgagagagagcgtgttcgtcaattccatttcgggggtgttttggtgtggttctgacacgggtgccgtgggcgcggtccgtcagtacggcaacggcaagcagctcgctcgagtcgagctcccctctccgcccggggcttttcgcgttggcgttgccgcaaccatcggagtcttttgccccgccgccgaactcctgcaaccaggactg

SEQ ID NO: 103872 - DNA, 590 bp, Oryza sativa
taggccggtggatgccctaacggctcttgccgttgccgcagtggccggaaatggaacgcagatgcgcttcgcgttactcgctttccgcttgctgcgcgcagcgcgagaaaaaagcacacgaccagaattccacaaaaccgtgtcccactctcagtctccccaccttttgtcgtgtctccccatcttcacttgttttctcgccaaatcctacgtgagtcgctctctcgagcagtcgagcgcgcacagggcgccccgctgtcctccgcgcatcgccagcccacgcccccgcgaacctgacacgaacatgcgcctcgccactgcagcctgcactgtactacacccctcatcctcctcgatcaattcgtacacactctcccaaccacctccgtcaccctcacgcttaactcctaccccacgcccagcaaaaacatcgtctatggctgtgtttagttggggaaaaggaaatttttgggtgtcacatcagacgtttgaccggatgtcagaaggggttttcggacacgaatgaaaaaactaatttcagaactcgcctggaaaccgcgagacgaatcttttgagcctacttaagccgt

SEQ ID NO: 103873 - DNA, 697 bp, Oryza sativa
ccctaaactctttcatgcttattttataatctgagctattttgtactgaaattttgatagaatacatatgcatttagaacttacgtctagtcctctcttttttttttgaaaattttgaactattagcgtagttcgaaagcactaaagactaatttaacatcaaaaatttaaaatttaaagttcaaacaaacatccatggaaaattttgaaaatattcttgaactttaataatgatgtcatatatggcttaaaaataacagttttaaatacagcttgtataaagaataaaaaaataaatgttatttaaacattaaagtgaacgatttttattagtttaggggtaaaatgagccaaaaaaaaatagttcacgggttaactgatccattgaattagttcggataagtaaaatggatttattttcattaggggaagtaaaatgaatttattttcattataatacaatggattatttattgtcacattgactatgggtaatagaatatcttgtatatttcatcaccgattaagatcaatttttaccagagttggattagaaattagcttaaacgtatcttcgggataaaaggggacagcacgcaaatcagaacgcaacatgttccggccggagaaacgcagaccactcgacagtcgcacacgcgcagccgacgtaactaaccaccttaccaaacgggacgat

SEQ ID NO: 103874 - DNA, 629 bp, Oryza sativa
ctatagggcgaattcgagctcggtaccctatatactatgagatattgtttgtgttctaatgtttagttaagttgggaaaaaacttgtgctcggatatggtttcttgtttgattcatgtgtaggtatgtcttgataccccgggagagtgttgtcgatgataatcgagggtcaacttgggatatgatgacatctggacgatcgggatacatgagggatgcttatcctaaagaacaatttacgtggttggtgaagatttcatgcggcatacgatattggagagtgtgtgcgtatgaaaaggcaaaatcgaatttggaaggagaccaaatttgggaagattggagtctgaattataataagataagttggatacttgtacatgaaggtttcctagtggattagatagacttgtataggttggattcgtggctttaggctcttacctctaggtataaatacaagaggggttgtgagagttgagttgagataaaagttagggttttgaatttagtcgaattttgagagaaaagtgttgttgttgcattttgtaaacatgaattaaggtaaggaagtttgatctactttcaagaattcttcaatttgtatttgcttgggtttggtggtcacaccaa

SEQ ID NO: 103875 - DNA, 654 bp, Oryza sativa
aggcgctcaacaggggtataagccaggactccacctaggacttcttcttcaaagcttctcttactgaatgggggagagatagagcaagaatgagtataaccacagtactcagcaagtcacactgggagatgcatgaataatgcaagggggtacaaggggtaataatatagggttaggttttgcagtaaacagcatttaaaagtcacttagttgcccaaagctattttataaacacgatcctatagctacacaatattattaatcaaggccgtgaaccctggcaacccgaactgggtcccagctcatcccaagccaacctaggccaactattacacattttagttgttaagtaagttttaagaattaaaccactaacttgggtacattgctaggcttgcccataaccgagggcgtggctattcgaatagatttactctgatcagaggtgtacatctttacccacaagacacatctttactccgcattctatggccttggaacccgtcataaacatgtgacataacccttcacccatccgagctgtgaacaaaagtaccgacctatcccagcctacggccggtattctggacaggcaggccaggattgagcccctagcaataggatcaagaccgggtgcgccacacacataggggt

SEQ ID NO: 103876 - DNA, 1477 bp, Oryza sativa
ccttctatatccggtctacgggtatccaccgtcgacaatccataatcctaaaaaaacaacacatcaacatcacattcatcgataatacattcatgaagaacacacattcatcaagaatcaaacatattcatcaagaatgaatcggttcgaggaggaggatgccttcatcaccaccgccactgcggatgaagaggagggcgccaccaccaccgctgccgcttacgaggaagccaccgtcgccacctcccgccgctgagccgtagtcgggccaccgccgccaggcgccacgccgggccgtcggaccaccgccgcctcccctcccgccaccgacccgccgccgccgcatccccttccgtcgtcgggccgctgacgccacctcccctctcgtcagatctggcagaggggagcgcgtcacccgtagctgccgccgcctccctcccgccgccgccctcgggtgcagagagagagagagaggccgagagagaaaggagagggtgagatagagagaggtcacgggtgagagaaaggataaggttgccccctcacctcccactcggcaagcggataaggccgtctcttgactcggctcgtttggtagggtgtcggtcttctaaaaaaactagcacctttaatatattataggtgtcagtttttagtgaagacacaaaatataataggtgccagtttttatttagaatcgacacctataattacttaaaggtgctggttttttgcgatttcaacccgcggaggtggaaaaaggtctataggtgccggttttagtactaccggcacctatagtggcgactactatctctatcggtacctatagtggcgactactatttgatgtcttgtatgtcttgtagtagtgcttcttgaatgttagaggagccggttcccccatcaaccatatccatgtaaatattttacctcatcttatacctaatcttacaatgggtaccaaagtttttattctcaatatctctgctgaacaaaaaaaatgcttatattttgaaatgaaggaaatagttatatttagaccattagctcatcaagctagcttagctgtaggaaaatttttcaaataagacggatggtcaaacgttggatatataaatctaaaaatggagtctttgtgggacggaggaaatattaattaaactgtcagataagtcaaaattttatgtggcaccaaaattaaatttctgttcgtactagtcacaaggctaagcatgagagtttgagaggagaggaaaagagaaaattgagaagatatgcaaaacgagttcgcatgatttgttgagtattaactattttaaattgtaaaaatggattaatatggttttttaaaagcaactttcccatagatttttttaaaaaaaacacatattttagtagtttggaagcgtacatgtggaaaacgaggtcttttctttttcgatttcccagccacgaacaagttagagatgttgatt

SEQ ID NO: 103877 - DNA, 604 bp, Oryza sativa
tttgatacagcttcaccaagctagtgttagtgatatgccctacaggcaatcatagagatgattgtatcacatactatatttacatatttatccgactttgttccttgaaatagataactcattattagttaatgaatatgtgattctttcatgagactctttatgttatatgctgttatttctaaaggatccctgatcaaatatcatatgtggaacaaatatatttagataatcagcacatgtattaattgatgatcatgtctcatggatcatggtatagagatactaaattaataatgtggacacatgttggcgaacatgttgttggatagacccaacatgagacactgcaagagccatatgtattgtgtcatcagtgatctcatttagtgttggtgttgaatccttagacctgagattgtcatggttcccaaaatatgtagtagcttccttaagaactactaaacgcaactccgtaattgggtagttataaaagtacttttcgggtatgctatgaaacatgtagtgggatatgaataatcaagatgggatttgcccctcctatggagagatatctctgggtctctcgatgttgtagattatg

SEQ ID NO: 103878 - DNA, 627 bp, Oryza sativa
aatcggctaatgtgctcataagtcgatgtactatcttgccctgagaactttgaaaaatctagaactttgaacctgttaggtagaggaactttgaaccattcaggatacggctgtcgatataggtttccaacatctttcggcctaagcccaaactgctccttcgtgacatctgcaatcaaatcggcccatggtcgttgttaaggtgttccttgaggttgttgtggcatgggctcgaattggttgtattgaggaacaaattggggttgagccgatcctgcatgctggtactgaacattaggtgatggtggctgatactgatagttcaaattgccccctggtaattttggaggtctggctgaatattgcgcaacaaatgttcaggaataacttgaggaacaagtgtgccatctggttgtacatgatgaactaagtgttctgtgacaacctgatttgcggtatgctgcacaggttgaccaccaggtgttgcaaacccagccaatgcattcatgggactttgttgctgaattggctgaacaacctgttgcctcaacggtgtctgctgaattggctgcaagacctgccgtcttggtggcgtctgctgaactggttgcacaacctattggattg

SEQ ID NO: 103879 - DNA, 683 bp, Oryza sativa
gtttaacaactaaaatgtggaatggttggcctgggttggcttgggatgagctgggacccagggtcgggttgccagttcggtctgaatcatcgtaggccttgggttaaggcaggctcgtgtgggttcacggccttgtttaataatattgtatagctctaggaccgtatttacaaaatagctttgagcaactaagtgtcttttaatgctgtttacggtaaaccctaaccctttatattataactcccttgtactcccttgcatttattctgcacttgtgggtgtgtcttgttgactacggtggttgtactcagtcttgctcaatttttcccaaacccagaagaggagtccctggaagatgaaggctttggtgtctagctcgtgcctgccgtcaagcgcctgtggtcgtcgccctagtcttccgctgtttctcgtttgtctttgtgtgtgctgggccttcgctgcccatgtaataaattatctatttacgcttccgcttgttaaactctgaactgtatcaacttttggtgtaccttgcctcctgggacaaggaataatgcacgcacgtaaggaacgcctgttgggttatttccggtcgtgacagactagaaaaccatgcacccacagctcaccattcagtcgcattttagttggataattacgaccaatgccacatggccggatgt

SEQ ID NO: 103880 - DNA, 2024 bp, Oryza sativa
actacccctttaccctcctcctatgactctcccatcctctctccaattcaattatctcatgttctatttttattaactaacataatataaaaatagtcatagctattgttttatttataattcaataaataaatcaaaaatcacattagctatattctactatataaaagataaaatacatcatttgatgggtgaccctatcatggccagacagctaaacaacaaagaaaaattaattgaacatacatcttatgttatactaaatcactgtacataacaaaaaatcaattaaacactctccagagtgctcataaatgatcatatatcatctcctaaaattctaagaaaaaccaattaaattaatacatcctttattttttacaattatatgtattttttaaaagaaaatcttaagttgccatgtgtcacgtcctataaaaaaacataaagaaccttagaaattcttaaaaaaaacaaaacaccccatcatcggctttcacttaattgatttagaaaaattagaaaacaaatctcctccacctcctccttgccatcacatgcacgcaacactgttcttcacctccctattttttatctattaatgttggacatttttttagaaacaaagacctccctttttatctattaaactaaaatagaaacaataaataatgttggattttctttgagaaacaaagtacatatgcaggcgctcacatcgcacgcatactcacccctatgaacgcacaccctacccctatgagttcctttgtgagaagtctatgaaggtacatcctacccctatgaggacctctgagagattaggccgacatcatattttgagattgataaagtcaccacgaacgccttagtgttgatggatacgtcgtctaccactgaaaaaaattcatgcctaggacttaaacccaagtgggcaagttccaccataaggaaactaaccagttgaggtacgttcacttcgcaataaatgttagacattaaaacaaacataatttttaagctacatctctggaatacttccataccttttaaaccggtggaaccattatttctaatcgttagatctatcgtcatatgtattcatggtacatcacatttcaaacatattattgtatattttatcgttatcatattcacgttaggttgcgtagaacctcttatccactctacataaaatgttcatatatcgaccatcgttgtcgccggttgtcgatcggcaggacatacgggtcaggatgtcaccaaggtcgaaaaggccggcaagaaatcggtggcccacgccacacatgaccgtagtcgacacgcgaaagaagctacagagatagccattatctgcagcctcgggaatcaagaacgagaggactccctagtgtaccctgtagtctgtagagacgaaagataggcccgttggatcaattttgatggtggatgcctgggttacgttactcccgacatgcttcactgctacatctatatctatattaatataaaaagaaggagttggacccctccaatcgtactggtgaaatcacctggttcagtctctaccgtccatacgcaggtcagatgtaatccgaaccgtccacccatctccaccgcacgatttcaccctctccacgcgtgaagaccgagcgaagattacgcctcatcagtcatcaccctctcaacgcgcgactcactcgcgtcgtcgtccccttccgccgccggcgcgcactgaacgagaggcgaggtcttccccaccgctggagcttccccatccaccgcggccggccgcaggcggagacgacgtcgtccccatccgtcgcccggagccgacgttgtccccaaccgccgccgccggagacaaggtcttcccgatgcgccgccgccgccgcagtccaccgctgcccatgaggtcgttcctttccgccgccgcagccgccgtcaccgcgcactgaaccggaggcgaggtcttccccagcccctgtcttcatcgtgcgcatccttgccgtgcgccatgttta

SEQ ID NO: 103881 - DNA, 1936 bp, Oryza sativa
tgtgcgtggctaggtcaatagtgatcaaggcggacgtaaaacgagggagaattgacggaaatgttaaaaatgggaacggggtgaactttaggtactattaaagtgaaccggtgtctttcggtgctataaaaccaaaaacgtgaactttcgatgctatataaccaattttgcctatggattaattgcttaattatttgaaacccaactatcaatttaaccttactttttcagatttgcttatttgactctgcttttcaaaattgaagtttcgtctgaccctgttttttacttcaccgttagaacttcattttgaaaaaaaaataataaatttactaccccaaagtgaccaaaatacccccagagtactaatcaaccctatccccatcccaccccccacctctccatcccaatccctacctatgctaaattcattacaaatatttaaaaaggtcccaatgaaaaaaaaagctttgatataacatggttaaatgagcagggcaaaaaggacaattttcttattagctaactccgttatctcaactcaatttgtgctcatctctgcagtccaaggagatagcccagcagcaccatggcaacgctgttcgagctcatacgctcattacctttctacaccttcaatgctttacataaaggaaatcgtcttagataataagtggttggtaaaaatggaagaatttatactgttctgctatatcctaatacattttccaattgatccatatatatatatatatatatatatatatatatatatatatatatgcaacgggtgaaactaatattattaacaataaataaatactaataattaaagtttaagtatcacaacattatgatgagtaaatattggagttttcggctaaatatcttgttggttccggttagctcccgctgggccattagtttttgtcattggatcgaaatcaacatccaggatttctttgtagcagtgtgagtcggctcaggctgcatgtcatccgtaggatcttgaccgaacggtccagatttctccgttaacaaacaaaaatcatacccggtcaaaccctaaccatttctcccattcctccccgattcataccgcgctagaaatgagcagcgacaacggctgtgatttggcggagcggtgacgacggcgtacccatgcgcggcggcctctgatgctgtgcacagctccggcggagctgaagccgacgggaaataataattattttgacctgaaacaatctactgagtgattaaataattgaacataatttcctagcaattttaaatggcttaaaatagtgccaaacaaatttctataaatctaaaaaaaattaaatcagttgctttgaaaaataaaatgatttgggccttagtaagtttcagggacaacttgagggaccaaaactgaacttatccgtgcagagcgtacacatggcccaattgtgtggtggcccgggaacggcagcctgatgcgggagaatacgcagccgtccgatctgatcgacgatcatgattgatccagacatatatatatataaagtcggcagcttaaccctaaccctaaatcatttcccctccgctccctccctctctctctctcaaacgactgcgacggcgccttcccactccgccgctcccctcccccctcccccccaccggcggcgacgctccccttaccctctccccaccggcggctacgttccacctccctctctacctcccgtctcttctacctccggcggtggtggcaacggccgagggccgcggtggcgatggccgagggcggatccggcggcccctctagcctctctcccgcggcagatccgccggcggtggcggcggcgtccgcggcagcagcgggcggatctggcggcggcaggcggcaggcggctccctccgccccctctcgccttcctcccactgctgatcc

SEQ ID NO: 103882 - DNA, 921 bp, Oryza sativa
aaaacttttaccaccaaaacttttgccatatgttatttaccatttcaaatgatctaaatatgccctatgaactagcaaatggcaaatggcaaattgtcaacttttgctactagtgtttagatctaaaatgataaaaagtgctctaaaatagtaaaacttttatcattttggagaatctaaacagggcctaatacaaagtacaatgtacttttgtacagccaggttataaattccatagctttaatgtttttgaagctggacttgccgataaataatgtggttggatatgtagcgaaatggtagacgagtagctcaattacaacaaactaattacaaaattttgggtcaacggcatttaatttgtattttatcgcaaatggttattgattgggagaatagctaatatggtccctaaagtttcactcctgagtcattttagtccttaatatttcatattgtccaaataagtcctttaaatttatcatgtgggctaatatagtccttggttccaaaaaatcgccacatgaacatgccatgtcacgttcctatgcaaaactatatgatttgtccaatttacccttacgcataggaaaattaaaaataaaaggaaaaagttaaaaatatatatatatgatatatgtaagagcaaaaatatacatcaaaagggtgaaaaaagaagtattttttttcctatggttatatctaattcacccctatatttacttttctatgatatacgtaagggtaaattgaacaattcatcatagattttacatgaatgatgatatgggatatctatatgatgatttgcaggcatgcaaaggactattttaggttttatgacaaaggttaaggatttctttaaaacatttaaaaggttagagactaactaaacgagctattcttcctcattgattcatt

SEQ ID NO: 103883 - DNA, 609 bp, Oryza sativa
gaatatcaaaggggacagaagatacaatgaacatgagtaaaattgacattttgagcttcttctccttcgagaaaagtacatacaatgaacatgagtaaaattgacattttgagcttcttctccttcgagaaaagtactaactgctggattgatggattggatagatgtctaaagctcccgttggctcattttgtcaattttgtaatcacttctgtacactttacttcttcttcttaatttcctttttgcttaattcagataggccttagtacagatgccatgaccactgaagagcactctaagaaaattaagtgcaaacagcatattccggtataagtcgagctaaattttgtaactcttggtgtatcttccgctaaaatgcttactcctgatccctccggagcctaggagtctattgaaatcttcgaggttgaagttacacctactccatacgcaaatttgtgttggtttaccaaaagcagtactgcagaccaacagccaaattatatcacaaacaacttctacattgtccaagctctgaaattctcatgtttcaagaatgcctccttcgtactgaatactgccaagttatcacattgaagtatattt

SEQ ID NO: 103884 - DNA, 613 bp, Oryza sativa
  unsure (1)..(613): unsure at all n locations
tgcttacaacctattctttatggcgacgatgaaatgtccttatggtgaactattttggaagattagagtgctagcgagggtcagattctttatgtggttggctgtaaaaggatgatgcttgatggctaacaatcttctcaagagaggatggctgttcgttgtgccaatctgagatggaagattgtgaccatatgttcatcaagtgtcgtacaccaacagagtatggacaatgctacgagattggatcaatgtggcctttgacccacctagtcagcaaggtcttctatgtggcataatggtgacagcaaacgcaatcttgttttcgagcgagctacatgaacatgctcgatatgcttttcatgatggtgtgctggctcatttggaaggaacgcaacgggatagttttcgagcagaggttaaaacaattgcagagaagctttggagatattaaagaggaaatagccatttggagaactgctggcatatttcaatattgntatgaatagtccgttttagctaatgtcatgatcaatcgctataacatataacacccccttacaatctcaatgaaatttgattgggccatctttcagccgacccgcgaaaaaaaact

SEQ ID NO: 103885 - DNA, 632 bp, Oryza sativa
tgaaaacgacataattaagtgttcgaaattcatgaaatcatatctaaaaaattttgtaaattggtgaaaaaaaaatactaaaaataggtgtacatatgcaatacaatctaaccaaatctcaaatgaagttgaggttggacttcagatttagtgagaatgttcttcatatccatatttctctgtagtaacttttttatgaatttagtaaatttgtatgtatgatttttcattcggaagccaccaaaattacttgaaggaagaagacaaaaaaagtttcggatatggcaaaattggttatatagcatcgaaagttcacgtcttttgtttcatagcaccgaaagatatcggttcactttaatagcacccaaagttcactccgtttctatattttaacagttctgtcaattctcgatcattttccgtccgccttgatcgatattgacccagccacgcacgcgatatgacgtttctacccctcacaaatacaagtagaatgcatggcaatgagaggtagaaacgttatatcgtgtgcgtggctaggtcaatagtgatcaaggcggacgtaaaacgagggagaattgacggaaatgttaaaaatgggaacggggtgaactttaggtactattaaagtg

SEQ ID NO: 103886 - DNA, 595 bp, Oryza sativa
aagacaataaacatgacatgaacaatgtgaggtgatctagtgataaaattaaacataaccaggagcatgcttaagataaaataagcatcaacatcatttagagaacgcaataacattgcgactaacagatgtaacaaaaacagagatagcagtaggatggtataccctgtaaaggtccctccgctggattgtgagacagaactgcctccgttggtgttgtcgatcggtgcgactccagttcctggcgcacctccgttgacgccgtcaccagtagacattgccgcgacgcataccgaacagaaccaccgacgatgatgaagagagagcagttgtacggaagcactccttaaaaacctgatcacccgcctacccggtgcagatctcaggcgaaggtgtggtttcggaggccctgctcgttccgatcattcgtgcgcgcaagcaatcagaaccggggaagcagaagcagcacaggcgcaagcgtggaggaagaaccagcgatgggagaaagcgtagagatctgatcggaggaagaaccagtgatgggagaaagcgtatagatctgaccggggggtctctattttctaatagcgtcgga

SEQ ID NO: 103887 - DNA, 664 bp, Oryza sativa
ttccatggacttgagctattcctgttgtacttccatccaattgcttccaacaacatgctttgtctgggcgcccagatgaataacatcaaatttatggactttatgacaaaggtgtacaatggtacattaattttgcataattgcatctcttgcttcaacaatagacaaaaacatgggtggacagggcatctgagaacttcttcgtaaaattttcgctcacaaaagggttagtgcatgctttgagaacgttggccaaccatccaagcttaaacaagtaacagcatttcgttctcaaagtcctgatgcagtgaaacatatatatggtttcactgtaacacaagtgcttcatcctatgagaatgggacatgtcagcacacatcgcggagggcagtagggagcaatggaaggacaccaatttctattcctgtctgtgccaataaaaatgatgctgtgcgaatcagaggaaatagtgcgttgtttggtcgctgagcagttagactttgagactacaacactgtccatagtataggatcaaaaggttccataggagcacattagcatgtaaatacataacagtaggaaaaatctagaattatcaaaattttgtaatggaggtaagatttggcaatgtaacaattaccaaaacttagtaggggtaattttg

SEQ ID NO: 103888 - DNA, 616 bp, Oryza sativa
caattagggggtataaccgcgagaatgctagctatcgtgcatctgatgggataacgaaatatcatggttttcttttctagccacccgtgactccctctctctctcacacccccttttctctctcccacgctcacatgggagggcgaagctgtttctcttccctgtgcgccattgggaacccctgagtctcgtcacccttgcttcatcaccaccaacaccgtttctctggcctactgctgctaccggtgggaaacccctagtcccatcacccccgcttcattggcaccgacatcgtttcgctagcctgctgctgccggctgcttgatgtttcgtgttccaaaacgaagtgtttcaatccatgattcaacagtgtttcatcattttaatagtttgaaacatgtgttaagctagtggtgaaacattcttctataaatactgaaacatcgtctgatttttaggatgaaaatcatgtgcccgacttgtagttgcctgcgcataacaatagcaaactacttaacgattggtttgtttgcaatgccaaatcataagcaagtttttggaacatttgtatagtttggccaagtttaatagcaacaagacattggcaaaatactat

SEQ ID NO: 103889 - DNA, 584 bp, Oryza sativa
tctaatacgactaatcattgcaaggtattgtcacgtcctgataaattcatcccgaaataaaaatcattctctaaaaggaataatagaattaattaaaattcgaaaagaaattggcaaacactaaaatacgtgccagaagaattcgaatgtggtccggagaatttttgttaaattctccttggtctaaaaggagacctccaattttacttgaattttcagagcacaaataataattaagaagaaataaacaaagttaaaatggttttataaaaagaaaagctctaaaaagtcccttttccccccctctccctcttgggccgcctcggcccatcttcttccccctccctctcctctccccgcggcccattcggcctccttcccgcgcgcgcgccgctgacgggcgggcccgcccgccttcctcgctgacgggtggggcccacccgtcatcccctttctccccgcgctcccgccgacttgcccgcgccctagagccgtcgccgccgagaatcccggcgaccctgtccgccccgcgtgcaatcaattggggggaattatttcccgggatcccctccccctttcccccc

SEQ ID NO: 103890 - DNA, 635 bp, Oryza sativa
cgaattcgagctcggtaccccttgcgccaatgcccctccctggacattacaagcaagctacgcagtgtggggcacctccatcgcgcctctaccatggacctcccgcaggctctgataccacttgttataaaaccaaccccaaaatcgacattggtagctaaacgcggaagaaaacaccataggagatccaaaacgatgacgacaccgagacacgatatttggtaacggagttcagccgtagcctacatctccggagcactgattatgggcgctcctcacagatccagcatatacagtatatcagatttacaacgactcacagccggttgacgccggcagccgctccctctcgctatgctaagtcaccatgcggttacaacaggcacgaccctctatttatgagaaatactaagatagagtccgactcatactctagtcataatacctattacaacttcaagtcctaaactgtaaccgactacatacacatattcgacacaaactctaacatatacagcaatttttccacttattagtggcatccctcgctatgttttgctggcttgatatttgatgacttccatttctttttggtaaattttgacagccttgctcttgatgcagtatttgtagac

SEQ ID NO: 103891 - DNA, 708 bp, Oryza sativa
aaattcctcaaactcaattcagaaatttgaaagtgaattcaacttttacctttcaaattaattttttaatcagtctttcctcatttacaatttgttcagattctcatatatcaaaatccaccccaagataaaaaaaaaatccttatgatccgcaggatgatggatgataaaagaaaacacaaagatttttctatgggtagatagcgaagatattcctaaattaatttttataatttgatataactaatcattattaatattatgttttaattaaagtattagttatgagattaatcctactttgatccccttggtgatcgaatgcaaacatatatttacatatacatgtaacaaagcgcaaaatctttaatacgtattcattagcacaatactgatatctcatctatacactcaagcagcaaatccaagttcacgatgagcacaactatcgcatgtttctggttagcatcaaagcttccaacgaagcatggtcggacacgacaaacgaaacggattaagtaaagaatcaattctcacggatgtacatgctttggaaacaattgttgtgaacacacgcgtttccgtaacaataatgtagcataccgcagcggagagaaaatgcggagatcgtaggacgccacgatgacgcaagcagatgggaatcaatctcggataaaaattatgtcaaaaacatcttcaatttttata

SEQ ID NO: 103892 - DNA, 662 bp, Oryza sativa
aaagtcctgatgcactcgataatctgccattctttctccttcagttttgcaagggtgacatgtctaccatgggtaatgccggataaagcaaggagctgcaaattcataggtttgccaccataccaattatcctcccaaaacagattgtttttgccatctacaacctaagttgaacaaaatttcaggaattcttcctgacttccatcaaaccatgctagaaatgaaaattacccgctttataagtcacccatgacaaagttttttgactcaaatatttttccctgagaatggaaattatagaaacgagcgctcgtcaattcgtcattgataaatcatagaatgtcacatatgtatgttggtatgaataatctagagttgagctcctaattggcacagtccgtaaaaagacattcggccttcatggtaactatagtcctcttaatttttatatgtgtacaccgatctcaagtgaggccaaaagatggacatcgcttgaaatgaagaacgaaattaccggtgggcggtggtacaatcaaggaatgatctgcggaaaaataaaaacggccaccactttactgttctcgattaccgggatatgtagtacaccgatcttaagcgaggccaaaaagtggacagcgcttgaaatgaagaacgaaattacc

SEQ ID NO: 103893 - DNA, 1081 bp, Oryza sativa
ggaagatcttatcaataaagtgataccctccattacttattaccatttgaggtgttccgaaatggaggaagatgatttcgtggaatatccaacgggcgtgcttggtgtcagcgacttagcacggcattgcttctacccactctaacacatagtcgatgggcaccaagatatactcacaatcatgggactttgggaaaggtccccatagatcaaataactccacttgaaagttgtaggtcaagggaatcgcatcttgagtggtgatatctccatgcttctggcatttccaacatattcgaatgaattctttagtatcttcgtatatggttggctagaagaatccactctaccatatctttgcatgtgtgcaaaatgcatcataatgccctccatatggtgcatcatgaaatttttccagagaatgatctggttaccttcagcagctagtacacatctcctaaggaagctgtatgcacactctgtaaaggtatgactcatcccacaagtatcgtctgttctcgtagatgagcctcctttcgttctccctttgtcatatgaatcctgcaaacatgaaattcacagtatttgcataccatgcattggaatctgttacatatagtagcatgtcatcccgtaggaagtcatttatcggcggttcctgtatgtcagtcttgacaaacgatcagccaccatattttctactcatttcttatcttttatttccatatcaaattcatggagtataaggacctagtttagcattggctttcccctggtctgccaagtgaatccagcctaaagctatataacatacctgaaagtggatgtttaccaatgacggacagagatgtcactacctgctgcctacctctacaacccatggagcacgcaacaaacaaagataacctttaacctagatactatctctacattattgattactactctagactcacgtaagaacttctctatccagagtcttattactagagcacttaatataaaccttaagcaatgcacccgcaatgaatagaatatatcttacttaaacaagaaaattaaatacctaaaagaaatctcg

SEQ ID NO: 103894 - DNA, 1051 bp, Oryza sativa
tgcaccctcccctctggcggagggaggcagtggacagtaggctccagatcgagctggatttttattttttatgttcatacttttttttatataattttttatgtgaatttgggatgttattatctgtgatgtatttttttttgaatttgtgatgtttttttttagaatttgtgacgtgattctgtgatgttatccgtgctttgtaaagttatgtgtgaatctttgatttggggatgtatgattttctgatgtaggaaacaactcatttggggatgtagtgagcaaccttctgaaattaatatgcaaccagctaaaaacaatgaaaaaaaatcatttagtcccgtttggtgttactaaccggactaaatatggatctttagtcctggttaaaataaccgggactaaacatgaatttttagtcttggatttggagtcccgatttataacccggaactaaagtggggtgcaaatcgggactaaaggtgttttctccagcagtgtgtattaacaaccatgaacaaaaatacgaaggaaaacaaggtcatgcgtcgtgtgtgcggatggccaggggataacttgtattgttgggcggagggaatggcacgagaggatattttaaggtttcttttttttttaaaaaaaagatgatccaatggctaaaaacattggttttactggtttaagtaaaaaccaatgattggattttcttttccataagaattttaaagatttaatctatctcattagagcgtcacctgatatcttagaagtatttatagaaatgtcacgtgaactagaatacttcatagaattttactatataactaggaagataacatgtgcattcacgcgggcatcgtattatttagtttcgaaaacagatataacaaaataagttaaaaactaaagtatggtattttccctttttaattgaatgttcgttgtttatttttcttaagaaatcttgacaaaattttagctaacaaattaatttttttttaccatcatgctggaatataaatatcttagatagcgcttctctatgacatga

SEQ ID NO: 103895 - DNA, 878 bp, Oryza sativa
tgagggttattgttggatcgaacacaagtaaccaagcctaccataagggaggtgaatggtagggaaaaccaaaaacccaaaaacttttagcggaaataaaacttaccctcaaatcgatggaaatcttgatgttgtccgatcgccgtcggtcacaacgctcctaagccgctggtctgaccttcgtagcctatccggtcagaccgctgcactcccttcagttagaccgtcgtactcccaccggttagactgccgccttgctgtcggtcaaaccgttgggatccagaaaatacgtatcgacgaaactcttgaaagtatatcaactttgttgcatcaatatgtatttacaaaatgcatctaaagcactcctctctaaactcaccaactaggattgaaagcttgaagcaaaccctaacttttctctcccaaaagtcaatatccttctagcctcacccctcatctatttataaaaaaaaaccctactcaaagtaggtctagaactcctattcacaatagaactttatggagagacctacggatcggacattcaatccaggagaaaaaaatcggacgcccgtcccagccatcggatcgagggattaaatcccgaccattggtagcgcgtcgttactgttcgatgcaaacttctcctgggcatctacatgcatccatgcaacttttcccgcgcacagaattgcatgtgtgacagggatagttaatgttttgtaagcaaactttaaactatttttttctcttaaattattaatccaaatcatgatccaattacaccattaaattcgttgcaattaaatctttaaaacaagaccacacatggatatattctgacgaaaaaaattttagcttattattgaattattttt

SEQ ID NO: 103896 - DNA, 504 bp, Oryza sativa
tcatgctatacaaaagataaagccgttgcccacgctggattgtggttggcacgataaatgtttcacatcagtagctcgcgacccagtcgttaattgtcatgagcacaaccatcaaaaccatatgctcacaacccaccttacccagattttatttatcaattaattaacatcacacgattaaccatcgtgatcgaccattaaatatagccataattaaaataatataatatagtttataattatcccctttagttagctaatgtttctaagcatagctaagcacacatacatatagcatttagttgaaccaatccaatatataaggttcatgctactcgaattataacccataggaaaataaagtcatcttaggccattaatcaacggggaaaggttcaccacccaatgacattcgtcaaataatgcatagttgaaataaaataatagctttaaacgggttcaacatgctcaaagggttatttgggatctgtgtgacttgccttg

SEQ ID NO: 103897 - DNA, 514 bp, Oryza sativa
ccttttgttcttgattactttattcctagataccttgggttattataatttgactagttgggctttatatattggttcagctagatattaggtgtgattgcttagccatgcttagaaacattagcacactattgggataacttatgattcattattatttaatgatggcttaatgatagttcacgatggtcaatcgtgattggctaattaattacttgccaactaaaacctgataatggtgggttgtgaacacatggttttgagagtcgtgctcatggcaattaaggaccggttcacgagtttcggttgtgaaacattaaccgtgccaaccacaagccagcgtgggcaacggctttaccttttgtatagcgtggttcattgcagagcaccagactgagaagtggcggagataagcccacaggggtcgctggggagtccatgccttgtttataagggggtgattatgatccaggaaaggtgcgctgtagtggattgtgttgtgcgaggggtattg

SEQ ID NO: 103898 - DNA, 683 bp, Oryza sativa
acccctttcacaaatcatgtcatcaacataatggcaatgtggcgcttatgtctccacatgccgcatctcaattaccttcccaaaggtaattgccccaagcatatagcatttgataaatatgagtatgcatgattctagagtagcatttctaagcaattgtcatagttgactagggactcatacgtaaacatggttacaaagatttaagggttagcaataatcaaggcatggcataatcacaagtaggatgttcatcattgcatgcaattttatttgtaaacaaaacaattttgcaattaggatcaacatgttcaaggaatagtgatgacttgccttgctcaaagtcttgcgggtcttggccttcgcttggatccgcaactccctcgggctctattgttacgtgcaaaaattgatttgaattcggttagaattcaaataaaaatccaaataaatccaaatgaaagtcgaatgcgaaagtcgattcctttttattaactttactatgtgcaaactacggcaaacccaatttcgatttaaactactttgcgggtataattatttcgttgcaataatttactctccccgagcattgtatataataggttagaaatttctattacgagctaaatattggacgaaatcctagaaatattatacaatttaatttagtctatgactaaacg

SEQ ID NO: 103899 - DNA, 595 bp, Oryza sativa
cctattcccattcttctcttttcattctattatctatttatctctcctattttccttcttctaaaagaaagcagaatttacgtaaaaaacatttaagcaactatagcatttaaatcataaaagtattctaatatgcttatgctgttagattatttatatagtaactaaatcatacatatatgatttgatcacactgctaaaaaagacacagagatttacgtaaaaaacatttaggcaactatagcatttaaatcataaatgtattctaatatgcttatgttgttagattatttatatagtaactatatcatacatatatgatttgatcacactacttaaaaaaggcacatagagctcggtgttataggtgctggaagtaataaaaccggcacatatataccatttcccatctatgcgggttgaaaatacaaaaaaaaaaaaactgccacctttaatagactgtaggtgtcagttttctattatatagctagatgtatttttttttaaaaaaaactaacacctttaatttactataagtgttggataattaaaagtcgagccgagccgatcggtggtcttgagcggataaggttga

SEQ ID NO: 103900 - DNA, 521 bp, Oryza sativa
gtttccctgtatggagttgcaacggtgttatttttattttattttttcggatgttttttcacactcaggatcacgatacaaccaaccacaaaaaaaatttaaactcgaactaccacttagctaagtctgaaaatatctagcataccacttagtctactttgcacctttactaaaattagaccataactcgtttagtaaaaccctttgatcagcatgttaaaaataatgcactctaccactatatgaaattacttaatctaattcaaaatataaccacatgaaatgacatatataagttaaacagtacatagagatgcaatttttttatttttatttcatttttttgatatttttttcacacttaggagaacataggaaccaaccgtataaaaaataaactcaaacggacaaaatatgtgacatgtagaattttccgaaactctatcaaaacggacaaaatatgccatctattaaaataggcgtaactttctcatacggactcggaatcaggcaaataatat

SEQ ID NO: 103901 - DNA, 674 bp, Oryza sativa
tccaaacaaatccgagggagagagggagggaaaaatggggggaaagggggaggggatcccggggaataattccccccactttattgcgcgcggggacggcaggaggtggcgggattcgcggcggcggcggcgctagggcgcgggggaggcagcgggagcggcgggaggaaggggatgacgggtgggccctacccgtcagcgagggtggcgggcgggccagcccgtcagcggcgcgcgcgcggggagaggccgaatgggccgtggggagaggagaggaagggggaaggagatgggccgagccggccaaagagggagagggagggaaaagggactttttagagcttttctttttataaaaccattttaactttgtttatttcttaataattattatttgtgctctgaaaattccactaaaatttatttacgcattttagacttttaggaaatatacaaaaatcctccaagccttatttgacttttaactttgcaccttttaattgttggaggctttcacacggattttaattattctaggcataatttagaggatgtattttagggtcattttgggacgtgacattctctctatatgatcttcccacgggataaaataaatacgatacccttggaatactctcgagtgaaatgttacaataatatatccgtgcgct

SEQ ID NO: 103902 - DNA, 563 bp, Oryza sativa
ctccaagctgagtcatgctttgtaattgttaacttcgatttatgaaattagttataaataataactaagattaataatgagtcgtgatagacacgatttggcaattaacacttcaaaaattggttattcattaacaaggatactaattgagagtccacaacaagtagcacggtgcttagcaatttttatcttgaattatataaattattgttgtacagtccaacatgatgggaaggtagagtagtagaatggtagaaagtgtttttaatcccggttcgttacccccatatgtagtcccggttatacaaccgggaccgcgaatccgggattaaaggtacccatctttagtccccagcctggccgctgcagcccccgcccggcgatcgccaccgcttctcccggcgtcttcccagcgcggccgccaccgcttctcctatcgagcccgttgcgagagagcgagagagagagagagagagagttagagagacggcgagagaagaggcatggagaatggctggatttttcacattttgatccttttgaaaaacttatttcgcaaatag

SEQ ID NO: 103903 - DNA, 1214 bp, Oryza sativa
caaggaggtcatccaatacatcaaccaaacctcaaccacaagcattaagaaggaagacttggcattgaaggcgaaggaagaagaagaagagagtcgcaagagcaagagcaagagcaaggcggagatcgatgatgaagagatggctctcttcgtcaagaagttcgacaagttcatgaagcaaagcggttcttcaaggaaagttcgtccaagtattcctccaacaagtcaagtggaagacactccgcaagggtgtgctatgtgtgcaaagagcccgagcacttcattgacgattgcccccacatcaaggattgcccccacttcaaggaagacaagaagaagcttgagaagaacgagaagcacaagcatagcaagcatgatcgctatggccaagctcaccttggggtgatcttcggctccgacttcgagtcaagctcaagtgatgaagaaggagttgccacattcgccgtcaagccttcatcaccaccgagactcttcaactactcaagtgatgaggatgctcccatttgcctcatggcaaaggagcctaaggtaccctctcccctcgagtcacttaatggcgacattcgagctcggtacccgaagatgttgaggatgaggttatggatgacgagttgttcaaatccatagccaaggaatccataccacacttgagtgagttgcttgggagaattgagaatcaatatgcaaaccttgagaggcaagaggaattgctcattcgtgagaaagagcggtctcatgaactcaagagtgaacttgctaaggagagagagaaaaatgaggctttggtacggctttacaagcaaaccaaagagtctcatactaatcttgaggtggcgaacgctcaacttcaagagagagtggatggcttggacaaagcttacctctctcttgaagagaagttcgaaaccttaaagaatagtgtctctctccctagcgaggcatcgtgctccaaaattgtcccaagcaacgaaccatgtgtgaggtgcaaagatattgatattgaagcttgtagtactaactctacttctttgagtgctttacaaaagcaaaatgagaagcttatgggactccttcataatggcctacttaagtgccatatgggtagtaaggcgctaaaggagtacctaggctatcaaagggacaacttcaaccatgaaggtcttgggtatgtttctccacctaaaggaaaggtg

SEQ ID NO: 103904 - DNA, 522 bp, Oryza sativa
gaacaggaatgataaaacgaagcgacgcattacgaagtgaatccaaagagttttcatgtgaactgaaaatagtcactctgttgttatgttacataattaaaaaatccatccattttgctatgcagaacaagcagaatggtttacttgaaatctgtagtaacgcatgggcactatattattcatatgagaaataaaaccctgattgttgttgcagattttaaccagtcattgcaaatggttaggaaggatacttcagggtatatggattaaagaacatataccgagtaattcagatactaaaaagttctagacgaagaaaaatcaatcgagccacatctgaagcctgggtcaagtgaataaatcatttacctgttgcaatgtcacgattggtacccatggcaatagttactctcttccctggttctagcatttgctcaaccagaacattctgtgatgaaagacaattataggaagtttattggatgagaacgtacattatctaatacatgatccacaaaggtg

SEQ ID NO: 103905 - DNA, 987 bp, Oryza sativa
agggagagagagctcaaagatccaaagcaccttagtaccaagctcaacccaaagtgaatgagaatgaaatgagttgggtaaccctagaaaagggttaggtggggggtatttatagaccccccaaaaatgtggccgtgtgaggggaatctttcagccacgtcggatagtccgatacaagatcggatagtccgatattttaaacctccaaggcaacgagaaatagagaacgaagttccatgaaatttcggactttccgagacatcgaactatctgatgttaaatcggagtatctgatattttagaagcaaaaacttcgtcctcatacagagactcgagttctatgaaatttcggagtctctgtatcatcggactatctgatccgacattggatactccgatacatagaaaaactcactcgataggattttttcaaatcaagacagagagtgaagttatatgaaaaatcggatagtccgatacatcggatagtctgatttcaaatcggatattatgatgttgctcaagtaaaactgcaataactttttactctgaactccgatttcgaagatcttggactctatggaaagctagtttcgtgggctatcaaacccaacataaaacatggtccaaaaccttcaagagattttgaaaaacttgcaaagaaacccggtgtaagtgttgtgacaagtgaaacaactcgtgattaaaattttgacttaggtttttcaactcacacaaagatgaagcattttgagcactagtattttaccaataatatgcatgtggtatccctcttaatagtacgacattcctacgacacaatgtaaggtaaaaggtacaatatactatttgatcattgccgcattgcatcgtgatgtcgcattcatggggtatgcatctcattacaacatgtcgaggacataacaaccttcacatttgcttgaataaaagtgttagtcctctctaatcgcattgtaatcaatcatc

SEQ ID NO: 103906 - DNA, 833 bp, Oryza sativa
ctcatcaacataagcacgaggattatatttttaatttggacttgttccggatacattcatcatggattcatgattacgagtcgatttctcatgcccaacgattgaactattcattattccccacgagggccattagctgagtgcttgtgctagtcgggattcaattatcacatctactttggtattctccatgagggataattactcggatcagaagccactcagatgagatatgcatgatctacatcacccaagatatttatcactcggggtcatattaattgtcgtgttctatacgtcatatttaagggtatcggtagacatactttaggtctaggcctaatatgtctgcagcccatatttttaggtgtggcctgtcacgttcttttagggacttaggcattttttgcttaggcaaaagtgcacgtgattatatgcccaataccttcaaatccttttataccgcagttactcaactttttaggagttggtgtaatgcattttaaaaggtgccaaccagtaaagctttaaataactgcccgctgacttttttatatagtcaggcggctgttttgttttatcaagcaattgataggatacaatattgttgctttttgccatgtaagtgtgcatttttattgaccaatattatggcttaggctgattatatatttggtcattttccaagcagtagatatatcacttggatcatgttattcgtggattcacaccgcatatgctattaatattaagttacttggttgactataattataaaaaccgctcggttggttggattatttactccttgactatatgtttagtttgttcaa

SEQ ID NO: 103907 - DNA, 797 bp, Oryza sativa
catccctactcatacctgtcttgaatcaacctgagtttgctactcttgaattactcctcgatatattgagcgactgaactcttgttcagacagcattttcaccatgatagtgtttggaactaatatgtgagctaaggcctatatgtagattaattctttacaaaatcaaaaaagcctacctcatgaaaaaacatgcatgtcaacctttagtaccaccttgtctattctagaacaagacctttttgagagggagatttcccttctagccatttgagatatgtatggtggagagaactagaggaacacatgcgttcgctcgcattgtctcgcctgacataggacagctagttttgttcacttgagatatgtatggtgggttgtgaaagggcctatgggtgctggcccattaccactcctaagtgtgcatttgttagatgagtaaagatggacaggatataatgacagaatgatacaatatgatggattgctttgatatattaaataatattgtttgattggttaggttcttataaagtattggatagtaggagataatgtttggctacaagctagtgaggtggtacggtatactcttctatgcacttttgaacttttttagcttattttctaattgtttttccctcttctttttttttaaccatgtacacatgttcccatacatatatcagctaatggtatgatcctaccttttgaatttagatctaatatctcgtgcctataagcagggcatggccaagacgctgctagctgccagcccccttcaacccgacctaata

SEQ ID NO: 103908 - DNA, 666 bp, Oryza sativa
gtgttagttaagagcctaaccatcatttataaagggtaattaatttcatcgatgagggagttaatctctgatcctatcagtccggatcaaacaccaaagccccggcaagtgttgctgctcgtcgccatcacaatgatgaacgcctggcacctggccatggcatttggttcgcgctacaaaaacatggccgtattgagcacttcagttttacaaacaaacataaaaaagaaagatgcatccaaaactccaatcattctcgcgtacaatcatccagtttttgttggcactgcaccatgtgaccgagaagcaagcatcaatgagttcattagcttttcatccatatggagcaatgcattgatgttgcgacggcttatatcactgatcttggcagaaaatttgccccatggtcgctgatagcctgccactactattcaagaaacaactgtaaaatcaaaggtgtttttgattattattctgtgataaacaattggcattagagattattggttttgatatttggaatttatttacgaagtggttttggagataattggatttcacaggtgaatctacaggtagtgctggatttgggtccggtcagaccggcgtgtatcgcgcggttagaccggcgcagcccgcggtctgaccggccgactctgtgtcggt

SEQ ID NO: 103909 - DNA, 780 bp, Oryza sativa
accttgatttaattcgcgtagaaattgtgtgatcggcttctttccgtaggctttgcttcgatgaatttgtttcttatgcaactatgctgtcagtatggattgttattggcgtggtatgatattaccttgtttgaaatacatgagggcttgacacctgctcttaattggctgagatatttgattccatagatagctttggataatatttataatccgtcaaattatacgttactatgaacttttggattttagtttgcaagttgttcttatagctataaattaatgggatggttggagtttttttgctggattactgaatagtagacttcttaatgttgttctgtttcatgtgtactaaaagcattgtgagttcaagttccctgtatactatacttgtacagttactatggcccattatgataaactaagctagacaaatttattgtgatgtgttgcatcaatttttcagagcaacgtttcgtgacatttttaaaaccaactgtgatttcattggaaacttttgtaactgcaagttaccgatagttgtgcctgacttgctggtttacttacaaccacattatgtctgatgatgcgaagtcctgattgtttactgatgagggctaaggagctctatcgtttgcattcttctcacccttgcatccttctgatcagtgatattgaacagtcttatctatattcaattaatggtcttcacaataattttacgatctatcattgcatgtcttattctacaaaagaggatatttgggggtagaagta

SEQ ID NO: 103910 - DNA, 632 bp, Oryza sativa
tagaacgtagtacttaatttgctgaggtcgtgtacttgttttttaaataagggtagtccaattttggaccccaaactttcatccaagtccattttcattctgaacacaaactaattatttttcactctaaaccttcaaaaccagataaacttcaccttgtgattaattgcttttagtggtgacttacataatgttaaaaatcatattgttacaggacatcaaagattgttaattacatgactaaacgacacctaaaaatttagtaatttgctacaagacactttcagtccaattaaagagagaaattcttcaatagacgagaatgcccctaagaccacaggattgtacgtaacatggacgttgaagtgaaaatttagaattatgccactctaaatctgcaatcaaccaagtgcattgctagggtcgtagaagcttttgactctaaggacattgtcatcttttcaaaaatttctctcttcaatttaggctgaaaatgtccttgaacaaattactaatttttgatatccttcatatacacggcccaccagcaagctacacaaactttgagtgttaatttagtagtaaaattgatcttaatatgttgctgtagaacatttaaaaatttgtattac

SEQ ID NO: 103911 - DNA, 613 bp, Oryza sativa
tgcaggtcgactgtagaggatccccatcgagaaggaccaggggtcacatccagccattatcgccagcagattattgtgtggctgtatcagacagcaacttggatctaaccaaaatacttccaaaccttttgacgagcgcctgcaagactatttttcaagcctcggctgcaacgagagaatttcacactgaacagttcgattatagagggagaacggcagaattgccgcgcgtttcgaacttagcccggttacttttggataacaaccagtacggctaacgatctcagaaacttcagtacctttggtgctcactgaagttgctggaagtctgaaacacatttaagaaaggttgatgctgtcttgtgctgaaacatacagtacatgtctcaaaatgatcggagagtatagttgggcctcatctgatttgtgcaagcacttgaattatcagccaatgctcttcttatgcaaggtagagaaggaaatcaagccttgtgttcgggagctcataatcattggcccatcccgggcctttccacgggtgggccaattattatgggcctccaagtgaggccttagagattaaaaaagaaataagttcaccaggcatccctca

SEQ ID NO: 103912 - DNA, 1456 bp, Oryza sativa
accacgcattgttgcagttgcatatatatacatactccatggagaagagaagagggcgattgctgtgcaaaagtagtacgtgcacattgcccgcgctggggcctggttttgcagaatgattccatgcaaaagcggctaaactgctcgcgccattgacatatgcacatgtcctccgtccgccgtgtgcatcggcttttcagatgaaattcagaatttcaactgttgagagtagcagtaatacgcatgcagtcatgcagagtacgtcttgtctgaattggacgttgataccggcggaattaatggctgaagttctctgaaatgtatctgccagatcgatggtggcggatttatctgaaatgaatttatgtaacttacagtgattgcatggtactactactaattgattataagctctatatttgcttattgcagtgtgtacgtagtacggctatatatagttctattgagaatttcagtcgatgaaagaaagagaaaaaaaaaagaactgtgatctatatactgatgcatgatcatcgatggagagcgttggatggcgaaatggcgatgggggaagtggcatcgaaacggagagagtggtttcccccttttttctgcagattctctctggtttttgatgggagaaagataatggcacgtactgtgagcgtaaactgtgtggcagtttgtcgtgcctgcttgaacgtagcggcgaatggccagaacaaaaacatgtccaagatggcagacaacgacgcttgctcgccacgcacgtgccagtgctgcgttgcacagctcgacacattcgcagaaagctacccctttttaatattcatcttcagatacaagtattttgtcctaagatatactgatatagtatgtgtatattcaccggggaggaactataaacttttggtacaagttcaccacacacattcacccgaaaaaaaaaaaagagtttaccacacgcattcaccgtcaactcatccaaataatgacatactccatgcatcatctgcagagatcagtcatcagatgatcagatcaatatgcatcatctgcagcgatcagtcgatcatcagatgatcagtggtcagtcatctgctagctgctaatcaacggatgagccggaggccgtctggccgtgcgtacgaacgtcaccccatgaccccatgacccagctagctcctgctaacgatcgatatgattaggcgtattcacgagctcgaccaaacggaaataaacgcatgcatgcatgcagacgcagtgctttcaaatcgatcagctactagtatatacgtgtagtacgcgtactcctactgatcagcgtctcgatcgggcccaaataattaactggccggctgggctccggctgcagcatgtgtcacgccccggcccgaccggccgggccagcgagatcgatgcatctagcttggtgtatatcctagtatagtcccgt

SEQ ID NO: 103913 - DNA, 625 bp, Oryza sativa
gcacgtcgactctagaggatccccctatgctctgaaaactaatcatctagtcactaatcattaatcatctgattattagtatacttttgttttggtgctaagttgagttcaaaggaagttgtcattggaggtacaggttagcacaatccttatcctactgggctacaggtaaaggaagttgagcttttgaggattgtgttgcaccctgcattctacaagtcacaactcaagttataatattttctagccatgagtctcagatgaattttgtaggatcttgaaacaaacaatttaaatctggtaagagttcacaaatttaatggtcatgttccttaaagacagaatccgaagatataaacaatttccattatcttaaaataagttctataagaagttcagaggaattcatcagcattttgacagcccataattcaatgcatctcttgtgtaaaaatgtatttagaatgtgtttagttcacacttaatttaaaagtttggttgaaattggaacgatgtgacggaaaagttagaagtttgtgtgtgtaaaaaagttttgatgtgatggaaaagttggaagtttaaagaaatagtttggaactaaacacggcattaatgatttttgtgt

SEQ ID NO: 103914 - DNA, 624 bp, Oryza sativa
atgtatctgaattttgccttgcaggaacaagaaaaaaccaattgcattcggacatcccgtccggcaatctgaatctaaaatttgttcctcagttcaattatctatcttccccaggtgctactgctacatctgctggcatgaaagaaaaagctgtactactgtttgtgatttgtatgaggaattgaggtggtgtttggatccagggacttaactttagtctctatatttaaacactaattttgagtattaaatatagattacttacaaaactaattacataaataaaagctaatttgcgagacaaaattttttagcctaattaatctataattagagaatgtttactgtagcatcacataggctaatcatggattaattaggctcaatagattcgtctcgcgaattagtccaagattatagatgtgttttattaatagtctacgtttaatatttataattagtgtccaaacatccgatgtgatagggactaaaagttttagtcccatctaaacaggttctaaggatacttccagggagctgcagagcaaataagaaaaagaatcaaacccaagaagattcccactatttgatattgatattccaattttcctgtttccctagcta

SEQ ID NO: 103915 - DNA, 1293 bp, Oryza sativa
cagaggctggcttggcaatactacatgaggatacccataagagaacaatcatgatggactgggttcaacgacaagaagcaacgtaggagtgtgtgtttttcccttcccgggagcgccagaactcctctcactgctagaaacgtatgacgcctagagtgcatgaggatgtaaagttcatggagcgggtactgccaatgcgaggttatcgaaaagctttgccgtgacgcgtctcatgtgttgggatgaggctcatgtgttgggcagtcgcggagtgcgggtaaagtgtacatccactacagtgtgagtaaaccaaatctattcgaatagccgtgctcgcggttaatgagcactgggacatgtattacacttggctagactctaaattctttaacttgagtgggatggaatattgcatgataatttttatgctgatggagccacttcctgagaggcgggaatgtggacgtcctcagaaaatcataacgactctatggcgggaagctatccttgggatcacaatggatggtggacagaaccgtcattgtttaatatgaacaatggtattaaaacttgattagtctttgctaggtcttaggcttgtgaaaagaattataaaacttgctttgcgcaaatgaaccatagccatcctttgaaatcctctgtcatgtgcatcattgctgtggtggcttgctgagtacgggtggtactcacccttgcaaatataaattttatcagaagcgggagatgaagcttcggaggatccctatgcctactaccaggagggagatgaagacgaaggcgcccaataggtcttagtacggtcgttgcctgtggcaatggcatgccgctgcttaaattctgctgccttacctatttctgcttttggatgtattccggaccgcttggtccgatgatttaagactatgcctgcaggcttatgatgtaataattcgtactagacattcgtgtatgtgtatttggtatttcagctatgaattcgtgtgtaccagactacttgatccagggaaatggtactgtttacacgattgattcctgttataaaaacgggggtccacagttgttatgcatgataacggctcagagtcgactcttagtatttatttgagcaaattttgttgcatggtagtgaaagaaaggaaagaagagtaagaaaaaatatttttgatacattaatgattagagatcatattgtctctatctgctgtagaatgctactctctagataacgtagagcttatatctgactctatctttggggatcctctagagtcg

SEQ ID NO: 103916 - DNA, 890 bp, Oryza sativa
aaagatgccacatcatcatccactaattaacaagatgccacatcatcatccactaacaatcatcacatttaaacatcatgcaaacatgctatatctttatagtttttataatttaagaacttttcaaatacaaacatgttaaattatcatccaacataattcacataatgttttaatgtatatctttattatgtgttatgatatcctatatacttatatagttcatcctcacttagttagtgcttaaatgattaatctctggtacaaattatctttcttcttttttcctctaattaagtcatatcacatcaattgtttttagcatttagatgattaatctacggtccgaactatctccctacttttttttcttccataaagtcataccaccttactttttacatttgaatcaccattctacatactatttaaatttaaattatcataaaccacattaatttacttaatctgatgttatctagctatcttacacgctaatttttttattgttatcacactaaattcccgtagcaatgcgtggggtttcagctagtacattacaaaagaacatatggcggcttagacttaaactccctaaaggttaataatgacaatttcgacaaaaaatcgtccttattaattccatgttactcttgaaagcgtttaaagggaaaaaaatagtcactccccatgatcatagatataaaaaccagacagtcacttaataattcttgcagaagagaagttcataataatcccatttccttaatagcttagtcctattttgattcagtacgatcaacaatggcgatagtgtcatgatacctcattaactacaccactaatccactaactactcacaaaccgatcttgaaataaaaatgctagaa

SEQ ID NO: 103917 - DNA, 1199 bp, Oryza sativa
cgactctagaggatcccctcgaacacgatggttcagagggtgaggaggtaattcgtgctttttcctattttttatggttgatagaaatttatatgccgaatatagttgatggacaaatgttatacactattgaacccaacactaagtgcaatcaggcgaattagttagtgtaaattagtttgtgaaaataaaataaatacattcttagaatcagtaagtgtgtctcgtatagtaataaagattttaataaaatcgtagattaaagaccgttgacaacacatcagtgttggcactgatggttagtgtttctttccaattctactatgtacgtgtgcgtgttttattttatttttatttttttgctttatctttttttatcgtaaatggtgtaggtatttaagttttgttttttttttttcgggaggagggcgatcatacgaagtacgcacatacgcacattatgttttttttatagagattagtatcatgagatttttaatagatctaatctaatatttaaaataataggtccaccagtttcagtgaaatttgaagattggatgcttttctttttgttctctcgatttctaggatttctctaataaattagagcgccatgtgacaacgtaagaacatatgtacgatatttattggacttttaatatataatagatttttagaatttatctaatttattagagagacacgtaggcagcggcgtaagagcgtttgtacaaagtttaatgtacttttggtatataatagatagatttagaagatggtttaaggaacattgattggatatttattataaatatttatttaactaaatatatttatatttgtgaagtaatatattttaactttacattgtagattatcaaattttaagagactgtcgatttttatggatgtatgtttttttctgtcgttttttatgtacatgcgtatgttttttttcttccggcagacattagcaagctttattattttgttttcaattgtgtacgtacgtaggtacgttcaatcgtgtatggatgtacgtaccggaagaacaacattaacgtttgtatggtattaacttagtacgtacgtacggcacaacagtagtagcgctggtatgatataaacatgaggaagttattattttttaaataataaatctaatctaatggtgtaaaataacaggtccatcagtg

SEQ ID NO: 103918 - DNA, 758 bp, Oryza sativa
gcctgcaggtcgactctagaggatcccctaagttgcacccacctagcaagtttgatagcaagtttatgtgctatcagtgcaatttactcaaaataatggtaagactatttaagtgtgttatcaatattacatatttgtgactattttagtctggtgcactgatgttcatatgatgttttatatgagatgaagacctatgatataatagagtggactacagtaagtcctaggctagattcaccccattttcaaaaccggctataaccgtgtttttaccgggtacaataaaggcatgcacacaacaacccatcaattttaaataaacttataataatttaaattttggataaatttatatggtttctcacgttttgctgtgatattgtcgccgagatgtggttggctgcaaaagtttcaaacatccctatatcaccatggatcatatagtaaaaatacgtggtttagttttgttttgacacaatatactagacacgatataaaagtgagatataacttgaatgtatcaatgtgcttgtaactgatatgcacaggtgcatgagggaacctcaaattagccaacacgtacatttgcaatttgcaaaggacaaaggaccgctcaatgtgatagccaaattaacatgataaacagagatagcaggttcaccttcgcttctcttgagttgtccaggacaagatgttgtcataattgctactccctccgtattttaatgtataacgccgttgactttttaaccaac

SEQ ID NO: 103919 - DNA, 1065 bp, Oryza sativa
atctatatagatatatatgtctagattcactaacctctatatgaatgtggaaaatgctagaatgacttatattatgaaacggagagagtagtatatatggagaaaataaatggtccctagctttagcttaaccaaatcaacataaggccggccatttgtcaagtttaaccaatgcttacagcaggcccgcaggtcaatttgctccaactacttaatttggcatatataaataagtcagatgtatatatcgatcaacgcctgtgtaggatcaggggttatttaatatatattcggctagaacttgaattctactactagtagtagtattttagtatcaacttgatgtatcacatatcctataaataaggatccaaaccataataatttgaacggggggagtcattttacaacttaaataaacatccatgccatgccatgcatgcataatcttctatgaccaaactatatatatacgcctagtggtgtggtttgagcgcagtgatattacaaatgggatagaatgatgaaaaagggatgattaattaattaatttaacccacaatgcatgtacataaagaaatactataatgtaagcacatatctatggtctatcactagcaaagtagcaaactttaattagtgctttcatgtttgatgactagctagaagtactaggccgtgcaaatgtctgccctaaactttctcccatcaagatgacaagaagtaacatctcaacaaccatgcaagaaagcatgaatgtttgcaagatgctagctactagctagatgaatatatataggtatgatcagatcgatgcaggtacgcatgataaaaaccatgcacgtaaaatttctccagagtgaagaaaaatgtcgttaacccttacaaattaagaagaaacacaaacgaaagggggaaaaataaacaagaagatggaagcaagcaaatcaaaatcatcttctcgccaagaacttgttggcgatcgatgaataaaaatggatgcaaatctaggaactaaaactatcatctccctcctcgatcgctgcaacccaatgtgtacgtacg

SEQ ID NO: 103920 - DNA, 1571 bp, Oryza sativa
gggctctcttggtctctctctttaacttgctctccatggccacggtagacgagagccgcaacatcgaccgatgagggcgagggcaacgacacgacggtggcagccgtggccgaggcggacgaagttggcggcgacagctgcagtggacaaggtcggcggcagcggcatacagaggcgacgagcacggttgacaaggacgagggtagcggtggtcgcagtggacaaaggcggcagcggcggcggacgcggacgtgcgcgacgatggcggcgcggccctggacttggacgctccgacgcaggcaacgacgagtagcacgggtgcatcgcttgctacaggcgggcccacgtcctcgggccatgcgtacagccgggcgactaattagtcgcccgcttgcgccctctcccctcccctctctcctccagctcagcagaaaatcctacatggatctcctatcgcccattattgtacctgctctaagttgccaataagtgttgtggtaattaatgatgaatattcctacaatgctccccatgctactctctcggttttaaatatatgccaatgtgatttttgagatgacgtataagcatttgttttattaaaagaaataaaaaataagttatgattaaagtaaatttaatgagaaagtaagtcgtcacaatgacataaatggtacttataaagtatttttaatataagaaatagtcaaatatcaaatctaaaagtagcgcctcatcgatgatgccccattaggtcccacatacatgtgcctagtgtcactaagaacctgcagtaatgagtcctcagtagtgtccgtaaattggcaccactagtggagtatcaagttttacctgtaccgtttttattataaaccggcactaattaatgataattcattagttactttaggtaaactgatactgataggaggaactagctagcgagccgaaccatatctcaggccaagtcaacagcccaagagcccgtagacatcgatctcaagtctcccctcgttgacctatctcactctctcccggggcatttaactatttgctacttttaaatttggtgtttaattattttttactcatatgtcaatgatacgtgggacctcatatgtctataacatgtgggtccatatagcaaatagttaatcgccacatctaagaatggaaatagttaaatatctcccctttctcccccttctccattttttttcaatctctccaactcgcgacgacgtctaacttggcttatgacgtcaatcagcttgagaatgagaatagcaaggccaatgagcccacaggtagcggtggcctctaacctcactgccctacatctctatgttgtcgacgcgcttcttaacgtatataggtgccaacgacgagctcctcctgaagcatcaacgtaggcagcgacctccttgctcgctacctagctcttctttttcctccatctccactagggtttctcctcacgctggcaccccgatccatatggtggagaaggtcgcatgggtgccaaatccacccccccccacccaccccccaagctcaggcctacaatctga

SEQ ID NO: 103921 - DNA, 2399 bp, Oryza sativa
  unsure (1)..(2399): unsure at all n locations
gatataggcaacattcagtagaatttgttttcttctattccctacgtcccaatgcaagtataaccttgtcttatattcagaaaatgctttgtatcacacgtccgacgaaacggaaatatcggacgcctcgtctaccctactaaaaagcctgatggatcggaggaacctcactgtaacatgtatgctacctgtttcttttcatttttttccctcctctctttaaatattttttcttctaattacttatccgatctacgaaccgatcacaccgttgtattcgttgcaattaaatctttacaacaagatatcatatgattatattatttcaaaagaaaaacatgaatttcaaaccgttaaaactaaatgtttcatacttgatagtgatatgtttcaacgtgcatcttcagtgtgtttcacaaaattcctgaaacttaactgccactacttttcctctcttctccaccttcatccaatacaatacagtgcattatatttttagcaaagctttcaaaagtgatttnttctctttaaatttactttatccaaatcttatgatccggatcacantcattgtattcggttttaattaaatcttttacaacagagatatcgaatgattatattttgataaaagaaaaacatatgtttcgatccgttaatacttgtttcatacatgacagcgacatgtttcaacatatatcttcaccatgtttcataaaatatttaaatgtttcagttgctgaattttttttcaccatatataacttaatgtttcacctgttggccaactgcaacatttgaccgtctgattttttttgggtcatcggacgtccgatgggtagattgctcccttatattcagtagaatatattactacatccatcccaaaatgttgctacctaggatgggttaaattctatcctaggtagcagtattttgggacggaggaagtacatctgtactaagttgcacttatattgagggcatgtttagttaccaaacaaaatttttcacgctgtcacatcgaatatttggacacatgcatagactattaaatgtagacaaaaaaaaacaattacacagttcgccaggaaattgcgagacgaatcttttaagcctaattgcgtcatgatttaacaatgtggtgctacagtaaacatttgctaatgatagattaattaggcttaataaattcatctcacagttttctggcggaatctgtaatttgttttgttattagactaagtttaatacttcaaatgtgtgtccgtatatccgatgtgacatacatgatatatgggcaaatatttctgccaactaaggctctgttttgttcccaaacaaaaacttttcaccctgtcacatcgaatgtttggacacatgcatggagtattaaatatagaaaaataactaattacactgattacgtgtaaattgctagatgaatattttgagcctaattgcttcatgatttgacaatgtggtgccacagtaacatttgctaataatggattaattaggcttaataattttttctcgcattttaaaggcgaaatctattatttgttttgttattagtctatgtttaatactttaaatgtgtgtccgtatatctgatgtggcacgccaaaactttttgtctcgcgaagtaaacagggcctaaacaagccctgggttagagggagtaccacacatgacaacttactactccctccgtttcaggttataagacgttttgattttaatcaaagtcaaactgctttaggtttgaccaagtttgtaaaaaaatagtaacatttttaaacaaggcaaatttattctgaaaatatatttaattattaatttaatgaaactaatttagtattataaatattactatatttgtctataaacttaatagactaaagttaaaacgttttataacctaaaatggagggagtagctatttcacctctgagaatgtctcttttttttcccttctgttatggtggaaggatggtggaagttgtcggccggtgactctctgaagtttctacacgcacaacttttccttcagaaattaaacatttcaacagagaggaacaaaacgaggcacctatatgcatgcttatttttctaactgaaacacgcacgtgttagacgtgcgctagttgtaaaagctcctgttcttctatacagacacgtagtaattaactagtgtaatgtacgggtctggatgatccaacggccagaattaatcgcatcatatatatgccggatgaataacgtacttgctaatatcatatatgatgctagctgagtacacatatatattactccctccgtttcaggttataagattttctagcattgctcacattcatataaatattaataaatctagacatatatatatatat

SEQ ID NO: 103922 - DNA, 505 bp, Oryza sativa
ggtcgactctagaggatccccagcatcaaagctctaagtatttaattagctgattaagtagtagttaatgaggagagaaactaatctgtcaacgacaggccggtcattccttcaaaagatagcaaaggtcttagcctgcaatagtcaacaaaacttgatctggtttcttggaccaactacgtacatgaacacaaaactattgacagatcttttcactactccatatcagatattagtactccatccgtttcataatgtaagttattttagcatttcccatattcatatggaggttagtgaatctatatagatatatatgtctagattcactaacctctatatgaatgtggaaaatgctagaatgacttatattatgaaacggagagagtagtatatatggagaaaataaatggtccctagctttagcttaaccaaatcaacataaggccggccatttgtcaagtttaaccaatgcttacagcaggcccgcaggtcaatttgctcc

SEQ ID NO: 103923 - DNA, 798 bp, Oryza sativa
ctatcagtgtcctttaggaagctctgaacgttagtgtcatgtctgcatcagttcttaactgtgctcaacttggccgacatggttttctaggatactcctaagcaacctttagttgcaagttattgcagaattaactgctgctcattaggagttctagtactattgtgcaggtagcagactgaaatgtttcttgtgctgtactgtgcattccagtttagtgaagagttaatggggtttgtacagtgtacagcaaccgtgtgtttaaaggctgaaaagttagaacttctgaggctggtgccacctgcgagatgcataaacacaagaaagttataacttctgaaaagttggaatttaatggcgtcttttttgttcttttcctctcacggatagcgtagcagagctgcaggatgcagttctactagggtcatttgttactggtagagtgccggaattgccaaccctgctgtcatttgtagtatttgcaaataatcaagatccaatccgctcaaatactttggccttgctatctttgtgggctcatggaaccatggaaccattcgccagatcgacatttccagctccatcctgtttggcaatggtttttctctcataataagttccaagatttcgtagtacgacacgtacacctgttggattgttcttctgtctctgccaaatcgttgatgtcacaagctaagagacgatgaagtatagataaataacattatgtttcatgatgcgtgaaatttaaaaatagatcatttaacttactattcaggttgttcaaattgatgctat

SEQ ID NO: 103924 - DNA, 510 bp, Oryza sativa
taattagcactaaaccaaactattatgtatttaatcctaccaaaggcttccctgatccatggcaattatcaaaatgataaacttagtggttttgatgctaagatgcagtactactgtactgcttaagaatcaatgacatgaattatattaacatatcaagaagatgcacgtactcccctgcagaacagaaggattatcgaaattggggtccaagttgtttaatgattattcgatccttgtcatgctttgacatgattaaactacctaaccaccaatccctaaccacctagcatctaattaaactccttgtctgatgtaactaacaggattgcataaagtaatcaatcaagtacaactccatggaccaaagcagaaacagaaaaacaattgttgagtttactaagaacactagaccaacttgcagatcttagcataacacgtaatcagacggggggaagtggctattgctggctctatcctgcttgggttctttgttttttttaggccatc

SEQ ID NO: 103925 - DNA, 620 bp, Oryza sativa
tggcaggggagagaggctaccggcgagctagctgccaatggatgcaatgttggagcattgcatgaattttcgtgcctggatggttgtcggtctttctggggtcaggcttgtgcaagtcgcctgacaaaaagggctcgcatacacgcatgctgcacaccgcgaagaactccaggcttttttcaaggcgatcaccacttaaaactgagggccattgccaatttgtcatggccaccatgcatgatcgagcaagcgagagcgaacggaccaaaagtttttgctttctctcatacacgacctaattgcatcgtttctcgagcaaaaaaaaatcagtctttttgctagctatagcttggttcattgcatgggtacaattatatcatggaactgtactgctgcattatctgaaactatttgccatatgacagtggcaattaagctcaagattcaagaagcattccatttcctcgaatctgtcgctaagaggttggtagggaaggattacaagtacatgtacatgcgcgagatgcttcctgtcatcactggatagaggattaacgttgttcccaaggagaatgaactaaaaatgcagcaaaacatcatcgttctctaggtaacctcgc

SEQ ID NO: 103926 - DNA, 682 bp, Oryza sativa
atgaagcattaaatatagataaaagcaaaaactaattacacagtttgcatgaaaatcgcgagacgaatcttttgagcctaattagtccatgattagccataagcgttacagtaacccacatgtgctaatggcggcttaattaggctcaaaagattcgtctcgcggtttccagacgagttatgaaattagtttttttatttgtgtccgaaaacctcttccgacatccgatcaaacgtccgatgtgacacccaaaaaattttttttcgccaactaaacaaggcctaagttgcttaagaatatcatacgaatccatttttcaaatcaataataattaaaactcaattaatcatgggctaatgtcctttttttatatattttttttgccctaacttcgatcaatcaatcttcagtagaaaccagcacaccttaacaagagtttctttttagccgttgttcaatttccctataatttctgcaaaattcatcaaatccaaagagacctcaaattttaaggacggcggcgtttgattcccccacccttcaccgtcgcttaccactctcctctagccgccggcgcctccgccgcggccgtggccgccgtcggtcacttccattggcgaccacccctcgcgcatggtttcttccgcctctaccgccgctctcctccccctcccccgaacac

SEQ ID NO: 103927 - DNA, 608 bp, Oryza sativa
ctaggatttctctaataaattagagcgccatgtgacaacgtaagaacatatgtacgatatttattggacttttaatatataatagatttttagaatttatctaatttattagagagacacgtaggcagcggcgtaagagcgtttgtacaaagtttaatgtacttttggtatataatagatagatttagaagatggtttaaggaacattgattggatatttattataaatatttatttaactaaatatatttatatttgtgaagtaatatattttaactttacattgtagattatcaaattttaagagactgtcgatttttatggatgtatgtttttttctgtcgttttttatgtacatgcgtatgttttttttcttccggcagacattagcaagctttattattttgttttcaattgtgtacgtacgtaggtacgttcaatcgtgtatggatgtacgtaccggaagaacaacattaacgtttgtatggtattaacttagtacgtacgtacggcacaacagtagtagcgctggtatgatataaacatgaggaagttattattttttaaataataaatctaatctaatggtgtaaaataacaggtccatc

SEQ ID NO: 103928 - DNA, 564 bp, Oryza sativa
tcgactctagaggatcccccatattaatttgagtgtatcatatagtgaagcacatgggataatatggaagttcttgccaagagaaaactaataagcatccatgccaccatggataccaagagacaactgatcccttgttacttgctgaataagttggttgctaactcttcattagatatatagaacgtagtacttaatttgctgaggtcgtgtacttgttttttaaataagggtagtccaattttggaccccaaactttcatccaagtccattttcattctgaacacaaactaattatttttcactctaaaccttcaaaaccagataaacttccccttgtgattaattgcttttagtggtgacttacataatgttaaaaatcatattgttacaggacatcaaagattgttaattacatgactaaacgacacctaaaaatttagtaatttgctacaagacactttcagtccaattaaagaaaaaaattcttcaatagacgagaatgcccctaagaccacaggattgtacgtaacatggacgttgaagtgaaaatttagaatgggt

SEQ ID NO: 103929 - DNA, 879 bp, Oryza sativa
acccccacacgcactgcaagttcacgcgcaccacgctattgtgcctgcctgcctgtaaattaattcgaattgcctttctttcgtcttctcaatttccgacccacccaaaaccctagctagttcctctacctggaggaggcagcagcaatgatgcccaactccccactctcaccatgctcacgcgaacttgtacatggaaattcctagtgtatctttgtatatgccaaaaatatatattgctagtgtattgtaccgtagaagtccttcaatttctttaatcaatcccttccaaaattctacttgttctcaacagaattttcataggattctcctagggtctattggctaacaccacaatctgattagccaacccagctcacatccctcctatcttaagggtttattcgattgaaggggtgtgggattaatctccttaatctcatgtgaaattaattgattgcccaataccctccaattgccatgtgaaaaggattaatcgaacaacatgtaaatagggtatatggggaataagtcttgttcatatgtactaatttgatcaagattttagtgacatttcaagatttgcgactcatatcccaaatgccgtagcacatgactacatgagcaataaatcctgatttttttcccttttaaaacaaccttaatttcatatatgaaacacgtctctttagtagaaacaattaattttaccattctagataaaaatgggtaaatggttttgtagttgttttcttacgttaaaaaattagaaatgtaacagtttttacgattgtgtgcaatattaggtctggcatggagtatagaggcacgaagcatatgttcacgcactccattctagagggagtataagagcagggt

SEQ ID NO: 103930 - DNA, 526 bp, Oryza sativa
attttatttgtttgacgtccaacatcatataacaaggaaaggagggagtagtaatatttttcacactcaagctagcatatgcccggcgcagaaaaggaagctggccccacatttgtcacgtatagctccacggcaccaccgcaaaattctcgttgcgaatccttgcaaagcgtatgcacgtgtgccgtgtacatggcaccagaccagatccatctgctactagcaccttgcagtcctgagactcctgattccttgctacttggtccccaacggcgtgccgctagctactgggcacgccgggggagcaggcacgttattgggcgtggtcgccccaggtgtgccgcacgggcgagacacctcacctgccacgagagccttcgcaggggagagagctccacacgtatacggtgatcacaggccgccccatgaacaacaatgatttaaccagttgatacatatctgaactctgaactgttgttttctgacaacattaaaatggacggtttgaagaacctttattaaaatg

SEQ ID NO: 103931 - DNA, 949 bp, Oryza sativa
cccctctccctctggtcataagtattatatgtttagaacaaaatttggttaaagttctgaaatcatgacgatcgattacatattagaataagtgggatatcgtgctagtaattttcacagtaaatctatgtatattatttttttttgaataagtatttgaaaaattgcaaagttttaaaagattaaccataaatttcaacaaattatgaccggatggagtatctttcaagtcacacttgtgtccctactacaccaaccatatgctactagtaaatgtttgcaatcactctttactcctatatatgtcccacttgaaacacagagaaattcacataaattatgcaagtagtatttcacagtgagccagcaggaatactcctggagtcctcccattctttttataaacaaagtgaggatactatttaaaacagggaccttgcgggttgtgccaaaagtcaactcctggaaacgggttccttacagaaatataatactacctccgtaccatattataaatcaccgtgattttttgctattcaaaatttgttaagtttaattaaatttttagtataatttagcaacatgtaaaacacgaaattagcttcattaaatctaacattagatatattttgataatatatttattttatgttaaaaatgctaaacttaaaaaatataattacgaaaaaaatttcaaaacaactactccttccgtcctaaaataaatctaagaccagataagacatttcttagtcctcgatagtattagaaaatgtcttatctgattataggttattgtattttgttatatttcgagacggtgggagagggagtaataacaaggatggaacagagggagggagcagtacactcccaattgcaaaaatctggtcaaatttgagccgtacgcccagttgatatgataagtggtgcactacatatcccccgt

SEQ ID NO: 103932 - DNA, 729 bp, Oryza sativa
tcagtcttcggtcattgaggaggttttggtcatctcaaaattaagattgacttacattaaaaaaaagttaggaccaagcaatacggtctcgatcatgaccaaaatcatctagagttatccaaaaagatcatctagggatgcaagcatcacacagagtccaagatcatcaaaaaaccaaacaaacacacaatcgtcaaaaatcacaaaacacatgaacccatctccagccatcgctcatggatctctgctactgccagcacacacgcaagcatcgaaggctcggagcggcgtcctgcgaacacactgttgtaagggagcacgtgatgtggaggagtggaggaggaaggttggatatgtggttagtggcctaccgcaccggtgctagatgggggcaacgaggtggtgcgggtgtgcaacagccctcccttcagaaccgcatagctagtccatccgacgggcggacccacttacacataccaccacacttacattttcgttctcgctttgtgtaaaagggttaatctgggagtggtatagttggagggacacggccttgtaagttggttccacccttgttaaactagcaaggttgtactaaacatacgcacacagctcacatgggctacacatgcctcatcctgattgggccaggatgtcccaaggtgcttaatggaggcagcaaggtgatgcgggatgggggacagctcgggtaccgagctcgaattcgcc

SEQ ID NO: 103933 - DNA, 685 bp, Oryza sativa
  unsure (1)..(685): unsure at all n locations
aagacgaagcgtcgcttggatctcggatttattgtttaagggtatcgnaggtgcaaatgggcctaggcctgaacagtacttcagcccaatacttttaacagcgtggcccattgtgttccttagggacttaggcatattttgctttggcaatattatgcgcacaatagtgttgcccaatgctgataaaatcctttttatgcggtcatataattctttggaattattgcaatgcaaattaaaaggtgcccgacagaaaggtgttatactgctttttgttagctttattaggctacagaagctgtctgggttaatttggaatgacttgtttttatcatagtcacttccttggtatgttatatacctattttcattatggtaaatagtcatagcctaggctattagacttattcattaccataatttttataatacttggtgggtaatctttagagttttatattcggatgcctgtccagtgtgttcattcgtgaaccttttagagtgtaaaccactcggactcttttcattatggctaaaaagcagtcggctggcatgcctatctaggcgccgtgtatgcttttgtcatatgatgcacaattgtgttattattttgtttctcaactatatgtttagttcgttaactaatcacatagttgaaggctacacctaattaggtgcatctatt

SEQ ID NO: 103934 - DNA, 833 bp, Oryza sativa
tttggatcctctccatcgttcctgagtaaaacacgagtgcacgcgtctccggggtataaagaagaggaatatgaactcaagaaagaactcacctggtaatttagttgacgtgcacgagcgcgggtaataggaccatcatgctgtacttggggggacgtggatgtatcgatggtgttgatgtcctcatcatacctgccctttaaatagacttcacttccatcaattcacacacttccaatcttgagttgaattacaagatgctgtattgtactatttgtatactagaattaggaagagagtagagtagaagaagtcggtggaattctggagctgtcggtaatcctttcctgtttcttttattctgtttattactctaatattaataagaattatctttctgagtaatatagatttatcttgtgagaattacctcttggttagttcctaattagtatacgggattattgtttactataatcaactaatatatagtgattattttttttgaaagaaccacagtaggggaagcccccaccattaagattttatactaataaaggagaaaaaattacaacaaatttaaccactgtaacaatgtatctctctcagaatttttgattttatattaatagtgattattttagtgagttataaacactgaagtagatactaattccttagacatggtgtttaggtagttaatatctagtaattgcagcgtatcccagcgtatcccacagtacgtttgaggtgggtgtagaggtggtgacagccctcgagagcacttaagtcctccctgttcgggtacgtagtagagcgacatctaggaacag

SEQ ID NO: 103935 - DNA, 1189 bp, Oryza sativa
acttgttattttgaacaaccatccatatgtagggaaccttatgcatctaagtaattgttatatgagtgatggttaaagataaaaggaattcttgcagcatttgtcatgacttttgggggatttgtttttcaaaatgaaatttccttcaaagctcgttcctctaaatgatttcattattctacctactaaggccatatgctagtatgacaatgttaaaccatattgatgcatatgactgcttgacattataatgagctttgcgaaattaatgtgactcgtgttagatatctttcatactctcgtgatcaagggttcatatccacatacacaaaatagctaggcttctacattggaagttggctttccacaaaaatttcattaccatctaaataaactcgtactttgtactatgctttcttctcctagaaaatcctttgcaaaaagaaaatgagaaatggagggaaaggcatggctattaaaaaaaaattctttctctcaaaacatggaccatgataaaaaaaaagagaagaaaaagggaaactagccatgccccttccatatttatgcaaagaaagttggagaagaaagtataggcaaagcagaaacattttattccatcattcataaaaatatcttacattttccaccaaaaataaagacccttgatctaggagtataattgatgatcttcttgagtccatgtatttggctttgcaatatataagatgcaggtgtcacgaccggaaataacccaacgggcgttccttacgtgcgtgcattattccttgtcccaggaggcaaggtacaccaaaagttgatacagttcagagttcaacaagcggaagcgtaaatagttaatttattacatgggcagcgaaggcccagcacacacaaagacaaacgagaaacagcggaagactagggcgacgaccacaggcgcttgacggcaggcacgagctagacaccaaaatcttcatcttccggagactcctcttctgggtttgggaaaaattgagcaagactgagtacaaccactgtactcaacaagacacacccacaagtgcataataaatacaagggagtacaagggagttataatataaagggttagggttgcagtaaacagcattaaaagacacttagttgctcaaagctattttgtaaacacgattctagaactatcaatatt

SEQ ID NO: 103936 - DNA, 704 bp, Oryza sativa
ccttttaacacatgattaattaagtattagctatttatttttcaagaatagattaatttgattttttaagcaactttcgtataaatttttttttgcaaaaaccacgccgtttaatagtttgaaaagcatacgcgtggaaaatgagggagaggggttgggaacatggggttgcaaacacaaccacatgtgaagcagcagacagtcgggcccgcatgttagatccgcacttggactggagagcagagcatcgcacacaaccgccaacgcagccgtcagcgagctcggccaggagcagaccatcgctgacgagttcgatccgtaccatgccagctgtagaccccgattcggagcttgttgccacagacagaccaagagcacgccgtcgacattctccatgagcaaatcgaagaagcaggtccgctgtgagggagatggaaagagagggatcagttccgctgtgtcgttgccgacctggaagtggaaccggcgtcctcgattcagagcactctactgccgtcgagcttctgtgtctggtggagtggtggatacctcatcgccgttgctgctttttcattgaacaatcagagatctgctgtttcgttgaacagacagcattcacaattttggagattgaactgtataggggtagagattattttttttatgaacatatatcattaggatgtactatgagttggattttt

SEQ ID NO: 103937 - DNA, 1327 bp, Oryza sativa
aaaaaaggaactttcgcaaataatttttatttataaaatatgtccttgggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgacaatatttacattattacaaaggcacttaaggcctgacaatcaaaaataaacagcagcggactagcgggcctacggctccatcttcacaggcgctcaactggggtataagccaggactccccctaagacatcttctccaaagcttctcttactgaagaggggaaggattgagcaagaatgagtacaaccacagtactcagcaagccacaccggcagatgcatgattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcagaccgaactggcaacccgaccctgagtcccagctcgtcccaagccaacccaggccaaccattccacattttagttgttgagcaaattttaagaattcaaacactaacttgggtacattgcttggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccatagacaagagtaccgacccaatcccgcctacggccagaacctccgggacaggcaggcaggactgaggtgctactatcaaaaccatgcaccccgagcccagcctaaaaccattttggggattttgaatagagggggcggtgtgaatccaattccacaataaaccaacaattccaaagtgtccaggtgatatgaatatcccaaagtctagagttgtaaaaccgcctaatgttacctaattaatcagcgaagcatctacctaaaattatactagtggtactatgagtagagtgtccactagttggggttttgtttaatctagggtgaacaaggtaataataacaatagcaataataataaggtcataacaaaggtaaataggcatggctaaataaaacagtgataacgcgggaatttaaat

SEQ ID NO: 103938 - DNA, 508 bp, Oryza sativa
tacgtacctatatatggatatatggagtacatgtgcttttgttttcttttttggtgaacagtaaggtatttgtttctttttaaagggataataatacatttaatctaatggtccaaattattgggtcaccgatttaagtgaaaatcgacggtgtgattatacattgccacgtggtggcttaaaaacgtttgtagaagtgacacgtgacgatttaaaagcgtttatataaagtttaatggacttttagtatataatagataatgcaaacggcgaaaccacacgaaacagggcaatcggtgcacgtttaatttaatcacacaccccatgcacgtcgtcaatgtttttctaaacacaatgggccatggggggcaggccatgtgtccaataatttcgaattataaattcgtaattccatcagcaagcttaaatttaaattcgtgatggcatgtcggcgatcgatgggcttcattaattaggaccccaaagatcgataataaataaacgcata

SEQ ID NO: 103939 - DNA, 624 bp, Oryza sativa
agttgaaaaaattcaatcatatttctttcatattcaatcatatttgtatgaatatgcaagaaattaattcaggtaacaagaattgtagaatagcactatttctttcatataatttcttttatgattagaattttcaaaatttctgcagaaaatggagctaacaatgcaaaggttgattatgaaaacaatgttctatctctgttggaccaagactacattgcagtaagtatttttactttgacaaccttaagtttgatataatttcttttattttctttgacaatcaagactacattgattttttgttttttttatcaaataggattcatttatatcatacactagtctaatggaacatattatttcatcacaaccaaaacgttgcaatgaattgaaggtaaatttttttttgaaaacaaaagtactgatttgttgttcatttatgaatttatgtgttcaattaagtatattttttgaaaatctttcaaaaactgtttaattaaggttgaaggaacaaaaaaatgatacaatagagactggaattggacaagattatcaaaaggttgacgaaagtttgaattcacacgttgaatatcaatcagaacaaagatgcttgatggatat

SEQ ID NO: 103940 - DNA, 502 bp, Oryza sativa
actaggtccaacccatccaaaaaatagaatggatcatctaacctatcccaccacatctccaaaccaaacacatgcttagtgactattatatggagtaactaactaataatactaataagtagtactactttcatttggtgcctcatcatcatcagaagaggacttgtcatcgtcttcaaggtcgtcctcctcctccgtagtatcgtcgttggacacctcctcctcgtcggacacctcctccgtagtatcgtcgttggacacctcctcctcgtcgtctccattgtcatcgtcgtcctcctcagactccttctcgccctcgctgaaatcgtcctcatcatccccatcattgtcactctcctcttcctctgtcacaagtgttagatggatctccctccccttgagcccttgggctcaagggggcctggacccgcgccctgatcgggggcgcccagcccaatggctggtgggcccccgtcacactgtgccatataaagaggggtgg

SEQ ID NO: 103941 - DNA, 2624 bp, Oryza sativa
atactccctccgtaccaaattgatcatcatataagtttatgtatcgagactaaggataatttaaatcacatcaatgaagtaaccatatacatattctcccacaatgcatgcatcgattaaaacaccatgtcaattatacattttagcatgcacatgttctctcatgctgcattaattgtattatgatgaaatccgtgtctatgcggttacatgatgatcaatttaagaaattttaaatttcattatatgatgatcaatttgggaacgagggagtagttagcctatactccctctacttttgatagtcatattttcatcttggcacacagaccaaggataagttattctacttatcatccatttaaacatgctactaatcattcctcgtaaacaagcgattcattaatatttacatttcttaatgaccatgtagccaatcttatatggaagaatggagagtcatacattaaatccgagaaagtcattaagataataggatgttgaattgaaatacgcctatcaaaaataaatttttcagatttgaaaatatgactatcaaaatagatggaaggagtaattaagaaacactcaggagtctttcggctagtttcatagggagtatttgtgtccttttagttagcttaccttaatgttattatccttctttaatctcagttcagccagccttccaagaacccctgaaaagaaaagggaaaaaaaacgaaaagcaaagcgccgcggcacacagagggaggggcctcgggatttggtcccgaaggtggcgtgtcagtctggagccccacgcggatccgacggccaccagacaccgtccgacgcgtggtccccacgcttgtcacatctcccttaaaccgcgtgctaattactgtgctgaccgctaattaatccacttgtgctcaaactttacccctcgtggtgattaatttactcctactggattagtggtaaaagtgtttagtgtggggggaggcagccgagccaggcaggcaggcagaggccaaaaccgtgttgaccttttggggggttggggcaggcgaacgagggccacgggttggacacgagggaagtgaaatcccttggtgcacacggttgcaaccacacttaagacaaggcaaaaacacttcctctcctttcactttgggcctttggctcgtatgttttctgagctggtgggatattcgcagcgtctcttattttgtgggcaaaatttttttcactatattttacgtgaagccatgtgagaaaaataagcaatgattaatacgagacttggagtgaggccacttgggtaggtgagcatgcatggtaacacacatacggtgtatgcttggttggttggctagaatacggtgaaccatgctgaataaattattgtggtagtaggttggctgtgtttgatggtgattttacttatatagcgaagcatttgtgttggtatagttatctaataaaaaattatgatggaatagtattagctaagatatcaagatactattcaattttggattttatgatactatttgtggtatctattatttaatcgtacttaattgtagtgaattgatgtttacatggcaaaatgatttggattcatcaacataaacaactcagcatgttgaataaattaacatggtaggatgcatgtgcagtaattatatatattaactggcatgaatttgtcttatttaaacacactcaattctagtgcgttaatattattagcgttgaaatgattctgattcatagacatgaataatagtagcacgactagttgcaactaaacaaccaaattaaaccaagtaatttaacctagatatgcccatattaaagaacataatattctaatactaatataaccaatatgtcttttttttttgaaacttaaacacatatattagagcaacagatcaagagggcaagcccccgaacatcatcaacagagacagcaagatgcacagaatagaaaactggaacaagaacacaaacaacctcctaaaactagacagtgcagaaggcgcgaatcgacagggagcagcggcaaagccatgacaattgcaaccttgggtctcctttagcatgcagaccgcttgacgaaccgttaatccccttcggtcgcctccacagaaactgcacaaattggagatttgctgttgagccgtagattttggtggaagcttcaccggactcaaccaaacttcaccacggagttctccattgaatctgaggagcttgagctcaacccgaatggcacacccagcgtggatgccactgcccggagacaaagaggaagaaggatcccagatccagccaccctgatgcagtgaagagcacaaccatcgacgaatgaactgttctctatagcacaacgttggggaagagcggacttgcacaaggtggagcagaagcaccagactaacaccaccgacgccgacgtaggccacaacagtgcagtcattgccgccagaggcagcaacagcgcagccgccaccgccgcgggccacattcgagccgctgccgccgccacggaccgcatccgagcagccggcgccaccgccatcgccgcggactggatccgcgccgccgccatcatcttcggtcgtaatcgc

SEQ ID NO: 103942 - DNA, 9070 bp, Oryza sativa
ttaggtattatccttaaattgtagaaaaatctttttttaaagacttccgattgttttactttatcataagtacttttttttgtccttccgtcagatgatatgtaagcattattgtttttttttcaattatctgtacgtacggagtacttttctggtcaacagttatataattttcatgtatccgtatataggagaattgtattatttgtcaataataaatctaatctaattgtgaaaaatgaaacaactaaattgtgttgttttcatttttacaaatatagatttaaattagtgttgtatattcgtcaagtgatatttgacaccctaaaatatgatatgaaataaaaaaataccatagcattaattattatatatattagtcttgtatgttaagatagaatgaataaagatcattgatgggatatttcatatttataatataaatttagtttaaccacgtatatttacataaatttgtagagcaatatatttatcttcaaatagtagataatactatttcaaaagaccatcgatcttttttccaatgatacacatttttttccgtgattttgaaaatactatttcagaaaaccactgtaaataatatttttcttggttcccagtaggtaaacttcatttcttttcccaggtcatatgcacgtactgactactccctccgtttcacaatgtaagactttctagcattgctcatatattaataaatctaaacgcatatatatgtctacattcattaacatctaaatgaatatggacaatgctagaaagtcttatattgtgaaacgtaggaagtacttatatttcccgtatacgtatatagagtaatagggtgtttttaaaataaaatacatctaatctagtggtctaaaatattgggttcaccaatttaagtgaaaatcgacggtgatatttgcttaaatttatagagtaatagattttatatttaaatagtagaaaactccatttttaaagataattgattttttaatggtactatgtatgtatatttttttagctttattgttttctatagtaagtctgtgcatagttttttatttataaacagtaggtaagattgattgtttttagtattacgtatgtacgtacctatatggagtatatacttttgttttttttctttttctggtgaacagtaaggtattagtttttaaaataaaatacatctaatctaatggtttaaaatattagattcaccaatttaagtcaaaatcgacagtgatatttgcttaaatttatagagtaataggttttatctttaagtagaaaaatatctattttaaaaataatcgattttttcatggtagtacgtacgtactttttttggctttattgttttttttatagtaagtctctgtgtgtagttttttttaaagtaaatttcacaaaactacatatactttgaccacaatatcggaaaactacagatttaacactaattttatcacaaaactatagatttaaggtaaaatatcgcaaaactacagatttagtaatactgttatcacaaacatacaggtttaatgtcaatttaatcaccaaacttagatatttataactcaaacataacattagtgcaaaggatttaaatcctaaaatatgtagttttgtgataattttattctaaaatatgtagttttgtgatacttcgtcttaaacctatagttttgtgataaaattgttactaaatctgtagttctatgatatacggccttaaatatgtagttttgtgataatttggtcaaagtatctgtagttttgtgaaatttactctttttttttcttacgatgaacagtaggtaagattattgattgttttttagtctttaggtactacgtacgtacctatatatggatatatggagtacatgtgcttttgttttcttttttggtgaacagtaaggtatttgtttctttttaaatatataataatacatttaatctaatggtccaaattattgggtcaccgatttaagtgaaaatcgacggtgtgattatacattgccacgtggtggcttaaaaacgtttgtagaagtgacacgtgacgatttaaaagcgttatataaagtttaatggacttttagtatataatagataatgcaaacggcgaaaccacacgaaacagggcaatcggtgcacgtttaatttaatcacacaccccatgcacgtcgtcaatgtttttctaaacacaatgggccatggggggcaggccatgtgtccaataatttcgaatcataaattcgtaattccatcagcaagcttaaatttaaattcgtgatggcatgtcggcgatcgatgggcttcattaattaggaccccaaagatcgataataaataaacgcatagaaaaaaaatactactaaatgaacctgacacgttatcagttatcacaagttgaacggaatttcaacagccagacacggactcgacactgttcttcacctcctgcaaggtcaaacccgttgcacgttgtgctcccccaatccgtatttgacgttgaccggtcagctttaacggaggtcggaacggcttaccgggggagcccgcacgaatctcaaagccgcgtggaaatcgggccgccgataccgataccggtggcgtttttgcgtacggaggcagacacgtggggtctgtacccttgggcccacgtgtcagtgggtggtgtggctgactctgggtgtggtaggtgagcggacgtggacctgcggaaagtcgcaccctttgactcgttcaattccgctgggttgtgtggggcccacctgccaggctggcacgccggtgtagcgggagaaaattgacattttgccattgtcaaaacggagtttcgctaaaatgacactctcaaaagtggtttcgttaaaatgccatccttagtcaggggcaacatgctgcaatgccatttcatccatttcttcttagtttaatgatttttttcttactgagatgaccaaaatacccttggatcctatctcatctctcttcttctacctcatctcttcgttgcatatggtggggcggcgccggcgcagctcggcaccgtcgctgaaccgctacgggatgagaaagctggccacaccggggatggcgccgacgccacctttcgccgccctcactagctcgacggcgaagctcaccgggttcacgcacaggttgccgccggtggcgatggcgaccaggaacgggaaaggcggcgcgcctggggatggggaaagcgccggcacggacggggacgatggttcggctcggcggcgcggcgcaccaagcgctcgacttgaacgcgtgccacggcgtcacccccttctccgatgtgctcctcgacatgggcagcgacctgctcgcagcggagctccttgtcgaggcgacctggttacgcgcgcaggcgcaaccaaattaaccccggggggttcagcaacttgagtgggcccttcaaacttggccgggagagagatccacccccgccattggggggcttggtattggagaaggacttcaaaaatcaccaacggagtaaacccgtttgggtgggaattggtggggggaattaatgaggaggacgagaggaaccaatttttgcattcaattttgggcgagagcaaccaaggagtgagatcaatttgggacatgagttcatcggagagagaatgatggtggcggacggaggtgaaagacgctcctggcaagccccacggctgaggcaagggcatttgggtcaaaccaaataagcaaaacagtagaaaacatttgcaaataataaaaattggttgaaatggcagtgtggcaagatggggtcgtttgaagatggcattataacgaagccacatttggcgatggcattctgacgaaaccccaacccgagaatggctaaatgtcaattttctcgtgtagcggtggctgcatgtggggtccacacgcgtccgtggtctggctggacacttcgctgacatgtggggacatcgtgctggggagggtgcgcgtcatgctgacgttggggggtgtgcaccacgtgtacggctttttctcctcctggcttccattattggcagctgttgttgttgttggtagtttttgttagagcaagtttaatagtatagccaactgatttatagccaatttaatagcttattcatataatagttacatactatactattaatacctagccccacctgtcatagacacactgcgtcttggagtccgtgctatagctggctacgaatatgtagtccgctgctcttctctctcctgatttatctttttaaaatatgtttgcagctggcttatagcctgctattgtacctgcttttagggatattgttcgctagggatggtcctcagctcctgatgaaaggattgttagttctattaattaatagatcattgttgattcatcataatttcctttattcaatagcaattcatggctgtagtcgatcaatctttgctgcaaacagcgtaatcttgttactatactgattaatctcagtctggtgaaacttcgatctttcaacaaaaaagaaaaaaaaaatctttggtgaaacttgaattatcagattgaccattcgcccttttggaaacaagaccttgaaatgcgaagcctggttagtcgtatttctcaaatcaataagcttgaccagtctttgcttaatttgcaatgaatttctgtcctggggattctcatgtacatcttgaattgagcccggtagtttgtcaatgcaagacattaagaagtcgtaaatttatgtgcaagtggtgaggtcaacgctttcatctacttcttccgttccataatataagggattctgagattttacttgcaacgtttgaccactcgtcttattcaaatttttttgaaattattatttattttatttgtgacttactttattatgtatagtactttaaacacaacttttcgttttttatatttaattttttttaataagacgagtggttaaacgttgcaagcaaaaactcaaaatcatgcatatatgctcccgtatatagtcccatgcatgcatgccttttcttatacgctaaagaaggcagcacagtgcacactattgacttatatatacgcgtaattagtcaattacaatggcctagtttgatttaattgtcaatagagtgcagaaccaaatatatgggcgaggtgtgcacatatatacatgttgcttgatcaatgcatgatcacaagactaaattaaaccctcaaataattatcacaaatcattctgctattcagggaaaaaaaaactccggcttgctaatgttcaacaaccaccattggtcccatgcatattttttttaaaaaaaaaagaattcctaaagtttttctatagaacgactcatgcatgtaatccaagcaaacattgcaatccattctagttaactgcgaatgaaggaataatgacagtaaaggaaaaaaaaacaaacaggatgtaccttttggtacctgatgttagttaggtcaagaaacgttctcactggttccctaatagctcacaaagatacgtgacgcgtcaagaatatattatacattattgctactgggaattttcaatagaatggcatgatatccccaaatcctgaagccttgtttctttcagtggaaatgtggaatattcagtgtctattcatcgaccttttgaatgatatgcaggaatggaattctatatttttaaatagatatgttcatgctaatattccacttaattttggaggaatatagcaccttgaacaaatttgcagtggaattattaggtttagatatatgtgcatttccctatatgtttacttgcccaattcttctgatcggaaagaacttctcttcgagattattcccaaattaagaattccttgttatgtttacggctggatcccctgctaatataataacgtgtaaagcttttacttgttcaggaaaaagatatttgcagctgcagatttattacagattcttttatcacacagtaaatccggtacttcacaacattggggctgcaaatatcattttccctagtatttttattgtttctaaacagtgcctctctgattttatttatttgtttttttgagggaacattttatttattggtttaataaatttatatactatagacctcatcttttcgcttattcttatactccctcattccaaagagatatttaactatttgatgaatagttaaagtcttattttattctttgatttttctaaaagtctaagtcatatttgtaattattatgtgttatattaaatttttgatcggatcccaagaaatcattttagtacttattagttgcatgttcgttggttttgtcacatgatgaatgagttaactacaccttggttttggtaaaaaagaaatactagaacttagacttttggaaggagggagtacttatcaaccaaaatttgatttttcaacattaaatttgaagctggttttggatttttttttatcgaagtttatttttcagcctttgcttttggatcactaacaacccgtatataaaagttttattcaaaatcactttttgtttgcaaatatgccgtttgttttattccaccagacgatggggttgcatatgactgtttcagttatttttctgcctactgcctttgaggtacacccatgcaaaggacaaatttgcagttttttcaaaggtatagtacggatcaaaaagcgcaagtagccaagagattagatagcatcatacgtaagcgcttacgataccgtacgagaaattatcctttgtgtccgtacaccggtactgcagctaatccaagaagattagattatcagaaagaatattatgccaaaactactgtagagcacagtgtacatcgccgttatattagaaaaaaaatgggtcgctttagtggcatcctgaatagtatttttctctcacgtgggggcttcgtatttcttactaactgaacacgattactgttgaactgttgaagaattatatgtactggtcggttgcgatcaaggcatgttggcgcaaccgtggccaagacaatgttattatgtgacactataaagtgtttgtgggtacgctattaaccattggcttattatcgagaaagcaccgtagtgtactggaagagttgggtgtatatgacttgatccacggagtattaggttacaaagcctgatactcacggatattagaatattttcattaaaaatatagagggaccagagatttatcggtagtcttcatctatttgagcgggaggtacatatgtaggaaaaaagaaatctaggccattagaaatagggtattgaagaaaaaatgaaggaaatttacggtattgtgatactatgaaaaacctactaggccctttagaataggggtggggaaaaaactcaaaactcgaatggcttggattggcttgaacttgtagttttaatgcgtcgagccagtcaccctgcagactgggcttttagctcatgagcgtaaagccaagccaactcacgagctgctcgttaatacaaagagagatcaccatatatccatgtattcagtgcttcttaaccagtatttagtcatttagctacattccaattatttgcatttaattatttttattagttacttcctccgtccaaaattaaatgtgtctaggatagggatatgacattacttagtataaataggggcatgtccaaatttattgtactaggtatgtcacatcgtatcttaagttggtctattttgaaacaaaatgaatagtttaatattatgtttatatatatatttgagaaaaatgataaatttgaaaaatataaaggtgatataaaggattagcctactttggaacaaaggattagcctcaacaaaatcctttgaatttcctgtaggatgacccattttcataagaattgtgaggtaaactaacaaaagatatagccttatgttttctctcccttgagtcttgaagtttcaatgtttttttctggtgctgttaaatggtattcgttgcaaattcccatggttcaattttctacaagatttaacacaacatggtattgtattcatgtgttttctttattggtgtatttttcgaatcctctgttttagaggagccccgagcccatactgatttgtatgtactccatccgtttcataatgtaagttattctaatattttccatattcatattgatgttaatgaacataggaaatgctagaatgacttacattgtgaaacggaggaagtatactgttgtccgtgtataatgggaaaaaaaagaaacatcggtccgccaccgccatcttaaacattttgacgtgattaaaatcgcatttttccaccatctgactttcatcatgttgtcttatttacagttcaaaaattatacatacttcctccatttctaaatatgtaacgccgttaactttttttaatatgtttgaccgttcgtcttatttaaaaaatttaagtaattattaattcttttcttatcgtttgattcattgttaaatatacttatatgtatacatgtagttttacatatttcacaaaggtttttgaataagacgaacggtcaaacatgtgctaaaaaatcaacgatatcaaatatttagaaacggagggagtatatctcaggtcaacgttgacggatccatcatgaatcaacgggagcaagccggcaagtggcaaccgtcagttgtcgtgcatcgctctgccgctgacaaatgctcctactgatccgaggcgttcggaggcgcaccatcacgatccaccgtacgggttagaacaaccgatgtacggatcttcatctgccaagtgcagtagattcgctttttggcatgttggcagtgcccgggttcaattgagaccgaccgtttaatccgatatgaaatccaaactgtacgtttaatacgcataataatactggtagtatcttgtttttctttttctttttttgaaaaaagtgctcgaataatccgtattagggtagttgacttgcatacaaattctcttccaaatccatacaaatactactcactccgtccctaa

SEQ ID NO: 103943 - DNA, 2253 bp, Oryza sativa
caccccataaaccctaaccgatcgagggggcgcagccagtgacgggaagactccaccgccgcgccacgacctcgccgggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaacctaacaacaagctcctccctccaatgtataggagtgaaggttgcagcgttactctcgtcgatatcaacgtaccctttcttctccagctcattacggatccatgccttacgcttgacgatgcgtttctgaaactcgtcatgcgtcctcatgcagctgtgcatgagacggagcatctcataatctttcttgatccggtagtattcagggcatctgtagaataatgcatcgtcttcgtggcgaggatcgcatcgatggtctgctgcgagagccggatcttgccttgtggcaccggaggatgcccctcgccgaccttctccgccgccttcacctcgtgcactacgctcaccatcacccgcactttacgacgggtacccttgtcagggccattcacagtcgccgacgccgtcgcttcatcacccacctcctccttgtcggcaatcaacgccgccgctgccgtcgcttcatcacccacctcctccttaccggcaatcaccgccacatccttatcagccatcaatcaccacgactctactggggattttgaggatttctttcgctgggagaggaggcttccgatggggattttcggaagcctagccgacccgatgatggagcaggcggcagtggctcccgcattttataccagccggtcagggcaaaggattccgagttgggctttggatgtgttcgcgatcgggcctgaagcctcacctcaatggagtccgtctcggataagcccagcacagtccaacctgcagttctactggaaattggaaaatactcctgatgagatccgatatatttttctggtgaaggacatgttctttccttctatcatcatgctatcttgtgaatgaaaaggttgtcttttgatgtgcggccaatcggcaccaatttagcaagcttaatacaacggcacaaatttggtgagcatgcagtacggaaacgggtaaaatatatgatgtggcaatgattatatagctttgaaactgaaaatgcaaaaatgaaatcaacgccgtccgtggggatcgaacccacgaccacgtggttaaaagccacgcgctctaccactgagctaggacggccaccgtatggttacgtttggaaagtcttatctctaaactgtaagaaaaagcctagccggccaagccaactatcgcaacgactaaattttagtttcttatcagatcgaggatgatcgggagcttactctgcaattcaagtattcaacagctttcactctcttagctttttctttattttgattagatggaagacacaaacgcacacgcgcacagacacccaccattacacacataacactaaaccaaaatacgccccaaacgcactaaaccaaacagcacaaacttgttcttactacatatttgctaatggatagagttatgcaccaacgatttcatccgtgtatcagtcggatcttaagttcgttcgcttttggaaatacggatatgtatttgagatggattttaaattctttcgcttttggaaatgcaggaggagtaatataagaaatctctttaaaaaaaacttatatgctaacttgagatgattgaactcttaattgcagctcataattttctagaaaaatatatatatccaagcgaattctcatagtgaaactattataaaaattgaagatgtttttgccgctactttggtatgtcacccgtgtatgagtcggttttaagttcgttcgcttttggaaatacatatatgtatttgatccgggttttaagttcgtttcttttggaaatagataagtagtctaagaaatctctttataaaaacttacctgctaacttgagatgatcgtactcctaattgctcttaattctcgcattgaatttcactttcaccttaactataatgtataacaataataaaattaaaataaccttcacccgttgcaacgcacggat

SEQ ID NO: 103944 - DNA, 631 bp, Oryza sativa
tgatgcttctctccgttggactgcggggttggtggcatcttttcttcgtcagcagcaaaatgatttgcaatcttttggtacatgatcagttcttcacaaaagaaccaagtgatcctgctcgttggacacctgtcgggtggatggtcttcctcacaatgaacgcatgtagtggcacacgagctggcaacatgacggatttctccacaacgagagcatgccttacgttccattttattctggttgaaaccttggggagacttctcatcttcatcatctgaggagacttgatctgaatcttcactatcagacactctacctccattagctaaaagatgctctgtcaactgtggtgcacctcggaaggtatttcttctctgacgttttgtcattcctggtggaggccattctgtgctggtaatgatcatcttacggacttcatcttcggttcgcattggtgtttttcttttctgctgaggaccctcctgtcacgtcctgataaattcatcccgaattaaaaatcattcgctaaaaggaataatagaattaattaaaattcgaaaagaaattggcaaacactaaaatacgtgcaagaaaaattcaaatgtggcccggagaatttttgttaaattct

SEQ ID NO: 103945 - DNA, 689 bp, Oryza sativa
  unsure (1)..(689): unsure at all n locations
gcagtttttggtgtcacaagggatccacttatagtgttatcatcaaatatttttgctatttctggtaatccttctttcttttgtgtttatgaacacatcttacaacaatcctttctttttattcatagcacatatcagcacttaccaatgtaagaaattttacaagagaacttttaccactagctaggaacttcccgtgagcttgctatttatcaatgaatatttctgcagcctttacttttgttagcacctgcagcctgcattcattcagccagttgatgctcagagttagttttcacaattttgcagttatctgttccataaaagtactgtttcttgctgtaggtatttgggctgcattcagcttgattgtttcatataaaatttaaatatactagttatatatctggatattacagacgatggtctaatgtggcacacatgaccctattatgtcctctcgataacgccaactctaggtttctagcaatctttgatgtttatacctcagtttgcagacaagtgattgatttggtaattgagtaacttctaatgatgtaattgggtaaatgataaatngataataacatacatcatagttacatacttgaagttgaatgaagcatgaaagaagacattagatatcagctagttttgatgctatatattttatatgtcacacattttat

SEQ ID NO: 103946 - DNA, 646 bp, Oryza sativa
cctgcaggtcgactctagaggatccccatataaaataatgactcatattttcttttaaaaaaataagacagacaattaaagttgtacacggaaactaatggctaagcgtattgggagataaagtgagaactatttttttatattatttttaagtattttattgtttggtctggagcgtgacacgagatgtggacaaacatgtcaatgttatgcaaagtatgcaacctgtcgggctttggaaacgtagattattggactatcgtttctttatgagtttagggtgtacaactagctatattattttgctaatcacaatttctatggttttttttgagaagggacaatttctatgggttggtgtactgtattttagtgatattagcatatacatgtgccagtagcatatacatgattttatacgttcaactttatttattttatcttctagttggtttttttctagagacactgatttttttatgaattgattttcttgtgaaaatgtcccttttatggtttctgaaagggtggtttttaactttttttactttgttttttatagtagtaaattgataattacttcttctcactccgtcctataaaaaaccaaaatatgataatgtcagggttatggataccacatacc

SEQ ID NO: 103947 - DNA, 642 bp, Oryza sativa
caatgtaatgtaattatagttttgtaactacaatataactagaatgtgactttgatgtaatttgaaaaaatctgccataaacatgtgatgatgggactagcttgtgaaaagagggtttagattcgataataaaatatctcattacaaatcttagcgcggaatcgatggctaaacactcatgaaaactgtcgaaagtcagctagtagttccgtttatttttcatagtagtactaatactaatattaaggacaagtagaacgtctcacatcagagtactccagtggataaagacagctattaccgacgaacagatgggaagtcggaagtacccaagcaaaacaactgatgaggcgaacgtgtatcaacaggcacgaaattaaattgttttggagtaatttatgacggcttcttctccgtacggactttggaatctcctctaatgaatcgacttgacgtgacagtcgtagtagtattaacagatgattcaagttgacccgattttgcttctttttttttcctccccttttgctggcgatcccccaataattaacacaaagagcaaccgcccctctggtggcatgcaactaagaaagaaaaatgcacgcctctgtgaagtataaatttattatatatagttgaagt

SEQ ID NO: 103948 - DNA, 641 bp, Oryza sativa
aaaaaaaaatcctctattctgaaggccttaaggacctattcgttttggagaaatttcagaggatttggatttttaagaattaattcctatcattgccatttggtttataggaatgtagacataggaaaatcaaggaattcttcctttcctacaagttgtagagagaaaacataagaaatttttcgtcttcttaaatctcttggaaaattcctgtggattgaagtgtgcgtatatttctatttctccactttaaattccttaaaaacaaatagggtgcctaactatttcatctggtcttgtatgacactgacatggtttttcagatgcacatttagctaatacagtacaattcatattgttgaagttttgcgcatatttttatgtaggagtaaatgagttttaagtatcaatttaaatttaaaatgatgctggtacatcttttcaaatttgatcaaaagctccaacgagtattactcctatttgcacataattggcagcgttgtgaattccaaacaagcaaataaagaaagaaaaagacagcttaaaacgaccgcataactagagtcacagctaagcgataattcacaacatcacgatgcaaatcataaatcagtttcgtttttataaaaaccctcgtaggt

SEQ ID NO: 103949 - DNA, 632 bp, Oryza sativa
tagtgacgatttccacaagtatgggcagccctaactcctcgtggcagagctcctcgagcctcccgcggccgccttcgccggagcagcaggtgtcgatcaccatgcacagtgggtcgaggactcccttctccctgacccgcgcgagctccagcagcgagccagggaagagcgcatcccagacggcggcgcggtggtgctccccggcgagcgcggcgttgcccagcgcctggaggcccgcgcgcgcgacgtcgggggagtcggagggggaggagagggcggaggagacgaccgcggcggggccggagaggaggacgaaggtgccctggttgaggtcgtcgccgcgaggaggttgcggaggaggcggaggcggaggagcaggaggcggtgggtggaggccggcaggaggtggagggtgtcggcgagggcgtcggagagcgcggcccggccctgggcgcttcgggaagcttctagaagcgcctctagagtttctgtcctcgatctcctcggcttcccacattttctcctctgcgccgttgcggtttcgccggcggcggagagagaaggagacagctgttgctggatggttatggaatggggataccgtgcaggcgtgcagcggcggcctcgggcca

SEQ ID NO: 103950 - DNA, 533 bp, Oryza sativa
ctaataaaatcaaatcaaacaaaaacaattcagtaccaattttaatccatcaatcaatcaatatatccaacaccaaaaataccttcttacatagtgttttcattttccgggtactcctgggccggagctgggagagagcagtcgaaatcgagctcgccggagaataagttggcgtcgatagcggcggccgagaactccggcgtgtagctggccatgaaaggggatgaggagtaggagtaggagttgctgaagaagaaagcttcagggttcagtcctacggaagccgccattgcacagtgctgaaccttttcaccggtgaattttcttctgtgatggtaatggataaatggtcagggcggcgaggctcgcaatttatatgcagccatgtggcctgagaaacgcgaggtggctggctttcttggcttggcttcccggatctttctgggatggcgagcttggctttgatccgaaggttcggagatgcgtcacctgtcaaatccatggacctttagctaatctttgctttgggagat

SEQ ID NO: 103951 - DNA, 654 bp, Oryza sativa
ctgcaccccagctcaatgagtgcacgtttggcaccaagaacatggcaaacctcgaggtgcttgtttttgctaaatgtgcaagactcagcagcccgccgccgaagcttgatgaactaaacttcctccgggaggtgcatttggctcaaatgcctcaaggattctatgacggcatgaaccagcaaccaagaagctcgtgcattttccagagttccagcaccacttccactcgtcaaccagagctgtcgtgcaagggggaagctaagccataatcgccgatccgttcgcttcactcaccacaggcaggtgccacctctatcctccattgcaaaatgtttcaagtattcatcatcaccctcagcgtcactaaccaaacttttttacttcttgtgtgtacgccataccaggcttctgtttcagtgctgtaatttccggccagcttctagtcacagcttcatcagttcggtgtggccgtcagatatatttgctgtgcaagttctgaatatttaccgtttcataaatcagagttgagtgaactactttcaaaataaatttagtcatcagtgaactacgtccatatatggtgagatccctgcccgccctcgtttactgctgtttcaataaggctgtatgttttcacaaacatggtgttaatgg

SEQ ID NO: 103952 - DNA, 643 bp, Oryza sativa
acatggcggcaatgattgcgttgaagacagtaatctaaaagaaaaatcattttcaagtttgctaaaagggtattatgtacatgcaaatatctcgtgtcatctctccttcatgcatactgctcagtaaggaagcatatataacatgtatataaagagaggatctgacaaaaaggctgcatgcagcaaagtcatagcaagaggttcgattttttttcaagagatcggacgactggattgaagcattttctgcctagctgtctgtctctgcttgcgatcgaacggcctgaaaaaactgacgatggcaagtgtgggtggctgcatgcatgcgcgcgcgcggctagcaacgcggggcgaggtgagccaaccacgccaactccgaccattcctcccgtcgcctccctctcttgacaccatctcaacctccatcccctccatgacttgtgttttgccatcgcgcgcttttgcccaccgcttctctcctcctcctctccccccttcccttccctcccggcgtgtggtggtcggaggttgccattcattggccgcccccccaccaccggcacccgccggtgaggagggacaccgccatcacattcttgctatatccaacgacctccattgattaactacgtgcgtgtgagaa

SEQ ID NO: 103953 - DNA, 657 bp, Oryza sativa
gtccaaagaataattattcagttactgtcagacaactgtttaccggtgcagtcttattggcttaacctgcacgagtgcagcaagcttagagcagtggtgttgtaatgctacagccccaagtcgtattatcgtatatacatcaaagtatcgaacaccctgaaaggatatgcacaataatctcgacgatggtcacttcagaaagaaaattacactggcccttacccaataataacccaaacaaacactcatgctccatagctaaaggactactctctccgtccaaaaaaacccaatccagattcaaatacaggattgagttatttttgagacgaagggagtacactatgtccagattcaaactcaggattgagtttttttttcaggacggagagagtaggagagttgcaaagatagtttctgcaagtcccacacccctactcaactcagtcactttgctagctagtactattgctctgtagtactccgtattgtactactgccaactgtgacgcgaaaatgtgatcagttatgagagcagtgacatcaaatgtatatttcttctgatgaatcgccataatgctggcgaaggcgactctgtctgtctgtcttctccccttgcatatcgttccgctatgcagtgggcctcctgcactataa

SEQ ID NO: 103954 - DNA, 1161 bp, Oryza sativa
aaacgtgattatttttttctaattgcgacgcagacctaaccgcatgacgtgttactattcctgactggttcagtgcattccgctttcaatcctctgaggcagcctctggataatagttttattggtgatttttatgattagaggtgatagtgcagcacaagagggttaatttgtaggtgaagctccagtaaagctcatgctgagcccaatgaaaaccaattttgtcacgcattcaggctcacacataggctcagctttaagaaatgtgacatggacctaaccccatgatgtagcagtgtgttaaatgctcttagtgcctttttccttttcattccattgcaccataggctttatctactgggactagtattgagtgttccattattgtgaggttatgtgcttgacagtggcgttaatttgtaggtcaagctagggcagtgctgctctgaaatcttctaagtattctaaacatattgtatttgtcaggaagtgctctgtatgcatatgcactaagataaagcatagccatggtattgcagtggtttggtggatgcttaagtggtcaggccagggtattgcttaatactcatggtaagtagataactctattctgcaaatctgtaatcatgtcatgcttacagaaacaaagcaaaactttgtacaaataattttctagaaagctttgtgtaaaatagctgtccaaacatcgactgaaaagaagaaacggtattgctatgactgaggtaacgataaaaaacaaacttacaggtagcatgtctactctgatcctaggtaaaattctgtgcacctcagcaacaaactgtttaaaaataataataataactctcaatttttagaccaagtgatagattgatagataggacataggagtagaacatgtactgacctctgttcatcagatttcactgaacatggcgcggccatcatcagatgagacagggtcaatttcacatcaccctctgcccagatttatgcagggtttgtttctgtagagtttgctttcgcttccttggcgaaacctgatcgccaatccaaccttcacatacgcatcgataaaaattttcgtttatttcaacttttcaacagacgcaaaatcttagaaattttgaacgggagaaatcaagcaaaagaacagggggc

SEQ ID NO: 103955 - DNA, 899 bp, Oryza sativa
aaaatgtgcggctgagattgcgtagaagtaggacagtggagtcgaggcagttttttcgcggaggtccttcgcttattcggtattggcggttgacttcatgggcctcaaagctaatcgcgttgagagattcttgggcctcatgccagccaagttagtggacctccgtatgagcgcgtgccgtttgggcttgactgatgccattcgctacaggtgctttaagattggagtaaattcacttttaatccctcaacttgatgtggagtgttgaatcatgttcttaaccgcaatataatatatatataacacgttcccccaacttgcaatactggattacccgaggttatgggtggaaaaaaagctcgggctcgtgagctcagctcgggcttggctcgagcttggttagcttggctcggctcgtaagccaaacaagccaagcccaagcctcctttttagctcgttgctgaaatgagccgagccgagctagctcgcgagccgcttgttttggctcgcgagcctaggccatcgtgtgtttatattgattattttactttatatagtgttattatttgtcaacttgaaatttatcattaagattttgaagaattgaatataaaaacttatttaaattttacatgttgatgatttgtttttactttttttaataattataaaatatatatgaagaggtgtttcaacaggaaggcttgcatagctcgagctggctcgagccaagccgagcttaagttttagcttgtttccctaaccaagccgagccaagccaagcctagttttttgcgagccactgcaagccgagccgagccaggcggctcgtttccacccctacccgaggttccagcatagtttgtgtccagtttcaaccgacgtgagggctgcaggaa

SEQ ID NO: 103956 - DNA, 539 bp, Oryza sativa
caagaatatcaaggaccatgaggtattgatatgtggagtggggacagctgaactaactgtgggcaccattaggcatgccgtacatttggagcaacaacatattcttgtagggtttggcaagtgactggaatgccttgcagtcattgctttagcattcattgcaaagcttacacggatgtccatatggatgattttgtggatgattgcttctccgttgagaagttcaagaaggcttatgcatggactttcaatccaatgacatcgaaggatagatggacacatgttgatctaggctacaaaatcaagaagcctagattgagaaggaaacctaggaggccacgagtggctaggatgaaggcaagtgatgaggctggcactagtaagagaaagaaatgcactgaatgtaatgagctaggccacacggccaagacttgccaaggaggtcccacggcaagtcaaaaaaggatacactcatcttcagaaattgggacaggagatgggaacaacgacacaagtgctgcagccacttccaagtgagt

SEQ ID NO: 103957 - DNA, 761 bp, Oryza sativa
tctaaaaatgtggttgctatcagtatatagtttttaggatcgtgctgctggcttggcaagtcagtttcaggatatctgttcttgtcaagtagccctttaagtcacatgacacgcgcaaaaagaatcttaatgggtattcttccttgttctgtaactttctaatttcacctgcagtagactttcttcagtactccttttataggaacgcctacaatctttttaacccaaagggtgaggatgggaattaagtaaatatggataactgctagaatggataactttgtagtgaactgaattcatagatcttattcaactaagcaatcagattcagcaagctttttttttttatccgtgaagattattaccacagttcagtgactagtggcaggacacgtggacgtggtgcagtgtttacagtgatgaacaaatgacgataagcactcgagattaaggaaaaatcatcttttatgtttctagattaaggaagactaattatgctttgcctttgctcaattcatagatactcttcctcacatgaaagaaacttaacactcagtcatcagcagttagcagaattagtttgagcctgggtagcatgcatggtagaaattgaagaagtctttcatacaactaagatctgaaatagtaattagatacagagtggttactggttaccaagtttcttctaatacatagtttctcttattacttaataatcgcactacttcaacagcagaaagaaacgtgtcctatgtgtggat

SEQ ID NO: 103958 - DNA, 574 bp, Oryza sativa
tttggccctgaatgttagtgcagatattaacatatatatagatactcgtgcatcatggatgcatcaagataacctaaccgcaaaaacatttgcatgcatgtatgcacacatatccttaaaaaatatccgtgcttgcttaatttgattattgtttcattatttgcatatataagaagccaaatgaagatcagttagctccttttttacataaatatggttggaccagcagctctaaattccaatccaatactagaaagtgaagttttattcgcaactgaaaacaccagtggcgaaaacaacagccaaacaacatgttaataattagatcgatcccctccctcacacacaccccctgtggcgtcgccatcggagcttctgttcatgtgtctccgatctgcagcagagctttgcctttttaatttgtccggagatgcatgcatcgatcgatccaaacagctagctagctatcgaagtatcgatcgatcgatcgatctcgaccgcacatcggtccatcgatcgatcgatcgaccgaacataggatcatgttgggttttaatgtttctaattcgtacga

SEQ ID NO: 103959 - DNA, 616 bp, Oryza sativa
tcctccacgtcccacccttgcatcacgagaccgacctctgaagcctttacatcctcggccggcacgacggctgctcccttgccgatctcatcgtcttcctcctcctggatcgccaagaggcacctggccacggcggctccgcagagccagctcccgctggcaggcgggcgccgacgcttcttgtcggcggcagagagagagccgcgctcgccggcgccggcggcgcgagacggcgagcagagcgaccggccaccgcaggagccgaatgtcttgagcgcctcgcagatgttgactgggatctggtacacccagccctggttcttccccgcaggaccgtcccggtcgtctccggcgcggcggaagctggcctccgcgctaccgccgccgccgacacccccgcgcctggaccgcgagcgcagcgcggcggcggaggcgtgcttgggcttgcgctttcctcccttgacgcggacctgccgatgcaggtgaccttgggcgacgagggctcggctggctcgaacccgccccggccgcggcggccgccggaggaccccgaggggaacatgggggactgcccacctttcaggctcccgctgttgcggaggcgacggctgaggga

SEQ ID NO: 103960 - DNA, 885 bp, Oryza sativa
ttcctgcagcccagaaagctcgaaactcgtggctcggatcggctcgtagcaagctcagctcggatccattcgaaatcgtagtcttaatgagtcgagtcgagctagccttttagctcgtgagcttaacgaggtagctcgcgagctgctcgtttagctcgttagtataaaatatcaccatatcttataacttagtgtttctttactagtgcttagtcttttagttacatcaaatctattcatatttagtgagtttatattagttagtgtttattattacgttaatacataataaaatgttaaatttgaaattattaatatgatattaatgagatatagctcattaacaagcctaacgagcttacgagccagctcgtgaaccgagccgagctagccttttagctcgctaacattaacgagcccggctcgttaacacaactaactcaactgagccaagccttaacaaaccgagttggctcgttaacacaatgagctcaaatgagccaagccacccctagacgaggaggagaaagagaagaagatcgacaagggttgctaccgaccacccaagtcatcgccgccgtcgtcatgagcctcagcacgccaattgatcaaacctcccttttctggtgttgctcctgctgtttatatagtgctctccctttgcttgcttgggcctggctttaagagtagctgacagcccataggcacgcccaattgggttcctaacaaatcttcaccaagaaattggggaccttctaggagttttcagtaggacttgttctagcattcattaatcaattaaatgtaagaaattcactaattaattaatcacgatttttgtttacatcaacaattgcataactaacttaaatgaacattacatat

SEQ ID NO: 103961 - DNA, 754 bp, Oryza sativa
ccggcacgaataccaaaagtcactgttacgaaaaatcatatgtatcgagtcccttgccatcacggatgacagtcacggatgatataccatgaagatcatcataggcttatcgtcagatagttgtttgtgacaggaagcgatcaaaagatttacagattatatatggagatgagattttgaatcttcttgatatgtgcttatatatattctaactgcaacgactgaaacttttgggtttgtttttgtgctaatagcgggaatggaacgttaattagatggccaaccgtagtttttataattcgaatggtttgatcgtgtccaaccttggttaagcatagtctatatagacttgtagcttgactttggcaaaataaaatatggcctcgtacacagtactttaattttatccgtataaaattaaatgtggaagtagcttgatgaggcacataataatgttttacgatgttggcaagctgcaactatatattctaggattatcggggtattcacttgttctcagcttatgtcacaaagattactttttgaatgtatcctgaatacaggtctgattttggtgatctaccgaaataatcctgtgagcgaagttgcgtagtaaggaaaatctcacattttatatggtctgagttatagaaaaccacatgtgtaaagacatatagcacaaaaccacatgttttaaatttatcgtctaaatgattcacaaaaccccacgtttattaaaatctgggctgcagga

SEQ ID NO: 103962 - DNA, 688 bp, Oryza sativa
ttcctgcggccccataatgacaaggaagaccattctaagcatggctaagcattatagtaacctagtgactccaaaactcatatataaagtggtatagtcatattgttcctaaggttaggaatgagggatatggatatacgtggggtcaaggtgaatgcaaacaataggagtttgtctaacaagttacaaaattttaatttattagtgtacaatcgacatgcaagatttgcaaacattttcaataacctccaaacataggttcaaagtgatcaaagagagggaggtaggacttgccttgcaactggaaaatgtcagcacctaaatcacttcttcaccgattaagcaatcatctatacaaagtacacgttatgcaattaaacaccaaattatgcgaaaaatccaaaatgctctaaaatgcatgatttgtgcatagtgaataggtactggtctaaaatgaatttaggtgaaagaatttctattttatctcatttcatttgagaattatgaattttagaagttttgtcggtatagtgtaggatttacttaggtactattgtgaaatgctgttgtaaggtgattcttattaagtttatgtttggtggggtgaagatatgttttctaagactaacacatttggtttcataatttttagagttaatatgaattctttatgtattttacaagttat

SEQ ID NO: 103963 - DNA, 701 bp, Oryza sativa
ttcctgcagccctcagaaaatccgatttgagcaaacttctgatccttgatttggtttgagaaacttattggaaattctgatcatgtcaccggaaattccatttcgtcgggaaatcagaaattttgaaagttctgagtcacggtttgattttgaagaaaatattggatattccgatcgtcagacggaattccagtagtactggaatatcccaaattctgtttttaactcagtctgtgcaggcaaaaactatctgaatatcctatacgacatcctatacaatttgagtttggagtaattaactcaggtgaatcaatctcaagatgctgtccaggactgcagggtctccactcaggacattcacagtgcgtcactcgcatatgaggaacctcgttgtaccacgtattctagaactacaagtccaaaatccaaattcttcaaagtacaagtagctctactagtaaccttaattttatattgcagcccctagtactttttctttcagttcacatattttcgttaatttgtgtggaggtccaaaatttgcaatcaacacccttgaatccaacaaagaatataatatccccctttcgccctctctcccttatcctcacgcccacttccttttcccctcacgccggtgcacccgccgcccgggcagcgcctcgatctcctcccctggctggtgccctggctagcgcccc

SEQ ID NO: 103964 - DNA, 758 bp, Oryza sativa
ttcctgcagccctatggtgtccaatccaatctaaattctttgaaataaaggttcaaggatgattttactctacatatgtttagagtaaaagaagtagaaagacctatttggaaatcatgaataaacacaatgatgtagtagcattgtaaattatttccctttttctctttatatatatatatagagagagatagcagaactattctacaaccggggttctataccccctccctcccaaaagccaaacccaccacccatccctccttcccaaggtctaaaatccacctcccatatcagttaaagggtggtcaaaagcctcctcgcgctaatcagacctcggtcaatgcgcctactaacttcccccaccatgcatctcttctcagctctcgtcgtgcatgaacggtgcagtaacatgatggccattgtgcactaacactatgttttatatatagtaacaacgctaaaaaatagttaatatatagttatgacggatctacttttaataagtatttttttctagcatcatggtacaaacgtttttttaaaaaaatagtacaacacgtgagagattttattcttcaaagattcacttcattggaattcgactctccacaagcggtaataccatagcatagcattattatttctattgtctgttatgtattactgcaatcccatcacgacattactgcaatagtgcagtaaggactaagtttcaagtaacacaacatgttactgctatttcttgataatgttac

SEQ ID NO: 103965 - DNA, 722 bp, Oryza sativa
ctgcagcccattgacaatgtaacaattaagcgacattatttatttgatgctagtatatatatggcataaaaggtactcccgccgtccctaaacacgtagttttatccaaaagaatttgtcgagtagacctctttaatacaaatacatctttttcatctcactgttaataattggaccaatagtatttcgtgttttcttcctcttcgttttttttcatatcaataaacactataaaaaacctaatatgtgccgacaaattaaaaaccggcacctatgagagttttgtcgtggtcaccaccgacggctatgccaccaccaccgcctaccttcagccggccgaaggggccttgtctcgctggtccgccctcccatatggaaagagagggagaggggcttaaatgtggggcccacgttggattcatttgagccaagtgcaaacttgtccttaatggttgtttctctaacctattcttccgaaaataataaaataatggtgcgagtgtctattagctaattaccattttttgcaatgtcttacggcaaatacgtgttcttacagtgtcccctggctaattacaccatttttgtatatcttgtaacaaattttgccgaaaattaatcatgcttgcaaaacgtggctgtgtagatgctttcttgatcaaaggaggtatcaagtattatttttccatggatgattttcccttttttggctaaaattttgc

SEQ ID NO: 103966 - DNA, 1148 bp, Oryza sativa
atgaagagctcagtgccaccgccgccgccgccgccgccccggtccgagtgcttcttgcggcgcatgagggggggaggggatgtgaggcgtgtgacctcgctgtttttttctcctctctgtatttatgagaggagtgaggcgttgctgctgtggctggctgcgctagcgtgttagatgcggtggaggggaataaattagggtttgttggtggtggcgctggcagcggagagttggagaccggagaggagaggcgaggtgtgcgctgtgcgggaggaggagaggggaggtggtggaagatacagataatggtggtggtctcgggtgggtctgggtctggatggccatgggactgtgggaggcaggagcagcgcccgcgccacgctgggtttgtcctctccggcttggcgatggaaagttaaaaggaaaaataatatatatacctatttttaacctttttaaaattaggcatcgttacattatcaagttttggtaattatagattaaatatgatattgtcaaattctttagacatgaccaatatatcgtaataaactaaacaccgccttaaattttgtcgattttaccaaacaatggtataatttaaaatggcatgaatctgaataggcccaaaatgtttttcccattttgtttcttttttctttttgtttttctttggaggactgatttgcccatagttttcggattgagatcatatacattactaagtcaaaaagaagtggacctatccatgaataattttttttttgcatatgcatcatgtcgcctatccaaaataaaaggttgaaatgtatgaacaaaaagttttcaaaataagttgttatgtatcccgtcgtctattcaagctttacttcactgcctccgctctggagccatcatcgagttatcgaaaatgcttacgatcggacgaccgatccagcgcaaactatcggacacttggacgatggacgcaccgtacaactcttttttcagattatgagccaacatgcatattgtctctttttcaataccaaaacctttctctcacataagatagcacacatactactcctgccctctctcccctacacatgcatgcattttttttaataagctttaaatgtttttttccaataatcgggctgcaggaa

SEQ ID NO: 103967 - DNA, 739 bp, Oryza sativa
cctaatatgtcattagcaaaagtttactgtagcaccacattatcaaatcatgaagcaattaggcttaaaagatttatctcgcaatttacacgcaatttgtgtaattagttttttttgtctgtatttaatactatatgcatgtgtctaaatattcgatgtgacaaagtgaaaagttttttttgcatggaaactaaacaggacctgaattttccattcctttgctcttatttttcatgcacacgtttttccgaactattaaactgagtttattttgcaaatttttctatagaaaaattattgtaaaaatcatattaagccatttttcaagtttttaaactaatacttaattaatcgtgtattaatctgtcagtctgttacttgcaaaggtcataaacacgctaatagcgattggtgttaagttctttacgttaaaataataaatatgagagtgttaaaaactttgagttgaaggttttaaaatgagttgaaagtttcaggtttgagctaaaagattaaaaattgaattgaaagttttaaaaattgagtttagtgaaagtttactatactttttaaattttgaaataaatctctgttgaaaaagtatctatttcaattttttaatcaaatttaaacagcactaaaaaaagatgtgcatgtgtgctatcagcacaactgcgcgaaatagctccactatgtatctatctaattaagggcatgtttggtgaagtttcaactccta

SEQ ID NO: 103968 - DNA, 698 bp, Oryza sativa
ccgtgaggaatacggaacgagaaagagttggtgatgacaatgtctcgacgacgggttgcggcgtccttcttcttggcggccggcaacgaagagatggaagaggagagctggagctctccctctcggtttcttcggcttagaggtggaaaatgatgtgtggaaatgcagctgggaggggtgaagcctcggctcggtgctgccacgtcgacgccgtccagagtgcgctcggcttcggcttctcttctccctctcgttctctctggtcggttgggggtgttgcatagggttggagctagtcaagacactgtcaactgggcccagaacgaagtacactaggctggagtgtgggggatgggtagaaaactgtgtgaaagagatttttggacgaattttcagattattttctcttccctaacttgttaattcatagattaatttgtgttgcatatgagttcatgtggattttattggaggtagatgaatgtacctagtttccattttctttgattgtactcatagtttagattactcacaaaaattaggagaagatgggctctttagaaactagtttgaatttctagaagacctaaacagtgaggataaatcctggaaaaattatatttattcatgataaattacctagtatttgaataaattatttcactcatacacttttatacagtctaatgcatattttg

SEQ ID NO: 103969 - DNA, 512 bp, Oryza sativa
cttccgacctagcccactgctcaccagccgaaccctcctgcagccctagccagcttgctcaatgggtcgggcaaactgagccgagccgttggcctcggcttgttccccttcaccttgatggcgacctgccgccgcccaatccaccagagtccaggctggcctgtccgccaacaagctcatcgacagaatccattgtacctgccgctcctcgccacaattagaaatcgcagcgcattaaaaaccggcacctttgaggctacataggtatccattcatcaaaatggcatcccacgagtgtgcgctctggcgggaaaaaacactataggtgttctttctagtattttcggcatctatagtgccatctttttttatgttatgttgtagtgacagctacatgaatgtattttgtcctttcttggcctatttggtctatgtggacagtgattgggccagtacgcctatcaaacctacttttgctttctccctacgctctagccacccctaaaggctta

SEQ ID NO: 103970 - DNA, 1568 bp, Oryza sativa
ttcctgcagccttgcaaagagataaaacatttctatcttggaagatatctggataaaaatatcatataaaacctattatgttttccagttgctacgtggcctcctcccgttgctacagtaaaacagtgacacaactgttcgtagccgtccgattagcttcgatctaggccatcgtatcatccttatgttttggacacctcaatcgaggccctgtccactcaccctcttcggcctccccttcacgccgcccccgccccatcctccacctccgtgccagcgtcggcattgcgtacctcacccttgtgtcgccgccgtggctctggtccgtgtcctttctaggctgccgccatcatcagcctcccctccatgccaccaccgtctttcccaatctccacttgatatgagcgagggtatcccgatccttcgatgagaggataagtcgattggatgcagcgatgttggtgatccgattaggtgtgagagatattgttatttaaagattagaattctaaaagttcacttgtaattggcttgctagtatgtatctttatatgaataaagagaagtatttttagcacttgtgtcaacttgtgatcatgcacatgcactttttagcactgtattttgcacaagatttagatttaaaaatttagctatgcacaagcagtagtattatactagtagcgttactaccatatgttaatttaatcatgatgttactaaaaacgtgcagtaacacctataaatttcacagtaatgtatcgtgctactgcacttctacgataatattactactgaatcatagtaacaagatataattactatagtaaacataactcatgtcttctcacaaaatttgaacagacatgcaagcaagaaaataatgattgctaatcacttaataaagatgatcacgaaagttgacttaggtattttactttatagaaaaatattttactacaaaatatctttcgtttaaaatatgaacatttgtaggaattaagcatttataggacttaaaatatgtagtatcttcgtttcaacaatataagcatttctaggacacccaatccaatcaagaaagtccatacaactttagccaattaatcaggtgctagaaagaggaatctaaacaattcaaaattcaaaatttgatcaccgataggacttacatggaatattttcattaaccctaatattttgctaaaaaataaaaatgcttgtatttttaaatgggaaagtagtagatatggaaatatgaaagatataaaagatcagaggttaaagtaaatgtctgcagtcctgatagttagcaggagatgtttgatatgtaggttcggactcacatgttagacactactgtatcaacagtacttacgaggttctgcatccataatacttcttccgtgccaaaaaaacaaatatataactaaatattacatattatagtaaaacgaatctggacatatcttagtccagatccgtagtcctaaaatgtgttacatctaatactagatttatttttttataggacgtagtggagaccagtagcaaaacttaccgatgtg

SEQ ID NO: 103971 - DNA, 750 bp, Oryza sativa
gtttgtcttgtccctgttaattaacttttaatccgagccattgatgcacttcaatttccaagcgttctttttctttcaagaagccttgaaggaagaaggtgagagatagagagaagaagaaaaatagagataacattatagttcatctattatacatggtaagttcatttgacaggatgatagttgattagaactaattagtgcacacgcattgtgtagtcccgtcgatcaaaaactactcgctccgttccaaaaataaacgaatttagaattagatacgacacattctagtacaatgaatctaaataaatatatgttcagattaatagtattaggatgtgtcatatctagtactaggttggtttctatgggacggaaggagtaggcttgtgcttgttatgagttaggcgattgattttttttttaagttttgtgagttgactttctctcctccatcggtcatcatctaaggttgttgaggtcttcttccacctccggcacaagatttggttctttctttttctttcttccggtgctcttacagttgctaatgaacctctccgatcatgcctcaccttccaagtttctcacagttcacgatctccccgtgccatcatctccctaccgtcagtggggcgcccccctccctggctcgccggtgcaagaaagtcgccaacgttgctggcaagccctacccaaccaactaggatctcccttctcactccccttactccttccttgctctaagta

SEQ ID NO: 103972 - DNA, 590 bp, Oryza sativa
  unsure (1)..(590): unsure at all n locations
gttgtaatcagctagatactttccttgtaaaccctcctcctcatcatatataatagggggtaggggtcacgagatatggggcaagccggtcatcacaacccggcatacgcattctccacttcaaccggacatagatccaatccacatataattggactagggtattagctcacatcgagggcataaaccagtataaacatctgtgtcaccatctctccttgattttccccaccagataaattttattgctgttcattaaaatcgacaaccgccattatgtgntaattaaattgttatcagaatccaaaagtcattttagaattattggttgcatgtccattggttttatcacatggtgaatgaattaattgctttttggtcttggtgcaggaaaaagaaataaggttcttaggatttttggatagagggagtatgatttctgactttgttttaccattgttttgtttgtcttgttttagtttgccgtttaaattggtagaatttttatcaattgtgaaaattatctccacctgtcgcaacacatatgtatttttgctagtatatatatattttaaggacaagactatacg

SEQ ID NO: 103973 - DNA, 910 bp, Oryza sativa
tcctgcagcccatgatcccactaatcaattcctccatattatcaggcctatgttggtttggtggtggatttggtggcctaataggttgtggttgcggcgcaatataattatattggccttgcctagtatcgggaggataccccctggaaacatcattgtaagcattgggaacatgtggggggggatttgggaactagtagtgcctttagatacagggggatcaaatgttctaagatgatacaaatacgcattgtttgtcattggatctaccccctgtattgggatgattgcgccggtctgaccggcgtccagaggcacggtcagaccaatatgaggaccggtctgaccgctggggtaatacccggtctgaccggccatctggccagtctgaccggcggcgaagtcgcggtctgaccggccatctagcccgatcagaccggctatatgcgccgtccacccctcaccggtttgttgtgtcttcgccccatcggttttactacttatttgatctataggggcttggctagcactggtagaggctttatctttgaacataaaatcggccatgagagggctgaatttagtcctcaaaaatccttcaacatgattctcaatagatgcatttaacttagtattcaatgtagctatagatgaatctattgtagatgcaatttgttgttagatagattgtgatacctctttagaacttaccacattgaaattaggcttaatgcgcggtccaggcttgacgatcacactttgacgagtcctagtgcacgccctcatcaatgcctcatgtgtgacctccttaaggtactcctccatggacttgcgcgcttccctatcgagctcctccaatgtaattggtatcacattggacggttccacctccgccttggatgacgggggc

SEQ ID NO: 103974 - DNA, 677 bp, Oryza sativa
  unsure (1)..(677): unsure at all n locations
tgatagatgaaccaatggttaccatgattcagggtataaccaataaataagtgatctaaaatcatatggatatctagttttataagtacgaaataatttgaacaaaaagtatgtgctacataaaagtaagcccaactagcctcctcaaatccatgaacaaaatctgcttcttgaagctctgaagcacaaacatacatacaatgaacaaaaacaaataaatggaaagtacaaaggaaaatagatataaaacccaaagaacactatgacaggatatatttgtcgactttagatacatttaggagggaatggactgaaccaaaatttgtatgaaagagagagaatagacctcagaaatcggtcacacaaatagacttcgaaaatatttaatctagacaaagaaaaatactatccaataaatgtttccaaattaaaataaataggaaacatctcatgttggaggcagtgttggatagtaataagggaagagaggngaatgcagcncaaatattngacacattgcattgagccccaagggccgatatatataggagtgcatgaattggatcttaagtaaacttagagagatagagatggaaactaatcctatcctaccatatcaaatcggatataatacgatattatctatgtactctaacaacccctccccccctagccaa

SEQ ID NO: 103975 - DNA, 779 bp, Oryza sativa
ggtcgccgagggaggggaaaaatcggtcgctcccccctccccccatgacgcgcgtgcgcacgtgcgccctgggccccacgatgtgtcactgactacctactacgtgtctccaccacatactccgttgcaacaaattacccatatattttggaaactctctattaagggaattcgttttattttttttccaaaaaaaatgtttcacctagtgtactcacaatgtttcactatgtatatatctaatattgcagagaaccgaaatattcttttgcaacaaatcacccacatattttggaaaccctctattaagggaattcgtttcattttttgttccacaaaaaatgtttcacctagtgtactcacaatgtttcactatgtatagatctaatgttgcagtgaactgaaacattctttcgctatttgctgaaacattgttttcatgtaaggtgaaagaacgtccgatttaaacgattgaaacattttcgatctacttagtgaaacaatctcgatatacttagtggaacattgtgcaacatttcaaaagaaaatcaataataagcttaaaaaaattcgttggaatatatccacgtgtggtcttgttttaaagatttaattgcgataaatatagtgatataatcggatcatgcatcggataaatattttaggataaaaaatagtttagagttagtagattttcatactgcatgagggaagagagagcaactgtgatagtgtgtatgcatgactgcatgctgcagagagagcagagacctataggg

SEQ ID NO: 103976 - DNA, 651 bp, Oryza sativa
ctgcagccctatgttttggtgattctacagaacttgggtttactcaaaaagaatctaagatgaattttatatgaacttctaaaattcagcttatctaaaactagtcattttaaaggtaatagttttagaggcatttgatgtatagtatgtatactatttcattttgctttataggagaacataagttgctggatctgtagaaactgagtttgctccaaaatgagttgagatgtactttatatgcattttatagtttgtgtatgctttatgtatgatttatcttagacccattttagagacaaggtttgtgctgagggtgccaagcttaatgttaccacattaaagttcatagttttgtgaacctatagaaatttgaatcatctcaaaataagttatatttgattttatatggattttacaagtttaggtgttttgctgttaaaaagtaaaggcttttagtattatcttttacattttcagattttaaactcatggggtccacctgtcggtctcaggccaatatgcaaaagggcctctagggtttcaggaaatcaaacgcaatcctatgactgttctgtgtgtcttgagcttttgcagaaaggaccctacattaacctaaattcttgtgacgaggtccctggttcgagctga

SEQ ID NO: 103977 - DNA, 769 bp, Oryza sativa
agcagaagttcaagatagagctgccactggttactggcgctgcaacatatgcaccgtttgttctgaagcgctgcaaatcggagccgatgcgatctcggcacggctggcgcccgatgcctgcttctggaaggaccggcataggcccctcaatgccaccggagttggcttttgattccagccgaacacaacctctggtatgcctagttagctaacgagtgagttgagagttttcaagctttgtcgtgtaatagtgatgaagttctttcatgcttggtgctgttatgtgatgtggacaaacaaataatagcatgttaagttacatcagatagattagggaggagtatatgtaaatctcttggggttgcttcatgtgtgtgctaaattccttttttcgttgatgatcatgatgttgtgcagtgcagctatagttctttctttccccccatcaacatctgcttgtttttgccacatgttaggtcttccttcaacattcagcttcatcattccttcatttccttgcaaataagttattgatccacactgccaagttggtaggttcacatggcttgatttataaaaaatgccatccagtcaaactttagtagcattgttgatccattacatattgcacaattagatacttatcccaattggctgtgaaactgtgaatggtgtcgcatcgtcgttcaatttcattccacctttattctgccatgacactgtcttgccgtttggggtttttcccgttccttgcttggtcgcgttattt

SEQ ID NO: 103978 - DNA, 582 bp, Oryza sativa
atagatagatcctgtaacgccccgattttcgttcgggtttaaaaatcattaaataatgtattttctagaaattaaataaaagttaaatcaatttaatcaagtgaaatattgggagaattaaaattttcccttaaaaatcattggccgggaatattttgcaatattctttgtgccctaaaatactctccggatttttccgttaattttcggagttcaagaaataattttaaagtcacaaagttcattaaactaatttaaataaaaagaaaacaaaataaacttccccttcctccctttcgggctcggcccaaaatcctctctccttcccctcccgcggcctggcttgcctccccttttggcgcaagtctgcttttcctccctcccggcctcccctctcactcaggccgacaggtgggacccgtgggccccacctgtcatccccaacctccagcccgggccgcaactgccatggccgcctgagccgcccacgtcgccgccctttcccgcgcgtcttccgattcccgcgcgcgtgtgggcgcggtccaccccacgtcatccccttcctacaccatttcccccact

SEQ ID NO: 103979 - DNA, 1122 bp, Oryza sativa
catatttaatagtttttttcttaaaaaaacatggaccaaagtttaaatttaaatagtgatggtatgagttatttgagaacggaggaagttgctttagaatgaattgactagcggttggatataagtatgcaactctatgatatgatataagtatgcaactctatgatatcgagagagtatctagggtagacaattgggtttaccttagcatgcgacaaggggttatcgtaccctagtgataatcccgaatcccgacgggttatcgtaccctagcggtaatcccgataaacacggtaaccatacagttaccgtagtggacaatgagaaaatgggatgaaatctatcaaaaaaagtatatatcagattatgtttaaattcttttaaacttgacatggttatcaggccctacctaccatttaccctaagtcctgatatggtggtgctttttttttaagatgaagattaagttttttgcgcaaaatgaggtggtattaacgtatgattgattgaattttaattattacagacttgaaaaatatattaatatggtattttagagcaactttcatatagaaagttttcacacgaaacgtactgtttaacagtttaaaaagcgtgccacgaaaattttaatcttcattcaaatcttgttggagaaaagaacaggaccataattgaaaccgcgaacggtaaggaaacctactcgacagcgactactaaggactactttgtagagccagactttcttcaactaaatccaaacatttgattttaaaggctactaaaaattattaattcatgggaagaaaaacctattattttaccaacctctatgcaaagagaaaaccaattacttaaaagagatcagcaaggagagtcaaaattgttggcctgtccaaatgcgcgtgtggaaattaaaatcaaagaatgaatgaatggatgcagtggtcttatcattgaaaagtgattcgattctgggagacccacacccacacacacaaaaacaaacgcaaatacgcattgcattgcatgcaaaggtggatttcctgcgtggcccattggctagcagctactaccactgccactgctgcaacctctgcaactcatatccacatcaaatta

SEQ ID NO: 103980 - DNA, 3534 bp, Oryza sativa
tgcctgccgcgctcatggaggaggtcgaccaacacgatgacgacgccggcggtgaagagctggagcatgacgagcaccgccgctctcgcccgctgcccatgaccagcttcgctcgcccatcacttcgccgccaccccacccattgctcccgccgtcccgaccgcctctctccccctctcccgcagccactgccgcgcccgtgctcgcctcctctccccctctccccattcttccccacgcgtcgccatgcccgcattagcccgtctgctggtgacaagcaatgagagccggcctcctctccctatctcccacttcttccccgcgcgtctccacacccgcatccacccgcctaccgcgctcgcttgccacccgcagcaagcctccctccctgaagaagagaagagagaagagagaaaagagaagagaaggagaagaaaagagaatgtgtagctgacatgtgggccccacgtactttttaaatttttttgctgactaggatgccacgtcaactaaaccacccatatatattgccataggaccgtgagtgcacggtttgtgtgagtttaggggtacacatttctgattttgtggttaagggaccttaaaaaatctcactgttaagttgagggacccccggtgaacttattccttaccgatttggaatgttatgagtataattcagggcttttttactttgtttccaaaacaacaaactaaatgagactttattgttacaatcttgtcaatccctacaaactttataattctagaaacttctactcacaaaactataccaaaatttggtaaggtatcaaacaaaacaccacctccacattgtgatcttcccaaaaatttggcattactaaattttggattaccaacaaatggtaaggttttcttttttctggcaatgaactgaacaaccccttaattttacttttttttaagccatggtaacagtttgctacagtagtgatgacactcactctctcccgtggcccattttttggtaatgggataactctcactttgattgaatatgatgtttgcgacatggctaccaaccagaacaagttcatgacatcgtgcaatcactatgccacaaacgatatcgtaccaaccatgacgcgtggttgacgttccctgcaatgcaaatcagagaacactacaagaacaagataagatgcaatctaaatattgcgaataggtaattaagcacaaatatatagttgcgattgaagtgatagatctaatcgatccgacaaatcaacacatcaacagttgggggctctgaatctatagtcgtcaactaatcgaacgagaactagagacaaggtgaatgactcttggcaaaattcaactaaacaaaacccaattgttctttttagggcgtacaaagctatttataaaggaaaataaagctaggattagtgctggttcgtggaggtggagagaggcacttccgagatgggcctaatctattacaaggcccaaagcccaaattcagtttcaaactgtcttgttttgaaattcctgttgactcgagatgaattttgatatgagaccagaagcatttaaaaggtgacgacgcaccgctttccaacaagtacaagatcatccaaaccggagttgacatgaaggcgctaggtccatttgaagttgttggacttgaatatcttgtagatcttccattcatccaatatattatttgacaatgttttatatttctcgtgcttgggtggaaactttttggccgcttgtgaccttacgtccccgtttgaatatgccaatatggggctccgaccacttgactcataggtgacgaaaatcatcccgccgtcccggctccataagagcatcacaacagcacatccaaattttatcttccatattcccatttggatgctcatccaaaaagattccctctccatatttcctttcacttcaacagatcatctatactaaattgtccatattatatcatcctttattttactaatatctttcaactaccatacattttatattaatttctcactaactcttcctctcttctacttcatatataggacggggaggacaagaagggctgacggacggttcgaaggcgacggggttgcgagccgtgctggtgcggcacggtcgccgggtggaggagtagcgctgcgggagggggaggtgcgaaggaaggcacgggcgaaagggaggtatggtggaaaggcgtgggtggccaggtggggaggtggcgggagcggcggtggaaggccgagtcagcatcggaaggggactacttcttcttcaaactccctagatcttgttggtgccacctctctacctcccttctccgacaaccggagccaatccaactagagctgcaactcatcctccctctcctcctctatttgccgctggcgcagatgctgtgggaggttgatccggaactctgtatgggagcaggagtttgatcgaaatgtggcggttgcgtatggtgtgaggagagaagaacgccaattttgacgttcctctctcctatttagcacacgcgctatttttggcgtagccgatggtgtatcagttgttggctgatttttcacccccatatgctaattttcagatggagcatctgctgaggatgctctaagattttgtccctattaccgatagggaaatcatcacccttagcagtatatactagtaagggcatgtccaacatcatgaccttaggttgtaccatggtttcaagcttcagctaggctcggatgccacgatggaggggagtagtggcttctagggtgccagagtgacctacaaaatccatgggtagcttggggagaaaaggtgaggaagtaattgattgaaaatatggttaaatgtgtgtagaaattaggtataattggaagaatatgtagaatacttacaaatctaacttttgagtgtaaaatacaaaaatccggcataaccttttctatattatggacttcgaagcaattcaacatttcatagcataataattcaacaacctcacatttcaaagcattatgaagtccacacaaaactgaaacaatagagttcacaatataatgtccatgactacaaataaggtagttcatatgacaagcaacacgaatatagaatgttgtagtttgaaacaaaggatataaatgacatagctaggtgttccattgattacatgttgtactcttctgtggacatgagcatcaaagccgtgagagtgtagcaacccagccttgtattcctgccaagtgggtttgaagacaaataaacaaaacaacagactttcttgcaaaaaaggctagagagaatacttcaactaatgttgttccaatagccagtcaaagaatatctcatttgtgctatcaaacataaggtagctttggaatcatctccagttatggagaatgtatatctagtgtagttcattgactgtgcttataatgatcaataaactttgttatcgaaaaaaaaacagaatccagcagggctcaggctccctccgctagcacatcggcgctg

SEQ ID NO: 103981 - DNA, 4359 bp, Oryza sativa
cccgcagtgcagaagggcctcatgaataactttaatttttcatttcagcccttgcccctttcaatttcatccacatatttttttttgatttacaaagaagtccaaattttacactaaccacccctaaaattgagagaagaatataaatcccaccccaaacccaccaccggatccacccccacaacccctcctatccccccacacacccccacctcggcaagttcaccggcgacgaactcgcctccggtgtccccccactcccccacctctacgatgaactcccgctgccggcggcctctcccctctccccgttggcgcctctccacttccgaacgccgttctacctctcccatcttccctgacccagctacgagctcggcgttgagcggagcagcgacggcgacaacgtcctctctccccttccacggccacgagctccgtgacaaaccgtgtgaatcgagcgaccagatcgacgccatcctcgacgcctctctcctctaaggcttctagagtggacggatgcgaagcttgacggtgtcgccggatctggtgtggtgctgagcgacgtgggcagaggtggatcttggcggtgtaaattgggtcggcgagctcctcggcggcagtgtggagtgggaggccacagtcgcctggcttgaggcggcgggggcggagattgatgtcagcggcgcaaatcgagtcgacgagctccccgctgcaaccgtcgtcgagctcatccgatggtcatggaggcctccgttgtcgagctcatgtgcagtggttgtatgtggcgagagactaggcatggcaaacggctttgtgcgctttgtctgtgccttttcctcgcctcttcgttgaggaacgaaaagctttgtggaggtgtgagggaccacaccctctctcctccatggcatcacacagtctacgtggtgggatgaagaaacgctccaacatggagcactgtgaagggccttagctcccatcagaccgtccttgcctccgcctctgccgaccgagtctgcaatccctagggcatgtgggtccaaggctccaagacgagagggacgaggataagatatggtgcgtgtatttctctccaggggtatttaggtctttatcattttctaaatgtattttttaaaatatatttgtaacactagttagaatatagccaaacaacatgttcattctttaaaaagagggttaaataagcgaagttaataatttagggttaaattgatagttagctttccgtatgtgcaatggttccttctataaaaggcttggatgtcctgtcatgtcctaagtacccccatcatcctaccgggtcatgtgcacaattttcaataaaaagagttggatgtcctgtcacctattcatgtctcacgtatgtctcgcttagagtaaggctaataatacagacgatttgttggctataaggttctctgcagacttctcttagcccacacgtataatagttagctatttacaattaatacagtgtctctctcacataatttcatggttcttgtgtccaagccagctgtaagtttatagcccgcttctcctctctctcttctctcctctcctccaccttagcatttagccgacttacaacctcttattatacttgctcttagggatagcagttttacctacgggtcgggtacccgcagatacccgacccgatgggcatgggtatgggtgtaatattttatccgtgggcatgtccgcccgatacccgaacatatagtgggtagcagccgggttttattttttacccgtggataacccatgcccgacccgatacatatacatattagctatatttggcccatctcttaattcccatggccttcttcttagcccatttagcccattaactgagacatatatatactcactcaatgaaacctaacctaattcctcatttccccaccccatctttcccggatgcctctctcctctccataatccaaagcggcggcgcgtgcaggcagcggcggcggcaagggaacggcggcggtgctgtgcgtgcaggtgggggagcggcggcgcgcaggcggggcggcggcaggggaacggcggcggcggcgcacgtgcaggcaggggctgcggcaggggaacaagaggccgcggtgcgtgtgcaggtgggcgggcggcggcagtggaacaagcggcggctgcgcgcgtgcaggagggtgcggcggcgacggcgcgtgcagtgtggcggtagggggacaagcggcgacagcggcgcctgcaggtggtggcaacaacaagggaacaaacgggagcggcggtcaccatggtaggcaatagcgacttcgtcgtctccattgcgcatgaccacaatcttcgtcaaccgccgccgctcacctgacccagtcttcgtcactgcgcatgacccagtggatatccgtcggcgggcatgggcacgggcacgggcatggggttttgcccgattggctttgcgggcatgggtcgggcgtgggcacgtgggtcttgggtcaggcatggattcactctgctcgtgcccgacccgacccattgccatccctacttgctcttatgcgaccttgatacgggtgcatccgtaagatatgtatacaagtcatttttacgtaatatgcccatgaactaataaatgtcatcaagaaaattataaaaatacgtatcatcttcaaattcattataataggaagaaaagaagacaaaatctatcatacttatactcttaaaactgttaaaatttttatctttttgttatggttaaaataatgcattgaggttaagactttacatagcagtgtaatactactgaaaatacatgcatatttttctagaatttttttggtaaaatttataatattagaatatgtctcatcttttattagattggtttattttggtacaaaagtagtaggtaacaagatgtaacaagtagcgggtagtaagatgggggccatgatacaatagaaaaaaagacagatagatattggagggaagatgaacgtccgcggaggaatggagaattaagggaagagagtttttaagtatttgtttagtttttaatattttaagtatttgtttagtttttaatatccggtctatggctagatgatattacgcgcctcagccaaagcatctggccatacgacgaggccatacgacatatttggttggtaactaatgttgccacacattcttaactaaggtggctaagtttagtcttgtcacgcttttgtggaacaaaatgacaaactaaagcttagacagtaacaaaagtgtataacatgtgggccaaatgactagttagacaaaatagagttgtgataagaatcaaatactgcctatcaaaattgtggcttatctaaggatagacatggcaaatttaattgctaatcaaacatgtcctactatctgctttattgccaacctcacaataatgaaccaggtaatatagttttttacggtgccctaagttttattttttcttaatagaatctagaattaaaatattgtacatatttctagtaatgaattagcgcagttaatgcgacgcaaagtgtacatcctgtcggcccggtcttattgattttgttcttggttgaacggcagcacaataaatgaaatattactgtttattgttgaaacatacagctagctcgctgattaatactacctccgtcccatattacttgtctttttgagtttttgtttgtcaatgtttgatcattcgtcttattcaaaaaattttaaaattattatttattttatttatcatttgctttattatcaaaagtactttacatatgacttatctttttttatatttgcactaatttttcaaataaaacgaatggtcaaacgttgcaaataaaaagtcaaaaacatcacctattatgggacggagggagtaatatacacttacatgtgtgaatagccacttaagattaaaattttcatgtgatacttgcttaaaggggatgtgttaactaaggataatttgtcaaggcgtaactcgaatggcagcttgaggtgttctttttgtttgaagaatgagtctattcaacatctctttataaattgtcattttgcaaagttcatatagagagcagttcagttctcttttggttttaatcttccagttactatatctcatatttttaatgagtggcttttgggaattgataagaaaaaaagcaaactgatactttggagcttctgccatttgttgggcaatatggctaagtaggaacgatatggtttttgataaatcaccatcattttcctatatgcaggtcatttttagggcaactcattggcttcgattttgggcacaactacaaaggtgtgatg

SEQ ID NO: 103982 - DNA, 2774 bp, Oryza sativa
gcctccggccggtagccggggagaggagagatgaggggaggggagaggaggagaggggaggggaggggaggggagtggccggccatgagaagtggagaggagaggtgaggggaggggtgaagtgtggagacttagaaaaattcctgctatcccaagtctatttatattcaagtctattttcgcaggcgcaccacttaagcggcgccgcttaagtggtctgctttcgcaggcggaccgtaaatttcaccccgatttatatttttgtaagcggtcatttggctctaagggtcatgttcgcctgcaaaaataagaccctcacgtcggaaaaaatgctttttctagtagtgcgattcgctcctcaaccggagcttggcaatgttggcgaggagcagcttgggcactcctcaaacggtggagatgcacgatgccaccgattcaccgtgcaagggatcgtcggcattgagagagatgcgaaaccacctgcctcgtccttgttagccctgctttcgagccccttctccatcctcatcgcaccattctcgttggctgggaagaagaagacgatagctaaaggagaagttaagtataggagcaaatttgaccatacaaaagtacagtacaaaagaaaatgagtccaaataggtatgcgcgtacggtatggcatggaaccaattcatagtgtatacgaatggtatggttacgaatagatgaatagcagtggcatttatgtaaaatggtaccttttgtaatggcatggatcaaactaacccatcttcatctatatatgggacacaggctgaaagttgtgaaaggtcttgaatgaaaatgaagttgatcttaattgtattgggccgtgatttttgtgctgttgggaaggatgcccaacaagaccttgaccggtcagcgtgctgctagattgggctctgacaggtacaaaattataggccttgttagcaaggcctagcccagccttctgctgggcctgggctacctacatatccaaaaatcgattaatatctagacccaacaggtgcaaattaaaaccaaatttttgtatgcattttcttttaagaaaacacaatatagacgtaaggcttaccacacatgcacactcacccatataagtgtgaacacacattccctagccctatgagcacctccgaaagactgtaccatcatatcttaagattgacaaagttatcacaaacgtctcactgttatcgggtaagttgtataccacttatagaacaaatagccgtaaatattaatacccgtgtcaagtttaggacttaactcgggtggaatattggttccactagtttgttatcttggaaaaactattttgatctcgcaagggtgaaggggaagtccctggtttatttgaaaaccacttaaatagttatgaaatgctctcaaaatatttgacaacactcacacaatatatttatcacagtctacaaaattttatatccaaactcaacaaatatattgagatatttaaaaagataaattcaacgtataaatagcatatactgtttattacacaccgaatttgtctctttttttgctctaagatgtaggtcgaatttaatctcgattattttggactcatacatgttaatatactctatacattgtcatttctttatattaaatttttataactatttgaattggatttaggagaaaagggtacagatggaaacatacctcgataaagtagaatccattcccgttctcttgttgtattcacgtacacttaaaaggtacagtaagtgatgacaactaaggtggtgtttgtatccagggacttaactttagtctctgtatttagacactaatttaaagtattaaatatagattacttacaaaactaattacataaatgaaagctaatttgcgagacaaattttttaagcctaattaatctataattagagaatgcttactgtagcatcacataggctaatcatggattaattaagctcaatagattcgtctcgcgaattagtccaagattatgtatgggttttattaatagtctacgtttaatatttataattattatccaaacatccgatgtgatagggacttaaaagttttaaccccgtctaattataccgactaatggtaaccagaagatagatcgatgtatatgagacgtgcttacaacaagaatgactcctgacgcaacaaaaaagaaaagaaaagaacgaaaaaaagaatggtcctgaatatgctgattaagtcaacaagccagtgggagaaccaccaagaccacacccccggtcgtacgcacgccccgctttttgacatatttttggaagattattcgtctggtttaaaataagacaaaacatatacttattgtttattttatcataaatgtactttagatatggattatatttttatattttgtaaaaagttgaataagacatgattaaatacattaaaacattaatggagtcaaaaaaaaaaaaaggaatggaggacttggacacaattagatcaagttttaccgcggaggtgactaccacctctaattttaactagctatgtcatctggtataaattaattaagagataacatgtacctctagcccacaaactccaaaatcttctttaatgggctcactctcacactattttattttttttccactttcttaaagattgtgtagagattactctttgcatgagagatggaattctatgtggcattcctctctcttcagtcttcacttcataactaattctatgggctgcaggaa

SEQ ID NO: 103983 - DNA, 1319 bp, Oryza sativa
tatgaggcggccggtgatagcggatccggtagcgaggagccactggagatggggaagacggcggggccaggcggtggtgctgtgtgggggcgactgtgacagaggaggtggggggatcgtgagctttccatggcaacggtgatacgcacaggagggggagggagtgggaacgaggaagcaggagaagctagggttaagtgtgatgcacgaatcttaaaaatactaaatggatccttttcgcggcgccaacatcattggcgccgtggttcaacatgactgagccaaagacattggcatcgttcccctagtctcctggagaagctaagtcacttatatgatggggaatgacgccaatgataggacctatttgtaatttttttctaaaaagaacctatttgtgataaaaaaaacttatttgtaataaaaaatatttacaaataagtcctcgacaccaataatactagtattaaagagcggtttgtaaataatttttattataaataagtcatttttcaaaaaaaaatacgaataagtcctcgatgccaatgtcatcaaaacaggcctaagtagacgggatatatgatccctttgttacttgtatattattatgctactgaataaaatttacatgcgagttctcttttctaaggaatggaactattccatagaacgagaatagttagtccatttgtttgtaccatcgattatttattcaagaaaaaaaaagacccttaagaatagttgattattctaggactagaactaagagttgtttaattgatcttgatcaagaaaaaaaaatagtgatacacgcttcgatgaaaataaaaacatgagaattagcaattatcaggagaaaatagtgcacgaaaagaacaagagatcacgcatttaaagtactaacagaatatataacaaagatccaaagtaatattgttttttgttactatcttactaatactgctatatagtttcacaggataaatttaaaaaggtcgtaaaattatccgagtaattccagtaacatatatacacaccatcactgttgttccaggacggctgcctagctgcaagtttgagtgcatgttaatctgtcatcatctcaattcttaactaatccgtctccttcaaattcacagcccagctttctgctgaacattctgctttcacaactgatgctaatccaggctcaatgttactaccataatccatattgctgaaaatacagttcatgtcaacatgagtgtccatgtcatagagcaggtattgtgcttcatcctcctcatcttcctttgtgtcaaacaaaccactccacattt

SEQ ID NO: 103984 - DNA, 2676 bp, Oryza sativa
ttatgtaacatagattttatttttctctctttttgactggtgttcgcttttccgctgctatgctgataccagtatggtaccagttgcatggtacctggtacctgtgacagctggtacctaatacctgtgacacctgatacttggtacctgtgatacctgacacctggtaccagatacctgtgatacctgatatctgatacctggtacggtggtacccggtgactgtggtacaacatgttgtacactaattaatcacacataaaaattgtcccatgacttcacttttccacggtatcccatggactagctgccctcctttgataatagtactaactagatttttgtacgcagtaaattaaagcttcaccagttagcaaactatttaacataacaagatttacaagtgatgagattggtgtcaatgttcacaaattaaactaaggtactgggcatatagctactccctgcatccttcttctttattgccccttcttctttgcatgttattttggacaatacattgatgtctctccaaagtacatgtttgatttagttatttttaatgatatatatacataaataaaaaaatcaaggagaaattaaaacataactgcatgcaagtatttctcatgataaatctatcaacctgttttttacatttcaaatcttagtagttttctatgtattagtgagttagtaatgttttgagattggactgtaatactctaagcgcccgttcttaagaatcttatcagccaactactagctctaaaaatagacatatatgtcatttattaccaatttaatagtgtatctatacagtagttatatattgctagcaccattaatacctagcttacctcttgtatgcacacaatgtttttaaagcccatgatgtagctagctacaattttctttaaaggagaagctacaatttttgtagcacacttttcttctcccccatctcctctctccttcatttaaccataaatccctaataatttttaaaactgattatatcacttattgtacttgctccaagactagtctaggatgtctacctatttgacgatgaatggggcaaacatcaatctttgtttcatggtgactacagggagtgaacacaaagatgcggaggatatatacaacctgtagctagctaggtcaatatgtgatgtatttacctgcaggctgctctcatgcatgcatggtcaaccatatgaagcggtaaggtaaattaaagtcaaactgagcatgtgcatgcatcactgtatgggccatgggggacaaaccacaaatctacaatctaggaaggtatatatatatatatatatatatatatatatatatatatatatatatatatatgtttgtgtgaatttgatggctacatgatcatctttttgtggtaaaaaacattttttttccattgtcaactaaattaattaaaaacctctcgtctgggatgtgaaaatatggagattctcttatcttttttttaaagaaaaggaacatatagagattatttttgcaaggaaacatatagaggttctagtatatactggcatgatatttttattttacagtaaatttcacaaaactacatgtattttgatcaacctatcataaaactatagatttaaaattgtgtatcacaaaattacagatttaacaccatgtttatagatttaagatatcgtatcagaaaactatagatttaacatcaatttttatcataaaactacaacttgtgtaatctcaatataatactatggatataaactctaaattatgtagttatttgataacttcatcactaaatctgtagtttgtgatatgattccttaaatttataattttatgataaatttagcgctaaatttgtagttctgtgattcatatattttaatatgtagttttgtgatagtttggttaaagtatcgtacggttctatgaaatttaatgtacattttattttctttcacaacctaattaacctatatatatatgttgcttaatttacttcttaatttggtacatttagcttccctactgcctagctagatattaggtcgagccaacatacatgcatgagagattcagggataaacaggcataatttttttttaagaactacaaacatagctaagagcatgtgttgcattggtctaccacagacatgtctatatatcttttttatctgaaattaatccgcctcttcatattaaaaaaatgtattcagctatacacgtgtgtttatgcataaatatctactcctgtattaagctatgattgggtcagaaaggtgcactaatgatgcacctctagatttgccaaatggattggtgctgctcaagtagattctaggctggtaggtaggtcttctagaaaaccaataggacatgcatagacatcatcacaggaagacacaccaaattttatagaagaggtaattgacacctttaattttatccatataagctaagaggtagtgtgtacaatatatcacttctacactaactctagcaaactattcctaatattttcattttatttgtatgtccaatccactttttattttctatcctttttttggagtttgcgtaaagattgctccttacatgaggggtggctcctactctctctcttttttttttctcttctccacctcaccat

SEQ ID NO: 103985 - DNA, 1059 bp, Oryza sativa
catctatcaacttgaacaaatttgttccataacttaatctgcagaaaatagaattaatatatgtcgaacgttgctagcaggttgatgggctttacacgcgcctgacatgctaggtcgagggtttgcataacagtatgtgaggggttagctctgcttagcagtatcatggttaaccagaaaaccaagtggttactaataaaaaaaataggaggtttagaaaacgaataaaaggttggcacacaagttatcacggtaatcgagaggtaagtgagtcatatacgaaccctggctcgagttctctcacgaggaggatgatgatggagaacgaagaggccaatggataataactgcataaagttcactatatcgatatccctttcaattcgcccactagatagattatgttatactctatccatatcattttgatcatcctataaaatttttgtgatcttcccaaaataatcatcatctaacaagtgttttttttcgtttatttatgtaaagagtaaatacatcatcattaaatgtgttattgcttcgcgcaaccaaccaagattaatttctattggtgcaatgacattcaatatttcaaacatgaataatccatggagcacattaatcaatgagaattaatttaagaatgataaatatttttgtgttcttggtctttatgctttttcttaggggaggatcaaattgggatgaagggagtaatgtctatgaaacggatctaagaagaaaacaattatacttgcttatgtttggtcaaaatcatttgtactgctattcagctgcacgtatatagtggaaagcgtcgtctctttccttgtcatatcataactgcagggagtatatatatgtgaacataaagatgccaaggatatatgggattggagaaaaaagtgtttcatctgattgtagtttcaatgaagttgagaaaattaaccctgctagttaataggtcatcaacatgtgctgaatttacctgcaggttgcaagtgagcacccatggtcaaccaatgaagaagtaaaagtcaaactgatcgtcactgtgga

SEQ ID NO: 103986 - DNA, 8550 bp, Oryza sativa
  unsure (1)..(8550): unsure at all n locations
tcctgcaccctttgaaggcaagtcgcggacacggtggtcgtcggggcaggcgacgaccgagggtggcgatggcggcgcccaggcggtcggccacgcgcacgggcgcgcgggaatcgaaggcggcggctggaattttgggcggcgtcggcgggaagcgacgccgagagaaagagagagaaaagagagagagagagagagagagagagagagagagagagggcgctctctgagggagtcacgtgcggcgcacgtgcgatggagaggctggcgaaagaagaggatgggccgaggatggtttcggcccgagcgagttggagggaggcaaaatagacttttactggaaggtttgatttggagagaaatttgatgtggagattgaatttgaattcaatttgtatatttgtacacgagggttcaaggtggatccccagggaggggtcaaggaagggcttcaaaagcgggaattttggtatttttgggatagatttatatttggcggcacgaaggattatttcagaggatttcaaaaagggaagatcattattcaaaaatggaacaagggagatagcggtagaatgccatagatagatagacagaaagataggttgataggtagagggacggatagacagatggataggtcgagactcagagagagatgggatggaagagaaggaagaggtggaccggaaaaaggatgaaggaatccaacctatgagggaggttaaatagactttcacagagagatttaattgggaggttttagagttggggtctggatttgaatttcgaggttgatactcggtctcgggagaataggaaggagtcaaggaagggaacaatattcggagacgagtcaaagtgagatggataatttagagaaagagagtgtaacttgggagtttgagtttgactactcaacgagatatgtgggtaaggattttggagggaagtctgaatagaagggttcggacttcgagattatttcggaacggaaatcattttggggagaactcaaggcgaaagggattgaatcttggggtttagagttcaagggtggaagtgatctcgatttgcatattcagacttgggtcagaagttcgagaaagaaaacaagggtagattgacgaaccaatacagagagaaagatagatgaatcaaaacctgagaggttgaattcgaatttgagaatcggtttgaaggaaccaaggagagagtttatgacgcgaaggtgaatccttggacggagttagggtccgggcattcgacaaagttcacggatggggttccaggaggggattccgaatagaaggaatcgagcttcgggactatattgggatggaaactttgaggagacgatctttgatagcacaaagatggaccaaaggagggatgtaaattgagatctttggcacaacttagacttcaacactcaaagaacgaaattttcgcaattaggattttcagtaaattagcttttaacgtctcgcgaaaagcggggcgttacagcaaggaagtgcacaagaagaggggtttccaagacgacggcagcgggagctggctgaggaactgcagcggcgtcaccatatccccagtgccggctgcagggcggcgtcgtcatgacgactgacgaggaggagcccgcagctgctggcgctcgggcggcgaagctcgagaccacccgcaactgccagtnngcatggctttcgtctgagacggcgagaggcgggcgagtggaggggcctctgtagagcgagtcgaaatgacggctggcagacccagaggctcgggggcgtcgacgacgatnnggtgtggagtgcgaaggctcgtggcggcggaggagaggtaatnntcatccagaggcgcgacggctnntcggcggctagnagcagagggctcgaagggcgtcgacgcgcgatgggtagaggcgagagctcgggcagtggagccccgcctctgccccagtcgctcgctacccgggcgagccgcaccttcgcaaccggccgccctgtccacctccgctaccgtcacccgccacccggtctgcctctgccgccgccaccagccgctcgggcgactccgcctccatcgccacagccggccgcccgagtgcttgcgagagagagagattggggaggaatcggagttcatcgtctttgaccggtgcagtgcggatgttccccgccgcgcacgctcgcctcgatgttccccgccgccgcgctcgtctcgcccgtccccgccgctctcgccttgcccacccagccgtgcccgcctccgcatgccgccgtccaccacccatccttgtgcgcccacgccgcagcctcccgcacgccgccgtccgccttccatccctgcgaggagcgaggtccacctccgccgtcggccgccggtcgcccgagagagagaggaagaaagagagagagggagagagatatttggcgatgacaggtgggcccgaacgttttttattttttatttgctgactggattgccatgttggcgccatgtgtgcaagcttaagtcnnaaaaccacnntcagaanntagtgctnnccagggggtaacttgtccggtatgaatacttgaaggtgtaaaatgtccggttttgttgttcgggggaggggtaatcaatcgacattatagttcagtggggtaattcgtacttttcactttcctatatataaacatcaaccaattaatatatatgttttccaaaattattaaacgtgcatgaatgaatactatactatatatatgttgccatgttgggcacaaaaattacttgcataaatgtacaattaagcacaccacttatatttctaacctaaaaaaaaagtctatgtaggtagcatgcagagaagtacgtgtagtaggtaaggtggtcttgatgaggtcgctgcgccaccaaaatccaaaatccaacaaaatagccagagcgcggtaggtatatgttgttgtatgtagcagaacacgtctgtatgaataatcttcattgatttttcttttattattacagcacacacatgaataaataaatgcatctcaggacggacacatgcttaaagagacggagagacaagcagcaaatccttattagcctcttttaactaacgctgaatggattttaagtcataattaatactccatccgttttatattataagtcatttgttttttttttaattcaaaccttgttaagtttgatcaagtttatagaaaaatttaacaacatctaaagtatgaatttagtttcattaaatttaacatattgaatatagtttgataatatgtttgttttgtgttgaaactactattatatttttctatatatttgatcaaacttaaaaaaaattgactaggaaaaaaatcaaacgacttataatatgaaacgaagagagtagagctttgcaattatcaaatatatataataaaagtttaattatatgaaagaagtatatatcttgagatataaaaattttcagtaatactgttttgcatgtcgaaagcaaataaatatcaatattctgattacatgactagttttaacagtaatatatatatataggtcgttcgaatacatgaatatctaatgtgcatataatatacttttaatagaaaaaacgattaagtacctctaaaaaaatgcagaatatgggcaattgaaccatattttaaaacacgttttttcactgcgaagccatatatcttcataggtagtcggtcgtattttcaattgcgattgctcgcctgcatagttgtaaggggagggggtcatcttaaagggttcgtctgagaaaattaattttcacgagttgtgaaaaccattggctttttgaccgcctgaaaaaggctttgtctaagtagtgccatgcaaatgtgcaataatgcaagtactataccaaattgaattgatcaaatcaacaaatatacacaagatatatatacttgaagtcgatcgattggtcaatgcatgcatcatattgatacaacaggaccgccaaaaatgatcgatgaggtaacacgtagtacgtgaagaattcttgagtcgacggcttatgtatatatgtaatttggtgcatatgccaaatttttaacagtggtactaccattaattctatctgtagttgctgtcagatcagaatggaatttttccccatgcagggatcttttgaattcttcaagctctatcgatcatcatgcatcttttgtccaaattaaacgggccagatttcaggagtggacaatagagttttgtactggcttggaacctttgagtttgtcaaaccgaaggtttcaaatctgaagaataattggcaacgatctgcctgcatggggccaaaacaatccaagaaaatgaacagatgtaagaaaatgaacagatcgtgagacctaagctagcgtaattaagcattgactggtaaaagaaacgttctacagatgtaatgctttctccttaatgcagtcaaggtagtatttgtcttgcatggaagcatgctggattgctgattaatctaactggtcagaagtgtactatagctctcttttggtcagtaggtacagtagctagctagccgatatatgcatgtgttaattctaattccgtcaagaaatgatcaaactttcctgctatctatcccttatccattcctagctactcggtctttatatgttttattttcaagaaaagacactatttggcaattggcaccaagctatggcatcttttcttagcaagagggtcatagacagctagagttatacctaattatgataatatgattgcaccttaatttctgtaaaagatgtatgaaagtagaaacgataattgtcataactaattatgatgtcagttcttttctagatattaactgaacaacaaatatgtaaatagaagcaactttctttcttctttttttttacaaaaatgaactgcggcaactgcctgatggagtgtaataaacagttcccacatatgatatcttccacagataatttaactttaacctttggaactacacataagagtgacagcactatgacgaagattactctcaaagacaggagtatactacaggagacaatcatggtgacatctctgtaatgcgtgtagcaccagtttcaaagagaagaggttgaaatccatggcactggaagaagaaattgctagcatatctagataggttgggcatgcatgcgtgatgcgtccaatatatgtcaccaagctagatcatgtcaagaattcatggtcaactatatatgctttaattattactattgtagctaattatatcattcaaattttatttcataatataactatttttttacctacatactcatctcaactaatcacaaccatccttcgtacgtatttaatttcaccatattctttaacgaaaaaatacgcgtccctattttaaaatataagacatatttttttgaggataatattttcaccaacaattagtcttttgtcacataaaattgaatttattatgttcatatttaaattacttatgacaacattttcttatcacatataactgataccataatagagaaattatatcataatagggtacttgtgctaatcgaaaattttgttataataaaataacatatatcttatattttaaaatgttggaagtataaagctagctaacgggacagatgtacgtagtaacacgtgctccctccgttctaacatactccctccgttcctaaatacagggcgtaacatcttttcaactggattccataatacaaggcggcagcttctcggtgcatgcaggaattgatgagtaatcctcggctcctgtactggtgcatgcagaattaactgatgactcggtttggcttttaaatgcatctgcatgcatgctagctattcgcgcggaaagtgcaggtcgagtgcacgctgcatgcatggtggttaatgctagcgtatctaccacgcaacaaccgaaacgttgctcttcgaacggagagaattaatcagcataactactatttaaacggttttattggtctttgcaactacaacagccacgccctatattaaggaacggagggagtacgtaatacatatattagtactataaattcagttagatgagattatttcggattcatattattagaatctgttatatttaatttaatattataaattactatattctgaaacagagacgataaccagtttcaaagagcatcaccatggagagtagcagagctttgctcaggtgccattgactggtcaagacataaaggaagctgctaaactagctacaggagaatctatgcgggcatcggcatgtgtgtagacggtacgtcccccgttccaaaatataagaatataggactagataaagacatttctagtaataaaaatttgaacaaacattcagttctagatacttatattttaggatgaagagagtactccctccgtcctataaaaaatcaacttagtattggatatgatatatcttagtactatgaatttggacatatcagtgctagattcgttttttttgaggtagagggcgttggaaaaaaaagagatccacatatgaaaccgtgcagcagagagtggggtcacgcatgtccttaattagttggaacttatttgtagtgctactgtattagtaatagtatattacgatatatggtcaattaggaagaaaaaagtgaggaaattttaatgagaaggaaaaggatgtgtcctcaacaatgaaaaggaaacagttcatttactatcattcacggtttatataactttgtaccttcttgaaatgacagtgcgatttcctgaccttttctccatgaatattaatgtgtgcatgtctattactatgcttagctagtttacagtgttttgtacacgatgatctcgtaataagctagcttgtttgttcgatttaaatggagcattgagcaaacctagctagtagaagaaaataaaccttgtctatatatgcggcccgtttaatttatgaatgttaccttttgttctttagaatctagttaaacagggaaaactttactaattacagcaagatttttctattgaattaaagccagaccaatttttttaaacttactctctgcaacgaccaaaatttgaagagaaatttaacggtagactagggttgatgactatactttctttttctatttttaatgtacattaggatgattatatgggccgtacgtcgtcgtccaatcaatacattattttcaatgcaaaaattaattctgattattaagcttgcatataatatattatctattcatcgtgttctagtacataccatgtacatgtcttccatataaatgtactagttgaacttaattaattaaaataagttgcaaattaattatttaaccgatatcgattttcttctgcccacgctttgcttacgactcttgcacggcagcaaagtaaagtttttcttgtgttattcattcgtatgtcagcatagcgtaagtgctaagtcccagtagatcgatccatgcgattatacatgcaacaatagaccgtcgtgtacgtcgtactactagctatatactatatattttgacagcaacttaattttatatatatatatatatatatatatatatatatatatatataggacactcatatggggcaccatggtgcccgggcaccatggtatgaaatacacaaattcgtccaaatttttcaaaattttcaaattgtgagtatatacctagttataagtattcgattcatacctatacctagcaacaaaacaactcaaatttaactttatttcacaatccattattacatacctaactaattatatgtttggatgctatatacctagaatcaaaatctaacaaaagcaagtttgaattcagttcaaacttgctttgaactagttagtaaagtagttaacgttaatacctaaatatttgaaaaagtttcatactcatttgaattgggtatatagtaaatttcaatcatggtgccgggcaccatggagcaccaaacaaatttactatatatatatatatatatatatatatatatatatatatatatatatatatatatatatatatatatatgtttggatgctatatacctagaatcaaaatctaacaaaagcaagtttgaattcagttcaaacttgctttgaactagttagtaaagtagttaacgttaatacctaaatatttgaaaaagtttcatactcatttgaattgggtatatagtaaatttcaatcatggtgccgggcaccatggagcaccaaacaaatttactatatatatatatatatatatatatatatatatatatatatatatatatatatatatatatatcgcgatctcacgaatcttttgttgagtctagctagtgatcaaatgttacagtagtaaagcatagcacatgcagtagaaaaaatggtcacctttacgtagtaaacccatcgttttagtcttcgaatgtacaaagagatgatctgctaaattacgtcagccaggcgtattaattgcgtctagcatgcgtac

SEQ ID NO: 103987 - DNA, 717 bp, Oryza sativa
attcctgcagcccttcgttctccatctgtgtagacaatatcacgattagcatcaacataaacaattaattatttgagcaaataaaaggatttcagagaaggtggtaggtccatccaagtaaatcatcttgttaagccttaataagtcgatcgattcatttctctgcacatatattaacctgcacaaaattgtttcagaaattaattaatttttttgacgggagaaattaattaattaattaatttaagcctgctgaaaacagaatagaggctaaaatgagagaggacgatgggattgggctctctttttcttttgaggacgcacgtgcggcccaataaattaatcaggccgggcttgcgcatgggctgggctcgccgataatattaggcccgttcaacgaacgaccatgcgtcccaatacacctgaatatatactggcgcctcaaactctttgataacagaaaatctagataacggcatcccgtaggaacgagatgacttaaaaggtctacattatttccatcaaaacaattgtacacgcatgcggcacgatttcttactaagtggcaggtctatactccacaacacatccacgtgtatgtgtccttcctacagcacgaggcctctaaatacactggttgggcacttgggccatgtgaatcaatttgggcatgcacctctgtaggcttgacttacatcttctatataccatggtcat

SEQ ID NO: 103988 - DNA, 572 bp, Oryza sativa
ttctttacgttaaaataataaatatgagagtgttaaaaactttgagttgaaggttttaaaatgagttgaaagtttcaggtttgagctaaaagattaaaaattgaattgaaagttttaaaaattgagtttagtgaaagtttactatactttttaaattttgaaataaatctctgttgaaaaagtatctatttcaattttttaatcaaatttaaacagcactaaaaaaagatgtgcatgtgtgctatcagcacaactgcgcgaaatagctccactatgtatctatctaattaagggcatgtttggtgaagtttcaactcctaaatttaactctatgagttaggtctagagcggagttgtggagctaactaaaccttacccagctccacctttctaattcattttatgagatcactccatttagttccactcccatttttagtggagttgaaaccgtttagttgggctccaactcaacgaaaggtggagttgggctagagatatgccaaacatgccctaagtagatttcttctcaaaaaaaaaagagaaaataaagtaggttctattgatgggcc

SEQ ID NO: 103989 - DNA, 1963 bp, Oryza sativa
atgttgagcaaagccaagagaagccaatgcaatgcaatgcaagagcaacacttcttgctagttcaattagccttgttaattaaatttttttgggggtattgtttttatttttgtattgtttgtttttttttttggattgatctatcaagattcaagaaccatttgtcttgttgagacgggtgtttgatgatgattagtagtgggtccaaattaggagggccaagaaaaaaggagtttgagagagaaggggaggatttgtacagttgatcatcttgatttatgctgttgcactgttaattaattctagtttatttttcattctttccatgtgtgttctactagtactagtgtatatctctctctctctcttaattttattttttcagtgtgcctgtggctgtgtttatgtttagatccaaaatttggatccaaactttggtcctttttcatcacatcaacctatcatacacacacaacttttcagtcatatcatctccaatttcaattaaaatctaaactaaactttacgctgaactaaacacaaccgtgttgctctacatggcaatgatcttgtgcttatcaccttgggatctactactcctttgtcttgtgatgtcactgtttagtattactactcctatcttgtatggcagcaaacattatcagcaatttccattcttttctgtggttactgaaacaatatttgcatgtactactatctcaatatctttgtttaattgtagttcacctggtggatttttatcccagctactataacatttttttagggtttgttcactttgtagccaaatcaaccttgtcaaattttgatagcgttgaatgtatttagtttgacgcctttgtaaaatttgatagcacttttatgagagaaaagttccggaactatggcattgctaagatcatatttagtttatttgcatgctgaaaaggataataaagtgaataagcttttaaaaatattaccaaagggtgttttacaagacttgattaccttgtttggtgcgccggaatttcacaaaaactataaattccgagatatgaacaaagagagaacattgtggataatgtcccccttgtcctagcacctctgttagtagaatgagatgagctaatttagggcttttatgggttggccaaatagaaatgattcattttgctattcctattcatgcattggagatgatggatctctttcacacaagtagacacactcccaaagtttttcagggcttggtcatcacatctctacttgaatcatgaatggcaaaccccacacacaagatattactaaaaaggataccaaattaatcaaaataaaaaaagggtggaaaagcaagcaaacctaatgaagagatcagcaaagcatgtcagtgaagataattcggtggtgatgcaatggtacagagacaaaagagcttttaaaaaatgggtgagaaaatcagaaaattatttatagtactaggactagtataatgtactccctcactcctctaatataagggattttgatattttgcttgctgtttgaccactcgttttatttaaaaatttatataaatataaaaataaaaagttgtgtttaaagtactttggataataagtcacaaataataattctaaaatttttttgaacaagacaatggcaaaacaatataagcaaaatatcaaaatcacacttattaagagatggagggtgtactgtactatttcattagagagagagatggcgttttcacgggtgattggattaattaacagaggaaagggcgtcgttatctggaatgggtggtaacacaagttggtttatccctttaattattgcctgtcgcgtcagctttcagtttgctgctgctctgctctctctgttgctgctactgtgctatactgctgccgcgtggatctcgaggcatatccaatggcgtagcctgtttgttggcccaga

SEQ ID NO: 103990 - DNA, 583 bp, Oryza sativa
agggtgtaaagttttttttttcatatcacatcagttattatatagggtgtcgtatggtgtgtttgggcattaataaaaaagctaattacagaattcgtcagtaaacagcgagaagaatttattaagcttaagtaatctgtcattagcaaatatttactatagcaacacattgtcaaatattatggagcaattaggtttaaaagattcgtctcgcaaattagtcgtaatatgtgcaattggttatttttttagcctatatttaatacttcatacaggtattcaaacgttcgatgtgacatgatttaaaatttttgtgtgaaaacttaacaaagaccttcattctggtccaggaggcgacaggaaagagtgtatattacgaaaaaaaaattttgtaaaaaattataaatcttacgatactaaactatacggatttataaaaattgatggtcaaatatagatatatttaagttaaaacaaaccgataacaaaactattttaaaatcaagggagtacatatcataataatctccataaatgctgaaaaatgtacataattaaattactagcgatttggttcagagaa

SEQ ID NO: 103991 - DNA, 1928 bp, Oryza sativa
gatcagtatcaccggtcacaaacatggtgggacagtgatcaaattcagctacaatgcagtgtctcttgcacaagacatggagctaccatttgcagcatacggaacgtctcctctcaagccggcgaagctatttgtcccagctgattatcctcgaagctccccggtgtacgaagatggtgatgaacagcaccagggaatgtacagcgtgatttcaggcatggttgacaaggtgttccagcgtgccctgcgtaaactcccggtgccaatgtcgatcagggacatggcccggcagtggggcatctccgtgcgaacggtcaccaacggtggaggaacgttcagctccgggtatggccagtgggagagttgcaccgatgagtttgcaagtccatagtccatggatagacccatgaagttttgcaggaacaagtgatatgaagaataatgctgatctgctgttttgctgtagggcagatgcagaatccagtgtgagtgttgtgagagaatatttatatttttgttatgcattaagaggctgtgtggatcatctgtttttgattaaaccggttttgcttaaaaaatatttcttactacggttgtgaattgtgatatttatctgtttggactgtgtaattggaatgagcgaatttgctagtaaaacatgttttctgaaaactggttcgtatcttttaagatccaaacaaccacttagagtttttattggcaaatactttggtcgttaatcttgcacgtgcaggcttatgcaattattgtgcaacagttcatttcatacttcatactccgggcaagtagtatgaactgaaatgttgcaacgggcttatgcaagtagtatatatatgttcgtctgaaaatttttcacaggaattgaactgttttagttcgatgcaacaagatggaagtctgcaatgcatccgggtctgacattttatttgccacattctgcttgacacatggagttcctcatacagatgttcttcggctgcgtctgacaaagtttagcaaactgaaaagtgaacttatgcctatttagaagcgcacatatctcaaacaaattttgtgggcctcatcgtttgccctatatagaatcaactactactgccaaagtttaatttttaaaacttaattttgaagctttttcattgaaatttttagaattaccttttaagtcgttaaaaacatagagtatataaaagtttttacctataatttttagtccctccggacaacattattttttgtgaacaggctgtacggcgtattctcagtatatagtttttaagcagaagtttcagtctgatttctccatgaacctgcaagaaagaaaaatgcggaagtactgtccttaaccatggaatcctttcagaaataactggcaacagggatcaacttgcatagatttacgttaacaaaactaatatgaaaaatgcataattcttctatttccaagaggtaaagtgtttcattttaattttcatgtgtgatcgatcgaaaaaaaaaaagaagcttgtgttatgttggtggagccaggacctggccaccatggcagttgcccgggctccaccgtccatgcagcagtagattaggatttaattactgtgattactgaccttgcagccacatggagtacataaatacaatgcttaagcaaaggcaaagtgctataatcattgtgtattttggtgaaacataattgaatcatatggtaaaacattttggtgtagcgtttgaaacgtcaagtttcaattgttgaaacatccacgcagggacagatccagaacaaaaaatggggggagggggctcaattacacggtttctttaacctccagttatataggaacctttagtttattattcatggtgaaaaaactaaaggggtactccgggggtatccatagatcttgtgggtgtag

SEQ ID NO: 103992 - DNA, 637 bp, Oryza sativa
cctcccgaagttgggccttaatgcgtgcagctttctgtgccttggaaagcttgtgcttcttgtactgccacgcgtattggaaaaacccaaacttccatggaacattggagccaatgcccttagtttgtccacggtgttcttcatttccaacgctttcgtgcggatgtcatcctcgcgtttttgtgagcatacctcttgggaggcctgtctctcagcattcagttcgacctggggtacagttaggacgcgttagacgaagaacaagatacaacataatgaaacttattctatgtgttcaatttacgattttctggtacaccgcttgatcttcgggatttggaaacgaaagagttccgtcactattcttcttcacccttgcccttgcccagttccttgcccgctggaccgggatatcagcaagcacttgcggggtgttagattccgctgcagcttcatcctcgttgtcccattctgcctgtttccccgtgtagcctccggtgccaagccggtgcgggtgaaggttccttgcctgcagatcacggtaggtctggcttttttctcgagactctttcgtttatttggcggcatggaactcatcccacacgggttgggtgatgaatgggtatttcccaaatgg

SEQ ID NO: 103993 - DNA, 524 bp, Oryza sativa
gcagcccgggagagagagggaggagggagctgggccgaggggaagggagggagctgggccgggaggggaggaggcccaagaggaggagggagagaaggagagggagagaaagagagggaggagagggagactttgggctgggcttggcccaaaggaggaagaggatttatttttaggtttttctttttaataaactctaataattgtttttgttgcttaataattatttccggtgctctgaaaattcaagtaaaatttgagggctccttttagaccaaggagaatttaacaaaaattctccgggccacattcgaatttttcttgtacgtattttagtgtttgccaatttcttttcgaattttaattaattctattattccttttagaaaatgatttttatttcgggatgaatttatcaggacgtgacaaatccaccccccttacaagaatctcgtccccgagattcgaggcggctagcatgaagataggttgggcggtcttctcttcttgtctgacttcttcca

SEQ ID NO: 103994 - DNA, 739 bp, Oryza sativa
taggatcgcctgtaacctatggagtcgagcatctaatcgactctcaaacgctattacctgcaaacctaatgccctattcatctatgccatggtccctccattgctttaaccatacatgaacactgtggatggtgaaaactagagtcaggcccattttgcacacaccttatccgctgtacccccagatactttataaactaagcattctgagcatatctgccttgtacccaatatccactcctccgaatagggatccataatcctagtcaaccaatggacttaataccaatatatcagcgctcttcagtgccaatccccaattgaaatattccacgtatataccaactgctgcaatataaagtcgtcaacctacacctgactacttctttgaaagttatcattacactatcattataaaaaagctaaaatgccctgaataaacatatttacatattatatccatacaccatacgcacactgatttaacacaacacttaactccctaacatacacaatgtctccccacacatctacaacacttacatataatctatcacattctattcaataacctcatactacatttctcaactctctgatcaataccctcctatctaatcaaacatacccctgctattcatcaacaaaaatccacacgtacctaactttaaaccactctgtagaattcaatcaatcactcgataaatccactccacacctaactatttcataaatcccg

SEQ ID NO: 103995 - DNA, 556 bp, Oryza sativa
ggaaaataaaaatagatttagtgatgcatcaacttaaatagaacaagaaacaaagtgaaacagcatgcatgcccactatccaaacaaaatactagtacacaaagagcatctaactaatgatccaatagctcatgatttttgatggggttaaagctagatgcatccttggacaaggatttagccacaggaaccacaggagacgccggaatcggttgactgcaagctcagatctggatgcaagagaaggaaagggtgacttctgcttagcactaaactgagtaaaatagatgaggcggcagtgactaccgagaatggggtggaaggggacagccgacgcctgctctccccacgacatgttgacctcgacgacgtggggtggtgtggacggcggaccgcttacctcacgaacggatctggcgtcgctgaagctaggactgcaggatctggagcacccaaactcgggatggttggatccgcgacctctgagttcagggtgtccggatctggagcccccgagttcatggttgctgggaccgtcagggggagggtgggggat

SEQ ID NO: 103996 - DNA, 589 bp, Oryza sativa
ttgctgttaccgatctgatcactagctagctagcataaggtaaacagtaattaacttatgtacgtacgtacgagcagtacatatgagtggctgtgccgatcgaatcagcacgcacgtgtggctgtcacgtgagagcaagggtgagcaatttgggataatagattatatggatctcttagcgctagctgcagctagctaggaaggagcagtagtaaacaagaatggcaggtggccatcaaaggctgtacagctcctccgatacattccgatctcgtcgtcgccttcatctcgcacaaacaattaaaccctaaataatccgtggaccaatcaatcgctcggcacgaccaagttaaaaattaaattaaccccatggcctcgatcgaaaggacgacgagccgcatgcatgcagatcgatgcgagctagtgaattgaatgaacagcgaagaattaaagagagagagaaaaaagaattatgtacggcgattccgaccgcggcgcacgtaccggttgtagttaacgacgcgacgacgacggcatgagatgggaacaagcaggaagaacttctcgaggcgctaaacaaatcggaaag

SEQ ID NO: 103997 - DNA, 821 bp, Oryza sativa
ccatttacagctgaatggaaaatagaaaacagaagcaaggaagggaagtgaagggactggttgcgccagttctattcttgcaacaaatggggcgatctaggactgccgccggctacataagtagctgcggaaccacagccttcgcaaactgccaaagagctgcttcttccgccattgtctttgcaacgtcgacccagttctgctgtcgttggttgcacactcggtcattgcgctctttcaaatggaccaggctcctagagtgactcgagccggttcttttcatgatatagagtgccagaagtagtttttgggcatatttcgttgatggagagattgttttcctttataatatataagaatatgatatgtgggacaagttactaccggagcatggtacacacaactgtaacagcaagccaaacaaaacatgacatactagaaatctatgataataaaacaaacagtagccacagaaaaaatatcaaagtacctaaatctgacaaagtctccaagcaaacaagaagcatgttcttcttatttccaattttgcacctcttctttgagtggaccaacaaaatgtacaagtttctattaagtcacttacgtgctcgttgatgaaaatgggattcttgagctctgggtatatcccaacaaccctatcggcataaagcgcaatcaagatgtactcatcaaatgtaataatctggtacttccctgtgatcaagtgtgaaagcattattggcaaccatattttaagcacagatgaaacatagaacaattaacaaagattagactgagcattacatgctacagaatacaca

SEQ ID NO: 103998 - DNA, 1342 bp, Oryza sativa
ttaggatattagtgcggtggtggtagcctacaaggaatccagttaatcagaactagcagtggaaggtagattcgcaatttttgaactgtatacagtggatgctatttttctaaccaaagctttaaggaaaagcataacagaatgtgactaccacatatattcaacacataaaccatccatgtagcattctctgttatctcgtgatgtgataactttgtacttttaaatacaaaatgtgcatattacaaaaaaaaggatattcttgtgtagttatgtggttttcagttatacactcaaattaatagagatgcacgtaatggctatgaagtaaatctgccaggaacagttaagtgaaaaaacaaacaaacctcaagatcttggcaaatgctgctccaacatgaatttgaaaagtccctagtttagccagtccaaaattcaccatgcagctctgtgggtactgcaaacatacaggaacgttaaagctgagtaagttcatgtggattatccattgcttcccttagtatcaactctgccctctgctccttatcctccttgaagaaccagggatccttcagttcaaccagagctctcgaattcagtgccatcaccattgacttcttatcaatcccaattctaaaatacaccggtggcctctcttttggaacaaccctcttctgagtctgactatcattttggccctgatccataccctcatcaaattctccaccttttgattcttcaaatgcgggtgcgaaggcctcaacaacagagaatgtcttccccacaccaggcatggtaacctcggacaccgccttctccccataaggcaaagctcgctcatgaaacggattcgccttgctctcaaccacatctagtccgttcgctttgactgcatcatcgaccagcattcctggtcggaacccgtcggcacctgcaagagcaagacgccgttgcaggctgagcagcgacttctcagctttcctccgctgccgcgcccgctccacctcatccgccccagccttagccacctcctcactccacaactcgctcctcacatacgtgtgaggttccggaaaggccgggagccattccgggacatggctcatcccgctctccctacccaagaccgcaaagctcgtcgtcgagtgcagcggcacacgctgtaccggaaacctcggcaatggccggcccgcgaacggggatccttggacgcgccaacaaacacggccatatccttgacgacggcggagttggcgaggcaacgggcagaaaccgaggcggcccccgcgaagccatagtaggccgcgccgcactcctcgaggaactgtatgacgtcccactc

SEQ ID NO: 103999 - DNA, 2453 bp, Oryza sativa
tctcttcatttaataccttccaagtaggaaaatatgctgacatagatctcttgtagagagcctatagataaccattgtgggtgccctaagggcagccccaaccctccatctaggatggtgtctatagcattaactacattgccatgtaggacttttagcttatatggcactatattaattcagagagtaagtgaagagaggaagaaactgggtctcatgcaagacacagcctcaacacgagaacctatgcactagacactatcaaattttgtattgggagagaatagtatcttcataatagatgaagaataaatatgattggtagagaagagagatgatgtatttattagtggcctagtttaagaaaccatgggttgtagagtgtagtttctattgtgatgtcttattgacatgatatcatagacactgcttatggacactatgggttgggactgccctaatagggtaggcggacactcaaaggttaaattggttttatttagagaagagtaaagtgtgttggcggtccttaaacttgtagggttgtgtcgtatatgtctctaaactctcaaaatggatatccaggtctcagaacttgtcaaagtgtatcatcttggccccaaattgatacatcccctctaggatcctacgtggcgctgatgtggcaatgccacatggacgtgacgtgtccttttcttttttttctttttttccttttcttttccgttttcttctcattcttcttttttttcctttcttcagagaaaggagaagaaatgggaaaaaggagaagaaaaaaggaaaaaaggaaaaaaattaaatgggtcctatttgtcagtcaaaataatgtcacgtcatgtccgtgtggcatgccacatcagcgctacgtaagatcctgtaggggttgtggcgatttgggacctagatgacacactatgacaagttctaggatttggatatgtattttgagagtttagggacctaaatgacacacccttacaagtttaaggaccgccagtacactttactctttagagaaacaatacaaatgtatgcgctcataatatacacggatacatccctatgcacactctactcttataagtatatccgaaaagctcacacgcatgcacatttataagtatattcgaaaagctcagccagtatatttggagattaataaaagcatcttaaacgtctcaatgttaacattaactttcatgaactgccggttgtagtttcgtgaaaactgatggtttttaactagtttttactaagttggcttctcggtttgtatccttggtggataaaccgatgggttttcaatttcaaaatgagaagggaaacccgctttcaatttccacgtgtcgtccaatccataatgatccggtgtttttatagttatttttggaatgttcctttggccaattttgttttactgtcgtgaggacacatttacaatttaaagaacataatcataattattatggataatttattacaccctccgtcccaaaataagttcatttatatgtttatgtgtgcaatgtttgaccgtatgtcttatttgctctttttatgaattactagtatttttgttgttattagatgataagatataaatagtactttatgcatgacttgttttttaaaaattttcagataagacgaacggtcaaaagttagatatagaaacctaccaataaacttatttttgggatggtggttgtacttctgaaggtgtactttacgcttaggttttgttcgcctttgttcagcaccatgtttaagctgagatgttttgcagcgaaggggaaaagtcacatgattaggaaaaaatatgaattacccctctgaactatcgaggttgattgtattccccactcccccaacttaaatatcagatattttacaccctcaactatgcaaaccggataaataacccctctgattcataccggagtggttttggccctacgtggcaattcaatcagcagttttttaaaagttgcccatatgtcatactccccctctctctctttccttaatccccatcctctatcttcttcctttcctcacctccctctccacctctctttcaccaaaccgagcagggaggaccgagctgacgacaatgcacagcaaccggcggcaggaggggctcgagcccgtgtgggcttaggcgcaagcagcgatagaggtagcaagtgactcgcgtctcacagccgacaaaaggcacacgcgagggacgacagacaacagctagcaaaagttggggcggcggcgtttccggcgaggggtcggtgatgggtggtgctttgtagtgcgacaagcgacgatggcgcgtggctcgagcgacatcgatgcccgggaggccagcagcagggcaagctcagcttgcctcatttgaggaggcattgccaccgtaggtgttacccctctccacgtcgcct

SEQ ID NO: 104000 - DNA, 3634 bp, Oryza sativa
agcaacagagagggtggggggaggggagaggatactggcgagagggagagagaagaaaggaaatgacaggtgggccctataatttattattattattattattattattattattattattattattattattattattattgctgactatggcaattgacaccacgtgtgcaagctcttggtcaaaatcgcccaaaacagtcctagaagggtaattcgtccgctttagaaagttcagaggagggggtaattcgtactttttccttatgattaattaattactacattactattaaaagttgaaattagttttatttgatatttaaagatacatttatgtaattttaaaaaagtatcgtttagcagtccaggaagcgttctcactagaaataagaaaatagctaaccctgtcaacttaaatacagtagaacacaacgtttgacgaagtatttatagtcacgggtggtataaccatacaagtgtttttaggtagagtgtggtcagcattccgaggtttattatcattgtatgagcaaatactataagacctttaattacttgtcctacattgtcatatatgcttatatgtatgatgaggtagatgagagaagagaagagagataaagagagaggagaagatacctctcatgcaagaaacaaacttatccctcccgcacggaaaacggagcggtccattagcgtatgattaattaagtattagctaatttttttaaaaaaaatagattaatttgatttttttaatcaactttcgtatataaactttttgcaaaaaaacgtatcgtttaatagtttgaaaagcgtgcgcgcggaaaacgagggagatgggttgggaacacgaggatgcaaacacagccttaacacaaacttgaagagaaataagagaaaaggaaagagttgattgatcaaacaaataaaataaaatcattagaatcaatgcaagtgtatccattgaaaagggaagagtaaatttgagcaaacaaataaaatgaaacaagaattttaaaactgtttttttccctgttaactgcctccattaaaattattgtaatgctagtgttggacgtcttatgagtcttcctgatttctcattttctatgtggtgaagttgttgaaaacatgttaaatgacgctacttgacaaacatattctggtgggggtggtagatcgccaggcacattcctttgttgtatcaatatttgttaaatacatttaagtaagcaattcgctttaccaaaagcagaacatgactccatggcccaatggataaggcgctggtctacggaaccagagattctgggttcgatccccagtggagtcgcccatgtaagtttcgatatttactttttacctttctttttttttataaaattggaaatttttgataaaccaaaagttgattattctcccattataaatatagattatcttttaccattttgtgttttaatttttacctttctttttttttgtataaaattggaaatttttggataaatcaaaagttgattattctcccattataaacatagattatcttttacttttttgtgtaaaataggaaaatcaaaagctgattattctccaattataaacctagattatattttacttttttgtgtaaaattggaaacttttggataaatcaaaagttgattattctccaattataaacctagatttatattttactctttttttttgtaaaattggaaacttttggataaatcaaaagttgattattctccaattataaacctagattatttggtcatattctgcgcgcggtgcggtggggtgctataccggctgatgtaagatgtctaccggtaaaaagataattccgtgcacacatatctctgaacaattttctccatcctctaaattttgcctcattttctatgtgtctttgcgttttgcttcgagctcctctatgcccattctagttcaccgttagatttttctaaaaagattacattgccctttctcatagttacgatctaccaacttcataaatctcaatgtgcaaaattttaatctacgataaaatcaagttgtggaaaattatttgatgcaaaatttttaaaacaaaatttaatttttgaacaattttttttattaaatccatacctcgtttcatttggaattgagaatcaaaatatttatttgatttaaattttagtgaaattgttgtatgaatttcatcaaatttgatttgaaatttattttttaaaaaatcaaacttcatctttcaaatgtgtggtcaaataattttatcccctttgtttttagaatgattctttttttcacatgagaattgtgtttttatcaccaagctaacacaaaagtatgaagcggcgtatctaggatttttatacgggtagtccaacctatatatattttttaaaataccctaaatataatgaagttagaagtacaattttatcgaatgtgcatcataaaatatgaataaggatttttttcctttttccaaaatttttttttcacatatgtatatatgcatggggctacgattttttggtggctacgaaacaacccctggatttgactagtatgagaaaggggcaattagtcccttttgaaatataattccatcattctgcatgcatacttccgcatgctgccttaggcccctttctttaatgttttaaaacataggaaattcaaagtattgcaattccgataggaaaattttctagaaaagctttgtttcaattgaattatatattttcctttgaaatttcaatgaagatttcggagaaaagttagtaagagctctaacctcttataatttttcctttgagtctatttctcctatctcaatcctgtgttttttatgtggtctattcaaatcatcattcccatattctccatgttttacaatcctatgttttatatttatatttttatataaaagttctattttttttatttgtcttttttttcagtacagatcccttagaatatgcatccatcacttttttttttctcaaaccggacgcctgagtctaggcattttccaaaggaaaaatgttcacttttcgtacctcgaatataggttgagtttcaatcgcgaaactcaacctacataaccaggtacaacacattagttatcttctaaaaacagtgcaaatagtcccaaaatattaagtatggttttggctaacatgacgttcacgtgacagcccggtcacaataaattaaaaatagacatgggcccacatgtaagtgataagggggaaaataaaaaaaaatataagacccacatgtcagctccgacttctcctctctctctttcttttctcttctttcccatccacaactaaagttcatgtgagggaggcagaggtgggcgagggtgagggaagaggaggcggccgatgagacgaagggttacctcatcgacggccggtggtggcgaggaggggaaaggtagtggcacgggtagctagggtggaagccgcgggctgtgagggctagatctacgcgatgagaatgcagtggagagaggaagaaaagtccgcagtggcgtagaaggagacgggagcatgcaaggaggcaggatctcaaaacagtaatgacgataacactctag

SEQ ID NO: 104001 - DNA, 2066 bp, Oryza sativa
attcctgcagcccgccttgggtggagttcacagattactgggctattgggttaatagttgtgctttgtttttttggtaggtttggtttcccaaggtagaaatgtttcacttgcgcttcctgttgcaaaacactcattgccgaaaaccttagttaacttaaatgagaaccaaatgcaaaactgaaaacccaaaaaactggcagttgggtccggtcttcggttttatttttacccacaatgatactatattttatttctaataagcgggtatttaaatgtatagagaaatggtgctcattatatttacttgtggaatgcaaattgagaagttagttagcttctataaactgtagtagatgaaatatccacatatcttttttatgcaacatattcctaaggttagaatgaccacggtccatacaatacagttttacgtacttcaaggcatctcactttatttttttcacttattaattaatcttcaataaaaggacaaattccaagtaatttctcaaacaagttcacttcttcaatacacaaacaagcgggtattcctttgatgaatatggtaggactctaataagaatgcaatggatcctttagattatgttactatcattgctcacatcttccttattgctaccaactttgccaacaaaatacttacgaagagtatccttgcgtacatgaaccactagataactctttctgtagagtagcactatatgtatctatcatactgtggtgattggaataaactggataataatagacagcaaaagggtggaatatcctctatagggataagggtcagcgtgttggcaaatgaatcaaagcattggattgatagtgccatctgtggttggtcaaattttctgtcccaccatgttgctgcagattccagggatggattttgcaagttcctgtttatatatcttgggcaacacataataaaatctactagtatcctctggcatagttataataaaatctactagtatcctctggcatagtttatcacctttgaaaaaggtgaactttttgacttttgagattctgttctgattgatttttacagttatgtttctgaaaattttgattgcagttaaattctatggcaactgagaacaataattgttgagttactaattctttttgtagagaaccctatggctagtaaaagcctgcttgatataaatagcatttaatcatttccttctgaaaggtaatgcatgtacttgttgcattttcaacttctcagcaataagctggcacatctataattgtaatcaatttgtgcaacactcaagttgtgtatgtatgatattttacttcctaccaccagcatctacttttgtgtgtgtgtgtgtatggtggggaaaaccaaatctgcctgcctgtacattggagatgcaccaggccgttttcccccacctgtcacattctcgtacagcctgttttctaaaattgaacttgattttccttttgtgtcatggatattgttgaatcctaaattgtatcaatttgtgataattcctcgtctattgctagcaatgagcttccttttgatttggattgaaggtcaacacaaactataatatggcatatgttatgaatttatggttttccttgtgtgttgctagccatgtacagtgcacaaatgcacaatgaaaaatgcctatataaaactaatactggtaactgaacctttttattttgtagttctagtaaccaatccatgtggtaagcaagacatgcgacattgggttttaatgtttaatgaactctaatatgagacataatctatggcttaacatcctttttatttgaaagggtttgcaagcgaaccataccgataacagaaaactgaatctggacatccttttgtaccttggtaccttggggttactgagcatagacttttgtgctacaatgttcactgttcactttattaaagtgtaaatcttggtatgaacatctcagtgctgtataaggatcctctacatcttacctatccagtgtttaaattcagagtgtggtgcaataatgagaactaataatgtttga

SEQ ID NO: 104002 - DNA, 809 bp, Oryza sativa
ccgccaccaccgccgcataccctgccggcccgggccaccacccccgccgcctctgctgctcatgctcgccttcgcgctcggccgcgccccaatcataccggcggcacctctatcccaccgccgcgaacccaggccgcgccgccatcgagggggggagtggcagcgccaaaattgcgggggaattcgagcaccggtggtcgaaatcgggatggaaatctagggtttaggggttgaccgttggggaatcgggcacgcggaggcggcggagctcggaattcggagagaaatccaaaccccaagctggcgaaatggggagagggagacgacttgagttgactacactagcgagagagcgaggaggacacaagcagcagcggagagagagagagaggcgtgtcggctgaatgcggaatgcctcaacacaggaagatttcggccatcttccgacggcggggaatgaacggccaggattttccattctcgattcaggagctttgtcactcgatgggtggattatcgggtgcttctatggtctatacaaaacaaagtcaacatggaaggcatccacaatggttatttataggctctctacaagagatccatgtcagcatatttttctacttggaaggtattaaatgaagagagagagcaaagctatctactaacttatagatagtctatagagaaaaacgaggcaatgcatgagagagctatagataccaatgtagacatactattgaagtggtttactattaatcgagtctattgctgagatgtacatgttttatagagagcaccttagagcaccc

SEQ ID NO: 104003 - DNA, 610 bp, Oryza sativa
tctcactgagcctgactccactgtaattctcaataactcggctgagaattataaacttgaatgtctcaatattatataggttgtatcttaagaaagtttaatagatgtctcacaaaacaaactcttgaaagagtaagcatttttattttaattagctccttaattacatatataatcagatcagatctgagggagactcaagcctaattttgctccgttatctctgaactgtgatgtcaaaagatactattgcattaacactggtggtggtattgatttatgcacttatgtactagaactactataaaccatcttggctttatacacttatgtaccaccacttactacacttatgcacattcatgtaagaaatctatagttttttgggtttcatcagtataccactccagaatttagagtgaagcttattttacttgttatacatgcatgcaggttgatgatccaaaaattatcaattttctgctggaaaatgaatttgttcctctatgcctgcataatatgacgatcggcagtgaattatcaaaaactgtatgtagccagacacattaatcccccttaaaatactacttcctccgtttcacaatgtaag

SEQ ID NO: 104004 - DNA, 655 bp, Oryza sativa
ggcgaaacggagatgaagccggggaagatgacgttactgcggatcggatggtggcgacaccgggctgcgaggaggtcctgaccgccggcgaggggtggctggagttgcgcgatggcggcgacacgagaagaaggcggcgtggcagccaggtagagaagagggggagggcagcggtatgtcgggagagaggagggggtcaggaatcctttttataggcctggggggaggaggggatcggccggggagaggagagaaacggccggagagctcgccaggctgccatcaatggcggcagttgatcggagattaaattcaatgattaaaggctgaattaagaggagaaaacgtgggggaattgatgatgaggaggagaggaaccaatttttgcaatcgatttggtggagagcgagtggggaggggcggcgctggagttcttctgccgggaagaggagcggtcggctggaggtggaagacgacaacgtgtccctttcctgggccgactgggccacggccgagcgagcaggggaggaactgggccgaagcggcccaagggagagagggaaggagggtgggccggcttgaggaaaaggatgggccggaggagaggaggtcggcccgagagggaggagggacccgagagagagagggagcgaag

SEQ ID NO: 104005 - DNA, 2089 bp, Oryza sativa
ggcatcgcagagccatggttcccaaagccacggcttgtctccgacgtgaagggttgaccacagtggtgcgtagggcatggcctaagacacctgaccattcataaatttggttcaggcaccactgctctagaagaagaaaattacacaaaattcattatggtcattgtccgttcttgaagtctctctcgcttggtttgccctggaaaagaaaagaaaagaaaagaaaaggagagggagagaggaatacttgggggagatgtctgtttaatttgactagcggtaatctggttggtttgggttaggaaagttcctggtgctgaacgcagatttgtatgtacggcgtacgtgcttctttgggtgtggagaacggaacgtgtattgaaaaccgagcgtgtgcagtcgacttgcattgatcttttcaaagtactccgtagtacccagtacattctctgaatgggataaattgtcaatctgaaactaatggggtaatatgttttcgtgcattataaaaaaaacttgagcaattaagctaaacagtatacaagcaattttcacacaactcttgattaagatttaccataccgttttagacaagtttaatagtatagctaactgttaccttaaaacaatctacatatacatataatatatatatatatatatatatatatatatatatatatgtgtacatatgtatatatatacatgtatgtatgtatatacatgtatgtatatatatatatatatgtatgtatgtatgtatatatatatatatatgtatatatattatatacatatatatgtatatatccatatatatacatgtatacatgcatatatatatatatatgtgtatatatatatgtgtacatatacatatgtatatatatatatatatatatatatatatatatatatatgtatacatataaatatgtatatgtatatgtatatatatgtttctatattggccccattcgaatctacttaaaagggtggataaaattttagattaatgttgcacgtttttcaaactactaaacggtgcgttttgtgtgaaaattttttatatgaaagttgttctaaaatatcagattaatctattttttaagtttgtaataattaaaacttaattaatcatacgttattaccatctcattttacatgaaaaacttaatctttattttcattttcatgttcagaatattcaaacactaccatagattaaagcatggtggtaacgctacatagcacgcaaggtgctacactgctacgtagctatatgtaggacgcctcacaagttctttcacctcaccatccgttaaagagtaaaaaaaattactcgttgtttccggagcctccatgctctcccacttccgtatcctaaaagtaataaatttactaaaaaattaattgacactaactttcttaattgctctttgagtaattttttacaagaacttccgcagagattgttcagtaataaaattactgacacgaatcactcccacattagtctttcagtgatatttttactaagggtgtgacggaaaagttaaaagtttatgtgggtaggaaagttcgatgtgacgaaaaaattgaaagtttaaagaaaaaagttagaatctaaacagggcctaacacgtactccctccgtcccaaaaaagccaacctagacaaggatatgtaacactttatagtacaacgaatctggacatgcaggcaagaatgggacacttcatagtacaatgaatctggacatgagcatgtccagattcgttgtattaacgcaaatcctggagattgacgaagtcaccatagacgtctcgctgtcgacgggtatatcgcctaccactgaaaacataatgttgttaaatcctgaaaaatttattcccatggatagtcgaacccaaaacctaaggtgctactgaggctcttataaccattaggctacaaggcctttcgcaacattgtgatttttctagtaacacgtaacttcgcatccaccgtttagtaacacatattaacttgtgtatccatcatcgtttgtaagtttctgaacaacaccatataacttatgtatccatca

SEQ ID NO: 104006 - DNA, 680 bp, Oryza sativa
tattcgtaacctcaccacccacaagaggagatatctacacccaaagatgtatccatccaaccaaacaacatctcttgtatgcaagtgttccatccacctttttatgcagccaaccaaataacatctaaccacatcctggctcattcaatacagacaaccaaacaactgcatctgtatgtctctagcctggatgagggagaagagccaggctagatccatacgagcaaccaaacacaccctatgctatccggcttacgttttccttgttggagctagctacttcctcatttactacctcatttaccgagagcaagctttccagattattgaatacgacgtttttctaaaaactttccaaatagagatttcttttaaaaactatataaaactatttttaaaatttgtaatagataatatttaattaatatgactgttttagtttgcatgtggcttaaaagccacgaattctgtatcgaaccaggcttaacgacatgtacagtgaagaccactggtactaatgtctcagcatgccaaataagataagaacaaatgaaagccacgcaatctaaaacagagactattgttgagtatatttttcatttcagcccctgattatttatgcgtctgcccctagttattgaatcaattagaaattttatattttgggccttataatagta

SEQ ID NO: 104007 - DNA, 590 bp, Oryza sativa
taactcggcgttatcggatgagaaccatagattttggtgacggcatctaccaaccctcgtatagctacacagatctgatcgctaccaaacagattgcgtccgacatggcgtgtatacttcctgactacattggggcgccagcactaatggaagattggaaatataacacctgctactatgagagctggtaaaagctcggagataaaagcgaatgtgggcgatatataatctgcctctacctaccaccagataagaccatgcctcttctcgcgtatagttgctcgtgagctactgaccatggcaagagagtgcatggagaatctagatgaggcttctaaacaattaacaactcatacatgcacgatatatctcgatcagtatgcttcttacgcatatagagtacatgataaagagatcgatctggatgactgtacttcgtgctgtctcctgtgggactcatgagatcgacgaataggcaattggcagctatcatcctcacatacactttgatgagtcagagatatatattgccctgaggatgctcgctgatactaatagtggtacaactcatgcatattttaagggtgata

SEQ ID NO: 104008 - DNA, 1065 bp, Oryza sativa
gcgacaccctagatccggccttcgcgcgccgctcgccgtcggccaccccgcgccccgctcgctgtccgccaccgcgagagaaccaacgacgggagagaaaggacgtaggagagcggatccagcgccgatgaggaggacgacgacgagtggcgggggaaagagggagagattgacgacgggacagagaggcgccgtgcgaagggagatagagggagagaacggtgacgagagtgagggaggattgctgcggtgggaaaaagagaagggtagtatagaaaaataccgaccgtgggctttttggttgggacacccactgtgagcttgagttccttcatccagatgcctaagattttaaagagcctacctagattattctccattgggagataagtgtccctacgagtaccctcagttaggctttgttgtagatgcccttttagggcccctttgatttgtaggaaaaatgtaggaattttggaggattttaatcctatggaaaaaaaatcctatgaatgcctttgaaacaaagaattgaatcatatccaatcctttaaaattcctatggaatgggtaatcatatgcacattttggaggaaagttagcaagaggtataacctcttggaacatttcctctaagtctatctctctcatctgatttctacgtttttcctgtggtccaatatcaaacagccattcctgtgttttgcaattctctgttttacaattgtattcctgtcagaatcctgtgcttttcctattcctttattttttcattcctactattcggaggagccctaagacaccggccagcggagcggtcttcggcaggtcaaccagtaaggtggtgattgggctcaccaccttttacgcccagtgcgtgcgtgctacacgctccggagtctgcacccatcttccccacgtgcgcgcccatcgccgggccaccggaaagccaccgccggccatcccgccgccgcgcgatccatcacccggaccagcttcacacccgcgtaaaataataaacaatcaaagccccacgttttcccactcgccccacgttgaatagac

SEQ ID NO: 104009 - DNA, 2894 bp, Oryza sativa
ttgcagggcttgaagagttggtagtcgccatggcctcaatgctcgcttgtgctgatgctcctcccattggtaggttcccggtaataagatgatcttcttcagctccctattcacatcacatgacagcagatatatgcatgatttgtgaaacttttctgaaagaaaatgtgcatgcttgatgctctcctaagaaaagatgaatttgtactacaacacattccgttctaaaaaaaaaaaaactacaacacattcatgagatatgttatacatagagatagtacgtacactttcaattccctactactaactatttatgatcagataatggagtactgactagaactgtttcagggcctacttaaacagttacagtcagaagctatatagtagtccaaagaagttcaacagaagttctagttaagtcaacaaagatgtgcatccatggtggagctagttaatacactcttcccatttatgcttgtgatctcaaggatgcatgcatagatatgtacctgatgaagagcatcttgaagcactggtgagtagttatgcttctgacaccggtgcaacgagtcaacaatcgcgacacccttttccagcgctggcgtttggtcagtcctcctgtgctcaagaaaagttaaagcgaggcagctcttatcaattccatgtagcaaaacatttattaacattgaaattgactgtattactacatcaacatctccatatatgcattcatgaaacctacaagacagtactagcagctactgtactcttatgtttaagccatcgatcactgcagtgtataactaactaatcaagagctagctagcccttcacatctcacctgcatgctttatcattgcagacatgaacgagcactctgccatatttctttgttgcttagcaaagctcaacactgtttaatctgtgatatatatagatctcacgaaacagtcatgcccttgggcagttgcgttgcatatgggaacatgcctggctcgatctgtccctacaccaccaatgcaatgcacccaacaacctggaacactgactgacttaaccgatccattttttgcatgcatggccaccgggcaccggtcaggaactcttcagaaaaacgcattgcagctaacactgttgcgaggcctccatatctgacactatatgactttatttgctcatgcatgcatgtacatgtactagtataaatcgatcgatcttcaaatgctatccatccacagttagctagtatagcttctttgcctcggctactgtgcctggacttcacttaggttgtgtttagttccacatcaaaatcgaaagtttgaaaaaattagaacgatgtgacagaaaagttggaagttcgtgtgtgtaggaaaattcgatgtgacggaaaaactagaagtttgaagaaaaaagttagaatctaaataaggccttcacttgatttctcctacttgactggaacatcgagctcttcttgtttgagagagagagagagagagagagagagagagagagagagagagagagagagagagagagagggggagggatgggtacggtgtagaggggatccagaagaacaaggtatccaagtgcatgagcaggggcattatgatcgagtgaggaggagagatcgatgcatgtggacgcggacaaggagaagcgtgcatggaaaggtgacgacacggggaagaggtcggcagggaaacatatgcgctacagaaaaaacactagttgtcgctcagtgcatgctgatgcaggagctagccgaccggcctgcatgcacaagttaattagctgcttctatgaaatttatcagaaatcggtcgaatggaagaacaggcgaaactgacaagggctaaacgtactggaactcttatgaaaaaaaaaaaggcatatatgcatgagaggagctagcagattgatcagggacgacatttttaccatcatgatcagagattaatataagtaattggccctgtctacgtgccatcatcgaccatgcattcatgacgatgtactatttcttttcttttcttccaaaatgcaatctactggccgcaatctgatcagatcatcagagttgaagactgcagaattagtagacattgatcttttcttaaaggcagctttgtctatacgcaacatgtgtggtaatataaatagatttgctaaatcacgacaaaaatggtcattacctcaagtaccagttttaaatactaatgaacaggggcgtagccagctaggtggcaccgtgatccacggaccacctaaaaatttaaaattatagtatatatgctagttaatatagtaaaaattgtatagtagaccacccttttaattgacatattacatatagatggaccacttttactttaaatcctagctacgccactgctaatgaacagtcttccaaagaaaatttttaaccttactttatgttgtaaaccacaaaaagaactagtaaaactacaacattatgaaaccaggttcaagacaaatcaaaagtatatatacacaacattttcatgcatgtaattagtcaaatatttaaataactaataacggaaaaaaattaaacaagtcgttccagtagtatacttgatccagaacaacatgtttttttattggatgaaaatattttatctttattgtaggctttgtttgggcgaccagtttaacaatagcatttaatttgttttattaacaattggaaaaggtttgactatatatgtgtcttataggttctaaatcaaccaaaccatcacataagacgaagtagattatgcgcactcctactcaatataattaaccacttgacatccttcaaagttcaaacaccatgcacaagcatgaattgaactcaatacattttgggctgcaggaat

SEQ ID NO: 104010 - DNA, 2453 bp, Oryza sativa
atagcagtggtggttctggtgtgatcaacaagagaagaggaaagaagaggacatgaagagagagagggaaaaggagatgtggagagatggcaaaaggcaggacagtggaacagtcactgagaaagagaaagggagtggtggggtagtggatttgtgcaaagtggtagtggtaaaaaggagtgaggaggaggaagaggaggaggggagaaaaaaaaaagaagaggcttggagccttggagcctgaggggtagtgatgagggcaaaaaaagatgtggtgattaggtcatgagtggtttatgatttggtccttgggaatgctgcttcgaagagagtgtatgtaaagaagggcagggtgtatatgaagggagtactattttctttaagaaggccataatgaagctacagttgctgttccaggccggtattcatgtacaagctgacaaagaaacaaatacactaatggtatatgattgatctaaatattcaaaactcgactgtaaaaagaaaaacatagttcatcttctaccataacattattcaggcatacatatattactatggtacgtatttttattcctctgttagttgtctggtacttcctccgtttcacaatgtaagactttctagcattgcacatattcatttagatgttaatgaatctagatatatgtatgtgtttatatttattaacatctatatgtatgtgggcaatgctagaatgtcttacattgtgaaacggagagagtaaaaaaacaaaaggtttgttggtgcaaaatttggtgcattcattccaacacaaattcaaaaactatacatatttttgcttgaaggtatcacagagaaaggcgacatacatgatttgaaacctttgcgggttttatgtttttagtacatattaattgctttgttttttttccaacctcgcaagttttagtacgtatcgctggtgtgctttattctacttttatcaagaacaactcaattggtacattaattagagccatgcttggatgctactattaattagtttgtttggagatataagaaggttgatttatatataccgttatctttatgaagggtacgttttgcttcagattaaacttattgaggtaatgttatatatcagttcatttcaggttttggatgaaaatccagctctattatattattggatggtagtggtagacatggtcaaattcttcttaaagacgttgttctggagtaggtgcataatattatgtattggacttagttacatgtgcgtgagttgctgcaaggcaacatgatatgttcatgtttgtcttcgtttttttaggtggtgtgcatccctagctagtcgatgcagaggccatctgtaatttcattatctaaagaaaattaaacctataccttcatcttaatggtattattgtttaaaaatcaagtccaacttattttatcctcttttcatgcaaatagctagaaatttgatgttgcccttagatgcgggttgtgttcaagggcatgtgaatctcatgtgaaattacaatgtcaaattagggatgtggagcacagttagataaagtaattaaagtacatgttgagaagtgtgtgatccaacttgttatttttcctaaataatgctcactttggttaaacaaatatttaaaatcaaataatagtgtgactgctaattgatcaaataccgaaaacattaatggtgtttcctctattttttttatgaacaattagggcgaggggggcgggggggggggaaggagatctgtcctttcgattaatagataatgaagtaaaagaggtacatataagttcactacactggacaaggtcaccagtgacgggcccaaaccctcacctttgacggctttaggcttggtcagtgatcagtggtcactggtgagttcggtcacctttgacgggtggaagaccgtcactgatgacagtcacctctgacgggttagaactctacgacccgtcagaggtaagtgtctgcgctaacccatgccattttgtaacccgtcacagatgactcacctgtgatggctcagagagtaaaaaacgtcacaggtgtgtcatttgtgatgacatgtatgtgcaaagctgtcactggtatggtcacctgtgacggcttttgcaatatgaaccgtcagtggtgagcttacatccagaaaaaaaaaataatttcccctaggatttgctagccatgcctctggaaaaacagaacatacacatgcaatatatatgtctccagtttcagcccattgcactaaaagtttcaaactaacatcacatgcattccaagttgtcaccgaaaatccatagacattcacacacatgcattgcaagttctcaaattgagccaagccgatgcttcaaagcaccagaaataaatccagaaaaaaaaagagaacatacttcgatgccaacatattgaaaaatgagaaatacag

SEQ ID NO: 104011 - DNA, 1709 bp, Oryza sativa
attaaaaaagatataatatggttccataagacactttcaattgaatgcgtatatgttttttctggcaaatactaagcacgtactttttcctcttcttttggagaaatatatgtttttctcttagggtaggtgtgcgtatgtgtatttatatgatggatgtgcatacgtttatatatgcgctcgtgaatgccttttatatcattagtaaaaaaatactttcaagaaaattggtgagatagagtgaagtggtgctgcggcaacgtggattctttgacaacctcgtcaggagtggtcgctactcatatgcacaatttgaggaaaatcgatctcatagctgcaaagaaagaaagaaagagaaaactgctcgatgcagctgttcgtatacacactcttcttattatttttcctttatgacatctctttatacgtatatagtgagggattacttgaatagatatatatatatatatataatggttgaaataatatatccacgggttatgtataaataaataactagattttacctttttatatattttttcttagataaacacgggttatgtaatatataatacttaattaatcgatgatgatatgctttgtttcgcgtgtcctagatatgctcttccaatgaggtagaccaaatgattcttaaaagataaaaggacatccacatgctgtaaaaaaatgattgttaatttttcaaaaaaaatatatgaataaagaaacatataatatatgaaaatacattcatggtgattgcatatatctgtatgtattacacaatatggagtgagtaaatttttagagtgctactcacaatttaaattgtttttatttttgaaaatataaatccaatttaactatgctattcagtgatatacaatcatataatccacaattttaatttattattattttttatggatgatttgatgagatgcgttatttagaataaaacttgaaataacatatacttttacaacttaaaacatatatggttaacatggaatttttttagtttttcatctaatctaagtatacaagaaagaaaaagtgaaaagacatataggggatatgtacgtacacggacgtacaggtccatggggacacgtacggccggataacgtgggatttttttagatagattgatttggtattttcttcaaataaagatctgatggttaaaaataatgagtccaccagattaaatgaaaaccgatggctagatgtttttcttttttattagaatttctatgatttattaaaacgccacgtggtgatctaggagcatttgtaggaatgccacgtagcggtttaggagcgtttgtagaaagtttaatgggtttttagtatataatagaagatttgtataagacagcgtactagctatacatgtacaagggagaagtgaggataacaaagataagtatggcgcaattctgattttccataattccattaacttttggaattgcgcgaagttagttccccccccccccctttttttcacgttttcatttataaagtaacagtgttcgatccttccatttcctgttaagaactcaatgtacatgccaaactacaaatatgtatgtattctattaaagcacttttactggaaaaaaaaactctaacgtaacaatcacctaggctaaatgttacttcctccgtttcacaatgaagtcattctagcatttcccaca

SEQ ID NO: 104012 - DNA, 741 bp, Oryza sativa
cagtattgcattgagataggaatggaaggtgtattgtcaacgagaatcattattgctgtggtcggtgtggtgacattggagcatcaatggagtaccttgttttgttaggtccatctagatcacgttggtacataccattttccataccggtcaaatcaaggatgaacataaactaacaagcaaagattcttctaaccggtcattttcgatgcttgaacccaatcatgagtttcaggtaggtcatttatctataactaattaaccggtcacatctactgccatgtggtgatgctacacagacatgtgccactctcagttcctaatgtaagctttccatgagaggcacatggaagctttgcaattgtttttttctccttcattattgagtggtaccaagatttcagatttcttgctccccgaaacgtggtatgatctctcttcagatctcaatatccactgaaaagaaatatgcaaatctgggcatttgatgaaaacatgatcaccgaaaatcatttaggactgaatgatcttccctatttttagatacttccccccttctctgaaatacaaggagaagtcactgaccaactgaaatgtctactgaatctgaattcttcacaagtcactcactgcttcactgcattcagtttactcttccctgtcagcttctgaagacctgcaagccagcaaagactggattttttgagtgaaagactgaaatctcactcgtcaggtcaaggg

SEQ ID NO: 104013 - DNA, 1909 bp, Oryza sativa
ataagagtacatataagaacccaatagcagattaattaaaatttctaataataaataaataaataatctgcaattaggcaaattaaaaagagagttaaagtaggaatacaattttgaaacaactgcgattgaaaataaaaaataaaaatatcaaaagaacataataataaataaaataaattctgaaattagaaaaagaaaaaaattcaactaggagtacaatttataaataactaaaattggtgataaaaaaagactattgaaagaaaagaccatctaaaacacatacgagattaattaagtaaagtcctataggagcaaagtggtggcggttgatgaacttctagaaagtaaaaaaataaaccccaatgataatcatatttgattttaaaaatctcaattacaataaaaatgagaggcagcgagcgggtcatataggagtacaatggtagagccgccgatgattggtgggtcttctagaaagtaaaaaatgaattctaacgatagatagttatgttcgacttttacagtcccaatgacaataaagattatgcgatggacaggtcgtagagaagtatagtggcaacatttgacgggatttctaaaaattataaaaaacatgaaacccaacgagacaataaaactctaaaaacaataaggttcaatttttaaaggttcgggcttctaaaagtaaaaaaaaaataaaccccaataataatcatgtttgattttaaaatctcaatgacaataaagaagggcggcaacaggcgagccatagaggagtatagtgacaaagtcgccgactttttggcagaacttcaagaaagtaaaaaaaatgaaacttctagaaagtaaaaaaatgaacctaaacgataattatgttcgatttttaaaatagaaatgataataaaaagaagatgcagtggacggttgtagaggagtataatggcagtatttgacgggacttctaaaaattataaaaaagaaacccaacaggacaataaactctataagtttttagatccaatttttaaaggttccaaggagaatgaacaaagctaataaaaaataatatgacagaagtaaggggtagcaactgatgtatcttttaaaaactataaaattagaaataagaggatgataagatttggtttttcaaaatcttaagacaacgagataactatttaataaatttgaagtaaaatcataataaaaaatatataattttatattggtgctagccgcgcaattgcgcggaagccaccacgttcgctgtggaagctagaaattcccacattaatcgaagaaaaagaaaacaagagtccaagtagaaatacaaactaaaaaataactgaaattcggaattaaaaataatcaatactgaaataggagtccatataagaacccaatacgagattaattaaaacctttggcaattctagattttaactgtttatagtatagaaaagataagtgtatagatctgtactgtgtacgttacatactaggagtctttgtccttttctatttctttggcggtgtacacagtagacgtataatctaattcaattacaaacctatatggacaagagttgtgctgccaaataaacaaagcttgcactgctgcacctatatattctgtagatttcaagcagcaacgattgggctagagcggcagaatccaatgatagtgggagccgaccctagtaaaaagacatgatatttacatagatattacaacaaacagatcaatacttgcagccggcaatgcatcaaacaccaaaagtttctttgatgtttatgaaagtacaaatgatatcgacatattgtaattagtgtatatttttcacaggagatgaattagtgcaagccgctataaactgacagtcagattaaacgtttagattat

SEQ ID NO: 104014 - DNA, 722 bp, Oryza sativa
agctacaaaattcaaaaagtaatttagaagttagaaactgggtttttcaaaaaaattcatattctcaaaaactaaatcagttgcttctcaaaatttagggagcttaaaattataagaagcaattgattgatagtcggtctctaaagaatatgaaaaagctaggtttcctagtttctggcttctagttcattttctagtttctacaactatagctcaattttctagcttattttctagtttattttttagattttactatatctttttagaatctgaacgaaaagctagagatgattatctaaagagcttctaatcctaaaagaactgcatttgtcagagattcccccaaacaagccttaaaagcatgagcaatgggtatacttggctcgtacccctgctcatggccattacttttcatgtccatctcgtgcccctgtgggggacgcaccccttggtgacttttggtagagggacaagccaggagctacattgggcacgccgtagctagggctggagcttgtggacaccgcttcccacacatgtatttccctttctacccttggccagacctggaggcggcgaggtggtggaggagccagaggcgacgtccgcgaggtggatagcgatgagaggcgagagagaggaagagatcggaagagtcgttgtcctccccggcctcctttgccgacgccgtgcccgccatagtctcctcgggctgcagg

SEQ ID NO: 104015 - DNA, 659 bp, Oryza sativa
gtattatattgacatctcagtttgtattgtagtgaaaatagtttttaattaggcaatggtcgtagcagcagagtataatgttgacctgcttagtctgactgtacttttataaaatactcgaatagttaaagagattatgtttatttctgctttgcattatgtgttgtcaatggtgtctatttgcaatgtattgcctagcggctctaacgtggtaaataattgcaagttggtcaataagtatctaacagaatgactaagctcatcaatgtgaagtatggagtcccgacttaagcatgaaatgcggtaggttgtgactggaggaatgtcaagctcattctcttgagtcgacttgagtgtgcattgttcagttttagagatgaggagttgatggagggtttcactgaaacaacatcaatcaactagatgggttcttcatggtactactgcacagtagtactggtaaatttctactactagtatttatagctttcctagatcaagattttgaccaatacttgttttaagtatctgggtttccaaggcttgagataaatttcagcttgactataacctagtgtctagctgatgctgctgatgccctgatttactaatttagggaggagggaattccataaaagaggataaactgcacctgcaat

SEQ ID NO: 104016 - DNA, 1938 bp, Oryza sativa
accccatccgcgtcgcagaggaaccacccctcgccagcctcctccagcgccatcgccgccgtggccggctgcgagtactccctcagctcgccgccaggcatcaccaccctcgccgtcgccgccccctccgccaccgcgtcgcacgacacgcagatgcccattgccgcagtatgaaattctctttcctcgatcggttttgctttgcttctgacgctggggtggatcgctgtgccgcgcctgttcgatcgatctttttgctgccgtggtctgtgccggagacggcgacgagggtgaggagggtatatatagcgggggcgggaggtagatgacgagggtgaagtgtcgtgtaggcgggagtgggggcagcacaggctggaggttcgttgcgggttgcgatttggcggggttttctgggtaaacgtggtcagaggatatattatctgaagtttctgtatcctgattaagcagagggtgttgttgttgcgattatatttggccagctagattagctttgccggtcaattgcacgtacatgtacgttgggctcggattggctggataggatggctctgtatacagggatgtggatttttcatccctcgaggcgacgtctcctcgatatttatatatcatctaaatagttatcaaatttttttaaaaaaattaataacatagattaatacgaaatatatcactccacaaacatataaaaccaaattcatcttctactagttgcaacaaaaataacaaattaaactgaaaatagctatcgcatattcgcaactgtatttattattttttttacaacttataggagttgaatttaaacttaaacttgtatgtttgggagtgatatattttatattagtctatactgcacgacactatcaaacgaggacaagagcgcagggtggttcgctgccgtcagattcagatctgatggttgcagatcacgtggattatactctctccatgctccattctgcccccgttattttcaacttgcacttatcggattatttttatcagttttatttttaaaatctattatattattaaaggaataaaaaaaggagcctccacgttcgctctcatggtctagaaattctcacattaatcggagaaaaataaaaagcagagtccatatagaaatacaatttagaaatagctgaaattcggaattaaaaaataaggaatattagaagaggagactatagtccatacagaaatacaatttagaaatagttgaaattcggaattaaaaaaaggaatattagaggaggagactagagtccgtatagaaatacaattaggaaataactgaaattcagaattaaaaataaggaatattagattaggagactagagtccatatagaaatacaattaggaaataactgaaattcagaattaaaaataaggaatattagaagtagagtatagaatccatatagaaatacaattaagaaataaatagaaattcggaattaaaaaagaaggaatattagaagtagagtatagagtccatataggaatttaaaactaactaaaattcggaataaacataataaaatgaaaagtagtgtttagagtccgtataaagatacaatttacaaataactaaaataaaaaattaagaaaaacatgagaagaagagtttaaagtcaatataggaatacaatttagaagtaactaaaatttgaaattaaaaattaaagaatattgaaagatgagtttagagtccacgtagaaatacaattagaaataataaaaattcagcattgaaaaaagaaatattaaaagacgagtctagagtccatataggaatatatataatttacaaataactaaaatttgatattaaaaataattaataactaacatgtatataaaatacaatatgattattacacattagtagtttcgtaaagttattgca

SEQ ID NO: 104017 - DNA, 761 bp, Oryza sativa
ggttgaagaataaacactaaacacatatacctattgcatttatcactctttctcaaataacctttagcacaaaataaccaagagaattttttttcatttttttcttttcttgagcctttttgctcatatttttctcttttattccgggtacgtccctgtcgtcaagactgtttccagggattcggcacccattattttgctcacatcgaacacgtccttgtcgtcaagactgtttccaaggattcgttattcatttttttcatattttattctctttctcacaatgagcaattaaagctatttgaggaataacaatttaataaagcatatatatagagcatttatagatcaaaccatatgctagcatcaacattgcatattttcttaattcaagtatagaatttaagtgtcatgcatcatctcacataaaaacaaaatctaaatctcatgaaaagactagaatacatacaagctatgttagagacaaataaaccttcaaagtattgctagcatgcacaagaaaataccatatgtataaacaaagctctcttttctcaaatttttctcattgtcatattattgcttgataaaaccatgaggtacaaactccccctcaaaccatgccaaaaggatgaattattcccaattcaccacgaagaaaagcaaagcgattagaatccaaaggtttagtgaaaatatcagcaatttgcaacttggtgtccaaaaaccgaaattcaacatctcccttctcaacatgatct

SEQ ID NO: 104018 - DNA, 738 bp, Oryza sativa
tatattaaaactcaaataatattacatgcatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgttaagactaaaatagtcatgtatgctaagtgtttcgtgcgtatatgctaagtctaattaagactacaatagtcaattgataggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttttgcaagatacaaaaagatgtatttggataaatgcgaagtaacaaatatatatatatatgtatatatatatatatatatatatatatatatatatatatatatatatatatatatatatactatatatatatatatatatatatatatagatattgcatttcacgttaacgttcgtcctcgttcgttcgggc

SEQ ID NO: 104019 - DNA, 508 bp, Oryza sativa
tctagattcattaatattaatatgaatatgggaaatgctaaaatgacttacattgtgaaacggggggagtagctagtagtttttgtttttcttttttaagaaaaagaagtcaataagcatgtgcaatgcatgaattgtggcagatgatgataaaattatgcagtttcattctctcatttcctagctatgcaaattaatgagattcccatatatttatgtgatatttattgtactctttccgtgcatatatatgcatctaaccagcaaaactatttgactcgtgggccattattattgttagcattttctgagaaatgcactgcataagtcattatatttcttctgtctagtacataagttattactaatatatttcttctatttagtgcatctagccggcaaaattaattgactcattactcatttcttctgtctagtgcatcattagttaattaagacacaattgattggaccattaccattatatagaactccagagagtgcataa

SEQ ID NO: 104020 - DNA, 542 bp, Oryza sativa
cccgcacaaataatatttttttaaaaaaactttctttatcatcgcttcttattattaagatacttttaaattaaatcaatttattaacttcataatatttaatttgttcgtcttacccttgaataattgatatgtaaactcaatttcagctatcgtccatcagcactttagaacacatctagttttgttagctccgtttcgtatgctaccgagtttatggcttgctctacgacctagacctacctgtcagccggttgccctcatatttttaaccatttgatcatcaaaaattgccaacttaaggtagaactatatagagtaaagtccatcaccggtctctaaacttgtaccgctgtgtcatcctggtccctaaactcgcaaatcgaccgttcatatccttaaacttgttcgactgtgtcattccgatccctaaacttatagatcactcgtttaggtcctccaacttgttcagttgtgccacctcagtccctaaatttggatttgaatatcattgggtcaaataggacggtctaaagacttta

SEQ ID NO: 104021 - DNA, 745 bp, Oryza sativa
cattggccttggtcagtactattgtctcaacagaaattcagttcagagtttcagatcaaaatgtgttttacttttacatgcttcatactaatttggcactaactaaatagtatgtttgtttgattccagcaccaagggcagtggagaaatgcaagagctgaagctgatcaaggagaattaattagcgccgcatccagatttattaattttcacggatattatattatattatattatattatattatattatattgcatgcatgctttgctcctccctgtattatactagtatcaagtaattagtttactgtaattcagtgtcagttaagcctgtgtcatctcagtttttctaagggattttgatgtatttacatgtgggttagctccatcttgttatgctcatggagtatatatatacgtaacaacaatgtcatccttacgtcacccttttcctctctgttttttttttctgttccttttttttttttgcgggaaatgcggttggtgattacctgttcttctgcagggatcctgcagcttgtctaacactagtacagcagtgctcattatcgtggccatccaacagattataattaattgcctagctgcattgtttaattaattatgtcgaggtgctaattaaaaaacctgtttctggattcaatgatgagaatgagaggcatccttttgtgatgtagtgtacacaagaaacattagtatcttcacaatgttttatggggtgca

SEQ ID NO: 104022 - DNA, 726 bp, Oryza sativa
tcctgcgcccctactgggcttatcgggccaaattatatgggctatatctacaacattgctactttacaaggccgcatggttttctcacaggtgaaaatcccccccccctgtccaatggacctacggggcaagaatctcagtcgcccttggcccgtatgggtagggcctcgccccgttagggaaatttccacccctactacccagttactcataggcgcaaaaaaggtatttgcacataggctaacggaacgcaatgcatgtagattgtgatatcatttttttttttacaaattggcttatacaatcatattttctacgactgattgtcaatagaaaaccatcgaataactcgttttcacttgcaaaacttagattttctcttattagaaatgcaaagactttaagtccacgcctatttcgtgccaccttttaacaaatattttcactttaaaacaggtaaatatacctttatagtaccctggaccactcttaactattcttattcatctgcatcaatttgtcatatatatcaaagtaatagtgtaaatatagttgtgaaggttcattgattattcaaaattgttcatatatatgcttaagaagagagttgatactcggttcaaagtgaaagcgttggttatagtgtggtccaaagtgaaacatcattagtaataaaaggtagactaaagtaaaatttactaaaaaatataccattggtgatatttt

SEQ ID NO: 104023 - DNA, 4671 bp, Oryza sativa
tgaaagtttcaaatttgagatgaaaagttaaaatatttcaaagtttgacttacaaatttaaatttcaagttgaaagttttcaaaatttgatttcaacgttaaatcttgagtctaaagttttcaaattttatgttgaatgtttaaatttcgagttgaatatttttaaaatttaagtttagagtttcaacttttcggtatgtcttttagtttttcaatagaaagtcataattttttttgaaagttccaatttcacttatagaatttttttcaatatgctagagaaaaaaaaaatattaacttaattatcgtcattatctaaatctaacaaggttagttatgctaccgcgtggatctgcctctcgaaaaccgcgtgccacgtgcacatgatttctcttcccggcgcgtaagcgcggaataggatatctggcctctctgctaaaagagaggactaatgttcactgagaagacttacaagcctacgagtctgcgccatcaacgaccgtgaccatcttgtacaattaaatgttttgaaaatgttatgagagaaaattgtgggtcagtttaattaattacatagctcaaccagcatgtacagttagacctcttttggattgaaagaaatttcaaaggatttgtggaggattgaaatccttaagaaaaattttcttatactaccatagtttacgaattatatttggggagagatgcatcacattggaaggctcgagagccatcgcaagctggctccagccgtgaaacgagctgagccaggcccatgttttacctcatttacctaaccgagctgacctgagctaatcctaatgttttggccgaaaatttgaccatcttaaaaatttaaattttaaagagtaaattaaccgtgtaaatatttattgtaaaaataagttatttgcttagtgcaatcgagatcagcgccgaactaatatctcagcaccacaaatgttgatgttgagatattgtccgaggtgacgaaaaatggtggcctcctccgctgcttcacttcgtagacttgtgaattttggcctgattcatcgtgtcaagtctgcgttcttggcacattcatacacaagtccgattctcgatatcctccgattgatttatcgtctgagttgatgtcgattttcctccactttattgtcattctctgcaaaaggttagtatacctaatactagtggaatattattattctaacagatatatgcattgcaagcatcactagttctcctctattttggtaatattgacggtcgaaactaatcgataacgaccgtcaacaatcgggatgttacaatttcactagttaaaggataacatgtataatatataacttttttcactctcatactatttcacattctctttatatttttcttggatttcactttaaacttttcttagagattgtgtagatattatcttttatatgtggggtattgttcgttctctctttcccacttctttactccaccttatcaaataatcacatgtgtcacttttagaaacaatagataaactctatgagtaaggctactagtagatctaatgagaatagaaaacattaattcaaatttagcatgtcatccgagaatagatctaatgatattaatggacaccaaaaagataagaagaattatccctaaaaacaacacataattttgcatgcatatggagcacacaataattcaaatcatcaaatgagagaggaacggagtgagaaataatgaatattttctttctagacattaatcttcaaccaaacaaaaaaatagagcaaaaccaccccccccctcctctagctgatcaggcaaaaatgagagacgccgctcttttcttgctcaatcagctgggcgggtgggatagcacctatatatgtggtcgactgataggtgccggttctagacataaaactggcacctatttctgacagtacagaggtgtcggtttataagttgggccccccaacggctagttcaggaggtggagggtgaaaggtgccggttctataaataaaaccaacacatatctctttcaccacaaagatgctggttttagggtgggccccgtgccaactactttgatgagatggggaataaaaggtcccggattttatatagaaaccgacacttttatctgacaagggtaataggcacctaactatttgaagagaaatgtgctagtttttacggtttaagtaggctggtgtgggcgtgggcgggaacggcactataggtgtcggttttactagctatttccagcgtctatagtgccgacttgtattagaggttctgtgtgtacagtctgtaagttaatttctttttagatgacgaacatgtaaagaaccagctaattgaaaattaaaagtaccaatcaaagcttgactccagaaactggccgaaggtcaacaggcaaactcgaaggaggtcgacatgcacctcaacatcgacgacatggccgcagcttaacgctcgtgtcccctcgtagcaacaatcctggaaaatcgagatgggaccttatcataggcctggccctgagcggggcgaccgctctggcccccgattcctaggtgtgtgactacttagcgatcttctgccgctagacacgtgagggggcattcctaattaagctccatgattttgcaatcgtgcgagtatcgatctcatctgacgactgccgtgctggttggtgacgccatgcgcgcagcacatcagccgcatgcccgcatgcttacttatatcgacgatcgacgtgctggatgagcacgtttggtgtcgccggtgccgcatcaattgctggccgctgtgctgggctgaatgcttgaatcgatctcgccactgatataaacaccaatcatggcactgctgcctgctgggatcccggcaaaaaggattgtacgtcaatatattagaagatgagagtaaaatttgattacacaacgcacatggtaataaggctgttgccaggggtcaaggaaacactactggagaagttatcttttgagggtcgggcgatttctacaataatcccggttccaaaaagaatcggggctaaatttagtcccgattaaaaaaattctgatctttagtctcagtcgatgtttccaaccgggactaaagatcatttttagtcccggttcatcccatgtcagaggcatgtcaagggactgaggatctttactcccggttggtagtaccaaccgggactaatgtaggtatttagatttatgtttagtctcagttggtaacttcaaccgtatttactcccatatctgatcggttaagtcccagacaaagtatttagataagatcggatcatctcctctcctcctctcagatccgatcccctcttcctccactcccctctcctccttacccttcctcctcctcctctcccctctcctccccctcctctcctcccatccggcggccagcggccggcgcggccgtgcgctggcaggcggccagtggcaggcggcggcggccggcggggccatggcgagcggtggccagcacgcatgctaggcggccaagcggcgtcccttttttttccttttttgataatttgtgatgtatagtttctttttttatatataatttgtgattaattgcatggatctgagatgtataatctgtggtgtatttgatttgtgtgtaatttttttaaggatttatgatgtatttaatttgtttgtataagtaacttaggctttgtggtgtgaataatttgggatttgggatttgggatttgtgatgtgaatgatttgggatgttaatttgatttggggatttagggtttgatttgggatatgcaacccacttgattttggaggaaatacagggattaaccctagcaaatagtaaagaaacaatggaaaaaagggaccaaccaggatgtggctttgccacaccaaccgggactaaagatgaatctttactcccaggtatttgaacaaggactaaagactggcttctttagtcctggattctttctcctggttcgttacccggaagtaaaggaggttgcgaactgggatagaagaggggtcctctagtagtgaaaaaagaaaaaaaaaacaaatacaaagaagataagctactaaaaaagaaaaatctcctatcccaatgcatggtggggttggggatcccactacactccagcctgcgtcggaggcagggagctggggaagagtgaagatagggctatggcgtgatccagagggaggggctgggagaagagggcgttgtaagccgtaacagcctcggccaacacatgacccttctcaggcaccaacccaagcttgcgcatcaaattgtgctgcgcacataaggtcatgtcactcgggccggcgagcgcaagcttggccgcaatcctcttgctacgcttcgacgctagtctatggtggcaacggcaggcgtaggaggcgagggtagcaggagcagtactggaggcagagtcctggagtagctggcgaggaaggcgtgtatatacgtagcgcggtgttctcggcgacctaaagcggaagctgcgccattggctggccatcaagatcgagggtgaccatcggaacgtcgattaattagaaccccatcccttgcgaccgagggaacagccggcggcagggacaaggtcgacggtggcggtggtaagtacgc

SEQ ID NO: 104024 - DNA, 1008 bp, Oryza sativa
catatttccataaactgtcagtgaatccttccttttggttgacgtttttgtcatccgacaacatttcagttagggaaaagttgtacgtttagcagtgagaggtagggtgggtgctccttggctaaaaacccatgaaattaatgcttccattgacaccgagatagatagtttgataggtcctacaccgagatatatagtttgataggtccggttttcaggcagcattttttgtaatgttaggcgtgttttgcatatagaccagaattgaaatgaagtgacattagtcgatgtgtgtgtgttttgtatagggatatatggttttccccgctccctctgataatgtttaataagataattgatgtttagacttgggaatgctagttatgtcaaataaacataactgtgggggagagaatttacatttattttcttccttaatttggttataattgagattaatttggttataattgagatgagaatagataggaagaatggtcagcataatttagatggttatagctaagaatggtcggtcagtcaattagatggtgaatactacttgctatatagtggaatcaagattccaatgggatcgaacatactcctatgtctaagttgaaacacataatgctaatgtcaatagctgctgttcggtggtggatagtagcaattaagcaagcagaggcgaatagttactccactgtacttcaatgaataaatattaatctatagcaacaagtaaaagtaagacaaactaaggattaagtaacaaacgacaaataacacaaacttgactattaggttatttcttaccactccagttttacgcggtcaactagttgaatctcatgttgggcttagtgcttctaccggaagataaggtcgtcgacattaggtccagctctggctctggctatgtctgcacgtgcaaaccccactcccataagtgagtgcttggtgaggagcttccgcaggtggtgattgagtttatttagtgacagtata

SEQ ID NO: 104025 - DNA, 3542 bp, Oryza sativa
cctccctagagtgcataaaatgacaatttccaatttcctcagagttaatactctccctttgaactctacccgaatatctctagagtacatgaaatattgatacgtttcctttggatctccacctaaatatccccagagtccataaaatatccttttcaatccctctttgagtcaacatacccatcctttagagtttatcaatctaccaccaattccgttcctgtagaaattcccatccacatatacttccgaatccagttctattctccaacaaatatttcccctctgaaatctcgtttatctaaattatccactcaaaattccaaagtctactactttagcttgggccaatatttccccgattgacccgactctctgttatatcccattaaccatttttatattccaggctaactcagtataatttccttttcgttggaatttattttggatcaacacctatctaaatctatctcaaaaacctttattttcctctccatcaatccaaaatattctggggtcaaattcctagtttgatcgagccgccaatgtgattcccatggcacatgaataatattaatacaaatagtagagtgattgcacttgtgctaagaaacctattttcaatcccttccatacaaaatccaacttcctttagctcacaaatatttcaccgagaatccatatcacatatattgggctaaaatgcaatttatttgcctccatctatagagccaccatcccaaagatttatccaaagttagaattaaatcatttgtattttcttttcttcccatttgactattttaatttttaaatattagagaaagtcttacatttgattcttattgaattttataaaattggagcatttttttatccttattgaattcttttaaaatctgagcatctttattcccattcttttcaaatttatattctaaaaaataaatatatttgattttaaaagtatttcaaactcctaaaaaccattatttttaaattatttttaaaattcaaagaccctcaaacatttctttttagattttatttcccttttaaaatctatttaaatccctcgttagtttctatttcctagatatctttcttgtcaagttcaaaaagcctcaagcaagttctcttcattttattttcccttcaaaatcatatcccattgtccaaagttcaaaagtccacacgcatccattcatcctttagatttcatctcctttgaattccattcaaaaccctctacacaaaaattcctaagagtccctattcaatcgggctgaaacttctttctttcagcccatctagctcacggcccagccggcccaggaggactgagctgccgcctctctttccgtgggcccaccgccgtcgaacaccttgtggacgccgacgccgctcgccccttcccgatgcgccgccgctctaccgcaccacctgtgccgccccaggcactccctactgccacactaccaccgcgcctcggccacaaaaccggggccatccggtggcgcccacacattcgccgacgccgctgcaaagccgccgccgcctactgcaatgccgccgccgcccgccacatttgccgctgccgcccaccatcttcatcgctgccgtgacgctagtcgtagtcgcccaccaatccgccgccgtccaaccaacccggtgaggctgcccgacgccacctctccacccccaaatcgacgcggagccgtgccgtcatcgagttctcctccctccgccgccttcgccgcctatatatggccggcgagcctacaccaatttccccacccaaacccgagctccaagctctctatctctcttcccaacatcctccccaccggctgccgattccctttgccccttcaccgtcggccgccgcctttgcttccattcccggcgccacctccggctaccgcctccgtcgggcgcccttcatcggagccgcgtgctccctctctgctcgaccctttctcccttccctctctgtgttgtgcatgaaggaaggaaggagaagaagggaaaagggagacactgacagtgggccccaccttttataaagtaatttcattttcttttattcaattccaatctttgagcatcgatatctctccaaccgttgatccaattccagaaaacttttgatctaatttcatctcatttcaaactctcttttgataccaaattttctatttttaaaattttatttaaatttctttatttaaatccccttttagtcatttatttaattactttctaatttcaattttttttcaaaaccattttattttattcaaatacctttttaaattctaaatttatttaatttatcttaaatacctttaaatttaaatttctttgatttatttcaaaacccttttaattcaaattcttttacaatcctttagccacaaaaagccgccatgggaaatttcatgccttccatggggacgctcatatggtccgaggacctcgacgtcgaaccgagggtcatgaaaccggcataacctaaacccaaggtcgaagtgttgcttttcgcacctcacgcctcgacgcgtacagtagtcgaagcctcactactccatcaacctccatagcacaccgcacattagctttcgggatctgtgcaatccaagccgtttgctgccactcgcggctgtagggtacattttccgccccacaaacctgcataaaccttcccaactctctagtcattgtaccgcttgattgtagtatcgactagacgagccaatatttagccgctctgctgcccatccttagcatcagctaaccaactccaaatatctagccgtcgtgctgccttactctagcaccgactagaaaaccaaatccaccaaatcaaccacacctatccattttatcctttccttcaattccaacctttagaaaccaaaacccctcttttattttccaaatcaaaatttattttaaaccattatttttccccttgccttgctccaattttatttattccttggttttatcgtttctttgtagcaatttgcttataggctttatttgctatctttttcgtactcgtacgttagaccgtagagcaagctctatcgacatccaaggagctgacgtggacccagatggctacgcttaagccgcgggaaatctcgaggcgcaaggcaagacataactaaaattttgatcatatagaaaacttaaaataatcttcatatttaatttgatgcataatatcttttttctttacatctcatgggtaaatgttatacttcagaataacattgtgataattattaatgcttttgagcattgttacatgtggttatagagaaatgcattggtcatcattttatgtgatttattattcaaatatctttacaaactgagaaatccgattaaaatgggcatttgagttgtgattatgaatgttgatgaatgatgaagttggtgtggggagtttggaaagttttgggtggtttaaccggatcataattatccccttataccatggaaatgacatagttgcgcccatccacaca

SEQ ID NO: 104026 - DNA, 643 bp, Oryza sativa
tcataaatcactcacatcgagcgatctcacatccataaccatataatctaagtatggagtgtacaaacgtctacaatagcaatgttaagcaatgtcaataattgaatgcgcataaagagatagacttaagcaacaatggatatacaaaagtgtataacgataacaatatcaagggtaggcaatattcaagtgtaggtacgcaatttataaatagcatgcaattttatttgcaaacaacacatttataaatataggctcgatatgttcaaggaagagagcgtagtgacttgccttgctataggttcctaataatgtcttcgagaaatccgcatcagttaaataattagaatacccacatgcgataaatatccagaatatcgcggtcaataatagaaaaccatataaaatcctccaaataaagtacgaatcatcatgaactaattgtgccatttgatagatcctgattttagaggaattctggaagttgaatggagtcaatcggggctacggttcgaaagatatcaatttctgaagtttgggagaatttataaaccgatgaggagggtgtctcgggaaggacgtgattttggacttccatagagggctctgggttgtagagggacacaatacagactttaggtag

SEQ ID NO: 104027 - DNA, 793 bp, Oryza sativa
tcttttccctccttttattcccaaccccaacccccccccccctcctctttttttttttttttttttgctgtgtgtgtaaattttattcctcttaatacaaaggtgctcaatccttttgcgtattcccgaaaaaaaaaaaattcttcctgggcattgatcttataagattctagttcatgtctaatgtctttgtgcaagttctcctgttgctatggaattctctccagacatgcaaatcttttctccttgttggcatcaggtgcttcaggacacactgcacagcggacttaggggtgagggagggcgccggctagccacagaaatcatgtgaatcagggctgacagtgggaatatcctgcaggcaggctgcagcttgcagcagcagaattgcttaggagagcgatacagtttagtcggtacacacaggggtagattggtgtaagatagctttctgaattctgaagccctctacttgatggaaatagtcattatctaaatgttggaaactttgaatggttctaaagtgtatttgagaagttggatgatatatttctgaaactagtatctttggatatcactaaaccatcttttcctctaacaataaacaactaaacatattaggctgggcagggaacagatcacttaacacccatgtcactatctgttatgagcatagttttgtgaacaagcattagctgcttagtttttaaactgaaatgaatgtagaatcaatggtttatcaaatatttttccttgttttatctattgttctctctttatttcaaaatgacca

SEQ ID NO: 104028 - DNA, 1071 bp, Oryza sativa
agtgtgccgatcttgatggtgagtattgcactctcgaggagcagctccgctgcctattgtttgctcaacctcctcaccggagtgtcatggatgatagcggtgctagtgccggtgggctctttggcatgccgaggggaggagtggagaggggtgcggaggagcttggaggggaggaggtccatgacccgtccggtggtcccgatggctcggcggcaagaattacagcttcaacgacatcctaagttggaggcgaactcgaacacaagtagagacgaagggaagaaagaagagaggggcaataaggtcattttcacctcaagttgttgagttgatggttaaagtagtaaaatagaacgaaaccagttggttcgagtggcaaataatcaaagtccatcaggaggatggtatttgagaatgtgacatctgggaggatggcataaagtccaaaaccttggcgtaaacaatacgatggaagaaaatatattcgatgtttgggacaacgattggtcatgcttttgaaattttgagatttagcaatcgatagttaaaattttgaaatctggttcaaaacattaaacatacatgacttatgctgtcgaaagacaaatacttctgctgaagcacatgcttcacttgaggagtagagcgggaaacagtagttgtatattgatttctcaaaaatcatatccctattatacaccttttggggtttatttataggtttgtagtcctgggtgacaaccctagggtttggtctacgtgggcaattatagtagtgccccctgatggggatgtttacaagggtttaagcctgtgtgggcaatttggttcctctttgcggtgagtccagagaggataacaattgctgacaaccaaatttttcattggaccaaatttttaggctatgtttggagatagataagagctttcacgcaaatgatctgagcataacagtttgggcaactggatttgataatgaactgccgtccgaccgcaatttctatacagtcaaactagagagtgaactacaacccagccacatgtatgtaagtgttctgatcggcaggttcc

SEQ ID NO: 104029 - DNA, 990 bp, Oryza sativa
tttagatgtgtattacgtttacaaaaacgattttgctatccatctcagtgtgatttttttgctggcataagttctctgtcagaaaactagctttaaaaatggacaacactaaaattggtaaaaaaaaaatcgtaactcctttatatgaaatcctttgtacgaaaattgtagtgctcgacgattgctacaactttcaacatattaatatatcatctcacatagagactacatgatataagtgaataatcttattaaaagaggtattcagggaaatatatatgtaaccatccatattaatagagaacatcaatcgtaaagatcatatagaactttggttcacctcgattggatctataatgatttttctataaatttttaaaatttattcattttttaaagaagatggaaaaatgatttttgcaggtgatgaacttcttcatgaaccagccttaaaaatgatattttacgtgctaattaacttcttaaagagctgaccttaaaatatttttttacggacggttctcataagaccatggattttaatatcgtgggtggtttaagaaagtcggccttgaaattaaatgcagttgtaaggctattcccaacccaacatactagacatagttttcataaactccacatcattaagaaactagtactagacactactcttccaatgcaaactggaaatgctgttcggcgatcgatcgccctggggatggggcaacgatcgatcccctcccccctccctccctccacccctccacctggttttcttttgtaacaccgcattactttcctattttagtaaatttatatacctaaagtttatacacctcaagtttacacatctgaagtttagagaccaaaagtttataagtcaaaagtttataaatccgattcaaatttgaatttgaattcaaatatttttttatatatagtatttctatacatctaaagtttatatatcaaaagtttatacacctaaag

SEQ ID NO: 104030 - DNA, 1446 bp, Oryza sativa
aggtagctacacagggagaggcaggtttggaccttgcattcctacgcagccatgccccaaaccaataccatagatgccatcatcatcaccaccagtggtgagtatagtgcgggtgacactgatcacgataagcacacgtactatacgtatatacggttatatataaatacataggcacatctgcgaataaatgtactcgatcgctctccctctcctggataatactccctctatcccagaatatagcaacctaagccatcctaggttgctatattctaggacggagggagtatatccctccgttaagttgtccttccatcattgttaatggcaatattatataatattacattgtaatatgttttgactttatatgctacgcgttcgagaatctaacatgaatattactagtaaaaatgtctgtgtgttgcaacatgtgaaaaataattttcacgatcgataaaaaactatgccaatttaaacgacaaatcgaaataagacaaacaaaaaaatagcaaagcaaagtcataaatcatatgcagcattgaacccggttgcgcccacttcatgtgtcatcacacgaataatcccttatacacaccattatatagcctcaaaaatcgatcgggtgaccattccataagttgacgcatgtgcattttactatacctcataaaccaaagattgaaattttgattattcaattagttactgtatatggaaagcatttgcaaagtaacaaatttgccctatgcacaccttttaacaatgatagattccaaaggaaaatatttatgagtgaaatttggaagagagaaaggagggaaaaagagaaaagagaggaaattgcaaggagagggcgagtataaggattatcaggagaaaagaaaaggagaaaaaaacaaagaaaaggaagacaaaaaaaaaagaagccaatcgggggagaggcacacacggcgccgagtagaggcagcgacatgggtgatgggatggtgtggaacggttgagttgggttgtgatagtgatgtataatatttattctaaactcatgttgaattggatacggaggacatataaccaactcaaccacggatgacgtaccaaaatttcggtgaaaacatcttcaatttttataataatagagaagtgtcggtatgcaaaacgagaaaatcattagtgtaggattaattgaggtttaattatttcaaacttgtaaaatagatttatttgatatttttaaagaagcttctatatagaaagttttcacacggaacgcaccatttagcagtttcaaaagcatgctaacggcaaccagggtagaatttgtatcttaatcagaacagaacagggcaaactttaaaaagtttaacctagtttatagaaaaatgtagcaacatctattaattttattaaatccaccatcaaatgtatttttgtagtatattt

SEQ ID NO: 104031 - DNA, 565 bp, Oryza sativa
ttgataaagtcatcagtatatagtagaaagagataatgacagtggtaaatcgttgaactgggataaactcagtagcatagaatagattatctcaactttatatacacatataaaaagtttatacgtatgtatgtaaagtatatacgtacgtacatataatataaatttttcatatgtatatacttttgatgtataaaaaatatatacacgtataccaagtttgtatctaatttaaacattcaaatctttcaactcgaaaattttaaaaaaataattatgtatagattttaaaactttagattctaagttttaactttcaaattcaagttgaaaacttccaagtcacctatttatttcattcctggttaaggacgtaggattggaacgtcgatgcgacactaaacatgtcataggtgcgtctccttttgctacctactaccgtctaaatccatgtacaaaagctgcttcagcaactatgatcagtagagctaattaattaccatggcgccgtcttcgttgctgctctgctggagcatcctctgcctcgccgtggccggcggcggcg

SEQ ID NO: 104032 - DNA, 849 bp, Oryza sativa
gttttagaaaagcccacaacacaaacgttacatgaaaaacgcatgggttgataaaattatcaaattcatcataaatcatgtacaggatcttctcccgtttatttataccaaaaagcagagaatacaacagaaaaaaaaatcattaactatttagctgggaaggagcaggaccggccaggcaggaagaagcccaagagcctaggcgatgggcagatggcccagctggtaaaaaaaaaaaaattcaggactcacgagcgcttcctcggtcagatgcagaacagcgcctgtacatctccgtctccgagcgacgtgcggcaaccaagccgacgcgacgatggataaaaaatgggacaacgtacgaaaatttgagggcaaaaacaccttgcataaattaagttgcaacaaaataaataatatttatataattttttaataagacaaatgatcagacaaaaatcaaccaacggtatcatctatttaaaaatgagagtactatgatatgacgaggttttctgcttcgaacatcagatgctagatgacagtgaaaacccctacagatgttaattttagttctaaaatttttcttcaaacttttaacatttccatcacatcaaaacttttctacacgcataaacttcttaacttttttgtcacatcgttttaattttaataaaacttctaattttagcatgaactctacacaccctatgtctacccgtgttgctagtcgtcctggttttcttgtacgtcaaagaagtgctgctagtcattaatgattgaccccctatgttgcagttactgtttggaaagtcgtacctcatcatgctcaaatgttctgcagtgtacaaa

SEQ ID NO: 104033 - DNA, 548 bp, Oryza sativa
aaaactatatgtgtatatgaaagtatacttaacaatgaaataaatgatatgaaaagaataaatacttatttaaattttttgaataagacgaatagttaaacacgtacttaaaaaaatcaacgatgtcaaacattttgaaacggggggagtataatataaaaagtgtggtgtgtatctgtccgattaattacctgaaggacacacagtagctagcaactttggtcgagctagcccatgcatatatcagtcccattccgtcgaccgtccttattgtagctaacaaatatccggtacacctaattgatatgacaacacccagtcacctacttccacgttaattgtccaattctatcacgtagctagcacaagtacgccttgcgctgtactaacactactacaataccctccagtcgctctctccctccccgttctctctctctctctccccctcatcatattttgtttgcacatatatataataacgacatgattctatatattcttctctgcccattgttattcatcacagaaatcacaattattaacac

SEQ ID NO: 104034 - DNA, 747 bp, Oryza sativa
aagaatgaaattatccagatgtaaacagacatttaataagtgatgcttatctttgttaaacaactcaaattatgtgcaagtcagacaagcaagtgacctgtaaacacaaggccatctagtcatgcacactgaagtcccactgggaatttcacacttcacacgtatttgtaaggtcattgtgtcagtgcactgctgcttataggctagtttgtacataactatcttgaattccactgtctaaaaattcctataatactatttgatacacaggccttagttgacattgtaacaacggaagtcgtacctagttatttaacgttgtttgtgttgatagccgtgatactggcacgaatgtgcaggcattgtgagctgtaattttcgatatatgcaacaatagagtactaattctttatccctaataaacggtgcctgtgtttttaatactttatgtttctaggcagtcacatagagattgctttgattcaggttctgtttggcattgcagtggactatgagttttggttcaactgcttttatacattttggtgcttgtaaactgtcttctgtttcaatctaatctcaaatgataatatatagtgctatgcaaatatgaataaaaaaaagagtcatgacagattgataaatattttgtttagctttcatttgattcataaacaaaactacaaccgttttagatttatttttctacagcaacttttagaaaagggaaaaatatgcacagtgcaa

SEQ ID NO: 104035 - DNA, 756 bp, Oryza sativa
gatcccccgacttttataattcctacaagtagctcccaagtcaagccatgcatgtaaccaaaaagataatttttttaataatagattaaataaaacccggcctctacatctatagaaggatgtacacaaatatggtattacatcaccaaacacttaggcttatactctccatcccaaaatataaggcacaaccacttttctctcatgtctcataatgtaaggcgtgcatgcatgcatacattaactagtatctcttggtcctataaaatttatttgttttaaatcttatactatcatcaaacctcccaatcactcccaatcacattgcttgcattcatcaaggtgatccaactaagaaagtgattaaatgttttcttggtctttgtgttatgggtggttatgccttatattttaggatggatcgagggagtaaacaagttcaaaagcaaacaccaccataggagacaaagagacaacaaagacatccagatcaagtctcacaacaaaaaatttcaactaacaattcaatcttcctctacaattccacctagattttgaataaaattccataacagtatcaagaaagattgataagccgtttgatttcatatatcatgttccaacccatcccagctcaatcatcccctctccaatatgctactgttgacaaccagcccagtccaactaatatgtgtgagatgcttgatttagaagcaggctgtaagaatctaggggttcaatttctcagcttctgac

SEQ ID NO: 104036 - DNA, 605 bp, Oryza sativa
gactatggttattttgaagggatcggatatggtttttggtcaactctctctgtcttttttatagtgatctccagttatttgtgacttgcgagaaattaagtcacacataatattcaatattactgattatatatctgcatgatttatcagtataagacttggatggcgacaggccactcctgtatcgagaatcattatgtactactccctctgttccatattataagtcatttgatatttttctcagtgaaactattttaagtttaatcaaatttatagaagaatatactaatatttttaatacaaaacaaattaacatattaccaaaatatatttaatgttaaatttaatgaaactaatttagtattgtaggtgttgctaactttttctataaatttggtcaaaactaaagaactttgagtaagaaaagagtaaaacaactaaaaatatgaaacaaagagagtagtaaatatcgatatatatgccaagatactctaacgtcctattattcctatataatacacatctatctattatattattaaaggaatagaaaaaggagcctctacgttggctgacattaatcaaagaaaaagaaaaagtag

SEQ ID NO: 104037 - DNA, 707 bp, Oryza sativa
ttatccattcataaatcagctttacaaggacagcaatgagatattactattgactattgagttacgacagcgtttgcccctaaagaaatgatgttttagaaagcatgtaatgaacatagttatgcacagtaatacagtatacaatgatagtactactccttttgtttcaaattaattattgttataactttgtcccaagtcaaatatttctattttagcctattaataactagcaatttgtataatttaaatacatgtggattgcatatttggaagtatttcttattgtgaatcaaaaaacatattaaaacttatgtcattaaaatatacattttttttaaaaaaaatgattgttaaagttagaaattgttgacttaggataaaactagaactacaaataatttgtaatggaaggagtagtagatttatcttcaactttgtagggatacagaagatgaaagttttagcatatatgttgtctaagtagagtagttaaaataatgaaattgcacattgatagtaaatgatgtatttcaaccgcttaacatatttatatcattagaaggtcagaatatggaaaatagcaaaaatgagtatacgcttctgattctccgtatgaattgatggttactccaaaaaaaaaaaagatactaactactccctccgtttatttgacgccgttaaattttttaaatatgtttaatcgt

SEQ ID NO: 104038 - DNA, 692 bp, Oryza sativa
cctaatgcttaccaattgctgcatcttgattgcaagctccagaaaaaaatattgtcatgattattgtgccagggggagaagtttcggttttttatgtgttttgtatgagaccagtgcaaggggatctacattgttctggattttgttttggtttcaattttgctggtcctactacgtgtgcatatatagacagaaagccttgacgggacataccaaattcaaaaactcagaaggaatcaccttgcgcttgtgcctaattgctccaaagtataaggttggcacaaatagtggcccgatttttagttcactgatttttatgctttcccaatgttgcggttaggctattactgtgtttgaggaaattccttcatatagttttatatgttccgtatattttgaaatttatgcccatagagcaccctaattttgttgacgtgatcagacaataaaaaaggcaccatgacagctatggtggataatgtcatttagtaacacagggcaatgtgttgtaaataataatgggaatggtttgtatcatttgtttcttctatgctcaagatcctggactgttatgcatgtatcatttgttgcccctcgagtcagattatttgacgtggatactttagtactttggatcaaagaattagggtatttatattgtacatagctaacaattgcatatactacctccg

SEQ ID NO: 104039 - DNA, 775 bp, Oryza sativa
ggccatggccttcgtcccactggacgagctaagagatctagtgcatctgttctgaatttttcaggacggttcatgtgtcctgtattgttctatgctatgtgttcccatttttgtttttgttgtatgctatgacattgttgctgctctgatctttttttttttctgaaataatgaagataagcttgctagtatttgctttttgggctatcgatgtggtcttaattgttgctggtcctaatccttgtggttttgtgtttcttattcatgtactgggcataattatatatatttgtctcaacttttttttttcagaaataaaatttgtacagataatttgcatgtatgaaccataagcttccattataaggaaacgttcagagctcagagtagtagctgaaactgaaacatttaatttgtcaggctaacgaaaaacgaaggtcaatctgtgtacaatgaggcagttgtggaccgactggaaagctgtgggtttgatccaatttcttctttataatacagctacagagagttctgtgccaagatttttacaggagttcatcatagatttgcctgtagataaaataccagcgacccgttggctaaatcgctaaacacaaggtcttgctttcatgctcgactggtttcttcagaataaattcctggtccatgtaaaaatttgcattaacaaccttgcaggctgaataagtactgttagccatctgcttagtttttttttcacatcttttcttatttgtggtccacagtacagataatttta

SEQ ID NO: 104040 - DNA, 612 bp, Oryza sativa
taggggatcttttcactgcattttttttttgcagctgaaacggtagggcggatacacgccctaccgctgcccattgcagtcggggtgggtgtccctggggtggcgatggaatagaatcaaatcgagctaataaacaggtcgtgttgtctcagaatgggcgatatggtacaaaactcattaccggatggattcagtcggagccaaagaacagcgcgcagagcaacctagggctaggagtagaggtgcgtggcatacctgctctccactccacgtcgagggcgccgtcgaactggccgtgctggtgaagtttcccgccgcccggccgtcgccgtcgccgtcgccgctgacggccggatccagattctccggcagcatcaccagctggctgctcgccgccggtcttggggaagcggcggcgtcgcggagagtggagagaggtcgggagcgagcgagaagccgagaaggggaggaggaggatgacccatcgacacccatcgactcaggcaaatgcaggatgctgggccatgagtccacgatgagtccatccttctgacgacgcacgtggggccatccttctgacgacgcacgtggggctcgagcggaagctttccc

SEQ ID NO: 104041 - DNA, 568 bp, Oryza sativa
tgaaaacccattcataatgcattcatggctttgtggtatatttcttgcaattattatgaataaccttaaacatgtgattcttttgtaaaatttatatacaataatataattctttttgtaaaatttatatacaataagtacaaagttatctataaacaaactcttagcttcggggtttgcaacaaggtgaatatagtaaaaaatgaatttactataacaaatgcactggtaggttatattaaatgttgtaaaatttattcaacatatgaatgtaaaattgacgacaaacatagaggatgccatagtccttcttagtggcatatgccatagtccacatatagagattgaaaaaagtcatgatagtcgcgcaatgggtgacgaatgtggctagtaataatatgaagtttttaatgcaactcttctacagaaatttttttaaaaaaaacacgccatttagaaaaacgaggaaagtgaagttagggaaagtagactaaagaacgtaacctaattagaatctatgttataaaattcagaaaataaacaagaagcaagaaggtatgaaatctaa

SEQ ID NO: 104042 - DNA, 1027 bp, Oryza sativa
gataaaaccaggaaaaacatttgataaaccgttgattctatattcatttcagttttaaaactaaggaactaatgtttgttgaaaagattatgctgataacagatagtggcacgagtgtgtgcagcctcatgtttagttgtttattgttagaaaaattggtttagtgatatccaaagatgctaacttcagaaatataccatccaacttctcaagaacactttagtaccacccaaagtttcccacaattagataatgactatttccgtcaagtagagggcccctatgaagcacctgatgccaacaaggagaaaagatttgcatgtctggagaggattccatagcaacagaagaacttgcacaaagacatgaagaagaatattacaagatcaatgcccagggacaggagataaaactgaaagaaccgctgcattaactgaagcaattactgggggtggcgaattgttgggcgttttctgcatccttagttggtgtcacctggtgaataactaggacatgcactgagatgtccaccaatcttgacaggatacgcatcacaacaaaggtgacgaaacgtgaaagcgagcaacgtgaggagattgggatggtagatatatcaaagagtttagaacttttagatggtactaaagtgtactagagatttttagtggaatgtttctaaacatgggatcttcggatgtcacttgaccaattttacatttttttttgttcgaaatgcttaaatgctacagtgaagttctgaagattgtacaatgaaatttatgatggtgtgttcataataggtacaattgtttaaatatgctgtgccagctgaggtgacagggaaatccaagccaagctgctacagtagctggagcagatatgttcattagattgggcagaatatacccctcacacgtttggctagtcccttgcttttccaaacaggttattctcacttcataacatgcaaaatgcatcaatctggaacgcaaaccacatcacgatgcaatcgatgggctgcaggaat

SEQ ID NO: 104043 - DNA, 1027 bp, Oryza sativa
catcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttggaaatttctttattcacaacatacaagcttttttatagttgttttgctatgtgaattttcaataatgtagccaactttaggttacactcatcatattttacaaagcagtcggtatatcactcggatcatgttatttggaggattcacaccgcatatgctatatattgatatcaagtcacttggttgattacgattatcaaaaccactcggttggttggattatttattccttggctatatgcttggtttgttcaattaaccacattgtcaggggctacacctattaggtgcatctagtcggtgcacctgactttattttccagccctccacagtcttcagatttggtaaaagtactcgggagaccatgataaagatgattgaagcactcggctttggagtaatctggttcgagagaagattatcttttcgactgcgaaggtctcaggggctactgtggatattatgggtaccccatacccatacggca

SEQ ID NO: 104044 - DNA, 1068 bp, Oryza sativa
gttggagaatctaaacgagtgatatacaagtttagggaccgggatgacacagtcgaacaagtttgaggacctgaacggtcgatttgcgagtttaaggaccaggataacatagcgatactagtttagggactgacgatggactttactcttttttttttttaccgcccaactagctactgtacatatccagcttgtctttctggagtttaatttagttttccacaagcacatgcaacaattatacaagactaactgatgagtaattaactaaactaaaagaatataatattgtgatcactatgcaagattgtgtacctaacttaagacaagtcgatcggccagtcccaatcatcttggaaattggaatgggatgtatatatagaatttcttaacacgtactacgtgcgaggcagaaataatctttgggctataatgtttctagctagcaacaaaacacaagcaagcaagcagcagaggagtatacctccgctagtaaaaaggaattaagtttaaccaaatatctatctatgtaaattgtactccacactggtggagaaaccatctttcgtcggtcggccgaattccacgatagtcccggttgcaacaaaaaccgggactaaagaggttcaaatgctgtcagggcttgtcaggcacccccgggatctaaagatcgtaactttagtcccggttggtgttaccaaccaggactaaagatctcggtgatctttagtcctggttggtaagtcccacccctttatatatgtcttcttcctcctccagcccgagcaagctataaaatttcttcaaaaaagaagggaggtcatgccaaaatttatagtgaatttactttggtgattatatacaaatcggaggtgcctaaaaggttagcaacttcatcctccaatgtttttttttctcatattacatttggagctatgttttgcatacttttttgtctccaaaattttgttgtaagttgatgagagagaaaatgtgtgtggggaagaaagaatatatagaaatttagttcatttgctaaacaaggttttataaaatagttgagaagga

SEQ ID NO: 104045 - DNA, 647 bp, Oryza sativa
tttgaacactttttgttccatggataattgcgtgagttaattaaaaaaattatacagtgataatggagtctaactagagggcgatggtatattatactccctccgtcctaaattataggcgtcctccttttaagaaaaatcaagctcagtaacttttaactaacaatcatactaaatatatatacgctaagtattatacatgttacttcctccgtttcacaatgtaagtcattctatcattgcccacattcatatagatattaatgaatctaggcacatatatatgtctagattcattaacatcaatatgaatgtgggaaatgctagaatgacttacattgtaaaacggatgaagtatatcactagatttatattttaaagtagtttcatgtgatgctaattttatattcgttggcaacaaaatatagagtaaattaatggttagagtatgtcagtaaagaccatgtaagaaaaatacatgccttataatttgagacggatggaatagaagttaagcaaaatacgatatcatattatataacgagtcaaaatcagtgacacaatgaattctctttgaaaaataatatagtcgaatcgttttttttattttagtcataatagaacttttttttacctaaacatgattg

SEQ ID NO: 104046 - DNA, 712 bp, Oryza sativa
tccagggacataactttagtccttgtctttagacactaatttagagtattaaatatagactacttacaaaactaattacataaataaaagctaattcacgagacaaattttttaagcctaattaatctataattagagaatgtttactgtagcatcacataggctaatcatggattaattagactcattagattcgtctcgcaaattagtccaagattatggatgggttttattaatagtctacgtttaatatttataattaattttcaaacatccgatgtgatagggacttgaaagttttagtcccatctaaacatggccttactgttaacaagagggccctcactgctgttgagtgttgacaagatgtggagtggctggtgcatgtacgtcttcagagtctctttcgaaaattactgacaaggaaatgtttgtctcagaggagaatggtctctctgtgaaccaaagacgggaagcaccgaccaatcgggaaacggcattagccattgacccccttggtttaacgcactctgctgcaccatgtatgacgagacgtacacgtaagggaacgtgcggtaggtagtagtagcaggcaagaaaatatcaggaaaaattcttccttgtgcagtcttgcatgcttgcagggggggtgtgcccgttccctgaagggagtagcactatcgataaatttttcctcagacgtataaatata

SEQ ID NO: 104047 - DNA, 1126 bp, Oryza sativa
cagtgtcggatgtgtgcttaggccatttttgtagccccctccctccctctcccccaaccaacatatgtaacaagtcaagtttcagaattgtgtatgtagctactatttttgtcttgaactggaaggttgcgaggggcacaacaatcaaagacatgaactctgtatgtggctactgttttcatgtacagatatgttggtaaagaagtggattatattgggtagaccttttctgtggactatatatagtttgagtacgttgtacacaatgaaatcgagttcagtatcatatgaaacctgaggaaatgatactgaggaggatcatgatacctcccagagttcacatgatcctactcaagtatcatatgtgaaaccagtagggaaccactttacaagacatcgatattggataggatcatgtgatacttcacatgtatcaatcataatgaaactcatgtatcacatgatcctacctacccatgtatcatgatagatgattttcctgggtaggatcatgtatgatacttcacaggtatcacaccatcctactaaagtatcatatctgaaacctcacagggatcatgttaccagagatgatacccaagtagaatcatgtgtggtacatgtaaagtatcacaccatcctactaagtatcatctgtgaaacccatagagatcatgttagaggacatgatacctaagtaggatcatgttagaagacatgatacctaagtaggatcatgtgtgatacctcacatgtatcacacttaatgatacttttttgagtaggatcatgtgtgataagtatcacgccattaagtagcatttgtgaaacctattgggatcatgttagaatacatgatacctaagtaggatacatgatacccaagtaggattatgttaaaagacaagatccctaagtaggatcatctgtgatacctcacatgtatcacacttaatgataatatttttagtaggatcatgtgtgatacttgtaaagtatcacaccattaagtaccatctgtgaaacccatagggatcatgttagaagacatgatacctaagtaagatcatgtgtaatatctcacatgtatcaaacttaatgatacttttttgaggagaaccatgtg

SEQ ID NO: 104048 - DNA, 665 bp, Oryza sativa
tggaacaaacatgtttatatgatcagcacatgtattaattgataattatgtctcataaatcgtggtatagagataccaaattaataatgtggacacatgatggggaacatgttgttggatagacccaacatgagacactgcaagagtcatatgtgttgtgtcatcagtgatcttatttagtgttagtgttagtattgaatccttagacctgagattatcatggttctcaacatgtgtagtagcatacttagggactgctaaacgctactccgtaattgggtagttataaaagtagtttccgggtatgctataaaacatgtagtgggatatgaataatcaatatgggatttgcctctcctatgaagagatatatctgggcccctcgatgttataaattatggaagtgcatggccatgccaaaggtgattgaggagtcaatcacaaattatataatatatcataagttcgagtgaatgattgagctattagaggatggcacatatctagccttgagcttaatcgatattgtgaggcaaaagggttcatacaagtttacactagaggttcaaccgatatgatctttatgtatgcccggtgggtcaatacgttctgctaggggccgctgttgacacgtggaccgaaaaggaattttcgagttacagcct

SEQ ID NO: 104049 - DNA, 605 bp, Oryza sativa
cccccggctacgtccgcaacgcgctcgccgacccggacgccgcgccgctcgcccgcgccaccgaggaagaggagaagcttgcctccgccttcagcgacgagaaccccaactcctgcgccgtcatgtagtatagccattatagttagctagtcatgcacccatgcggccatgccatgtcttattgttttttttttttaagtgtgctgctttgttttgagcttgtagtctcaagtgtgtctgtgtgcagtctgttcgccgctacgctttgtacactgattattagttgggagttgtaggatgagtccctcgtggctgtcaaagttttgcctaaaatttttgtatgaaacgtgtttgagtacgatcgagatgagcaaatgtttctttggctcataatgctgctattacttcatccgtttcaattataaggcctttatagtcttcgacgatatactttaacttataatttatttcattttatatttcaactaatattaaattgccattccctccgttttaggttacaagagttttgactttggtcaaagtcaaactgctttaagtttgaccaatttatagaaaaaaatagtaatattttttacccaaaa

SEQ ID NO: 104050 - DNA, 663 bp, Oryza sativa
cccatttctgttatggtacaaaatttgataatttaccggttttaaggactggaaatatgatattcattaactagagttttttgttctcaaatactctgtttgatcactcattttggtggaatggagttatgcataagcttgtgaatttttttatgaaaatgaataatggcgcttaatatagaggactatatacttgtaatgcactaactgtatgtttgtccatagagtgatccatcgagaactatatttgttaattttttttaaaatttctgtgtaagttgtagtatactaattgcattctatatgtatattttcttaaatatattatatgatagtccctgataagatctttcaagtattgtcgctttaggtcatgaattccattttacagcaggacaaataatttaggtatgtatgatatgggcaaccagggataacacagcaaaactaaatctggcatgtaagctattcttgggttaatcagacacaatgttatgaattgttttttaaatccttgtcaaacatggttgtatatctgaagctcttagtatttactgtacacaagatccctactactatttgtcttgaatatccatactattattgggcgtaatctcaacaactactgtagttttctttatttgtattgttgcattgtctttc

SEQ ID NO: 104051 - DNA, 1470 bp, Oryza sativa
tcgacaagggaggcatagacttttgctgaaagattttgatttggagagatttggagtttgggttttgaatctaaatttgatactttgtacacaagggttcaaggagtcaaggaaggaaacaaaacaggagtttggatattttgggattcggaaatgtatttgacgaggattcaaaggaagggattgactttcggaattagatttcggagacttgaattggaagaggaaatttgaggcagaggattttgatttcgatgagagggaacaacgggattgaattgagatccatggcacgacttagactctcactcaaaaaacgaaaattttcgcaattaggattttgccgaattagtttttaatgtctcacgaaaagcggagcgttacactaccctatcaagaaaaccccaaaagaaacaacaccagttaacgaccatagactctagaaccactagtaccgaagagagagtaaacatggagtttcgttccttccacaattgccaacataccagaactaaaatatttgtcttaaaaatatagagaccataagtgtaaattagacttcaaatgtacatcaataaaatcatatatttgttgatatttttatgtatattatatagaaaaaaatggtcaggattattttttgagatcatgttcttgtcaaagacgataagtactatcaaccttgaaagtgtattaatcgatggtttaatacttgttgcctgttccaaaatataactatttctatgcgttttttttttaaaaaaactagacgtcctccttcagatatattttaggaaacacacggaagtgcttatatttggagcaaatgtggtataaattgattatgcaaaaaaatgataaacattgtgctatattactcaaataattatgattgcaatggcgggtgcagatgtgaatcggatacccataatgaacaaaatggttagttatgtactcaacgaagcaaggtataacataccaaccggtatttccgagtatgtgcagaatttgtgctcacagcgtatgccgtttaattactagttgcactagaactcatcagaacaagaaattcataaagaatgttgtattttactatattgatcatacggttcttgttggttgacctcgagcactgaacaagatgatgcaaattatttgactatttcaatgtctcgccagtagttggaacttttttttagataatgagtagttggaacttggaagaggaaaaagaagctgcggttgtaaaagggttcaagggagttgagcctgtagttaattagacagcactgaaagaacaattaattaagaaatgaaatattcctactttctttccattccatctacttgcttatccaattaagaacttaaaatatccggtactaataaaaaaatcaagaaaagaatttaggtagccagtaaatgagcggatgcatctttttggcgtgaaatatttctgattgaggattt

SEQ ID NO: 104052 - DNA, 1715 bp, Oryza sativa
aggcggaaccggacggagggggtgcggggagggtttaaatagagccggggcgagagagggtggccggggaagggaggaaaccggcgcgggaggtcggccgccatcaatggcgccggcgggattaggggagcggtttccaaccgaatccgagggagagagggagggaaaaatggggggaaagagagagggaatcacggggagtgattttcccctctttattgcgcgcggggacggcgggaggcggcgggattcgcggcggcggcggcgctagggcacgggcgaggcggcgggagcggcgggaggatagggatgacaggtgggccccacccgtcagcgagggtggcgggcgggcccgcccgtcagcggcgcgcgcgcggggagaggccgagtgggccgcggggaggaggagagagagggagggagatgggccgagccggcccaagaggggaaggggggaaaaaggactttttagggtttttctttttataaaacctttttaactttgtttatttcttaataattattatttgtgctctgaaaattcaagtaaaatttgagggctccttttagaccaaggagaatttaacaaaaattctccgggccgcatttgaatttttcttgtacgtattttagtgtttgccaatttcttttcgaattttaattaattctattattccttttagcgaatgatttttaattcgggatgaatttatcaggacgtgacacctacacaatcttacatgctaagtctagttacaaatctaataatcttatattaaaactataataatcttatattaaaactaagtctaagtgtcgtatattaaatctaatagtcttaattgcattacaaatataacaatcatatatataattacgtcacttgcctgcgcgaattccttcgagggctagctaccactccggcttgagggacgacgacgacaacgtcttttctgcaacatacaaaaagatgtattgggataaacgcgaagtaacatatattatatttgacgttcacgtttcgttcacgatcgttcacgttcgcgttctcgttaaggtcacgtttcattcacctacgttcgttcgttcacgttcactcacctacatatattgcatttcacgttcacgttcgttcatgttcacgttcacgttcgttgacgttcgttcacgctcgttcgttcacgttcgttcgttctttcacattcaattctcgttcacgttcgttcgctcgttcatgttctcgttcatgttcgttcgctcgttctcgttcacgttcgttcgctcgttcacgttctcgttcgttcgctcgttcacgttcgttcacgttcacgttcacgttaattcgttcgatcacgtggcggcagcggagcggcggtggggcggcgcggcggtggcatggcggcggcgtgcggcgcgcggcacgcggcccggcggcggcgttgtgcggtggcggtgtggcggcgcggcggtgccgtgccacggcggcgtcgtggcgtcccggcgtgtcgtgccgccgcagcgtcctggcgtggcgtcgtgtcgtgacgacgtcggcgtcggcgtcggcaacgaggcggccggcggcaaccgagagggagagagagatcgagatcggagagagagagctgagagggaggcggcggcgtggctctcaccccagagatgcggcggcggcgccggaggcggaggcggcgacgacgacgagcgcgagacga

SEQ ID NO: 104053 - DNA, 959 bp, Oryza sativa
cacggatataccattgtagcatttcacccgagagtaatccaagggtatcgtatttattttatcccgtgggaagatcttgtagagagaactcaactaataatttatatattacttatgataatcatattctaagcaggggttatgataatccaagggtagagtgacacacaagcattacctactcatccttataaaaaataatctaagctaggtggaaagaaaagagaaagtaaatctattcctatacttctaaatacatagtatacatacattctagttaactgatatactagctaataccctctattcgatgccctcctggtagttcgagaagccaccccgactgccaagttccttacgacagcccgtcatgaccatccaaccggggctaaatacggaggaataccctccccaggaaattaacttaggattatatataggcgcggaggaatacccgtactgagctgtcaccatcagcggcccacctctcatccacaatatataaccccaactaatgatatcccgtaatctagacaccacgtctaaactaccagatactactctaatatcatcgtcatgacatagagtaattgcataagcaaacactatacccgcaccaaagcatctcccagataagccagccgtatactcagtataacaagattataatgtaaagttggtactcatatacttggaaagtatttcaataccagaaatgtatatagaagagtattctaataaaagtacaaagcttacaaaagaggaaaggaaagctactagagccatacccgaactcttccgaagacttccggactcctgattcctattctaattctattccaccagctagatactactaaactaaacttgagaggaatgagagagctcttgcttgaggtgtgtgttgaagtgaagagagtgagctccttatatagaggtggttatgacggttgtggaag

SEQ ID NO: 104054 - DNA, 1971 bp, Oryza sativa
tggcgccagtggcgacgattggagcagcggtggcaggcggctggagccggcgaacggtgatggaagctcggcctcgcggtgggaaaggtgctgcgggggtggaaggggagaacggagtggatgccggggtgcggcacgacgcggtggagcttttggcggcggcgccagtggtgggagtggcggcggcggcttggcttggtgaggggagagcgggagagggtgcggggagctcgggaaagagggggaaacgagagaggagaacacggggaatattttaaaggcttggggaggtcgggattgtggctgattggggcggcaacggccgacgacgtgggttccggcaacgtgaggagatgggggcacgaaacggcaccaaaaattggggaaaagtgggggaagaggtggaagaagtggtgggaaccgattttactcggtttgggagcaagggcgcgagcgggaaggcgccgaattcgacgggacgtgggcggcaaccgtcggccatggtgagttcggcctgggaggccagaggaaagggatgacaggtggggcccatgggtcccacctgtcgggagagagagggagaggaaaacgggcaagggaggcaaaacaaacttaggggggaggacttgggccgagcccgaaagggaggaagggtaaattttattgctttttttattttaattgattaaaggatctttgtgactttaaaattatttctcgagctccgaaaattcacggaaaatttcagagagttcattaggacacaaagaatattacaaaatattctcggccaatgatttttaagggaaaattttaattctcccattatttcgcttgattaaattgctttaaattttattaaatttctagaaaatgtattatttcatgatttttaatcccgaacgaaaatcggggcgttacatctagcaaaccacaattagatcggtggcttaagaacgacgcctagctgtctagaagtcctcaacctctaagcgtaaaggatgacgcaaagatctcttggggatgaatccaagcttgaagaatggtggagagggaaagtgagaaaacaaggctcaaaatggatatcaaatcaatgtaagtcaatggcacgaaatattcaatggagcagtagccaaaacttgagggtggaggaaactatttataatcacaaccttagatctacccgttggaaccaaagattccctttttcaaaaattccaaaagttattttcaaaaatatataaatctcaaaaaacaaggctaaataaaattttggtaattacgaaaattcattttgaacatatccgaaaaacatcagtaccgaattttcaaattttttgatttcagaatttttgagagccgtcttcggaaaatccaaaaactcaacgaagagcaaagcatactttcggaagtggatcgttgagattgtcttgccctaaaaatgagcattgccactcataacctagaatcgtcgcacaattccttttaaatttaatgttctaatgtatgggtaactaataaataataaaaaatgctcactatctatacttatataaagttatagcccactaagtctaaagctcaacatgcaaccatgccacaggcccccgttgttaattttggtaattaatgacaagtactaattatggactaaccgttgctattgagatatattttaagttaggtccacgttatgtgtgcgcatggatgactatcgatggattaaaattgacggcgcaaggaaagaagacggtaaaactagtgctttaatttagaattgatcgaggtgtagggcgatcaaatttgctaatttatttttagtttcgccgtactatcaagcggggtaatgacctagcaatgagatgattttaattgccacattaggtcattatgcatttagacttgtgctcacatttcatctcacacacacaatctctttatttttcactgggttcggcctgaccagggcgg

SEQ ID NO: 104055 - DNA, 1250 bp, Oryza sativa
taataactatggttattaataattgatcaagcttaagttagttttgctcaccttggcttaagttagagcaacagctagatggaattataaacttggtctgagtatacttatagtttgagaattacaagttcatactcctgatgtttgcactagaaaccagaaaatccagtttgtattctgaggcaggaggaactggtcaaatgatggctgtagccaagcatagctatttcaaaataaaaccgtagaattatatcttctcttttaaacatatatgattattctcatatcttttagaatgataacacgcatcactgcaaacatatagtttgtactaagaaatagatttatatgtcagagtgacagtgcacagttatgcaaatgggctaagcaaaagatgttttacaagtcaggaggatctaacaattgaagcttagtagtttgatgtaggcatcaatggttgaatcgatctggaggatggaaaaaagcatttgaattttgtgaaataattgatgatatactatttcattgaatgtgtgattttgcaattgttttcgagtatgtcttactgttgatcttttttgggcctattgccaatgtttaaatctagaaagtactttttaaaaatctcagatctgatcggtttatgtaaaacttggtcctgatcagaactactgataagcagtggcccccacatgagtttgaaaaatatggatatcaatttattatattttattggaaaaatgaaatatgccttttatgatgtgcatagaggcatatgcttgcttgcatttgttcaattattcttgctgggttttatttatttattttagtgtacattggaacatgcaaagtacatgcaccacagtcacatcaccttacacatgtgattgtgcacatgtctacacacttggaaaatgccagaagaactgaaaatctctcagaactctagcaagtgtatgcccattgagtgcacacatgtgtaatccaaaaatttgctaggtgctgaacttccctgggcttggtgctcatctgcacctctatccatttggccacatgctagcttctgttgggtttaactttttttttttttcgttcaagctaagtgtttcagtaatgcacgatattgttattgtgctctaaccaatattttatttttttacaagaaacaggagtggttcctactgcattaatatattaataatataactatgtacagaatattgacagagtatttacgagagtttttttat

SEQ ID NO: 104056 - DNA, 1206 bp, Oryza sativa
tgtcatatgtaaatcgatcggcggttataaatagataataaagaactaaacctactcgatcggctgtagatatcgacaatatatagttttatatcgatatatacttaaatcaagtgattgggatagatcagtcgccatgccgagacaatataaatcacttcgattgaaatatatactaataacagaactatatatgtttatagcatagccgatcagatagatctagcatgtatctgctagtactccaatacaactctatgttaaaatattaaaacaagcagaatataccaaacagaagcttaatatacttaaatgcaaaaatatcctgacataaagggcagatttaacatgtcaatgaagcatataaagcaaatatagttaaatcagataagatcgactgaaactctgatactaccctaatcggcaaccagaaggcagggtagagattgatattctaagctcgacttaatagatcaaacttaactgatgcagcattaagtatgaaaagaaaacaatatctagacaatcaagccgctgaaagtttcatagagtggtggatatcttatataatctaaatcaatgtcaaaacctaacctaatcggatgccctctattaatagatgttagccgattgtaagttagatagtgatatcgccaaagattatgtaagatatatgataattcaacgaattacataaacaagattagagtatcatgaagatggaagcactaatcccgataacgcaagccgtcataacaagttttacctcttgttgaagatcgaaaccgatgcagctcaacccaaaagcaagaactcgtcgaaataataactaaaggaaaagggtggcgatgcgccgaaattgtattgaacgtgtgttaaaaactatatagggctcggggtctattgatacccgaaaattgcaagatatgtccataccagacacgactattatctctaacaaactctaagataccataagtctttacggcagacttttgcccatatttatctctaaggaatttacataaaatatcctaattaatagatacaattgccttcccaggactttatccatgtatggcaatcatcttgaagtgcgtcaactcaaacccgatatcggatacaagtcgtattgtcagaatcagttgtatcacttaacccagtctgactcggacttagccgatcctattcatagccgacccgaac

SEQ ID NO: 104057 - DNA, 875 bp, Oryza sativa
cagattggtaattttcgcatcacattatttgttcttaattgcagctgtctccactcagaatgcacattgttccttggttttctatgttatgaggttgaagccggttaatacatatgtttgtgtttcagacttttttctcataatcaacaatgtcgtttagtgacatacattattttcccctatgctcttttagtttgatatgaaatacatttctcatatatgtctttttgttcttagagataatagtacgctgacaaactgagtaggtcttcttttcgagctcttttgaagtggttaggtgtttctatgtgatatctgcgaattactgattctttaatgagttacgtaaatatgaagttataatactctgtagattccacatacattgtggaacatagtaaatgttttgattgctattgtaggccatagtatgtagattacactcttattacccttatggttcccttcctttcctccaacccaacaggatcctgtgcatctcttctttctggagttcaattatcacattggtgcttcatctgcaacaccatatggaccaatttaatatgccatgtcctaagaaagtcgtgcatgacaagaaggtatctaagataacactctttcggtaatgccaattgttaaacatagaaatcaaagtaatttattttgttaccgtttccttcaagtggcactcgcatattgttcaattgtaacggggacattaggttttcttactctgctggtttcctcatggctgtgtacacaaacagttatagattataaaataaatataatggacccatgtttgcagctactacttctagtctatgtcctttttattatatgctacttcagatttggtatttgttctaggg

SEQ ID NO: 104058 - DNA, 1293 bp, Oryza sativa
taaaaattcaaacaatctcctatcgggctcatcttctccaattttctgagaacaaactacacataattttttagtgcaataaaataaaatggaaactatgtacattcacctacctccagtaaaatccacatgaatttatctacaccacaaattaatctatgaattaacaaatatggggaagagaaataatcctggaaataaatgaaaaacgtctttcactcatgttcctacccatctagggatgataattttacccatggcttcgggtatccgtggatacccgacccgatggtcatgggcgtgggtgtgacattttacccatggacacgcctgctcgagacccgaagacatcatgggtaatagccgggtttcattttttacccgtgggtaacccatgccccacccgatacatatgtattagctaattttgactcatttcttaactcttataccatttctcttggttcatttgagatgctaactgatactaagttgtgatgtaattcaaattattgttgataaacgataatttggtaaattattaattttatttctctttgttaaattacatatctttcaaattattattcatgtgagattcattgggtaccagccggacatacccgcgcccgccgggcatgggtacgggcacggagttttgcccgctaactctagtgggtagggtacgggcgggcaatgtcgggcattgggtcggccgacccgacccattgccatccctatacccatccctcacacccacacctagcaaccatcgccctggacccacctttcatcgtccctatgtcaccccatctctgtgtctattccccagccgaccaagatacaccgagggaaagagagagcgaggaggaagcggtgccgaccggcactggacgcgcgcgacgcatggcctcgacgtggcaacgccgagccgagtcttcatctcctcccagctgcatcgctcattcccattcctcactctagtgccgaccaaaccgagagcgaatgacctcagcctctccgacgccttatctccgctgccggctgcgaagaaagacgaccccgccaattgtcgtcatgccgtcgtcgttgctatattttccctgatccatgatctcctctcgacgccggttccatcccttctggcctagccctctatcgtgcagtgagcgcacgggaacgcggacctcgccgacaatgctctggagcacgcactggacgccgccatcgggacatcgtcttcgtcgacgtcgaaccggagcaagccgagctgagccaccgcgccataaacat

SEQ ID NO: 104059 - DNA, 662 bp, Oryza sativa
tttcagagatcatcacagatatgcatctatggatacagggcccataataccgtgacaagttatcgatttcttcataaaccggcccaaaacctgtgacgttatagcaattttgtcgcgatttaaatacttcaaaactatataagagatatgcaaattttatgaataatgttactatcaatttatgggatgaagaaatgaccaaaataaaagttatatatattgatgagttatacaactttgatgttgatgacttttttagttgaaatcatttagtatttgaaaatattgtttacagttgtcataatttgaaattcaaattcaaactattcaaacaaagtcatatagaaaaatgactaatactaaagctgtagatattgatgatttatacaactttgttgttgatgatctttccatttgaaatcatttagtatttgaaaatgttgtttgaagttgtcataattcgaaattcaaattcaaatttttgaaacagggtcatatagcaaaatgaccaaaacaaaagttgtagatatttatgatttttacaattttgttgttgatgactttttcagttgaaatcgtttagatatttgaaaatattgtttgaagttgtcataatttaaaattcaaattttatatagatcaattaaactcagatggagaaa

SEQ ID NO: 104060 - DNA, 1323 bp, Oryza sativa
agtgatttggatgtcgaggctagataagttggccgatgaggtgatatctagaccggtgatcatgatgatgtccagaagagttggggtcatcggcccttgggagaataggaaggcatacatggccgtggaccagaaatatgctgctgctatcatcatgggttcattccttgccatatttgctgcagttagtgctagagcttgggatatgccgatctctaaccagtgatctaatttgctagctcgcatccttttgaaccaagcaggccaggtaatctcggccgatggccaagatttgaaggtgcctttccattggctgagatctgggttggcaaatctgaagaggattctattggtttcaccatttataaactcggtagggtctaagttaccgattgggccaaggaaaagctgaaggttgtcggcgatactaggaacatcaatttggtgggcaagatgctgtagtagaaggggaattgaagattgagagaagaagaagaaccaatctagtgcggaaaaagaggagttttagccgatggggacttaactcgacatattctgcagttgatgtgctcggggggctggtggaagatgacatggtcgcaggcagaagttgacgcttgcagggatcgcttttggatcgccggaaggcttgaaaccgtcgtcggagagctcgaggaatagattggagaaagttttggctagagcagttaaaacggaggtgacaccgtgaaaaacgagaagagcggtggttactatttaaaagaacgcggtaacggccaaaacggaatcagttttggaaaccctagatcggctcggaaaagaaatttggacaaatctaccacattacaaatatagcggacttgggggcatgtgttgacgaccaaaattggtaaattatgagccaacttgatacagagatcgatttgaaaaacagagtatgcatcggctgtgaaggcatcagctggagtgtgcatcggctgagatggatcggacagagggtagccaatacagccgattctgataaagatggtctcgaagatgtttctagaattgatcaaggtgcttcatgaggattgccgcgatggagataaagctctcggataggcaattgtatctattaattaggatgagaaaatcccctgtgtacccatgaaagttcacctaatcccttctgtacccctgaattttgctcaatcccttacatacccctgaattttagtttggatcccttccattccatttccgctagttgaccgttagttgaccgttaaattcttatgaaaaagtccattttgccctttgctatgaagaagcatataaatt

SEQ ID NO: 104061 - DNA, 1170 bp, Oryza sativa
cccaaaatataagtgataaaatagaaattttttaacctaaattaatattaagatggtacgaacttgctgagaagaaatcatgcattttagagcattttaatttttttgcattatttgctatttattgatcgtaggttattcttgcatgtgtagcgagtaagtcaatggtgagaatttggactaggtgttgtccagagtatcgaagagcaaggcaagtgctcccctctttgaatacactgaaactcatgttttggggaatgaaatatattgttgcaaaattgcacaagtatttaaaactatcggtatttaaattgtggtaaacgatagctatgacctatttgccgcatgaacccccttagaatatcgtactccctactgtttgtatccataggattggttagagtacttcatttgtgctcatttaggtctaagatagcttgatatgtcgctatatgattaaccatgcttagaaacttgctaaataactaaaaaactaaataaccatgtgagcactttataaataaaattttgggtactattttacttctggacagaaatgaaaaccatggttatttctgaactaaaaatggaggaaaattgtttttttagatttggacagcaagtggtgtgtatatagtagcagttgcacgcctataggtaagtgtttacctgagtcaattaagcgctgaactctatggcatcatctattgtttaccgtatatcgacatgtgctagttatgtggtagccttagctgattaagttatttaatgactagccttgcatttggtcggctgaagtagtatagcaattattcaaaggaactacctattgccccacattttatttagggtagtatactagtatagatgtctaagtttgtccaatacgatgatatagcgcctcatggggaaacagatgtatttgccgccacggtgttaggtttaaggcatggcttcctcacctaacgtctctaggtcatacctagggtggagacacacttgctgtcatgcaatggtaggctttatgtaatgtaaaggctgcattatgatctctagactgcatccaacgtgtagagtgtggtggtgctttgcaagcacaaaacaaactagagtgcttatatcatgtggttcacattatacaaactttgtatagtctaaaactaatcgatt

SEQ ID NO: 104062 - DNA, 1364 bp, Oryza sativa
tcgttttgcgtgttagcttgtcgtttccgtcgttgcgaaggttcgtgagtgcgtcagaagtgttcaagaagactaattgaagaccgattattgtaaggcaagtcacacagatcacaaataaccctttcagcatgttgaaccgtttaaagctattgttttatttcaacttatacattattttcgaatgtcatcggtggattgtgttgtatgaggggtactgtcacagtcccgtttcgagataccgtggtggtactgagggcatggtaacatgttttggggttgtgtcttgtggttacagtggtacatctctggccagggtaaaactattcgaatagccgtgcctgcggtcatgagtgggttgaacaatgtttttcgtgattagtctcacacttctaacaataattattgatgctataaccggtaataatttgcttagctcctgatttggagttagatctgtacacctgactatgattgttcaggatggttgggcctgtgcagcatgggtgtgctgttcagtgttgattaatattgatgattaattactctattgttttgctactcctaaaagtttgctaaatgctacttttgcaaatgagcttatatcatgccgtccttcggaatccttgtgcacttgtatatttgctgtgtggcttgcgcagtattccatgtactcatcttgcaataatcaatcaacctcagttgaagaaaaatgatccagaaggagaggacgtttggcttataccccagttgagctgcctgtgggagtggagccggagcttcgttagtctgtaattccgctactgtttttcttttattttgtaagtatgtaacgatattattataatagatttgtatattaaattgtcagttttttacctcggctgattcctggatgaggattttatgcacaaataagtttagaaattaccagtgaatttccgggcgtgacagtctcgctgctcctttttatcttctgattccatccagttgtgttaccacacgacaggatatggacctgttctgaaacaacagtttcgctgtataatttaattcgttactcctctctataaaacgaatagatcaatgggtgcacctttttttgcatatcctacacaacctgttgtatttgtgtttgatctgagtgaactaatttgattcctctctatgatctaaataagaatgaaatggtcatctctgctcatgatgaatgggtttacagtatcttcctacttcccccatcttaatcgaattgctggacttatggcctcttcttgcacctaatccacaatgaatgtataagagagaatgtttctttagaacactcacttctgtatatatacagatctatttaaaatttccaa

SEQ ID NO: 104063 - DNA, 506 bp, Oryza sativa
tgctgtgtggcttgttgagtatgtcatatgctcattcttgcaataatcatcaaacctcagttgaagataaaggatccagaaggagaagacgtttggcttataccccagttgagctgcctgtgggagtggagcttcgctagaccgtaattccgctgcagttttcttttcttttgtaagtatgtaacgctattattgatgattctgtatattaaattgtcagtttgtgtacctcggctgattcctggacgagggttctatgcacaaattagttcggaaattactagtgaatttccgggcgtgacaccagccaatgaaccctcggttgttaatgagggaacatccacaacctactgggcagattgcgaatcaaccaacccaagatcaagttgctgccatgcttttgccacctccacctattgttgatccagtgcagcagcagccgattcagcagacatcaccaatccagccagttgtacagccgatccaacaacaggtcgtacaaccag

SEQ ID NO: 104064 - DNA, 790 bp, Oryza sativa
ccatgaatagagtatccactagttggggttttgttattctagggtgaacaaagtaataataataacaatagcaataataataaggtcataacaaaggtaaataggcatggctgaataaaacagtgataacgcgggaatttaaataaagcgataatgcaataatttaaatcaaaataattttataaagtgggattcaatatgttcaaggatgatatgacttgacttcttaaggaaaaattagagacttgaacggtccaattctgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtgggtcccacgcggcagcctcacggtccacggtggaccaggtgcacccgggctcacaccggccggcgccgtgggccccacatgtcagtcgcacccgagggcgcgggtggctgacggccgggccccacgcggcagccacttggcatgcccgagggcggccatgctggcgcggtcggcgggaggcggcgcgcccacgccccgatggtcgccgccggcgaccaccggcgcggcggagcggcggccgagagagggaagggaagggggaaaggaggcgacggtccacggctcaccccggggcgacggcggcgacgggggaggcggccggagcggagggaggcggtggcgcggctcgggtcgacggggacgacggcgctctggcggtcg

SEQ ID NO: 104065 - DNA, 525 bp, Oryza sativa
aggatgacgaatgggccccacccgtcagcgagagtgacgggacgggcccgcccgtcagcggcgcgcgcgcggggagaggccggattggccgcggggagaggagagggagtgggagggagctgggccggaccggcccaagagggagagggggagggaaagggaactttttagggtttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgtggaggctttcacacggattttaattattctcggcataatttagaggatgtattttagggtcgttttgggacgcgacatcggccatcatacatcggcaaaacacaaccaattaagataataaaaactgctaagggcaatataacttatatcggccatctctaggcggtgtcaacacatcagctaacatgt

SEQ ID NO: 104066 - DNA, 776 bp, Oryza sativa
aaaatgtggaatggttggcctgggttggcttgggacgagttgggacccagggtcgggttgccagtttggtctgaatcatcgtaggccttgggttaaggcaggttcgtgtgggttcacggccttgattaataatcttgtatagctctaggatcgtatttacaaaatagctttgagcaactaagtgtcttttaatgctgtatactgcaaaccctaaccccttatatgataacccccttgtactcccttatatttattctgcacttgtgggtgtgtcttgttgagtacggtggttgtactcagtcttgctcaatttttcccaaacccagaataggagttcctggaagatgaaggctttggtgtctagctcatgcctgccgtcaagcgcctgtggtcgtcgccctagtcttccgctgtttcccgtttgtctttgtgtgtgctgggccttcgccgcccatgtaataaattaattatttacgcttccgcttgttaaacttttaattgtatcaacttttggtgtaccttgcctcttgggacaaggaataatgcacgcacgtaaggaacgcccgttgggttatttccggtcgtgacacagttcttgagctcattcacggagacccgcaagggaacacttgttcagaagtacaaagtaaaagtaattgctgatgttcctgggacaggttcttctaaagatggagaagtgaaacaagctccagatggctcagctcaacccgagtgataaggtgctgcagatggttttcaaggagaccaaggtgatg

SEQ ID NO: 104067 - DNA, 1615 bp, Oryza sativa
aggaatctgtaatttgtttttgttattagtctacgtttaatacttcaaatgtgtgtccgtatatgtcaaatttttttttttccaaaacaactgaacacggcctaagtcataatgtagaattgtagtaccattccacacataattgacttgtgttagaaaaattcacactgcataagttctattccaaatttagtaagtatgaatgttggtcaaaagaagtgtccttgtgtgtgttctcaactgtactttcctaacttctgtttcgtcgttttcacgcgagtatttctcaaacggttaaacaatatgttatttaatattttttatagaatgttatttcaaaaataatattagtttatttttcaagcttctttctgataattaattaatcatacgttagtgagctacctcgtggggaaatcaaagttaccaagcagcactatccaacacaccaatatctgaaaatgaatcagcagttgaccgattaaccctgctaaggctgcattcgattgtctaggtaactaacatctccttcctcgttttttgcgtacatgttttccaaaggtacattaactttaaaaaattctataggaaagttgtcttaaaaatcatattaatctagcagtttttaagttttttacatattaatctattttaagtcttttttacaaacacttaattaattatgcgttaaaccgtcgttacttaattaattatgcgttaaacccccacaattgatcacagcctaagacaagagctgagctgtgacttactggaagtcccctaaaccacccaaatcagtaacaaaagtattccaggtttggttccatattagcaacgattatgaaggcttttttagagtaaagtgtatgggcggtccttaaaattgtagtggtgtgttatctaggttcttaaactctcaaaatgcatatccaagtcccagaacttgttatagtgtgtcatctagatcccaaatcaccacaatcccttcaggatcctacgtggcgctgatgtggcataattttgactgacaaatgggatccatttaaaaattttctttttcttttttttcttctcttgtattttcctttctctatgacccgagtagaagagggaaaaaaagaagaatgagaagaaaacggaaaagaaaaagaaaagaagaagaaaaagacgcgtcacgtccatgtggcaggtcacattagcaccacgtaggatccaagaggggatgtgtcggtttgggacctagatgatacctttgacaagttctaggacctggatatgcattttgagagtttggggacctagatgatacaccgctacaagtttaaggaccgcccgtgcattttacacttttttttacaatcaccagacttataactcaattgcttagaaaggaaaggaaaagaagtttgaatggacacaagcatgccaacaaaagctttaaacttgctgatgtttaaaacaaatcacaaactgatcgatgctcagtgcctccggctccctcaagtcccaatagaaaggaaagcacctgcccttatcttcacgttgatgtactgttgttgtgctacctttgttcctgtgtgttcgtacgtcctgccccttgaatcagctgatcgga

SEQ ID NO: 104068 - DNA, 1113 bp, Oryza sativa
caaactaatagttacaaatcatctatagataatttaatagctaattcataccatagttacctataaatatattctacactaataattacatatcatacatatattatgttttgtagtttatgctgtaactggttgcaaatctatagtccgctactatcctctctttatatttatctccttgatatgtgtttatatttagtttttagtttgttattgtaccttctctactcgactagtccctcccaactactagtagtaaaacggaaacctcatcaaagaggaggagagaggtgtgaggaggtttgaagcctttttggtttgcaggcaaaagtgcgcacagctttttctcgttttgtgcaattctggggctttgctgcttttgtacccggcggctcctctcttccgtaggccacaggaccaacctttacgtgcatgcatcatcggtctgttttactccgcacttgaaggtacttctgccactttaatctaaccgctggtaccggcagatctctcaccaccaacattgtacatctagagggactagggactaccaatggtactccttgctccgtccgtctaaaaacaagttaaaagacacatcggttgatctaataaattaaagcaaaaacctaaaatttaaatttgtgaattgattttaaagttgattttaaaatatttttaacacaatttattttagcgttggctatctttaattgcatcacagggaaaaaaatagaccaaaatatagtttccaataggtataatcccttacttatttttcttgaaattggttataggaatacaatcctgtggaaagaaaatatgagttaaacatgtctataggacaaaaaaaacctaaagaaactaaatcctccaaaaatcctttgccaatcctccatttcaaagggaccttaaagtttatcccaaaataatttgatttttactccctccgtctccaaatctaagggattcaaacatttaagatttatctcctaaatataaggtattccacactttatctttcttctttccttgcactagaaatactattactagatcaatcactataaaagtgctctttctttgcacctttgtacatgacaatcaacccgg

SEQ ID NO: 104069 - DNA, 1855 bp, Oryza sativa
aataatatgttttcttttaaaataactctatataaatgatgctttaaaagtcatattaattattttttaaaaggtttttaagctaatatttaatttattatacattaattaatccgttgcttcgttttgtgccagaaaggaattgaaggattctcaatggaatgatctttagtttgcgctttctagcgaaaccgggtcaatgaatgatctaaggtctaaaaaaacaacacagggttatttgtacagattatctagattcaactgccaatgacgaagattatgaactactgtatgcatgacttacttgtggcaactaattactccctccgtttcacaatgtaagactttctagcattttccacatacatatagatgttaatgaatccaaatacatatatatgtatagattcattaacatctaaatgaatatgagcaatgctagaaagtcttacattgtgaaacagaggaagtagagtatactgaatcggtcggtctgtgatggatggggagtggttattgtgatcagccacgaaagcgctagctagcctgcggataataagcggattagttggacgtcggcgtctctcttacactttcagctacaaaattggagcatgatttgataccgacctacatacacaacgaaaatttcagaacgaaacttgctacgactctcactcatttttttttaaaaaaaaccacgctatatatcttgtacagttagctacagaagtgagtaaaaaaaaaggtgacaaaaagaagaggaaagttgctgacacatcacgcattggcgccacacgaggcagagacgacgacgacgaaggaagaggacacagtagcagccaacaccagcagtattggactattggcagggtggtgatcgatcatgcatcgagcagatcaagagagctcagcagatgcgactgcttcttctctctcacacacacacaccatccaatgacgacattgaacatgcatatgcatgctgggtgttgcacttgcacaagcacaagactcctttccctttccctttggcgccacactatctaccaccttttggaaggtggccagccagcagcagcagcagcagcaggattgaatgaatgagcaagttaggccagccaagctgctgtactggtagtagtggcctgtgatgagtgagctagccatccatccaatccattccaaccatgcttagtttaccttttgatgatagatttgatccctcattagcttatattgcacatgcattttgtaattcttggggagagcttggcagttggacctgacaacaccaccaccagtgcatacatgcatctatggagaaaaggaaaagaggcaaatatttcaattccaaaatggatctagtcaccaccatgacaagcaaaggtagtactatgtgtgatgaggtgaagcatcatcatgtcatatactagcagatagctccatggactgtgggtaaaaagagagatagatggatagatggatgtgtagattcccaaagtgagaaaagaaaagatttaagagaggggagaaggaaaaaaaaacatatagtgagctccaacaaagctatggggtgaatgaaaagatgaaggtgctcatgtccttgtggcatcttttgcactcatgatcacaagtccaagacatgttcaagtgggtcatgcatgcacaaccttggaaaagatgagatctccttcatctcactttcacattcttttttctccctcccttgcacctttcccagggtcaccaaatcaagatttgtttgttttagttaaggcagctagggtgttgtactactcaaactcactcatggtcatggggggttccacaaaaagtgcccttttatttttcc

SEQ ID NO: 104070 - DNA, 1453 bp, Oryza sativa
acgaatgacagtatagtgcccattccaaagcattgcatattcttgtacttttcctttacaattccttcgaaactttacaattcctttgaaacgaataagccctaaggtctactccctccgtcccaaaaaaaggcaaacagtaggtttccgtgccaatgtttgattgtccgtcttatatgaaaattttttataattagtatttttattgttgttaaatgataaagcatgattaatactttatgcgtggcttatccttttaatttttttcataattttttttaaataagacagacggtcaaacgttggacacggaaactagggtttgtctttttttggacggagggagtaggttgtccagtgtccacccaaataatcacattgaaacaacagccacagcccacaggccatccaattatgcaattagaacatagaacatggtgccatggtggtatgaaaagtcactggaaataaaagccattcacatcttctggctgctgcacaagtagttagcttcgagtttgagaatgaaagggacactggggtaaaagggagtggaggaaggatgcagaatctgtaaaatgaatgaacacgtacagcacctttctacgacagaatccagtagacttgtagccaacccttgcatagaatcatattattgaatctccatcacgcaacgtggtaatctataagatgtcaaaaatgctcttactcttattattacagtatcaagtgtcttgtgatgtgtgcttgaaatctccaagcgcaggaaggagcaaagcaaaatcacaaaatagatgcaagctgatacttgcttgaacctcatttcaaccaaaaacaatcacgcgcacatgcaaagtagaaaagaagtcaattctcaatcccttcttgaacaaacaaatactacatagtggaaagtggaaactttataatggtgcacacgcacacttgcttgattgttgatgctacacaccaaccagatgatattatgcttcagcaatcaacaaattctacagttggtgaaaaatgatatgcaatccaaatacaaataataggctcccaaaaggatatcctatgggggaaacattttgtcactaagtgacttcacacacatctcagttgttttccaacttgtccaatggaagatgtgcaactatcatattcacaaaagaaagaatacaactaagtagaaacacaccactagaagagaactaaaacaaagccaaagatgatacttaataaagatgcacccataagcaccaaggccttattgttgtggcactattcacagaagacacaaggtttcattttattttatgttttgaaggataactcacggcatctattcatttgctgcagctacaactgttacagaaagccagaaaaagccgattctatttgaccacatggcatcaataactgtcacaagctacagtgaatatcaaaccacccacac

SEQ ID NO: 104071 - DNA, 3822 bp, Oryza sativa
taagaaacctaactttgctaatagagtttatgcggattagctagagttcaagttatatagagacgaagcagctatagctagtccacaagctgcactactggacaacacgaggggccatacgttaatcaaagatgctacaaaaacaatgtgaactttactactactgtactacctactggctatactgcgttgccgccagtagataactggtcaacactttggactagctaattgcgcgatttgacttaggtggtgtttagatccaggggtttttaagttttgagttgtcatatcggatattatatagggtgtcgcatggaatgttcgtgtaataataaaaaaactaattaccgaacccgtcagtaaaccgcgagacaaatttattaagcctaattaatccgtcattagtaaatgtttactgtagcacaacgttgtcaaatcatggagcaattagggcaagtactataatgctccatatgttgcccctaaaaataccacattttattgaatgatgaggtggaggagataagtgaggagagagatgatgagtcacctctaaatcaagaggcaacctccacacaaattttaaaaagggtatgagagtattagagatattgatatttatgtactagaggtgatacattgtatgagctgcctcttagttaatgagtgaataaaatagataaatttagaggtagtagtcacatccaccatagcacttgcccttaggcttaggtggtgtttggatgcagggacttaactttagtccctgtatttagacactaatttagagtattaaatatagactacttacaaaattaattacataaatgaaagctaatttgcgagataattttttaagcctaattaatccataattagagaatatttattgtagcattacatagtctaaccatggattaattaggctcaatagattcgtctcgcaaattagtccaagattatggatgagttttattaatagtatacgtttaatatttataattagtgtccaaacattcgatgggatagggacttaaaagtttagtcccatctaaatagggtcttagaagatttgtctcgcaaattagtcgtactctatgcaattagttaattttttagcttatatttaatacttcatataagcatttaaacgttcgatgtgacatgtgaactaaacaaggccttaactcgacgatcgtcatcgcgctttgcagtaagaagaacttaatgaattaatcttgatcgccattgaattaagggtagttcgatcacgtactggatggtaatatgcatatcgtcgatcatttccgtcaaaactcaaagggcaagagaataatgtagcatcaatatataatgttgtgtctcaagttaatatgacttttgtgtttgttgtagtcgatcgagatcgatcgtcgtcaaggttaatatctgagtttagaagctaagtactaggatgaaccggttctgtctgtaataatatcttaattctgtgcgcgaagcttttcttctttggttgtgtttagttcagcacaaagtttggattttggttgaaattgaagatgatgtgactgaaaagttgtgtgtgtatgataggttgatgtgatgaaaaatgactgaagtttggatctaaacacagcctttattaattttaggatcagttcctggtgaagtgatcggagttcagttatttagtatagtcctgtcaaaataaaaatgaaaatgatgatgccattaacaagttgcctcgcgtcataagaagccgtcatcatgtacatacgtaacgcctttgccccgaagcaaatggatttttatcctctaaatattgtagctctccgtcgtgttattattatacagataaaaaactgcataactaacaattaatcgagtcaaagtcaaacaaacgaagaatacttctcgtctaggtcgggcccacgcacactggcttctggagtagcaggagcaaattaaaaatccaactcagctatagcttagaaaaattgaagatgtcgtagtgaaaccgaagaaaaaaaaagtaagcagatcaacaggagatcgaaaatgcaatatattttcatgcattgcccaatctttttgcgaccagtgacatgccatcaaattggcaagaggagggcagggcgtatatattagtgcagcggcaacaagctataagtcaaggctttcgttgtctctccaaaaggtttatcgactcgtgcagaaactgacattggagaagatatatagtactaaccagattcgattcccaagctaggagaggagctggatttagggtgatatgtccgacgacttctcgtcacgtaagtacgtttatatattgcgtacgtattaattggaagaaattaatcgaagcttgaaagctccagctagccgaccaccaccagcggcacacacaaaaagaaaagtttttttcggtatacattatacagttgtactccatgagtccatgtatatatacgctatcgatggccaatgtggaaagttgtgaggagcaaaattagtttaagtctggagctgtgttgtctcgcgaaaagaaaagagaaaaagagttagagagagaggtggcccatatgtggtcgttgtgtcgtggcaagtggacttttttacgtacgtacgtgtgcacctgcagctagcgaccgaccaatcggtatataaaattaaaaatggcatcatccgagaatctcttgggttttttctttcttttcgtttattattgctgcgcacacatgagtacatgacacatgcgcaaatcaatttggtgccagccgccgccgggccgggcgttcgggtgactggcatttttttatccgctcatctcatttctaataactcattttcttttgtaaattttgtagtgttatgtaaacagtaaactagcaagtagggttttatgtgaataattgacgctcagttgtatttcaaccagtgcaaggcgggacgaacgaggggtaggcaaatggcggatttagagggtgttccgggtggtcctggaccacttaaacaaacggcgaccgatcccacttttttgaaaaaatagtgactattggaaaaaaaaagtagcgatcctattcctcctgattcccggcaccaaccgcgcacaggccccacacgcacgtgtatcgaattcagaatgtcgcggcgttgcacgactctgtctctctcctctcgccctagcccctagcgtagcgatgcgatctcatctcatcttatcacgcaatagcgttgcgccgccgccgtcccgcgcgcgcgcaacccacgcccactccgcgccgcgtgcgagtccgccgctgcatcgcactagcactgttgttgtgctgtgttgcaggctgcactctgtgccgccgccgcaaggtgccgtcgtcgagccgatcagccgagtaaaactggaaaacgttcccccaatctacgccttctgataaatgcctgtaattttgacacgccattactttaatagatataagatagagtctctctacctttttgcgtaaaaaaaaaaggagagggggggggggggaacggagtcatggaggcaggcaatgcaagctctatggccacaattgcatgcgtaacctgatcttgtccgttgacattttgtatcaaagacattaattaagctaagctaacaacgttgtaatagcgctagcccgttgacaatttgatttttctcaaggaatacaattagccgttgacaagtgatgaatcgtctataatattgctggctcgctatagggtgtcgtaatgtcaatcgagaggcaatttaagctgtaacctgcaagcaattgcaagctgatcgagagatgcaaa

SEQ ID NO: 104072 - DNA, 1643 bp, Oryza sativa
atctgttagaatattgggctaggcccacttataatattaatctcaaaggcccataataaatgttgaggataataataccacctctggatttaagcgagaaatatctcaacctaaatagggagttattagaggctccctgttgaccagttgaggtgggggtcggaatgccacacgcgcgcgcgccgggcgtggcgtggctggctggcggcgtgcgtgcgtcacgtcactatccttttgcagccactaacccacgttcccacgattccctccgcaacagcgcgtccacgttctttctcctgatagataaggaggccgcgagtccgatccgagttcctcgcttctttcccggtgttagtttctccttctccgcgtctgagttgctctcgcttccctgcttctgatctcttgcgcgcacgagagattggaagaagcagtgcctccgaaaccacaccttcgcctgagatctgcaccgggtaggcgggtgagcgggtgatcaggtttttggggagtgcctcctgcacgactgctcatcgccatgtctggagttgctgccgccgctattggcggaggtggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgttcctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttctaacataatcttcacagccatgtgtttttggaatatcatacagctaccaagtcatagtattattgaattttgtgtttggttgtcggtataaatcaaacagtagttcacctcaatttgcccaccgataaaaaataacttcaaatgatgcatcagtataatactcgagtaataaactaataatgcatcagatatgtaaattcaagtgtcaaactcaaaatctgaacacaattgtgcatcaaggtgttgagccagcagccctcatgctcctaaaactgaaccttgtttaacacgcaagatttctggattgtaatgacaacgcatgatgatgatctcagttttggaaaacagcaaggaccacatagtcaagtttggatcactttgtttaattagttaaacctaacgagacaaaaaaacatcacaaattcatttcttgactggatggatgactttggatgaacaaataaaactgtggatccatgcatcacagaaaatcaagctagattacctgctaatgctaagctaaattggattgcaatggtgcgtcgtggcttatatcattcaatgggatggcagtaattaactgagttgttgccaaattagttaggagatgatggtgatagtggcttacttactattcattatacaacaactgttcatgaatgcagacaattgtttgacctagttgtt

SEQ ID NO: 104073 - DNA, 730 bp, Oryza sativa
cttaccactaagttggataccatgttttatttcattatatgcaggtattgacggttagatattatgatttaaggatcgtcaacaccatgctgaacacgtctccatttctgtagttgtgacaagacccctcgcataactcaactcagagaggcgcaactttcctggatcataatcaccccattttagccaaggtatggactccccagcgacccccatgggtttatctctggcacttcatagtttggcacaccacaatgagccttgctatacaaagtgtcaagttgttgcccatgctagcttgtggttggcacggttaatgtttcacaacagtagctcacgaaccggtccttaattgccatgagcacaactatccaaacttcaaaccatctactcacaacccaccattaatcaagttttagttggcaactaattatccaatcaagattgaccaccgtgatcgaccattaaatatctatcattaggttatagtgaagctttagttatcccaatagtttgctaatatttctaagcatagctaagaaattatatctaatatctagctgaaccaatatataaggcccagactagtcaaattataacccattggaaaataaagttgtcgatttctaggatcggtatttgttggcagtatgtcatgagacccttcgaccagacctgccgaaaccatgcgaccagtcaggatcaggttaaggtgttaagtcaacggggc

SEQ ID NO: 104074 - DNA, 1116 bp, Oryza sativa
catcaatgtgagtatgaattcagggacatgtaaaaatttgatttgaactataaaaaaaaaacaggggtaagaaggcgcatatgtacttattgtagccatgcatggagaatattttagtattttatttgttagatagatctaactgtctagaaccatcactttattagaaattttgtgaaaagagcattaaatatctttaaactactgaatctaactaaaaaaaacagggcaaaaacggaatgtgataaggaaacggctacggttcccggttttgtcccaatctttcacagtgctctgtatgtctccagcgataatatatatactgttatctccatttgaataactcaagagcagcagcagtattaagatgatagagatctcgtccagcaaagtatatagggtcagacacataagatcgataactccagataaactaaactgaatagctccattagatcaaatttaaatagatagatgattaggtttacaatgaataaactaagcaaatctgtagataaactccacccgtgcagcaagaatgacacacaatcagagcaagaagacttcggcagaaatcagaacacgcccaggaaattaattcccgatcacgctcgtccaaaccaatgcagcaacaatggtggcaaaacgtcaggcagatggaatcaccatctccttcctgacctaggcggcggcggcggcacaatacaaaggaaaactaaaagccaatctcctaatacaaggaacatggcatatataggtggcacaaaggcctagccagctgaacggactaaaacccaacatgggctcctacacaacgatccaaataacagagaaaaacctcattaatgtaataccctgattacttggtaatcctgccgctaagcatggaaggaaagcagccacatgcatgcatacatgcggaggttgtgggagatgatttcgttttttgtctgtgggccctcatcttctctcctcgcatcacgtggcagcttgagagcgtttttaggatgccacatggtagcttgagagcgattttaggaagtttaatggactgttagtatataatagataatagatagatagatagatagatagatagatagatagatgagcaaa

SEQ ID NO: 104075 - DNA, 654 bp, Oryza sativa
cgatgtgaccataacaatactggatactaaagaaaaaacactaggagaacacaaaaaaaggaacaatgggtatatcaacaaataagtatattgtataacgacttaatttgtagatcaccaagcagcaggtatatattatttactacattcattcagcaaaaatagggatataatattattatttattactagtacattcagattcaaccaaataaagatatttttagggaccagccggcgggtcatttcttttgctacagctaccctatcgtcatgtacacagaacagtagaatacatcctcactcattccatccccagcctcccaattccgttagagcagtaataatttaccctaatggccaattaaagcaattaacaaccccatggaaaatcattacctaacggaaattacatgtacatgcagatttttagaacttatcaaatggtaccatgtttttctcgcttcaattaattgacagctggtgatattattttgaaacaagataaatactccttcaaaattatgcatgaatataatgtaaaataatttgcctgccatatatattgaacagttttttaaggaattttacagttcttgaggaaagtatcttaaggtacctaaattttacaagatatgctcacgtccaacaaaa

SEQ ID NO: 104076 - DNA, 1436 bp, Oryza sativa
  unsure (1)..(1436): unsure at all n locations
gactactaaaatatatatgaaatattttttggggatttattccctaagcgataacaaatgtactggaaatttattttcacaaacgattcttcgaagagagcgtcgtctgcaaatttacttcatacgtgattgtggaatccgcatgtacaaattgttaaattaattnnnnnnnnnnnnnnnnnnnnnnnnnnnnnttaccctcctgtgaaagtactttttgatggcctgcataaattatttgaagtgtattggctgtcataataacttttttatatgtaaatgtgcaaaggaatatgcaagtttggctgtataaattattttaagtgcattgacagtcgtgcacatacatagccatgtagcacatttgatgggtcaacttctaagatgcgtgatcactgaaaaatatatagaaagcaatgacttccaggagtccaggaaaattgcatagaatatagattgggaagtgaagtaccaatatttatttctgcaggattccatatactttctttatatgcataaatcttctacagtgcattgcaataattattttttctgaaccgggacggcgcaaagcaatagccttgtcgatcaattattagtcttagaactcagctcagatatagctctacttcaacaggggcacatcggatctgttaacattttagtcaacaggggcacatcgagcaagtataatagtagactataagccggctaaatgctgaggtggaggagagaagagaggagagagaggagaagcgggctgtaaacttactgccgtctcgaacacaagaactaagaaactctgtgagatagataagtggaccctatattaatggtaaaaagctaactattatatgggtaggctgagagaagactacaaagaacattatagccaacaggtcggctgtattactaaccttgctcttatgggtaggctgagagaaggctacaaataaccttatagccaataggtcaactgtattattagccttgctctaagtttcgaagagcatggttaataatacagtcgacctgttagctacaaggttccttttgttgtacacctctgatcagagtaaaactattcgaatagccgtgcccgcggttatgggcggtcaaccagactcatcgtgattagactcatcttagtttagtctaatgaaattggatggtataggtgaatggttgggcctgttgcaacgtggtggaacgttggacagtggatgcttaatactgcttaattattacaactgttttcgcattcgacttctatttataaatgctagtatttatgcaaatgaacctgtttagctatcccttggtaaatccctgcatcatacccttccattccggtatgacttgctgagtacagtggatagtactcagtcttgctttattttcccccccaacctcagagtatgagtatgtgtccgatg

SEQ ID NO: 104077 - DNA, 1531 bp, Oryza sativa
taatttaacaatttgtacatgcggattccacaatcacgtatgaagtaaatttgcagacgacgctctcttcgaagaatcgtttgtgaaaataaatttccagtacatttgttatcgcttagggaataaatccccaaaaaatatttcatatatattttagtagtcatatgtgcacggttttagccatgaaatatgcatccgtgcaaatatatatatgggattcaaacttgacctctcaattcacatgtagcctcccataaacatctcacctacgaaccacttcattgctaattgctatggaattgatgctattgttttgacttcaccattctaaaacttgtaacacatatatttaacactctaaatgatatcaaatggtaatgccatcaactacaaagttgcatgcctcgtcaagctttatactttctttatatattatgtcctcatctgatatcattttaaaaactcaaaagttcatttttaaaactagatctgagaacttgtaatgaatatttgagtccctaaatgaccttgaatgaacaaacattaactacaaagtggtagatatatatcatcaagacatacagttttcatataaattttgtcatcatccaagttcagatttaaaaattatgaatcaaagtcttcaaggctcccgccagggttcctaagtagccacttcaccacggatcgaatcgggtagcgttggctgctgtgatagagatttggtcagaatccatgaagttggagtggcttgccttgggaaaatggcctggagctaaaaccttgttattaataggtgttcgcaaaaatacaaactacggaggacaggatttctagttaacatcctacaatggcaaggcccattcttccaaacaaaagactttctatacatagcaaaaggattcctgtgtcacatctagaacgtagcctaccacaacaacagttctggccttcgacctcacatctccaaagtcccttgggggaatttaactatttgccacttttaatttaccaattatccaaatgcccctcttaggtttgcacttaataatttgccactggagagaggtaatttcttaactatttgccactttttcctatgtggcgtgccatcgtgccgtgccagcatggaaagcaacgtggaccccactcgtcagcccctctcctctccttcttctctacctccggtcgtcgcccacctcccgctggccccacatgaaggagacggagagcgggcgggaggagtccgggcaacggatgcgcagcactctccctagcgaccaggagatggagagtgtggcggcgaggaagcccacgaggccaaagaggaggcaggcagtggagaaggccggggtggagaggaggcagcaaaacgtggcgcgacgggaggtggtcgccgaggagaagaccttcggcgagctcggcatggcttcggcgaactcgtcggctgctgccgcgtgggtcggtgaggcgtgccggatcagagccgagggagatgaggaggaggagtggtgttggtggacgctgggtg

SEQ ID NO: 104078 - DNA, 2482 bp, Oryza sativa
actaacggaggctaacagatgatgatggtaaatagtagaagttatgcaaaaattgatggcatattatagaacatgacaaaatcagtggcaaatcgtagtgtgtgacaaacttagtggcatataatggattctctaaaaaaaaataatgccactcttgcatgacgagtttagatagaattaggctaagcttataaaatacttcctctgtcatattgttttcttttccagtcaaatcttttttttttgagaaacagtcaaatctttttatgcttgattaagtttacatgaaaacatagttttgtagtatttttaagacaaaaaaaatatactataaaaatatatttaatgttagatttaagaaaactaatttggtgttgtaaatgtgatattttttgtataagcttgatcaaattaaatacgttgactaaaaaatcaaaatggcttataatataaaatggagagagtatatgcgtttcagcgatacaaatttcaggttaactattctacgtatagtgagaacttaaataggacgatatacattacgattgttcgcttgatgtgggagcaaaggctaaggacattcacaatgtttatctcacaacgtttgtaatagtgtaggcccattaatcaggtgtagtagttgttaccatattccacaatgtatataagcctgtggtgagaaaacaattggggctcattggggctagagccccagctccatcccggcagaacccccagccctgcatgcagagcagcagccgcacagcttcgggagaggagcagcctgaagcaaaagggcagaacgaacaggtcgtaggtaagaaggagcaaacaaagacaacatgtatagtccatctaggtgattaagtggactaattggctactaagccttccttattaagttattagttttttgcttttttttgtctacttcaatggatggaacgatcatgggattagggaagcgagtggtttttactcacgaagtattaatccaacaattatcaacaattgtgttattgaatttgtggttgtgcctttgtagtattttgtcttccattaagtgaaagcattttcatccctcaagagatatcctctatcccctcattttgtgcatgtcatataatcataaaaaaactaattaatataaaatatatcgcttcacaaacatgcaagttaaaatttaatttctataaattgtaaaaaaaatcaaatataattacgaatgtacgataattgttttcaatttattttgttatttttttgcaacttgtagaagtcaaatttggccttctatgtttgtggagtgatatctttcatatcaattaatgttgtcaatttttttttcaaattatttagaactatttagatggtatgcaagcatcgatcatactttgtaaaacacattagaaatgatactttgtaaaacacattagaaatgagcaccccctatatttttattttcgttctagattcacccccactatgtgggaccatgctagctatgacgggcctaaaccatcacctctgacggattcgacccctcatcagagattagtggtcagtgatgactctcttcacctttgacgggtgaagagccgtcaatggtgaccagcccctatgacgggccacgtatagaacccgtcgcaggtaactattatctcaaacggcccattagtttgtgagccgtcagtgatgtctataatccagcaaaaaaataagaaaaatagattgcaacccgtcgcaagtgtgaaaaaaccctagtaagaaaattggcgcacgctgccatggtgctgcttgttgtcatcaaacagaccacatcacaaaaaacttcaaactgaccacatcacaaaaacttcaaattgaccaacagttcattgtcctccatcaccgcatcaccatctcatataccaatcattcacaaagggggatggcaagaatttatcatacaacaatatcatatcattcacaaaaggggcacgctggccgacagttcgtcgtcctccatgacgaaccagcgaagggagatgcaggtggaggcgccgcaccaccaaacaaaaatcaagaaacaagaaaccaccattagagcccacattctcaaaccaaacacctcaaatcaacaacaacaacaacaacaacaacaacaacaagatttaagtaaaaaaaacaacaagaagaagaaaccccaccgaggtggccggtgggtggggatggaggaggcggtaccaggcgttcagatctacgcatccccagcctcgtggaggtcggatccggcggctagcacggtcggtggcagtggtgagggaggcgtcggtggtgttggcgaccgggagtcggggggaggcgccggcggaggtggaggcgtaagtggcggccagctagcacgggcggaggcagaggcgcggctggaggcgtcgccggcagaggcggcgaaggtggagaccgctgccgccgtcgggcctcagccgcctcccctcccgcc

SEQ ID NO: 104079 - DNA, 1586 bp, Oryza sativa
acttaaagccatttgaggtgagtaaacctcacatctgacgggtcgtccggctgcgacctgtcataggtaactagtcacctgtgacgggttctattttcaacccgtcacagcctcacaggtgactagttacgtgtgacgggtcgcagccggatgcctcaccaatgacggcatcccgtatgacccgtcaaaggtgacggtcatcagtgaccatttcgtttactcgtcacaggcatcctgtcagaggtgtgagcatctggtgtagtgcactgtgttattcttggtcattataattgtgctgccagctgcaattacttgtcatcatcttttatttaaaaacaaggaaggtagcccgtgcacatgcgcgggcatcttatttaatgtgttcgaaattttattacgaatgcttacacgtagttggtttttttattgaaatatcctttgtactttcaaacttatttgggatttctatgaacgttggttatgattttattctagttacgcttgcaacataaaaaattgttaactaaaattatgtgaaagcatgccgttttgaatttataagaaaatattgtatcatcaccatgaagtttctatgaaactatatattgtactatgggtattattatactttaagtaatactccctccgttctaaaatataaggtacaaccacccttaactcaaagaccaagaaacaattattatcatctcctagtttagatcaccctaataaatgtagtacatgcatccaatagaattagagatcttaagggtagatgatttaaaaaagtaataatttaatgaagaagaggtcctagttaattgcatgcaagcatgcatgccttatattatggagcatccaaagaaagtagttgtgccttatattatggaatggagggagtaattgcttttaaactctccgtgtctttttggattttgggataaattaatttaagattttctattaaacatatagctaatagaactatgtcatataattaaagatagatttatacttcgtcgcataaatccgagaaagttaaattttgtttcaaaatataagggattttagagcagtactacttgtcctatccaaacaactataatttattgtttacccaatcttaccctaaccaccttcccaccctccacgtctattttaattagtaaggggtatcatagtgtttttttcttcctcattagctatggaaaattttactataggacactgcgatttcgtggttttagccataggacaccgttcgaactcacttttaggggaagacactccataaacgtagtaatttgccaatggacaccgcgccgattataataataatttccggttgaagaggagagagacatcacgtgaaatgtcaaaaatgcccttgggcccacatgtcagctctcctatctctcctgtctccatcccctccttccggcgtctaatgcgcggtgtcgggtggtcgtggtggcggaggacgatgctgactccgcgatggcgacggcggacactacgggctttcacgcttcctcctcctccagcacctccagcgccgctagaatgtcgagcctgacacacccgcc

SEQ ID NO: 104080 - DNA, 2842 bp, Oryza sativa
ggcgggaaggcgagggctggcggtagtaacgggcggtggtcatggcatcccaccgccagatttccgccgcatcccggagttccgccgccagaactcacccgagctgtcccgccgtcgctgtagctccgaccctcgcccccgtgtcgccgtggccgctctgctccgcgcatcagatgtcgagatgaggggatagaaagagagacaggagagaaaggagaactaacatgtgggcccaagggcatttttggacattttacgcgatttctctcttctcttcaaccagaaattattattctaattggcatggtgtccattggcaaattaccacgtttatggagtgtcttcctcctaaagtgagttcgggcggtgtcctaccgctaaaaccacaaaatcacagtgtcctatagcaaaatttgcctaaccctaaataccttacgatggttctttactacccatgaaatacatcttggtattttttccaatttattaacacacttggatgattgttttttaatctaaatgcttatctataatgtagaaataatccgatagttacgaataacatgaccacttgtgtaatgataaattacacgttgaatgttgtgccttcataaataaaatttttaataatttcaattattgattatatgctttaatataccaataaatacgtaggttatatgctacatagattagtcatattttttcaataatatgtagggtgtgtattattgatgttttttaatttatgttttttcatattgcagtatacatatatattttttgatttaaagaaaagtcatgaggatgtagtttttattttgttccatgagattgtacacgtaatttagttatttgtgtttatgaacgacttattagattgtcatgtgacgacgtaggaacgtttgtaggagtcccacgtaacttaactgcttgaggcgttttagaaagtttaatggacttattctatggttaatggatttttattatataataatagatagatatatagatttttaggatttgtccgattttatagagcgtcacgcgtgatggtgtaggagtgttttacttttagtatataacataatatatagattataatcagtttgttatctaatgtttgattttattctcatattaaattttgctaggtagaaaattaaaaaataaaaagaatgatagaagatatgagatggagggagggatggacggacaaatgtaagtatgtacattacgtacataagggggatcagagtatccctgggagggtatggtggatatttttaaatctaacggtgacaaataatgggtccaccgtattaaatgaaaatcaagggtagaatgttttgcttttttctcagaatttctttaatttctctaatttattagagtgccaagtggcggtttaggagcgtttgtaagaagtttcatggacttttagtatataatagaatagaatagaatagaatagaatagaatagatagaagatagatagatagatagatagatagatagatagatagatagatagaagatagatagaagataatgtaaatatatagatagtgcccgaaaaaaatgtttatatatatatatatactgttctttaattcagtatcgtttcatgcataaagaaaaaatattttgtttgccggaatggcttaagaggggccatccaatggtattaatattgagagggaaaggttaaaatgaaacttttgaacaacataaggttgtctagattgatcatacgtactgtggagcacacgtacactcaagagccacgtgccaaccatataaacacaagcccctgaaataaataagcctagcaccaaatctatcgcccctaggccaactaagaaaaataggctttttatgccgattctatttgctaattaattaccattgtagtacgatgaagccgttgattgcgagtcagtagctccataggaggttccatacaatgttgttccctgctgggcagggaccgagttccgaaatcctgcgtggattcatcaatttggattttagaggcaaaatactaattaggttttatgcagatgcatataaaaatatgatatgctagttagtattccctccactccaaaatataaggtatttttagtggcggacccagtgataaaatttagctatggtggattgatcgatgtgctagatcaaagaacgttgtactttcaacaaatatgataaaatttgtatacataaatcacactatatttgcattcattagctagaaaatatagcactacacacgattaacaaaggcaataatcctgaatttttcatgtaagttttacgagtgaaataattttcacaatgtgttcccattttacagatgtgtgcttactcttgtttcttgtttttttttttttctgttgttgctttctgctgtgccttttggttagagcattggacggtcagtccaatcaacagttatgcttaacaaagataatgcagtaaacatttaattcttagactcttcattcatttttagagacacaagtcaattctaccatagcccttacatccaagtaatcaaacaaatagagtttctaccaaaaccaaatagtcaattaatcatctaagtttggctgtggcatagctatggaagctgccataccatgccacaagagaggtccaccactcggtattttcattggatactagaatgtgttacgtacatccgatcaaaatacattattatattttagaacagaagaagtaccatgagttggtgtaatggtactcacctgacccgtacgacgacatcttgatcttgtcaggcctgtgaaatctcttgcttctgatcgatgctca

SEQ ID NO: 104081 - DNA, 640 bp, Oryza sativa
tatattctatgcaattttcctggactcctggaagtcattgctttctatatatttttcagtgatcacgcatcttagaagttgacccatcaaatgtgctacatggctatgtatgtgcacgactgtcaatgcacttaaaataatttatacagccaaacttgcatattcctttgcacatttacatataaaaaagttattatgacagccaatacacttcaaataatttatgcaggccatcaaaaagtactttcacggagggtaagcgaacagcctgtcatttacagtctgcgcaattaatttaacaatttgtacatgcggattccacaatcacgtatgaagtaaatttgcagacgacgctctcttcgaagaatcgtttgtgaaaataaatttccagtacatttgttatcgcttagggaataaatccccaaaaaatatttcatatatattttagtagtcatatgtgcacggttttagccatgaaatatgcatccgtgcaaatatatatatgggattcaaacttgacctctcaattcacatgtagcctcccataaacatctcacctacgaaccacttcattgctaattgctatggaattgatgctattgttttgacttcaccattctaaaacttggaacacatatat

SEQ ID NO: 104082 - DNA, 708 bp, Oryza sativa
attcctgcagcccatatgggtaggctaagagaagagcggggtgcttgtcatctacgttgctagagtctttgtggcagagttggagctgctgcatcgggttcagccgatgagccaggcaacgataacactcaacactccggctctggcttcttacaggctctacaccttttgagggagtcaagcctagtctggtctcctaggatcggcgacatcgacgcctgcgggcgccgtttcctccctggaggtgttgccatgtggactctctcccctttcgggtgaaaacccagcccagatgggtgggtgtcggcagcggcttctgtcgttgttcacctccttggaggcttcgccgaaggtcttgctcctccctcggtgtctactgtagtttgtagttttgtcacaggctttttgtgtcttcagtgtaaggttttgccgatttccctttaacaaattgtgcagttgtatggtttttaggcccggttttccttataaacagggcgaactctcttcttctaatatatccggtagaactcctaccgtctactgtttcaaaaaaaaaagagaagctgataattactgattgtttgtaactgaaaatgcatgagacaagattcacatatatggtgtcacgcccagaaattcccgaatagaattccaagcagaatgtgcattaaaacccccatccaggaccggccggggtacacaaacgac

SEQ ID NO: 104083 - DNA, 1062 bp, Oryza sativa
tttgaatgcacttgggttttaaacattgtcttttgcagcactacaccgatcccattaaaaattatgtattccgtactatgaggtcagcagcactataccttgaaacagggaaagtaataatacgtgcctttgttcaaaagacaagtgtccatgaggtgtactcttttgaaaagttcacacatttggtaattgttcttcacaatttcttacacttcatgcttgttttactttcgataaaaaaatcacacaattgagtgtaattatatggaattaccatgttttatatctttagatattctgaaaaacgtataagttctaagccatctactttaaaaaggtatatccaggacactcctaactatagttggtctctatcatgatattacgaccaatattcttaatagaatccttctacaatatactgcttccatgtgttattacaatatgcttttcaatgagttgagaagtaaaactataacttaagagggacgaaccagctgtgcacacagtcgtcaaaactccaaaagctttcactgaaagaagagattcttagtgatgagcaaggttcatctagcggtaaatttgttcctgaggaacaaaagttcatcaggtttcttgtgttaaatcaatttttagacatatttgcttcttataatgctctcttcaggttgtgctatccagtataattttactacaataatatgcttcaaattctatgttataaaaaatgataataattaatatagcccaaaaaataagacatattgatcctagctagaaggccaatatcattttaggtgacaattttgctataagctctgataactgattaaatagtgcacctaagaagcaaatccgtatgaccccaatcatacaccattagtttaattaattttcacatcctaacttccacgcaactaaactctacattttggctaatattttcatttttttatataaagtagtactattaaaactaggtccaccttatttacaattagatctagcattccaaatatttgcaaaaaggagagtcttgggggtgacatggttgtctatatc

SEQ ID NO: 104084 - DNA, 632 bp, Oryza sativa
aactagcggtaagttagttcccgaggaacaaaagttcatgaggtttcttgtgtaaaatcagtttctaggcatatttagttctcataatgctttcttcaggttgtgctatccagtacaattttaccacaataatatgcttcaaactctatgttataaaatacgataataattaatatagccccaaaataagacagattgatcctagctagaagaccaatatctttttgggggataattttgctataagctctactaactggttaaatagtgcacctaagaagcaaatccatatgaccccaattacaccattagtttatttaactttgacatcctaacttccatgcaatttaactcgacattttggctaatattttcaatttttcttacaaagtagtactattaagattaggtccaatttttttacaattagatctagcattccatgtttttacaaaaaaggagagtcatgggggtgagatggttgcctgtaccatcgtactaaaataatttaaaaattgtcatgtaacattagtttctcaatcttttgacttccttaagcattgtgcaaagtaaaaatacattatatattttacctccttaatcatcatgcaaaatcacagtgattagaagct

SEQ ID NO: 104085 - DNA, 2231 bp, Oryza sativa
gacatgcctttgctcaaagaacgatcttctgaaacttcagcgcagaaacgaaccgcacttcaggatccttcggaatgacatgaactacatgaagcacacaaaaaaaaagataaaaccctattcaaaaagcaaagatcagtacataagaagcacaaccatggattctttaggttataattaagaggcttgaacagatagattcagagtttgtatgaccaaaatatggtcatccaaagcttatttgttgtttaatggagatctacaaattattgaattaattttgcaatataaaacatgtttattgctcctagaatgtcaacctcgagaccatggaggaccaagtgcacagaaactgctcacgggtctatggaagtggacccgcgtgtcaaccgaagccagttgcccacaagcgggccccactagatgcaatgcgcgcaaccacgtggcactgacgtggcctccacacgtgcacaccatgacaacacgggtggcaaccgatgccagcagcacggggatcaaagccctctagaaaacggtggtgaatagcaatgccacaaagagagaagccacgacgagaggagaggaactagcatggctagaagagagcggtgacgaacttgacatggagaggatggcttgggggacatagacaaatgggtcggtaattgggagacaacttcggtggtgacttttgggtgaagacgaagcagacgaagcaatgttagcgacgcgtagggcttgatgacgtgaagctggcgatgatgacgacaaagcctgatggctgcaagggcttcggcttgatggaggaaggggcgacgcggacaacgttgttgcggcggccttcgggtgatgggagtacgaggccgtgctagagctcactgttatgacaaaaaatgggatgttttatgacaaaaataactatagaaatttctttaaagaaactcaaacaaatcatttttttaagtttataatggttaatactcaattaattatatactaataatccatcattgatatgtatatgctagaatcggctcatcagtcccagctgtctcgtacggctgcgttcgagctagcacttcggctagcagtttaagcgctaccagaagcagtttaagcgataccagaaaagagagaagtcattaccacatgattaagtattaattattataaactgaaaaactagattaatatgggcttttataaagctttaatatatatttttttttgcacataatacaccgtttagtagttagggatgagtgttaatagaaaacgaggaagttgtttagagttgaagcttataactcagccttattcacaggctgattaagatagcttgactgggtcgatcgactggccgatcgaatattttgttattcctaactggctaaaaactgttaatacgtttatataggatcttgcgctacttgacatatacttttctacctttttctatcattagcagatatatgcatgaaaactccattttgagcaaacaattagaccattacctggcaatgtttaggccctgttttagttccccaaaagtttttccaaaaacatcacatcgaatctttggacacatgcatggagcattaaatataaattaaaagaaaaactaattgcccagttaaggagggaaatcgcgagacgaatcttttaagactaattagtccataattaaccagtaaccaatatttgctaatgacggaataattaaactcaaaagatttgtctcgcggtttccagacgagttatgaaattagttttttgattcgtgtccgaaaactccttccgatatccggtcaaacattcgatgtgacataaaaatttttatttcgcgaactaaacatgctcttattgtacagaaaacgaacgctacaatccaggtttaatgaaaggacacagctagcgtattgagctagcaaacatgaattatactgtcatggtatttaagcggcaaaaacacgcagagcaaggaaggtcgtcctggaaaacatgtagcaataaacaagaagatgtaagacaccattttgcttctacctttgctgtggaatatagtaagcagtacaactaaactacaaggaaaaatataatcttgcatcattactcatgaatgacccttcttggtctagaagacaatacctgccattaaattaggcatgttccaagtaatttcctcggcgagctataattggttcagagggtatctgcaattctgcctagaa

SEQ ID NO: 104086 - DNA, 2874 bp, Oryza sativa
cattctaattctaaatccactagcactagagcgaaatatgtaaactaaagagagcttcttcacttgatttccttcatggtgtttgttggaatggaggatgagaagtccttttatagcttcagaatgacggttgtgggcgttaatttcagtacaaccacccttgggaagtcggttacaaccgtcattggtagggatggaaatttcccccacgggccggaggcgggttccgtttctgacctgtgggggaagcggggccggggccccgcatttttgtggggaggggccaggggagacagttcacccatgggtgacctgcgaggccccaagggtgtatattaacccttaaaatgtagcccatagaatgcccaaaagggcccaacccaaaagaatagtgagggataaaaacaaaccctagccttatcctctccagtgtctccccatctcggcatctcccctcccgactcccgtccgcatcacccaccatctaggcggaggcggtgccaggatgcacggcgcacttctctagatcacgtcgtcgccggtcaccctctcccctcccctatgggctccggcctctcgtgttccatctctccagtacccctctccggctctccctcatgtctgccgatgaggcgagaatgtagaggcgcacaggcgctgcgcggcgagggtgcggtcaagcagcgagggtgcagcggctggcgagggtttggcgcacaggcgcggcatcctatgaagggatagatgtggcgtccggctgcccgtggcggcctcgaggggacaggagcggggccggtgaggggacaggcacgacggcctgcttcacgcactgacagtgagagtctgagaggtataacactatttctcgatctatatttctgtgtatatttatatgttgtttcatatatttggtagttttacattccgatgatagagaacattagaacaagatttgctgatttgttggagttgctactcactgtggggccccgcaggggccgagggcagggattgatttgcacccgcatgtctactcggggctggggccgggtggagagtttgggggtcggggtcggggccgttccagcccaacccgcccccgccccgccccattgccatccctagtcattggcttgggcctgggccagcagagccaggccggtgttggctgaaccttagcagacttccctagcccagtgcttcctcctgggcattgtttgatggatcctcagcccagtggcttggtggttgggcccagttgcagaagtttcaatggggttgtgggcccatcgatccatatgtcaaccatatgtcggtctctgattgatttaaaggtgattttccatcatttctcctccatttatggtgtgatctcctgtattcaaatactttgctaagtacaagtggaactaaattatttttaaataaatatgcatgcaagcattgctagttccccattattttaggatgtattgatggttgaaattggtctacaatgaccgtaaacgattaccaaaaatatttatggcattacgaggtgggggacattaaaagcaaagaacacatgtctccaaagaaaacaaggaacaagacacccaaagaaaagatgttggattgtctctggtgcataatggaaagaaacaatagtgtttgtctacccccagtgtttttagccagtttatcctttgttaggattactttgttattaaggaaccacattagttttaatatacctttaaatctcatataatccacttgccaatcctaacactagagttcatggttgcgatatacatagagctaactaaaaattgtccatttttcagaattgaccattcaaagtaatccttgttttgcagggttacgcgtgtatctctagtcggatatgtaggttgtttgtgtatcagctagtacccgtattcttcataagagggtagaccaaatttattctattgaaattacgcagcgaaaattgctttttttttcatctcctaggtgtcgtgcagccgctcctaaattagagagaggaactctgaatttctgccatagattgttcttgcatttccttgttatgccatagattgggaatttcttgcatttccttgcaaggaattgaggggggcaatagatccacttgtttgtgtggtcgagtggatcaacctatcatagcgtgtggtttcacgaattttttattgaaaggaatgcagcagaggaggcccccactgttaaaaaacttttattgataaaggaagaaagagaaaaattacaacaaactgctccagtttaggattacatccttatctctttcacttattctaaacagcaaaaggaggagatcacccttgaagatttgtctccatgaagacagggaaggagttttttgttcaaaaatgaaaccattcctctgcttccagatattccaagcaccatacaagaatttttccatgaagcaccgaccctgatagagagtgtttgcctgaaccatcatactatccatgctcagtgaagtatcccaggagaaaccaagagcattccaacagttctttgcaaaggagcattgaaagaagagatgaagcaggtcctccatagagttaactgagtaaagcacacaacttaagtcacaatgaggtggagcacaatgattatggtccaatacattaaaccgagatttgggacctatatgttcattttacatgtttataaacctagatgacaccctggtccaagtttaaggactgacgacgtttattcaattctggaggtggcatcggatttaattaatttgatacattttatcgtttatagtaggatggatagctacaatgtgataaatagtataaattaatttcgaaaatatgttcgatttggcatcag

SEQ ID NO: 104087 - DNA, 1055 bp, Oryza sativa
agaggagggtgagagagagagagagagagagagagagagagagagagagagagggcgagggagggaggtagaggggagagagttctttgatcttggtttaaccatgggcaagtcaccatctgtcgggatcttagacgacgatgatcgtgatgaagtcaaatcttctgaggaagcaacaaagaatttgcaaagtgacgacgatgatgtggatggccgaccaggttggcttccagatggctggataatggaggtctattgtgatgatgatggcaccatctaccgggtattaaaatatgtagatggcaatctatttctttcgtggaacttaaattttattgtttgttctaaaagatttttgttgcaatgctaattttgtttgcttttgtacagtattacatatgtcccttgtccggaaccactttcacaacgaagtcagaggttttggattatctattctcagagatggatcagtgtttcttggaatcaaagaaccatgctgtaggcagtaaccttacggtgagttatatatatgaccatatcattcaagattttagttggtgtttagaattagtacgtctgagttctaccatgatttatgcagaggacacatgaatggcttccaaagggctggctggttgagattagagctggtggagacaacatggacaagatgtacaaggtagcttttgattgtattctatattaactctatactaattcgtctatgtccactagtagtactctaatgagacaatttatcatgaaagcttcaactgttgaatgcaacggtgctaggaaattaaaaacaaaatgacaaaactatttttgcaaatgtcccccttgtattgctcaagtggtccataagttaaatcatatgtgcaatacgccagtagggtgtagttcacagaccgcctctgtacagacaagctcgatggtaaaatgacattcaaactaggacctacctttttacaaattataaaattgtttattttagtatgttgtaacaaagcaaaagattaatttcatagtcactacaatacagggtgccccattcg

SEQ ID NO: 104088 - DNA, 524 bp, Oryza sativa
aattgcacgtcggtatattagaagaaaacagggttctggttacacgacgcaaatggctagaaggccattgccaggggattggaaaaaaagatttgtctgattttgcagtttgttctctagttcagggaaagtatcaaaaccatggacgtacataagcccatgcatttgaccatctctagtttagttgcaagtatatatctgtacatggatatccctttttagtgttactgaattcagggaagtgaggttttgtcaacaatatcattaagaacgctggcagctagccctagctttttgtgcaacatcacaaagctctatgacgaacattgtcgtaatatttatactacctactgtatttgatattgtcgatattgtcagtttgtgactttgcagtgtaccaagctaggaaacttaattacgtggcaaaataaactgaactacatgtctacatgtgcagtgttcttgtcagtcaccccatgcaagcgctgactctccaacatgattagaccatgcacgagtcctta

SEQ ID NO: 104089 - DNA, 674 bp, Oryza sativa
tcctagtttggaggtttgatctgtacgaccggggttggttgttcagatttggttgggccagtgcagcattggagtgctgttcagtgttgattaatattaatgattaattattctattgttttactactcttaaatgttttgataaatgttgcttttgtaaaatgaaccctatattatgccatcctttgttatccatgtgcacttgcatatttgttgtgtggcttgctaagtattccatgtattcaccttgcaataatcaatcgaacctgagttgaagaaaagttgtgaaggacaagacgtttagcttataccttgcctgtgggagaggagctgaaggcattgctagaccgtttatccgctgctgtgtttttcttttcttttgttagtttttgtaatgttattattatgatggatttgtatattaaaatgtcaatttgtgtacctcggctgattcctggataaggattttatgcacaaattagtttggaaattactaatgaatttctaggcgtgacagttgcatgcatgaaggatactgtttggaagagagattgtttggctggttgtatgatatgagtgtggttaccttttactttagttgggtgagattatctcaacaaattcatatgaagaaattttaaatttaattgagtacttagattgaaacaacctat

SEQ ID NO: 104090 - DNA, 1137 bp, Oryza sativa
taggtccttttctatatttgcataattattcaagtaccaacttaatttggtttacacttatctcgtattaattatatggttagcttgccagagatatgcaacggtattggcatagtgttcacttatttgattgttctatgtcatctgcagaggtgtagagtagtatttactaatgtaagcatggtgcttagattattaagtatcattaagtggtgctatatgccatggatctatagaggtaggccgctgatgctgacagttcagtacgagtaatcctccacgtgcgtatatagggctaagaaaggttcctgttcgtgtactcctccgtatgtaaaactggttggatagtcatgacggattgtcgtaaggtactcggcaattaggggtggtttctcgatgtaccacatagttgtacaatagcaagtgtatcgcaaaaggactatatactagaagtacataaatgatgcttttcttatttcttctctacttagcctagacttataatttagtgagagtattctaaactgaaccttctatgtgtcaaatctatccttatcctcaattgataaacccatgcgtaagactttgatttgcataagtgtaatatgaatttatagcacatcactctcttaccatatcttcccttgggattaaataaatacgataacttggaagtacttctaggtgaaacgctacagcagtatatccgtgcgcttgcagatttatttatgtaatccattatattaccatttaatatttctagcaacattgcttgggattaacttcctagtaaagaaatatcaacactaaatggtttagaagagtacctaggtccatgaaaaatatgatattaattggaacaagtgctttatgttggtcaatttggtggtgccgcaatgatagttctcaattgtaaacaattgtttaacccgatgcaagttatctttatgtcttcctattagctctccttttggtttactatgctatcatcaaaagagcatagtacaatgcacaatggtgctatatatactcttgaaattggtagccatggttctctgaatgcaatatgggtggcatagtttcattaaaatttgttggctaaactatgtggtttaacactagttaataataaggagg

SEQ ID NO: 104091 - DNA, 1057 bp, Oryza sativa
aggacagcaataacacaagaactaaatgcataaataggttctacccatacaccataaaccgacaatattaatatctaggcaatgcatgcatatatatacgtatagattgcaaccaaatcatttttagagaaagtataggttctatatgcttaggtgcttgccttgctgctgtatggaaacacactcaacctcagagtctcgctccacgaactccgaattctccgaatctaccgataagaggcaaatatgcaaataagattcaaataaacatgcatatgcaacatgctctataaatcatggcctaattacagtaggtagagagtatgataaactggttttagaaacaagaatcatttcatttacatttgtggtttgagagatataaaaatgacaagccatatacactgaaaatggcatttctgtaattacatatgaactacccttggtcatatgaaatgctgacattttctagttagatttcacaagtgctatcatttttaattcaaaaatcataacccactggttctaaaaaaacttggcttactacatttggagttaaaatatttagttatgaattttacaactttaataaaaagaggattacttaatcgctttagacttactttaggaggtagttttgtcaaattattccttttcagataaaagattatatctttataaggtaaccaaaagtggtttcataattttaggatatagcataaagttcctagagattatacaactcctcggtgcaaaaataagtgtttttatgaaactcacaattttagtgactttttcagtactgaagttgtaatgttttaatttacaaacataaagactacaaaattatgaatacatagaaatttggttcactcgaaaatgagttaagatgaattagttatggatttttgaagttttcctagttctcatatatgttttcaattattcttttggactgtactttttcatgtcgaaccctgggatttgtaaaacttgcaaccaggtccaggttcttctacactcgagcaggaagcagcgacagccatggctgagctcg

SEQ ID NO: 104092 - DNA, 674 bp, Oryza sativa
gaaatagctttaaaacttccaacttttactaaggatataccccgatttccacttaagttgattaattaaaactgcaggatgttacaattttgtgcgatcgttatttcattaacgacagtggcattgtgccatcgttatttcattaacgaccatggatttgtgtcatcgttgttttttttaacgatgacaacactgggtggtcgttattttattggcggcagtattatcgtttactaatgacagtggtatatttagattcatgatcacattcacaggaataagatgttaacagactaataactgaaaattattaacaaatctttattgatcaaatgcaaataatttaactcatttgttacataattggaaatgtatgtacataatctaattaaatttccgtacaactacaagagagctatatagttttatagtagtcttcaactaaaggttgtacagctcttggcttgtttcatgcttgttgtgagccctgcaaaatacaagatttcaacaatcaatacataaatgagctgtgatagcaatatagagttacaacagagcatatagctcagcctgaataagagagcagtctgcatgcttctgctgtgaataagatactgatctaacagcaaactatgataaatgtaaccctaacatgtaagttgggctgcaggaat

SEQ ID NO: 104093 - DNA, 2864 bp, Oryza sativa
catcaactgtacactttggtgatccttgttattggaacacactctataggagaatccgacatcacacacttggttttggatgtcttgcgacaaaaagtccaagtgtggggggaaggtcgacgagcaaaatgacgagttccatcaaccaaggccatcttggtttgaagttggtgttagtcctagcttgctaaaaaaaaagaaaaaaaagaagataaaaaaagaggagaaagtgagacataagaaaagaagaaaaaaaatgggagaagaaaagagcaagagagctgacgagctacatttggatcaaacaccgcattatgtgcatgtctttgaaatatggctatgcaccttgcttgtagcaatcatgctgcctggctacacctagcccctctctcgagctcatgtgccgccttggtttagcctttgtcaactcctagccgtgcacagcttcttgctcccgcaacacctacacgcatacaagcaagaggagatgccctcttcttttctaggtgtttgctgctccgctccaattggcacttgcatatttgctcggaaatagatgcaccctacatctctgtgccaacggaacgggcctttaaggaataaagttcgtgcaccagaggtgtgtgcataaccaacccactcgcctgagttggcatggttaaagtgccttcctctgctacaatccacatcaagacggaggagagatcaccaatcatatgtgaccatgacactgttccagagattccaatatatctatcatgctggcaggtaagtacactcaggtatgtggaagataaaacaaggttcaccaaacctttactcatacttatctctatgtgaatatggcttgatcatataggttatgcttcttatatccattttttttgtatgacatggtttgggtgtattatcgatgtacatccataggctttttaaattaagcatggtacttaggttaaaataagtctgtttaatcaagttagacatggtgtcaaatttgattaatgaaccatttgagctagtacttccatggatattagatgtatatcttgtatggactaacccctacaggggaaagttttcaaattgacgggtgagtcctcgtgtttaattcacactggagataagtcagggtccgacaaacaaatcaataaattgcaaacatgcaaaggagtaaaacatcgcatgtcaaggtgcacggtgcatatattactaatcgctccttcagcatgttcatgcaaatttacctcagctctgtatgagttgtgctaaaacgaaaatttggtgaataataaaaatttgaaaaaaaatgtttcagaataaaatgttggcaaccttatgggatccacgcttcttaagtttttgcaggaaataaaatgttggcaaccttgtgggatccacgcttcttaagttttgaatgcaatttcattttagcgtggatttgaacaactaatttcgaggctatgataaaatcttttcaaatctttatagtccctcgggtatttgttatccactaaccttttgcctgaaataaaaaggcaatcaaggagcagtgtacaataacttcaaacacttatatcatgctccttatccacgagaaaagatatgcacattgaaccaagtagaacaaatgcaaaacttgttgcattcttgcattcggctcaaatcttggtaagacctatctggtaagaatctcatacaccatgtgcatcctcatctcatgtgtccatcctgccaggatacccaccatatccattgttgccataaagagataaaataaaaaaagagaataaaaaaataaaataaagttggctccttggtcttccaaccaagtgagtcatttttgcttcactcgtgtctttgtttttctttttgtgtccaataaagagccaatgtacaaagacaagtgtgggggtgatcttgcacatcaacgccataaccaaagcaagattaccccagaagtgatgagccatgacgagccaaacaagggaaattgatgcagtcagacccaatgaatcatcctctgttttatacagagccaagtttgcacaatttttcctttggacatccattctatcttgagtttaatttgattatcaattctaaaatatcgaagataattaaactcaagctagggatggtgcaattagagttcatggtctccttaaaaatggcatgcatgcctattattctttgctcatcacttgttgcttgtggtgatatatccaatagggaccccatgctatctgggtaattgatgaatgagatatagtctgatgatagaaatcctactcttcatgttgcacacatgggaattttataaaaagaaaaaaatataacgatgctaaactcctcattgatattttgaattccgactagagccataggttgatcattcataattagcttgctacatatgctgctcgtcatttcattgagcgttgtcaagttttgtaaccctagtgaaatgcttttcatactttcatggtcaagatcacatacactccgcatacacccaccaatgcttaacttctacactggaaattagcatttctcatttaccattcacttcatgcatagtccatcaaataaatattccatgtcatttatgcctcttcctccaatgttctttcaaaaaaaaagtgagagaggcatggctatgcaaaaagaaagaaaaaaagtgctcatacgagtatggagcatgatgatgagaaaaaaaaggagaaaataaaaagatagccatgcactctccaaaatatcaaaagaaacaaaaattataaatggaggaggagatatacaaaaggagttattcttattttcctttttccacccacaaattcaccatacacatacacatgcacatt

SEQ ID NO: 104094 - DNA, 1234 bp, Oryza sativa
tgtttgtagagattaacacaaatagaggacaatcgatggaaattaacagaacaatcaatcaaaatccatcgagaggtagacttatggtagataggactctaaacccattaaaataatattaaagggcccaatcactacacaactagaccgaggaatcaacgaggagcgcactgaccaatttctaggccatttgggccaggccagggttcggccgaaaccccccccccccccccccaagcaccgttgatctccccctttggcacggatgtccaggatgcattatcaatgaaggttggagggcatttccggcatttcaaaccgtcgtaaccatcattgaaaagctatatagaagggtcacctcactcactccctcacgcactccaagaagaagatcattgttggtatttcttacgaccacagataaatccgcaagtgcacggaataccgctgtagcactttaccttcaggtgaccctaaaaggatatcaaactcatggaacgtgtgtaatctacctaaggctaagactatccaaggaccactattggtagtctagctaggctaaagaggactttctatgtgttttaattatctaaagtaagtcgaaggtaatttcctatctattgcttcgggcatcgacccctgctagtctgctagcatggttccagctatagctctatgatgtacccgaacgtggaggattactaggacagggttcagggctgtcaccacctgccgtctacctctgacaaatccgtgggatacataacaaacaaaggtaatctctaacctagacatcatgcctaagttattaattactactctaatacttgtgcagtaacttccttgtttatccagagtcctattactggagcacttactatgaatactcaacaatgaacccgcaaagatagaaatatatcttacttgaactaagtaattaaataacataagaaaggatcccgaatgcttactttatagaaaaagtttctccgaaccttgagcagagtgtaccgacagctccactactcctccagaattcctcctagagagctacactcatcgaggtggaattcagagagagcgccaaactttcgggcactcctccagagcttcccctcaccctctacctatttctaatgtataaaatatacaatagagcctcttataattcagctcaaagttgagtgtgggtgtctgggtgaagtgggggagatgagctctatttataggtgga

SEQ ID NO: 104095 - DNA, 587 bp, Oryza sativa
aggccacgtgggcgattgcgtctgcctcaagcctctggtcatgatactcctggtcccatatcaccgacaaatattgtttaatacttaactgttttattaaattctcaaatgtttgctaaatgctgcttttgcaaatgaaaccctactatgccatcctttgttatcatgtgcacttacatatttgctgcgtggcttgctgagtatgtcatatactcaccttgcaatcattcattagaggaagagttctacaatgatgctgatggtgtggaggattaggtgtagccttggtcaagctgcctgtggagtggagccgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacaagggttcacacacatgtaagcgtttggaattttggatagaaattccgggcgtgacacctaaatagtcattaaagtttttattaggaaaagtgatttcataattcggggggctgcaggaa

SEQ ID NO: 104096 - DNA, 787 bp, Oryza sativa
atttaaattattcatgaaatgcaattccatttattaaaaatacttccttagctcaaataaatcccagaaaaatctaggaattatagaattaagcaaagtatttaatgaaattttatctggccccattttatattggaatttattaattaaaaaaaattagatcttctcttctaggcttttaaaaataaattctaataattccaattaaacaacaatttatatattaatgattttcagggtgtgacattagataacatacacgacatgaggggatatcccctcgaaatagtatgtgcatgtcacaaattttaacacatttgttaatccatgcaccaaaattcctactttaaacagaaacttcatgctgaaatccctcccactatggctccatcctaatttaatgatccacaccaagaacaaggacaacaaaacaatgctccgttgattcagtccaacaaaaaataattcactgttgcatggcttgaaaccaataaaaaataattttgattagtactttgttagatgatgattatactaggaaaaggggtaaactacattttttttaagacgaatacaggtgctccacaaaattagcgtgaccatatggccaaaatgacttcatgccttcatggacaacaaggtactacaacgttggctacttgtttgctctgtaatctgatcatcttggcctcaaaccagcataggatgacgtcggtgagcagtccgcctcgcaccgaggaagacatcagtgagcactgtctttgactgcaacgaagccttcagcaca

SEQ ID NO: 104097 - DNA, 586 bp, Oryza sativa
caaaatgaaacccctcctccatctcatattactcgctttaagtttctgtttgtaacgaaaatgtttgatcattcgttattcactctattatttattttgtttgtgacttactttattattaaaagtgctttaattgaattatctatttttatatttatactaatttttcaaataaaacaaatgattaaacgtcgaagaaaaagtcaaagcgatttttattatcgaagaagatagtacgtcaatagaaatatttttttcaaaccatcaaaagcgtttatttgcattggtttttaaggtgcgggagatgttattggctttgaagatgccggagatgttatttccggttgtgtggtttagaaagacaattcaatgaggaagagtcaaaatagactttttccctccgataacgtgggcattcgtggtgggccgttatgtaaatgggccgagaggagtggtccgatttactacaggctataaaggaagcaaacctactgctcgtgctcatcgtcctcgccgtcgattccctcctcctcctcgccgtcgtcgcaggccggcggctgcggcgggcaggcctgggctgcaggaa

SEQ ID NO: 104098 - DNA, 555 bp, Oryza sativa
ggcccggcacggtcgggccggcccggcacgatgggccggcaggccaggcccggtacataaagtatggggactaaaaatagacatataaatgtaactgtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatcgtgccttcgggccggcccggcacggcccgaggcgtgttgggccgtgcctgggccgtgagtgcggcacgtgggctggcacggcacggcccggtgcgtcggtcgggccgtgccggcccgacaagcctcggcccaggcacggccgggcctgggccgtgccgtgccgggcggcccacatggccaactataccagtaaccatggaaccttgtatgcagctgattattccaggtacagtcatcgatactacacatatgcatattgcccaatatttatgaatgttgctctactgttcattgcc

SEQ ID NO: 104099 - DNA, 733 bp, Oryza sativa
cgcgtgcccttggttaaaaaaaatacttgaggctattctctcgctaacaatgtgacgacctagcgaccgagtatactaccctgagggagtgtgagcgacaagggatgggcatgccgccaaagggtggtttcttgcaccatggctgcaacaaaaccaacaaccttaggccataaccgtatgcaattgttgaatacacggttgttcctttcgttccaaatggaccaagcatcaaggtgtacatattattgtttcgcaagttcaatctagctaatggattatgaaggggtgtaactgtgctacaccaacaggcttgagctaatcttatcgcatacattgccataactaatccaaacttcaaatttaagtgattttatacctagcagtttgaaaaaatagatgtctcgaaaaaagaaagaaaattgtagcgaattactaaaatattgtcgcatgtaaaatggatgtcctaaacaatactaaaaccacattgtttgttattggttattagccgcaatcaaaatttgaattttaaagtgaatttagaatagattttgaggctttttatcatttttcacatgcacatatatatgaaagacaattttttttctaattaataaattgttttaaaacttattaggtcaaacgatgaaactagtaccatacagtcatacacaaaaatgctatcaggattcaggacatctgttacacacagagaggcattcaatggctactttct

SEQ ID NO: 104100 - DNA, 601 bp, Oryza sativa
  unsure (1)..(601): unsure at all n locations
cggaaatggnntatgtgcatttgcggtgcctttaagcagcgaaggtcgttgacttcggtgagtgtgcattgaaagcgtgtatagctcaatacgatatataatcagattaatcacggaacacgagcgcatcggctcgatgtctatctaatcttacaacgaatctggataaagatatatccagattcatagtgggtcggctgttttgtaccgccgcactgtcacagccgagaaacaatatactgtgtttgttggctgcaccacagtgaaaataatgacagccgaatatagccagtattaaaaatatgtcacatctagaacttggttgattttttataaaatagagggagtatttatagaataaaatcaggagagaatcaattaataacccatcaagagaggaaaggatataattcggaggatgaaatatatcctaatataatattcttntgtactaatgatatatggacacaattttttttacacccaccattaaatagttataacaaataaaaaataagtaacatcaattgggatcatataaaactataaacaaacatgcaaagcatctagatctagcaaaacagaaacagggctgcaggaa

SEQ ID NO: 104101 - DNA, 616 bp, Oryza sativa
ccttgatgctgcccacgcgggagaagatctggaggaggatgtcctccgtcagagccgccatgtcgtccatggcctccatctgcgactgcgattcctgatgcgtaggcgcaaaggctggatgttaggatgtgaatataacgcgttggatgaatcaaatcagtgttcgcctctctcatcaaaacctaggttcctccccataaatcatcacaaaaatacggtatgatttcagcaggagagcgagagttcagtcacctctaatccgtcaaatccccgaatcccccaaaccagcttcgacaagcggcggcggcggcgacggggagtggcggcgagttgcggcgcggcgtcaggggaggaatgattggggatcgggggacggggaccgggaggagatgacgattagggaggaagcgtcctgggcagttattgggccggtgagtcgggaggaggcccagcagagtattaggcctaagaacgaggtattaggcccagcaaagtatttacttatgcagtatcattatatcttctagtatttacatatagtatttcttttcaagagaaaaaagtttgggtgaattcctataacctacacagtgtccgctcctgaagggctgcagga

SEQ ID NO: 104102 - DNA, 597 bp, Oryza sativa
cctgcagcccaaatcacacccgtctcttttgcatgtagaaggcacacaggtacatttttttagataatgacacaaaaagaacacaaaaacatatttctagtgagacacccaaattgatagtagaaagatttcattgggtggatactgcataattgcatatcactaccaaactagtaagccaactatttgcaagactacttttgcttcttttttttttttgataaaaagaggccgcacctctcccgctttcattaacgaaaacgaaggaaatactacttttgctaaatggatacaataagaaatgcaaagtgacacttcacaataaagacctactgaaatctactgtcggcttaataacaagctgttgtaattttcacttgtgatgcctggtaaaactgctcatgcatcaatgcatcataactaagcagatacctccctcttgcaactttctttcttctttgggagaaaaacatcagtcagcacggtcttagacttcagggaagcaaggagtatctccagcgcctaaatttgaacacaaaaatcatcaaccatgccaattaataaaaaaaacgactaagatttttttttctttcactt

SEQ ID NO: 104103 - DNA, 596 bp, Oryza sativa
tcctgcagccctgctgaacaaaggatcagacagtcaaaaaaaaaaggaaaaaaaaaaggtgacaccaattaccaaaccttaataacacttgaagaatttatcaatgataataatatgctgttgtccttaaatcaaaacttacttttttttcccgcacatacccctattctacaattaaccctctttttctactgcataacatgagtaattttcgcggggccataaacatgtgtaatcaatcaatcaattaattaattgattatcctgtagatcacctctgctgcatagagccatagaccaccaagctggagcagaaagaactccaccaagtccatctcgtacggcacaggcggccgatccagtgaatggtccattcgcaggggcagcaagcagtccatggccttctccatcaccttcttgtcgaggtcgaggacgaacacagcgccggtgctactgtacatcatggccaccgatcccctgcgtcccaatccatgcgccatcgtgtaacttttggggtagttggacacctccgttggcatccaaatcacgtcgcggcgccacgccgccgcaccgtcgccatcgccatcgccgcgtcg

SEQ ID NO: 104104 - DNA, 740 bp, Oryza sativa
cacgaaattccacaactgcacttatattgggacagaggtagtaactatcaaagactcaagggtccaatatgtcacgatcaatcataaagacaaccttcttttttttaatgattagtattatttattgctattagatgataaaacatgaacaatattttacgcgtgacttctattttaatttttttcaaaaaaatttaaaaagacatacgattaaagttgaacatggaaacttatagttacacttaaaataagacgaaggtgtagttccattcgcaagatgattacgtcatcatttccaagctgataaagtcacgtctcacgggaaaaggattgatgtacaaaataatattcagaataaattcgattgaaatgtttaaaccattatggtccaaacaagaaaataactatgaacaagccagctgtgtactctttgtatgggggcatttaactatttgccacttttagatttaacatttaactatttgtcacccatatgtcaataactcattagtgcatgattaattaagtattagctaaatttatttttgaaaaatgaattaatatgactttttttaaagcaactttcgtataaaaattttataaagacgcatcgttagcagtttaaaaaacgtgcgcacgaaaaaaagagaaatgtgagttggaaaactcagctgctgaacacagcctaagagtcacggcaggctgtgaataaagagcagcaaagaagagaaggaaagctg

SEQ ID NO: 104105 - DNA, 522 bp, Oryza sativa
tccaaagtagccctaattcatcttgctatatactccctctgtcaaaaaaaaaatcaacctaggagagctatgttgattctttttggaacgaatgtagtttttttagataatggaagaaatattctggcctttgctcattagagttacagccaattattacaaggaatcacacaaacaacgagtgaagtcactactggagaatcgattattaacgacgggaaatgtggtcattaaaagcttaaatgtggtcgttaaagatcattaacaaccacaaaagtgtggtcgtcagtggttgttaaaagctttgtcgttaatagtactaacgaccacacaactttttttggtcgttattttattaacgacggcatttttatgcgatcgttatttcattaacgaccgtggcattgtgccatcgttgctttcattaacgatgacaacactgggtggtcgttattttattggcggcagtactaccgctattttactgatgacagtggtatatttagattcatgatcacattc

SEQ ID NO: 104106 - DNA, 677 bp, Oryza sativa
catcggctgtcccgttcaaaggacacatcaaattgttttgtttaatttagtgtggacaagtcaatgcatgcatacgcaagcgcacaaaaagaaaataggactatagcgtgtgttttctaatagaaaataggactacttaaccaaccatatgtactaatagtttttcctctactagctctaatcattacacactcacatgagatactcgtgtcccaaaaaggtttataattttattttgcaatttttttcgacgtgctctcatcatgttaatttgattttgacattaaagtttgtacttgtctattgtatatgaacatggttagcaacatagtactcatcaattgatcaagtcaaagtccgtgataaggcatgatttattgtttattaagacgtttttttttaaaaaaagcaccatagtttagttaaaaaaagttatttgtagtacgagtagtatttaatttgtgggctcaatgatatgatttgatagtatatatatacaccatacgacagcacccgatcgagatatgagaaaaaaataaataattaattaatccactaaggtagagggttggacaagcaattccatctagtacgtaattaagttgtatgttaatttcatataatttatacaacatttcactttgaagttattgcaaactaatttgattattaatttg

SEQ ID NO: 104107 - DNA, 2218 bp, Oryza sativa
ccaaatttctaagaccaaactcaacttcgtttggaagattaaaagaagacaaattctgcatgaaactttcctatcactatccgttcaaagtttgtatttcttgtatcttgcaagcaaatttgaatttggtgttgaaatcttgtggagatatagaccatgcctatacctacctctaatattttactcacaatttttttcatgattgtagagatcttttacgtcctgttttgagaggtttgtatctattattttcacttgatcctcttaggatatgtttggtagggctccaaatttagagctagagttgtggaggtgggaaaaggtatctccacccttcctatgtgtattacggagcagattcattgtagtagtgtttggttcggctccagctctactgaacaaggatctaggagttggagttctgccaaacaaccccttatactagtgtggaatatgaaaaatgacactattttgccttctggatgaattagatagatagtcaaatagtatgttaatgcagctatgtccaaatcgatttgaattatgtagtgagtttctccctccatctactttttatagtcatattttatcttagcacacagacaaacgataagtaattctacctatcatctagttaaacattctactagtcattcctcgtaaacaagcgattaattaatatttacatttctcaatactcatgtagccaattatgtgtagaagaatagagagtcacgcattaaatctgagaaaaccattaagatgataagttgttggattaaaatatgcctatcaaaaataaatttttcagatttaaaaatatgactatcaaaaatagatagagggagtactatgttttatgtggtgcaggtcggaagatgctttcagaagaggcatgaggaatataaggtttgtcattgctgttaatgccgctatatggtgttccaacatttactatatgatcgtcagcgctgccatggtgataagccaaagatgaaagtaggaacttccaggaaccatgaggtgggctagtttgtgttcccctaattgtgctttagactgcactgaacaactaaatattaagtctgtatcccttgaactccgtaccgatcaaatatggagcctggaatattttatttgttttatatgttgaagtgatacgtgcaatatatatatgtattattattacaaggcttctgttatggatattacagagagtcatctcggtgggatgtactagaaagcaggggtggtctgttttgtttattttgaatgaatgggtttattgttggcttattgtaaattgcatttcagcttattccatttttattcacccgcgttgcattttaagcatattatgtcgttatggttgctctattgtttttttttctaaattgggccctttcccttctatttcctccatcccacaatatcataaattttgttggacattaaacatgttcagattcgccaacttagattgttatattacagaacaaggagagtataaaattgaactttacatcattacagacggacaggagtataaaattgcatcagggagagacgaaagggaggaagaggctgacgagtggaccccacactgttttccacctaactttgccacgcggacaaaagtggcaaatagttaagaccatcttttaagaagggcaaaaaattaagtgtaaacctaaaagggtatttaaataattaccaaacctaaaagtggcaaatagttaaattcccctgtatcagcatacagttactggtttgtctctgcctctctgcacgttatcaacaccgttcgaggactttttttttttaagataataaatagataaaaatctagcctttggttcaacagaagctagctacattagagttggataacttaaggtgcttaattatacacaacagctgcccatacacattaccaaggataatcataaaggttggttgcatgtttctcatatcgatcgccggtgcttctaaacctcatcttcgtcaattcgacgcgatcatgccggcaacgaagtagcctgaaacaacggctgaaataatcacagccaagttcaaacgtctgtttgctgtcttgagccttaagttgttatatgtcacataaaggcaggggcagcaaaatgaatatagtcagcatatatatcatagaggagacgttatcaaagtatatagatagttggaatatgtatatataccctga

SEQ ID NO: 104108 - DNA, 555 bp, Oryza sativa
cctttggtgcttggtgtgtgttattaagtgcagttcattccattgtgttttatagtaaccagttccagggcatcactaccacgaactctttcctcatctgtgacgggttgtaaccatcagttccaggacatgcacagtgaatgtatttttggttcaaaaattcggaaccctctgccccaccgcaaggcatttttttggccgaaattttccatttctcaaacttttgtgtattttcccaaaatttattgaaattcagtcaagttgtgctaaaattttcaataatttcagtccaaaaattgcctaaatttcaggagtttttgtgctatcgaaattacccaaatattaagcgaaaatcgaaagtgaaaatcctgggcatgcaatcatacatacaagtcaagtcgtcggtgtggatgtacagttttgtgtcaactggaattaatactgcgtgctagttaatgatcaaggcttctcaacaaacaggcaagttgtccactagttaccactgtaacggccacaggacatccttaattatgcccgaaatccacgtcttactgg

SEQ ID NO: 104109 - DNA, 718 bp, Oryza sativa
ttcctgcagccctgtcttgagattgattaatattatttagtgagtcagaagaatcctcaagacctagggttaaacatataaaattcaaattcaaaaggaattcaaataaaatccaaaaatggagaaaataaaataaaatacaaaaatagcaaaaaggggctcaatagatagagaatgattttagaagatattggtccaagtttcactggaattggatctatattttgaaaatcaaataaaagtgaaatggcactgtgtgtgggtcccacctgtcagtctctctctctctcttctcttcttcaacctccggccgttccccaaaatcggtcggcggcgttagggtttgggattgcagtggcgctagagggagctagggatctctggcgatggcgagcggcggcggaggagctaatttgatgcgtggacggcctagcggctagggcggcggtggcacagttaggccgtgatggtgatcgaggtgacgagagttagacatggttaggggagggattctagagcatctatgaggtgcctagatggattccaacagcttgccgacctttggcaaggcgcggagaatacttgccgacaagcgcctccattggcggcggccgtgctcacgtcggaagcccagaaggtggcatgatagtgcaaaccgattgcaaaaatagactctaggtagtatgtagatggttgaaacggaagaactcaccgagat

SEQ ID NO: 104110 - DNA, 750 bp, Oryza sativa
  unsure (1)..(750): unsure at all n locations
ttcctgcagccccttttaatctgttgatgtatataaaaaaaatctgtcgaaaaggctacatgaatgggagtactggaattcaaaaataaatcttttcaatgaactttaggaagacgtttctaaaataacatgaacattggaaagttccaacagagtgcagtttgatataaatcctcttgccagtcacctgtacctggacgtccagtttgagcagtggagtctacaaatactgcatcaagagcaaggctgtcaaaatttaacaaaaagaaatggaagtcatcaaatatcaagccagcaaaacatagcgagggatgccactaataagtggaaaaattgctgtatatgttagagtttgtgtcgaatatgtgtatgtagtcggttacagtttaggacttggagttgtaataggtattatgactagagtatgagtcggactctatcttagtatttctcataaatagagggtcgtgcctgttgtaaccgcatggtgacttagcatagcgagagggagcggctgccggcgtcaaccggctgtgagtcgttgtaaatctgatatactgtatatgctggatctgtgaggagcgcccataatcagtgctccggagatgtaggctacggctgaactccgttaccaaatatcgtgtctcggtgtcgtcatcgttttggatctcctatggtgttttcttccgcgtttagctaccaatgtcgattttggggttggttntataacaagtggtatcagagcctgcg

SEQ ID NO: 104111 - DNA, 610 bp, Oryza sativa
cctactggctgcttccctctacgattgtatcgtacaatatctgttcctcatcgcgatcagccaactgttcatagaagaaatatttgctaagcgtaatattaaaactctactaatcttgtattaaaactcaaataatcatatatgctaagtctaagtgtcgtgtattagaaccctaatatcatatatgctaagtctaattaagtttcgtatattaaacctctataatcttatattaaatctctaacaatctctaacactcacatatgctaagtctaattaagtttcgtatattaaacctctaataatcttatattaaatctctaacaatctctaacactcgcatatgctaagtctaattaagtttcgtatattaaacctctaataatcttatattaaatctctaacaatctctaacactcaaatatgctaagtctaataatctgataatctctaacactcacatatgctaactctgataatctaataatcttatattagaaatctaacaatcttatattatatctctaacaatcacatctttacatcacttgcctgcgcgaattccttcgagggctagctaccacttcggcttgagggacgacgacgacga

SEQ ID NO: 104112 - DNA, 638 bp, Oryza sativa
attattaaaagattctgcctaagctcaaccaattagatcgaatgtagcctaagtaggagataaattagattatttactataaaatttaaaattaaagaatcaagttaacttcattattaaagattcattactttggatcatatatattttacggactagcttttgttcactaattcatacatttttaagaaaaaagcaaataagttttgacgtctttctcgctatttcttagatattaaactaaaatagaaacaatcaataatattggatttttttttaagaaacacgacacgcgcacagcctgctcctttgagtacctctaaaagactgagccaacacattttgagaatgacgatgtcaccacaggcgtctcgctgttgacgggtacgccacctaccattgaaagaatatttagccgtaaatgcgagcacccgtatcaagtctaggacttaaaccaggtagacaagttacaccacaagaaacctaaccaattgatctgtgctcacttcacaataacattggataataaaacaaccataatttttaagctacataactggaatacttttatgccttttaaaccggtgaacaatttgttataactgttagatctatcttatataaaagttaagcatgta

SEQ ID NO: 104113 - DNA, 1415 bp, Oryza sativa
ctgttggatgagtcatcgtcatctgacgatgaactcatcgctgcagcagcaatagttacacaagatgaatatgagcattcgaatgctccacgacatggttttgctgttcctggtagtcaggttgttcgtcgtgatcgtcgagcgggccatatgataggctgcaccacaactacatctcggagcatcctacgtacaacccagtcttattccaatgaaggtatgcaattaatctacatattttggttggtcccgttttgtgtgccacttctcttaattcacataatcttaaaaacaatattctttaagaaagctagacgctaactcaattaaatgattacataatcttgaaccgttattctactttaaggtctattaagaatttgctcataatacccatagaacttgtgaacttactcttgaatggtaccccaatgattgttaattgaattatggttacgatctgaaagataattactaaatttataatagatgaagtacttttcacaacaaatctacatgtactgtcttcataaattcagtctaggcatcataaaaatactgatgctaaactttgaaaaaaaaatggccacacatgtgctgccgtgctctgaaagatacttgtgggtcgagttagtgaaactctaataaaacagcaaaacaaagaaacaacacatgtatgcttgatcacttatttctataaacagaagaatataccgtggatatcattttgtcgaagtccaaaactaacaacttgatccgactaaaattaatgtatcaatccctggatcagtagatgttgatacatacaatataactagttcttcattgcatacgttaaagttttataatactaagggttttacaataataggtactcacctatttgattaactagaattaatatacagcggaagtttttatacattctgactagggaggtaaaacctttagggattctctaaattatcgtggtcatcgtagtaatagtcataggggtcctcctcttgacccaaatcttaaaaggggttatgagagcaagaatgagtattcacaatactcagcaagttatcatggaaatatgttatgcattagcatatagcagggttctttgcaaaaagcaataataaatattctggaagagttatagcaagaatttataatcatatagattttagatttctaaccagggtaccatatgagtcctggtactcaactccatgagtacggctattcgaatagtttcaaagatattctactgcagcagatgtacgctttacctgcagtccacgacttgctgataatcatcggctttagtcaaggcccagtattaagttattaacaattgtggcacctgttccatgaacttgtatcctcatatgccctgaacgtaatgttaatagcagcaagaggagttg

SEQ ID NO: 104114 - DNA, 718 bp, Oryza sativa
taggggaaggggttcgtattacaaagtacagaccatatccctaacggaataggtaattacagataaaatacaatcgtaaccgactaggatcctgggtgtttccttgacatacaagtttggtacttaacccgagtcctcttaaagatattctatccatacatggcaccccatacccagtcggactatacatgccgtgtaggtatagggtatccataatctccacagtagcccctgagacctttatagtcgacgaaacagccttctctcggaacgtaaagtgataatccgagtgcttcaatttctttcgtactgatctcccgagtaccaaaatcaaagactgtgaagggctgaaagtaaataattaggtgcatcgactagatgcacctaattaggtgtagcctccgactatgtgagtagctaaaagctaaacatattgtcaaagtacatcaaaacgtccattcgagtggtttttaaccaaatatcccaaggccaagcatatgcagcatctgataaacctcccgccgactgctttaatgtgccaaagaaatataaagaaaaacccgagtgagaagcactccaaaggtttataaatcaacacaggtgataaaagtccaagtaaaaactttcaaaagacctatcaaatgtggcataaaatttgataaaagacgagtcaaaatagcctaggctatgactcatcccataatcagggctgcaggaa

SEQ ID NO: 104115 - DNA, 610 bp, Oryza sativa
taggaaaattttgaatggaaggctttaaatagattttaaaggagataaaatttaaaagagggatgtttgagggtcttttgaacttttataaaaggaatttgaatataaggtttttgaagcaaaagggggattgaaatatttttaaaataaaatcaaagatatttattttgagatataaaatttgataaggggtaaaaataaagatgctccaattttataaaattcaataagaaccaaatataaaacttgtcaaaaaataatcaaatgggaaggaaaagcaataacttaatttctaactttggatgaatttgggatggtggcaaaaatagatggaggtaaataactaggattttagcctccaaaatatgtggtatggattctcagtgaattatttgtggctaaaggaaatttatattgtctgaatgaaaaggattggaaataggtttcttcgcacaagagcaatcactctaaatattgtgataatattattcttgtgccgaggaggaaatcaagccataagaattaaattggtggcttgattaaaataggagagtttgggaatattaaaggggtttatgaaaggtattgtataaagaagaaaaagggggat

SEQ ID NO: 104116 - DNA, 547 bp, Oryza sativa
gatgaataaaatcgacgggttttccgttaccagtcaacagggaccaatggacatcttatttttcatgcacattttttgtccatctttatttaatattgctctgtgcccttctgatatgatcttaatcaacttgtagaatggctggtctctatgtgtgattatgatgatctagacctaatctgttatgtctttataatatgaacataaagttattaactgcctcataataattataaatataatggttgataattgctctcaatgttgtgcgtgatgtaataccgatataaataatgatgattgatctactgaatcacaaaaccatttgccatttttagcattttccatttttattctatacagtgaacacattcctcaagcctgatcctgaatctgtacgcaacatcgcttttccaataaattacttaataaattaatcactaattaaatgattggaacgcagggatgccaatcaacactactgaatttgaaccgaatgaatcacactcgttacattataaaattcaagtacatgttttttaccatt

SEQ ID NO: 104117 - DNA, 609 bp, Oryza sativa
agagaaaagagatgcggaccccacatatttccttctcacttacatatggggcccatatattccacgttagcgaaaccgaagaagaattggatcgatactgctcgggacttttttttttttgcacggtttgtgatagttgagggctatagataacccgacgcgaagttgagggacggctgttgaacttattcctgcggataaggattactttgatgggctaaatcctatcgcgtgcgatacacggatctgatgtccttgcattttcagcccatttactatctagaagaggttgatgccttgatggcctttctctccccatggccacgatccgacgaaccctgttttcctaccacaaataggtcggatggccacagacgaattgtgacgatggttcgtggtagcatactatacgagtacacacgacgcatcaaggtagtggctatagagaggcacacgacaaaacgtcacagctatacaacaagagatggcaacaagcaacgccaatagatggcagagccgttgcctgctttttttttttctggccttggtgggagatgatacattagatacgacgagggaaaaaaaaaacaacaaacaagccaaccaacg

SEQ ID NO: 104118 - DNA, 732 bp, Oryza sativa
agagtaagctgatcccaatttgatacctgcagcccgtggagtctcatgaaaaaaacctcccctttttttatccatcgtcaagtatggtattgatttttttatccatcatcaacagtataatattctttggtttgtttccattatgtattcatcacaatgatcaaaaggtttgttagtgggggttgcatcgcatgaatcatgtagtctagtttgttagtggggtcctccgcgtcgctctcgcgcgtgcggctcgggggcaaaaccctagccgcccgcgccgccacccccgcccaccctaaccacctcgccgccaccggagctcgccgccggaaagccgtgcggccagtcgggaaggcggcggcggggccaagagaactggcaaagctcttcctcagcgcgggaggacggatcggcgcgcgacggtggggggctccggcggccggcgacggcaagggcgcggcggatccgacgcccctggaagcggatcctgcgaggggacgcggcgatgcatatgcggcggtggaggatggccgcgggagggaggtggtggcgacggtggcgatggggcggcgcgtcgtcttcggctaggacgcggcggcggcgactcatcccggcgtggaggcggcggatccggcgctgcccccgccggatccggcccgagacggcagtcggaggggagaggagcggatgctgcgcgcgcaatgagcgcggatgggcggtcggcggcttgtg

SEQ ID NO: 104119 - DNA, 1141 bp, Oryza sativa
attcctgcagcccgtgtccgcggtgtacgaggaggacgagatctacaacgtcgaggaccagccgccggctatgaacgagtcgagcgtgcatgagtgggggaggagagccgcgacgccgaggcgacccgcatggccgagccgagcagttggagaagcaggtgctgaccttcaacaccgccgcccgcgcggaggggagcgcctcgtgctcgcgcacggcttgcggctgcggtccgacctcaccctcgccccacgcgcggcgcgcctcgatctgccgcgtccctttcgacctcgccgacttccgcaaccgctcgtcgtcgccggccaggacaagacgtcgggatcggattctccgccttcgtgcgcgcctactcgcacttcctgggcatccgcttcctcttcgccgcacaggacatggaggccgtcgcgatctagcaatggcagcggcggaggtcacgaaccgagcaaggagcaacgacatcgacaggacttcgccacgacgcgtagacacggagggcgcggggttctccagtatcttcagcgatgggtgaatccgtggatcccaggtagatgacgatgagcagcgcatccagggccaaatcgttcagcggccaaactcggcgcgcgacgcgagtcctaaacagaaccgaaccgaacctaagctacttccgatgctgactcccgtttcttcgattaatctactataagtatcgcacctgagaaccacctcctgcaatcagcaaccagtgaaaaatatcatacaatcgcttatttgtttatttttttgaaaagaatacaatcgtttataattattcgcttatccctttcacagcattgagagatttcaggaaaaataactcatggagcactccaagcaatccatccatgagctccaggaggacggtggtgcagattccggctccggctccaaggctgaagcgaagacagatttggtggcaggcgggaataagattcaagaagaaaacaatgatagcactgcgttttgccgggggtgtcgtcgccgcctcatccggttcgccatcttgaccatccggttcgttctcctagcggggttgcaccgcgaatatttagggatggtggccaagtatcgtggaactggttagcgcctgttgggctgcaggaa

SEQ ID NO: 104120 - DNA, 713 bp, Oryza sativa
tcctcattcttgctcaacttcctctctttcttccaaggaacttccgggcagttgtgaattgctatttcaagcacctcacaacaagtaaattaaatcacaaggaagcctaaaccatagagaggtacaacatgtctcaaacaagagtaatacacatgaaaatacacaagatatcacaagtgatcatacaatgggagacatgatagcacaactaggcaaataaggagataagcatcacaatcacaaagataaagagagtgagaggagacaaatgatttgtttcccgaagttcggattctccaccgagaatcctatgtctctgttgaggagctccaaagagccgggtcttgattaacaccttgcctcgccaagaaaaggcctaggaagaggtctccggtcttcaagccaacacccctaggtacttctctttggtttcaagtgaccactaagatccccaacttaaacaccaaaagaacaccacaagtgaggcttgctctaccaagacgacctcctaaacctcacctctgttttctttcggaggtggaataacgctctcacaaacttgcccgggtcaatccacaaccttgttggaaacttgcgggcgacacctaaccgtctaggaggtcaccctccaagagtaacaagcttcaagtgatagcccaacgagatacaccaagtgctcaagtcatcctagccttcaaaagggctgcaggaat

SEQ ID NO: 104121 - DNA, 772 bp, Oryza sativa
tttttggtaataatacctagcccaaaatgaaaagttgtgctaccacccagttcatcatgcaacaaaggtaataaaaactagtccattataaaatttactcttttttataggacagagtgagtggagtacctagagggagtacctagtactcccttcatctacttttaattgtcatatttccaaatctgaaaattttatttttgataggtatatttcaattcaagaacttatcatcttaataactttctcggatttaatacgtgactctccattcttccatacaagattagctacatgggcatcgagacatgtaaatattaatgaatcgtttgtttacgaggagtagaattacttatccttcatctgtgtgtcaggataaaatataacaatcaaaaatagatggagggagtagcatcttgcaagaaaacagatcagtgctacctatggacgcattgcagcactcctagacaggctaaacctcccgtacgtcatgcttcacacaaatcttcggtcgaatctactcctatatgactgcacatgtgctcgttagtctcacacttgacccgagaaagaccagctagatacagtactactagtcactgcccaaggcatgtctgcgtctccctcttggaccatgtactagctccccttggttggacccctcggtgctgtgtactcactccgtcaaaaaaaaaaaaaaaaagacaaatcctactttccgtatccaatgtttgaccgtccgtcttatttaaaaaaattatgaaaaaaatta

SEQ ID NO: 104122 - DNA, 2526 bp, Oryza sativa
ttcctgcagcccttgaacgaacatgtctcagcgagcagtctagaagctgcaaacttgcagtgttgcagggtaaaagaacaacttggaatgcttgaacctttaagcatcataaattaagtttcacaaggtggttagggacaaagcttaagctagccttaggagctactactacgagtgttgtctaagctaagataagatatggcactcagttccactatgtttctgcttgatctaacctacaaatggcacaaatggcttctgaattctgcaaggttcataacccagttactactccattttacataaactttaccgaccaaatttgcagtctctactccaggcagtgaaaaactcttgtcccttgattagactgtcctggtaactcctgaagactgctgaacatgaggcttgattagagtaagtagtcatttagtagtagatttaaaaggactctgccggggcctagctgatattactagtctgtcctgttccgtaagagttaagcttcatgataagcactgataaattcatggacccactgtgttattactcgacgcattcaagtcgaaaacactgaaagggacttatgatcgtggaggactgtgggtaaggcttattcatggacaaaacttaaacagtcctagtagtgtttgtactgactatgctcgcgaaaatggaagtatcatgcttgcaatatgtgcgtggattaatgtgtggatatcctagataagaatccaaggccaaacatttctcatgaaacagacattttcttgtagaatttcgaggcaaatttcaacatgtttttactcaaactgaacagaaatccaactttcatcaactggtatttggaaggaacttccaactaaacaccaataatttcagccaaaataccagaatctttgaagcggtttctactatagcattttactaccagtataatcaccaataaaattatctcagtcgttgatatatgagttctagtagcagtaaaaaaaatctacatagagatggtagtataaatatatatgatctgttgaattagaaaaaaaataaacggtctaacttaattctactttcattaaaaaccattgtaaaacatctcgaaaattaaatgtggtttaacagctttttaggtttgaccatagtatataaaccgtgtctagcttggctgcacgacaatagcattcctacattcgttataaaattatgtagtgtgcgttttttaaaatctgatatttatcaacatattatgttattatgtagaaaatgggaattagtggtcaaatagtgccttcttgaccctagccgtgtttagttccctgtccaaatttttttaaaatatatagacacacatttgaagtattaaacgtagactaataacaaaataaattacagattccgtctgtaaactgcgagacaaatttattaagcctaattaattcgtcattagcaaatatttactgtaacatcacattgtcaaattatggcgtaattagactcaaaagattcgtctcgcaatttacatataaactgtgtaattggtttttttcgtttgcatttaatgttctatgcatgtgtccaaagacataaacatttgatgtaacagaatttttggaagtttgaaaagaactaaacacacagccccctgtcaatgtgaccaaaataattactaatacttgccgcagggtagagtacgtgacagcttgataacattgcaatctcttggattaaaatcatctggtaccgcattactccaaagaaaccaatggcatgaaggccacatatttatgagctgttggtgactcattaatatatcccagataacctgcattgccttcatggacctgcagaccaaggaacagggtttgacccatcattcctctgaatcttgtcatcaaaatcttcacaaaattgtgataaaaattgtcagccattgaaaatttgacatcttgacccacactacgctaggaagagagatcacagcagagcaaagtgatcaattagccatctcagcattaattaattaattaatctacactaatgatcagcatcaattagtttttagcaactgtacaataattccctcacttgccattccttcgtggaaacacaaaagaattagcacccaaaaaaagagaaaaagagattgtcatctcttgatgaggctaaagaaaaacaaaacgtggtcgtcgtcttcctcgagaacagcttaattagctctcctcctccatggtcgccgacgagtagtcctcgaaggtgatgcacgacgacgagggcgactgcgacgggatcggcgaggacgcgaggctcacgagcatgtcgatgaaggcccccacgatgacgccatggacgcccttggcgttcagcttgaggtaccacgccaggagctcctccaggccctcccagtcccgcagcccgtgcgccgccaccatgtccgccatcgacgacctgaagtcgccgtaggggtcctccgactccaccgtcagcaccaccgcgccgcccttcagcgcggaggcctccgccgct

SEQ ID NO: 104123 - DNA, 1138 bp, Oryza sativa
ctttcccaagggaatctgcacacgattgcacgaggcccctgcagccggtctgcgcatggaatgaccacccaacacaaaagtcgtccgattgcacgttctctcgctcttgtcctgttgcacaactgttgagatttttcacagtttcactttcacaggtcacaccgtcacagctactgtaactgcttacgcatcgctcggaccagcagcacaaaaaagttaaaacaatggagcgagcgagagaggtgatttcaaaatggggtaccgtccaggagggaagtaaaagctttttgataaagcaagaattcacatatgctgcaacctaacgtggcgtccacagtgtgcagtgctacaaaattgagcgaatatgcatgtctccgtaggctttatggaagaaaaaagaccaatagcagtgccagttggtgataacacagtcacagcccacaatgtctgatgtcagacgactccgtccaatgatctccgctttgcaaaaatgcaaatttcaactcgctgttttcaacacaacaacaagggtgtgctcggcaccctttttcccaactcatctctctcgtttttcatgcacacgctttttaaactattaaacggtgtatttttttaaaaaaaattctatatacaagttgcttaaaaatcatattaatccattttttaaaaaaataataaatatttaattaatcgtgtgctaatgaactgctctgtttttcgtgttactgttccggatttggaacaagcatatgcgaacacaccctaagtgcaccaatgagcttgtcaagactaaaacaacctgttccagtaaaaaaaacagactaaaacacctgttgattttctttttgaaagggtaaaacctcttcctgcagtctgtggctgctcaaaaattcctgtggtacgacacaaaaaggttgtatttcatagatataatgcaaataagcggtgacgtactgacgtcctaccacgaaaacaatatgcaactggacaaaactgtatggtcttgggcaaaactgtaccgaaatggcattcttcttcctctacgttggttgccattaccccactgtccatccacgctctgcaagcacttcacgaacccgtgccgccacatcaatggcatcgttcaggggagggtagc

SEQ ID NO: 104124 - DNA, 699 bp, Oryza sativa
attcctgcagcccttttattggctgggccattccttttcagttgtcttgtcattaaaatactagaatacagctagagacactgttgttttcgttgattgatgaataaaattgacaagtttgccgttaccagtcaacagggaccaagggacatctaatttttcatgcacattttttttccatctttatttgttattgctctctgcccttctgatatgatttgaatcaacttgtagaatggctggtctctatgtgtgattatgaagatctggacttaatctgagatgtctttatcaagtgaacataaatatatcagcttggcaaagttgactagagaagcaattaaggtaggttgctgcgtcacacagcacgtatttcagatggatgtatattatgaagagataagaatgacggatgccaaaattaatcgctattcattgcatggcatcatcaacagcgtttttttcaacaatttcaaatactatatctcgtcctaatttgaaaattgcatacctttttcaattacataatgtctttttcagagatagtagagtgtccatggaaggcgacctcattatgttgcaacgtgggagcagcagtaccaattggttagttcagctaacctgtgatgacagactcgtaaacatcccatttatgtgattgactgttcttgctgtgattttttccccattttctatgct

SEQ ID NO: 104125 - DNA, 678 bp, Oryza sativa
attcgattccatttttgaattcaggattttttttattgtgattcttaaaaagatttgaaaacgaaagcggtaaaggtggtttccatccatttctgagtcgttttcgccccttgaaaaacaacatattaccccaatctacgtagttctactggtaaataattcatacttgagtcatattaagtaaaaaccatcaaataaaacctatgaaaatcaaacataaaagttttttaaaaaaatattagatataggtatagtcataaaatacattatgtctaaatatcaagtctaaatttaacttcgtttgagtgtaaaaaaaaggatgaatagtatcagggtaatattcacatggaatttgtccctttttttcctcttggagatcggatttaagattttgtgtaaaataatttcaaaactataaccatctctgcatttttttttcatgaacttagagaaatttagatatagttttcatgggttttcaattaattggtggtttttattgcacgttttttcttggtaccaccagtcacccaactcaccacgcgaagctccatggccgcctctcctccccaactcgccgccgccgcggcgatcgcccccgactccgtcgacagaattggttggtgacctggtgcaccgtccctttgtaagtatctatctcgtcatggccttcgcatg

SEQ ID NO: 104126 - DNA, 716 bp, Oryza sativa
agagtgactggaactcaatgattccgcacccaatcgcattatatccaactattttgcattggagctcattgcctttgcaaccacaacaagaaggcgcgagaaaactcagtggagattatttttcactcataatctctaattaagctccttagatgccaccatggaattaaagaagagcacatgggtttggcccccatacaccgactaatggcaatatatacgtgcaaagatacatttatataccatatcctgtactaagcaataacctagtggcacagttatgagctcgcatttgggtcaaccttgccttcatagttgccttcaactccgagactttacctgcaattttagacgcatcatcgatgaatcatgatgaatggtggtgaaatattataaaatcaggtaaactgaactcaaacctttgatcccgaggccgatagcgttggctctggatcccaaaaccatccattactgcttctatttgcccaaaacgggagcattaatgctagaattagtcctaactgaggcaaattattttctctacaggtggctatctcttaaccttgatgagtagcagcattgaccaaacccaatgcaacacacaaaccaaaacaactttaagtgagttgtatgtcatcatcattaatcaaggtgggatatgtaagcaatctcggggattacattagtgggttgatactagtatgactttacaaagg

SEQ ID NO: 104127 - DNA, 674 bp, Oryza sativa
ttcctgcagccccacatcagatactgatcctgccaaggcaaataatcagcaaccttttcccccatgtaaccatcctagtttgcatgatgggtagtagttcagtagaaatcacattataaaaaagctcgaattgatgaacaataactaagataggtagtaaagaagattaggaatgaccaagcgagcactcaccgggagtcgtctcatcaacaattgaaaaagtggatgagactcagcaacagaagtggatggtatcaaaccagtgtcacggaatcctctggttctcataaggtatcaacggcagaaagaattcaaagcactccgaagagaacagtctacttaagatggtcccgttcctcttattaactcccatacagcttgttaacaagcacatcatttatgtcatgaagccagatttattgtaggcattctcaggttgagtgtaaactcttggtttctattgatctcataaccatcatgagtcaacatgcacagcattacagcacacatggtttttcctctcattcagaaagatgttcactgaactttccagtagggccagtaaacatatggcaaaataaatccctcactcatctcaaccatgctactgcaaaaccaaggtacagcctgcaattttcgttatccctcttcctgtcatctcagctctagtttca

SEQ ID NO: 104128 - DNA, 675 bp, Oryza sativa
gagtcacgtcgcattacttggtgacctcgtcgactagctggatcggcgtccgatgggtcgatctctagcggggagcgatgaatttagggcgaattcagggaagggggatttgggtttaaggtgtttggttgcttggtggagaggtgggttgtcatggtcgccgtcagcctcatgttcaccgcctccttcttcatgtatggcgggtccaggcagtcacaaacgtgtggctggtagctaggcacactggggctgtggatggcacctgggtccatcaccacggtgtaggtcatcgacgccggtagtagcagcaaggtgacgtctaatgcggccacccagtccatcgcaacaacgggacacaatagggcttgctgcttgggaggacgaggcgcttggacagcttgaggccatccaccaccgccaccctgaagtctaacacaacttgtagccttcacatgctcttcggtctctgtctcctactacctctgtttcaggttataagaagttttaactttggttaaagtcaaactgtttcaaatttgactaagtttgtagaaaaaataataacattttcaacccaaaacatttttttatgaaaatatatttaattattgatttaatgaaactaatttggtattataaatattactatatttgtctataaacttagtcaaattt

SEQ ID NO: 104129 - DNA, 693 bp, Oryza sativa
gatctacgtttcttttttgtttttttttgccaggaaatggaccttttttttgtttttcctgttttaggtgggaatcggatctgtttttttaatctacatttcttttttttcgccagttatcggatttttttttgctttttcccgttttaggtgggaatcggatctatattttttgccagggaatcggattttttaggttgttttttcgctgttttttttatattgacggacggtggaaacaagttaaattttttaagagaaaaaaaagtagtctgaacataactaggtagaaatatttttcttagcaagtctattgatgctgcttgcacatataaaatcttattgctcctatatatattggtgattcaagatttttaagttgaacgtgtgattccaaaacatgacgtccgaacaaaaatatttttatatgaacgatattcccactggtcataaatatttaagtttaggatgaaacttggttacattttaaactttgaccattagtaacttctcaaattattagtttaaaagaaaaggcaaaaaattgtttagatttatcttgaaaagtactatataaacttataagattttagaaacttactatgatataaaactgatggttattttttaaaaaaaattgatcagatcatgtcttaaatgtcaaatattcatttattttccaaggacaaacat

SEQ ID NO: 104130 - DNA, 615 bp, Oryza sativa
acagagagccggagagcgagagagagttcaggctctagcccccattcgccagagtcccaacccctcttcctctttttctcctgtttttttctccctcctctccctctcctaggcctgggcctcctttttatctggtcaggggtcaccacatgggcctccagctgcctaagaaaggaaacatgctttttacaatgagggctagtctacagccggaagtgacctctgacaagcagagcacacgcctcctgccccgctcgccagctttcccggtggacgcccatttcaaccttcattcaatggccagcgacttccttgccatgcttgcgctgaagcctggaatggatctgaccgggactgacataccaactccaagagttagcacgccggctccggctagggacgagagccaggaagctctcatcatttcgacgggacggggcgaggcgtgtgacaggccgcctgttgccacctaacccgcgatctgaccggtctgtgaccggtcacacaccgcgaccggtcacggaccggataagcgtgcgctgcgccgcattaaatgcggcgtggcgcgctcgtccaacccgctataaatgcagtaggtgagccccgctgtgctca

SEQ ID NO: 104131 - DNA, 1457 bp, Oryza sativa
aaattgcggggctcgtattcctttctctttctctctatccgtctgaagaagatcgtcatctcgtcggtctaattttcccggccttcctcgctggctctccggccgcgctcccctctgcttgcagccttacacctgtatcgtgcacgccaacagttcatcgtccccatcaaggtcacacctttccaacagagggcccctcaatactttcgactttctcctttatgattttcggaagtattagtaccccacatttctaacgatgcatatgctaatccaatgtatattcttaattctgcactatagaactctacaagtctattatagatgcttgctttccgtgtggttgtgcccaaccgcatcagcactaacggtgattaaacttccaggtaggaacactactctatgattacgaggcggcagttttctttatttttttttgccttttcttttctctctgttggatgctgagagcccgagatggcagttcgagctcgggggaggtaatttctggcgacgtgcgtccttggcgatttgtatctgaactgtcagtatttcgatctaacatctgctttcgcgcgggcaggctgtatcgtctgcttgccgtaaccgaatcgaatttgccccggttgatgatggcaacgagatcgcttcgcgttcttgaatgtctccatacaacaccacccatcttcgaagtcagatcgatgcaagtatcgaaaaaggtttttaatctcactactggattaaatcggcacgataacatgtttttccatcgtcgcttcacagaagaacggttgtttcagcaactgacaacagcctcacagggaaacttgaacgtaactcgggtctgagaaatacggtgggttatgcgtccatgtcgacgaagacgtatcatccaatgaaagcaaacacatcccacaatctaatttcgcaactagaatgtcacagtccgttgatggaaggtcaatgtgccggaaagggagggccaatgtttgcccgtgacagattcagaacaatcccttaattaccttgctgattcgggaatattttgctttcagacagcaccctgaatcacaaagcttatctatataaaatgtcgcagcgatcatcaactcacacacgtgaacaagcataaccccgtttttcagtccaaggttccaagttggttcctttgataatccgtaacccaccagcaacaccgactcctccatactcaaaccttttagcatgaattggctggattctttggtgaaagagctatcatgtaacacgagtaacataagggttcaggcccatcagattacgcaatctgcggcacagtcattcaaatcaaaaccaacaatggaataagacaggtaacgcatatttggcatagaaaagtaatatcacgaggtagcagcagtagtagtatagtcgcacctggtggagtaatctgctggggcaagaagcgaatgtacgta

SEQ ID NO: 104132 - DNA, 730 bp, Oryza sativa
aaattggtagtttatatgtgtagtaaagtttttgatgtgatgtaatgtgatgaaaagttaggaatttggggaactaaacacggcctactagtacatactccctccgttctataatacaagagattttaagtttttgcttgcaacgtttgaccactcgtcttattcaatattttttgaaattattatttattttatttgtgacttactttattatctacagcactttaagcacaacttttcgctttttatatttgcaaaaaaaaaaattgaataagacgagtggttaaacgttgtaagtaaaaacttaaaatcccttatattatggaacggagggagtaatttttttactgttttctttagccaggaagactttttacagtgtagtgttattacgactgggcgctatatttgctatagcaaagtgagtagtagtactgctgctcgctgcctttgcacaggctaccaccgcgatcgcgaaataccggagtgcgggcactgtgcggcaggtgatcagcaggcaggggcgcagggcattcacgtttcacagtagtgggcatgagcgcgctgcggaacaactgtcacacactcgcacctgaggacgcgatgccaaccaaaatgcttcgacgatgccaaccaaagtcgcatggcgcaccggctgcgtcacaactcacgactacaccgcgccgccgtcgcttgtgtagttgtgttgaggatgaatagagactataga

SEQ ID NO: 104133 - DNA, 516 bp, Oryza sativa
ctaaatcgtccatatgtgaagttctgtaacattgagctttcaactaaagctgctgactaaaaatcaagatactaggggagttcaaaattatgcagctagtgcagcatcaaaattttcaaatgtgtgaattgggatgctgtttttagctcaatgacatgatcatgagttctgccaccctgcacaggaatttatttttataaaacgcaaaatccatataattctaatttaaattgcataaaaatgttttagaacataacttacatcaacatctgaaggagtaatcttcttcatccttccaaaagcacgtgaagcattaagctccggagtttcctggatatcctgctgaacattcaacggcatggtctgcttgctgctatgtccagcttctgttgctatggagggaggctctacaacacttgcatgccttggaggtgttgcagtttcacctagctcctccattttcttatattgactgataatatagtaagggtgttcatcagataatttcttttgagg

SEQ ID NO: 104134 - DNA, 684 bp, Oryza sativa
attgagtgttgggctatttttgcatagaatggaagcaaatcaaagaaggatgttgttgttcagtttaagacatggctgaagggtctacacaataaggctggaggtatgaagaaaagcatttttagggtgtagtttgtttgttgtgtttacttaggccatcgttgctattttgtcctacccttttagtttcccattttctctttttttttctactatgtcatttctgataatagaaatgtgggctcttagtcctagttcaaaaaaaagtttgaaaagttcatgaattccggacatgttttgagaaatgagaagtgtcggtaggatttttgtcgggaaacttttataaacataaacggatatgataaggcttctatccgtcgaaaactttaagaaaacaaatttgaaaactttttataaacgaatttagtttttttttctcgtaatcgaaaaaaagagtatttctcatatacaaataattagcttcaaccttctttattctaaatatttagatttatactatgtattgagttacttaactaaatagatgtattattttagtcaagtactttttaatttttttcctaatgaatatttttatttttattaggacacgccatactacttataactatagttatagattaatatagttcttttttttctaataaaataaaatgtacaact

SEQ ID NO: 104135 - DNA, 656 bp, Oryza sativa
taggttggctaatgaactcgccacccacatgcttccaatcctgggaggataaggcccatgtctttgccgtgaacaaaataggcacattagcatacgaacaattcgatgaaatcatgacatatggatcgtacctactcgacaataccaaggcaacaatgacagtcttactaaaatgattgctcatcttgagtcttctggtcaagaagtcgcaatagtgggctgcattatatagtggaccacatgaacaaaaccgtcatgcatgaatgcatgatagccatgtctaataaacacaagctccagatatcggcggatcttagataaattggattgagcttggagctcacttggcacgtcatgtggctccccttgatgtcctaaggatcagatcattctgaatgtaattccttctgctctcttcattccacaagacacatgggatacccctgaaatggttccaggagctgtagctccgctccgtttgtccccgagcagcataaggttccacagatgacgatgtccccatttgcatggcctctaactaatagctcgtttccttggcaaatgttgcagcatagcacgatacggccatacgggaatgattggaaacaaccaccgtggcgttcacatcttgcaactatgataacagccactgaatt

SEQ ID NO: 104136 - DNA, 657 bp, Oryza sativa
cttcgaatgaggtctaaattaagatgtgaaactagtgggtggattgacgacactcatgtcttaatacacatgaggatgtaattaacagggcgtgaaatgtgagccgcataatctgaatttttttgccatgctcattggttcaagatagatattaacacttgttttccaactgccatctgtattagagtagaccttaattttgtgtgacaaaatttttcttccacgaacggccgtctagccgtccaggtccatgggattttattcgatagaaaaggacggggcaagaataatacaactgaatattcaaatacgtgttaacgtttcagactgttacagatatactttccatgcagcgatttccttcaaaaaaaaaaaactttccatgcagcgtgcatgctctctctttttttaatggtgcatgccaatttctttgttctgccgtgtgagtgtactccattttcttctgctgaaagtaagtgtcgatggagagtcagtttgacgatatctgtctttttttttggcaaaaaaattaatgcatgcccaaatggatggggttaatttctcaccaattacagaaagtcagaaacacatagctagtctggccaaacaaatctttgcgtctcacctgttactgatttttcttatcggcttaatttg

SEQ ID NO: 104137 - DNA, 672 bp, Oryza sativa
attatatgcagcaaggctgcacataaaaattattaatcatatagtattatctagtagaagctggtggtggcaagctgctccatttgggtgggtagagaatatagagtgaatacgaactacaaagtcttttttgcccaagttcggtggattgaaaaggcttggagaaaaatgaagcgaaaggttgagatttaatccgctttctccatatgtatcttcacttactgaaactaaataaagttcgcatagcaagtaaactatgatctctgatcctctatgatatgtatctccctatattttattactattttctaagttcagtagccaacaaatgaattttgtactatatatttgatccctatgtccaacaatagatccaggggtaatcatgagaaaagaaaatagcactaatgtaatgggccgttatggtaactagaaaggagacatacttcttgtagtaaggtgcttctctatcaagtcgagcaagtgttcccgccaaaattgacacctgcattcggtgaatgaaaatcagaaaccgttgcagtatgaaacacaatctatcggataatttttgaagttattatgctgatgtgtacccatggaatgtaaaggattaagtgattaacctccacatctaggtccagaaaatgtatatacatattaatgcatcactat

SEQ ID NO: 104138 - DNA, 706 bp, Oryza sativa
atcgcaagcgagagcgatcaagtgatgttaacaaactagagctcaaaaatagagtttgtggtgtgacgacacaagcaaaatcatgtcggagtattaggattcgtggtgcgatttgcacatacgtggatctgcaaatcttgctccttccgaccagcttcattcagatgaggcccgcctaaaaaagaagggcttcattcagatgatggcgagaaatagtggcttccatcttttatctttcggatggaaacccaaacagatcgatcgaaacttccgctgcgtgacacagccaaagtgaatcactctcttcccatcactacttccactctccgtgcagtttcgttaagataatggccagtacgtgcgccatgtttatttggatttggtcgctctaatgatgatgaattgatgatgatgtgctcctccattgctgcattacctgtcgagcttttcaagattcaggcaggagagacacgagcacaggaacatgctgccgactgcccactgctttgatcctttttgttcatgcagccgatcaaatctcgctttcgatccctttgctgtaaacaaaaaattcagaggcagcgtttcgtccaaacgaccagaataaacaacactagccgctggcccatgagcagatttttttctccaccaaatccacgatactaattgtagcaacgggcttttctactactacccgtgggctttt

SEQ ID NO: 104139 - DNA, 945 bp, Oryza sativa
gccgatcgatcgagccgcacgcaacgcaggcacgggggctcgcgcgatccgcaaagtcgcgatcgatcgatggtggccgcgcgcgcgcggttaggtacgccgtgagccggcgaaacggccggagccgaacacatggcgcgcgcgcgtgcgcgatgcgagattgcgaggaaataatcgtattctcatgccgaggctaccacgggagacggagttggtcgtacgtgcgcccggtgcgccatgcggaatctcctggctcggcacgagggcggacggggcgtggcatgctcgcccgttcacctacgaccgcgactgtgcgtgcgtgtgtgtgttgtgtgaaggagacacggcttcgcatggaggggaaagggggcgtgagtgaaggggacacgtgtggtggactgggggctgggactgacggccgtgtgggtgagtggcgtggcgccatgtcgtttttgcctttttgtgtccgtgttgggccgatgagtgaaaagcaggagtagcacgttttgtttggagcacgagccacaaggtgtgcgtataattaaagaaaaggggatggtttacttttggactttttgagtctaatggcatttgagtacatgcagcactgagtaggagtacgttttaagctgctgattagtagtatatactttgctcttagagcaggtacaatagcaggatataagccagctgcaaagatattttaaagagataaataaggagagagaagagcagcgggctacaaatttgtagccagttatagcacggactccaaaacgcagtgtgtttatgataggtgggactagatattaatagtgtagtatgtaaatattgtatgaataaactactagattggctatagatgaattagagatagtatttggctacactattaaacttgtcttacacggttacacccattgtgttcttccggaaacacggaag

SEQ ID NO: 104140 - DNA, 650 bp, Oryza sativa
ctttgaggtatttcaaatcccctatgttgatgtcttccgccatcgctctgagttgaatcctgcaatagagggaatggaatggccaccgtcaacatcgttctgcatgttttctcaacaaggacaaggcaatgggaggagagatcatttgttcgagaaggggaggctgcaggatctttggctatcatacgacgagattttccaaattttctgcacaatgctgtctactgtcggggagtactttatgtacgctgtcaaaccaactttgtaatgaggtagtctcactgataagtattataatttatttctttattaacaaatagtatcactcaattttatcatgttttaatatttctaagttttccaatatttgcagaatatctttgtcagatggcaagtatcgaataattaaaccaccagtagagattgaacggtacgaggagtcaaatatttatatgggactatcacagaagagggtgtactgtacattctttgatgatccaaacataatttatattcttgatgaatcgtacggaaaaatggagtgggtgcagaagaaagctattagctgtctggtcatacatgcatttcagcaaactgatgggccctggaccttacaagatataactatcatgaatatcctgatgagtacg

SEQ ID NO: 104141 - DNA, 627 bp, Oryza sativa
catgagtagtaggcatcccgtgctgggttttcgaggttagcgaagacttttaagcatcggcgttggtgttgagtgcggacaagcaagcaagcaaggatgcccgccacctcaagcaagcacgacgctggaccaaatccccatcacaatcacatcccacacgccaagctcccccaacccaacccattttagcttggaaataaacaaattaacgactctctctctctgtctctctctctctctcgctcgcacacatggacgctggaaggagaggccgtgctggttgctccagtttttaatacgaggccgggtgtgtgtctactttgcctgcttggaactcaaccaagtacgatcgagctgagctagctgcaaacactgcacgtcaaggaaaggcccctagtcctacaggggttttagtaatataatgcaattagctagtagaagctggcatagctatgcatagaacagccgactcacatcacttcagcatatgcctgcacacacccacattgctttctacgtaccaagacaatatatgtaggcaaattaacgatattaaatggtctcgaaagtatgtgcatgaagtaatgtgtatggactgggagcttcctcgtccatcggaagtctgaa

SEQ ID NO: 104142 - DNA, 514 bp, Oryza sativa
aatggtttgagtttaggtcatggaattaactcagaatacgggatcacaagcttgaggctggaggtgctgccaaagcactcttctaactcttcacctgtacgccctattcaatgaaaagacactctagtgctgttttcagtttttttttaaaaaaactcttcacctgtactgaatcagaattatagtataattcagtactgcacaacgtgcaaatagaggatcgatgaaggcggcttgaccgctgaagacacggcgacatgcaaaggagaggcttgcgagcgcgcatgagacaacatggggaatcttaacttggatgtcaaatgtggcatttggtccagatgaagttcctacattcattttctttacctaatcgaagctttccacgattccacttctagacttgtcctagttcaatgactaattgtccacaaggaatatgcgcgagtcataaacaagctgcgcagaaaacagcttctctctccgttttacaccctccattttatagggtaagtca

SEQ ID NO: 104143 - DNA, 1224 bp, Oryza sativa
cagcggcctattgggagactccacttggatatgagtggataaggccagtgccacggctgtttctgccgtccagtatgctgagtactcagctagtagttcctaccgaggcaaacttaatttcgtcagtagaagactatggcagttttgtggagattatggataccccatatttacacggcatgtatatccgactggatatggaatgccatatataggtagaatatctttaagggactcgggttacattccttaacttgtatatcaaggaaatactcgggattctagtcggttacgactgtattttatctttatttgcctattccgttaggaatataggctataccttgtaatacggactcctctccctatataaagaggggtccgagtatctcttgggacataacttttctcccagatcatacgatcaataatatactcggtggattaatccccggacaggagtagggtattacttctcattgagatggcctgaacctgtgtctctaaacccatccacttttctagcttgatagccaccctttttcgtattaccgaaatctttgtttcgacaagtttaactgcacgtagtagtgtacccgcaaatcatactttggtaggcgatggccggcactatgtttttccagatcaggtactctgttttcgtgctactaccttggaatgtgatcgaggtctagactctagactatgcaattggtgaactggagctgtttaacgaggtaaagtggtgaacaggtagataacttgtgtggatgtgatgagccaccggcccgcctagttcgttcacctcacaaggcatgataccgggcttcgctgcagacagcagactttaccaattcaccgttgcacacgatcagaaacagcggctcgtcgtaagttcttaacccagcgggcgggagacgcaaatccgtaaggaataagttcacttcaggtcccctatttgtcgctcagtccgatttttgtcctgaaccacaaaaccgggtacgacccgtcccccaactttcaaaaaccggacaaatgagatccctcggcggtatggagagcggttttggccgacgtgacgcctatgtggctaatttgactcagtcttcatctgacgtggcaattcgatctggaaaaatattaaacactatgggacccacatgtcagtttcacacacaaattaataaaaaatggtggagcccacgtgggccactgggccccaca

SEQ ID NO: 104144 - DNA, 819 bp, Oryza sativa
agagaggtaacccctctcacaaaaccataagtactcgtttctgccaatcgctagggtgaggataacaactgttggagagtttgacctgacgtgacaacacacgtgtgaagcacatcaaagcaagcgcagggtagggtatcgcctctcgcctcgccgaggccgtagaactagctattcaatgacaaggacgccgcagcgaaagcctctggctctaacctctaagcccctgttaattttttttcatcttatacccgtcttaattggaatccagctcatgatcctaactggcccattgtacatagactagggtcttcttcaaccggtcgatcagtttggtctcaggctgccagccattgcattaatccaacaagatttgcagttgccgtagtaggttcattaagcgaggtccttggaaagaatctcgacctactggccggctcggctctcactggtgcgtactccatttttgcacaaatgcacctatgccctgacgacgatagaaaaggattggacattgttgcatcttgggactttggtttgaaaaaacaggagtcccccctacaaaaggtacgtgtcatggcaccatgatgatgattatctccgcgtcgataccgcaatctgatggggaaataaagctgcatccatggtgatggggaggcaacgttgctaccaggccatcatggagattgcggcacctgaggtccacatggttgttgcattgttgtggatcgatccatccattttgctcggctttttttttttatgtttgtttttcgaaggctttgtatttataatggcaatgtgagagcacgttcagcg

SEQ ID NO: 104145 - DNA, 600 bp, Oryza sativa
cattgccaccaccactaccttcttttaaaggagtatagatatactacttttagcccaggaagcttatgcttttgttctaaaattgcaaggtctcttatttaataagaccaacgaagtggtcctgctagttgaaattgatacgagtcataaaagcacacatgcaattaggttaacatctatactagacatcacaagaagagagagagagagatagaaagaaaaatataatttggcattgaccgacatccgagttcatacaaaaaggaatagcattgctgtttaatattgattaattgtaaggtctcttattgacaggaacaacgaagtggtcctgctagttcaaaatgatgtcattataaagcgcacatgcaattaggctaactttaacatctatactagattagctggcttaatgattttcatcaggtaaaagtatggtatgaagtatcctattatgcactagacatcacaaggagagagagagagaacttatagtttggcactttggcattgaccaaaatccgagatcatacaaataggaatgccattgctgtttaatatttattgattgcccgtggcacccttatgtttattatattg

SEQ ID NO: 104146 - DNA, 1494 bp, Oryza sativa
caagatgagtgattcgctattcaattacaaaaatagtgaccaacttaaataagaaactcaccgtgcaagttgcaataccaatagtataatttgcactttaaacaaacttaaataagaaattcaaatgcgatatactactgtaatactccatccacgacatactagcttcttagcgatcttcaacattatagtttgatcaatgatttattttaatttataacatattttccataaaaataaaactaacattatacaaaaatattttaatacgaatccaaaaataaggacgcgttatattttagattgatgaaagtaattcaaaaaagttgctactactaagcattagacaaatacaaacaataataactataacttgaaattaaaggctattttaatctaattattgttatacagtttatgttatggttatggaaaccacataccacctccgtcccaaaatataacaacttttgactatgaatctggacacatagttgtccagattcatagctaaaaatgcttatattttggtacggatggagtacctaatagtagttgactaagctcggcaggaccatcatatattaagtcttatacggaattatatctcgtatatagaaggagttctggataaggaatgacgaatacagttctatatgaaaacgagaaggactactcgaattgtatccatattggtctccctagttctacttggacaaaggggtatctatgggtataaatacaagaccccttaataggaggggagacacaacaacagatagacacacaatatacaagccaacatatgccgtcagacatcaacattagggttaagcctagaaagaccaacaagagggatttagcgtcaaatctgatctcaagagctcatactcgaggaggaagactaccatgtcgtcaactatgtgttggttatccatgccgccaagttgacgacagctcgataggttatcccaattattgtacttgtgtgatccagatgaataaagagtaacaccggcttcggccgacaggagtagggctattacctgtcaaataaggggtccgaacctgtataaaaatccttgtttccatctcttttacctcaatctcgcataccctggtaccaactatccctatttcatgcaaatactgtagtcgagacctcaaacgtcgacagtttagttagggtgaaatttactctggaaatccgctcgattttttttagaaaatcatgagctacaattaggagtccgactttcgtctcaagttaacatacaagtttttttaaaagatatttcttatacggctccttttgtattttcaaaagcgaacaaacataaaaactaacttaaacacgaatctatatttctaaaaatgaacgaaattaaaaaccgactcaaacaaggataacgtaccttgtattggcaaaaacattttcaacttttataatagtcgagattaataaacagataggcgtgaacttagaaagggtct

SEQ ID NO: 104147 - DNA, 667 bp, Oryza sativa
cgaacaactagaaaggcgacagatatagtggactagggtggcgacaacggcgaacggcgaggcacgaaccatgttcctccccttgggttgtgtgtaacaacccgccttccagaaccgcgtagcccagcccatctgataggcaggcccactcacacacaccacccacttacactttcgtcatcgcatcgtgtaaaagggttaattcaaaagtggcacggttggaggaaagaggcctataagttggtccaacccttaggctgtgtttggaacctagggttcccaacctctctccatcgtattccacgtgcacgtttttcaaactgctaaacggtgtgtttttacaaaaaaaaagtttctataagaaagttgcttaaaaaatcatactaatctatttttttaaaaaatagctaatacttaattaatcacgtgctaatggatcgctctgttttctatgctcactgtgcaagtttggaacggctgattctgaacacagccttagtaaactaacaagattaaactaaacatgcgtacacaattctcataaaccacacaggtcaagtcatagtttggtcaggatgttatatacaacccctccaaatacctgacgtgcctatcgtctaacttacctttaacaatttctttactgattggtttgttttatgcgcac

SEQ ID NO: 104148 - DNA, 1462 bp, Oryza sativa
tcttgcattctcgaagtacaaatctggaaatagggtctcggtcccttaatgggaaataaagaggagagggacgtttcacactttcgcataatttgtggggggagagagaaggcccagagctttggaacttgctcatagctttgcaacctttgtcctctcggagtcctggagatcagatgccagagcatccccacaccaatatctggtggtcaagcctctccaaatccgggatactaagctagtgccatactgtcatagtatctctcccccctttatttggagcatcatcatgtccatttgttcagtacactttagttttcagatgtcgatgtgttcagccacctttccaaagcaactgtttagattatgaagtatattttctgaattaaattagctggagtaatccaaaccagcacaagtgttaattaagtttttgcacccatgcatgcatagcactagcttgttggcattatatatctttcaatgttactagctagctagtactatatgcgagttatagtagacatgatttggtctctaattggatatattattaatgaaatgcaagttgcgaaaggaaaacttaagacgaggtctaaccgtctaatagtactagctaagtgctaataacagtgcatatatattagggtaaattgtattagcatgcaccttgtctctagttgggtgctgccatctacaagactacaactaaatcttgtggaattccattgagtggcattggatgttgtgtcatctacaactaaatcttgcagcaagcgagcaaactgtatttgctattgtctagaggcctagtattcagattaaacataaaatatcgatgcagaacatgcaaaaacaggattaaaatatgcagtcggcaatagttcaacctacattcatcttatgaatgataactgtaccttgcaactttgccttaaacagaatatttttgtgatgaatgaaatacttaacttggtggttaaaaaaccactatatattattgtttgttcaccataatgccggccgtttatttgcttggtaatgggtggtagtgataatcatgtggattaatttttaattttcatggctttaatcagcttatgttttaaagagatgatcatactaaataatgtactgtttcacctgatttgatcccgttaatttatatagagttttgttaacatttctatgttatttgttcccggtacattgacaataatgtaagactaagatcttgctcgattttctacctgatgatgcacctcttatgacttctttcgtcaagaaggcctttgtcaaatcacattggagtcaagcatcagattgccaagttttcctaatttggtcctatatatacatgttgttctctatattatggtacattaaatttgaaagaaactaaaggaacttagtagcaagggcagatccagaataagactataggggggacttatcttctaag

SEQ ID NO: 104149 - DNA, 1269 bp, Oryza sativa
tggtaattcaaatgttcttgtcatccatgtttgtatccttcttttatgtctttgctgcttgtttctaattcctctggaattgcaaagctgtacctgtttgtacagaagtgcaatgcacttcaattttggaaactacaaaggaacacctccgagtgttactcctgaattttcgaaagagaaacaatcattgatgagaagtattgaaccgtagaagtttttggtgatggggacgtctttggatttttccctcttcactgtgaacagttttggagttttggtctttggttttaatgagcgtattttaggtttgttgaaaattttgttgactggtccctttatttcttccttggatagccgtctactcgcttatgtctgtcatggactgttttcaataagaaatcaattcaacatttttgcaagtgaatccacataactagctttctttcttattctaggtggctgttctttgcaaaggagaatcgacattatattatttctatacgtagaagtgattataaatccgaggaagaaaacatactagtaggttttactgaaaatatccatgctttttgattgtttgagaaaatctcatgtggttttttaagaggttctgaacatcatacattcgcagtttttttatgtagcagaaacctttattacctcatgaagaaatctctacaatggtcagaatttcaaatacattttctatttagcatctagatttccatcatctatgtgaagcaggtcaacgcctcaacggggaatcacaatgaccattggttggtccattggttgatgatgaaacctttcaggtttcctgtgagctttcggagaagaccctgctcaagtctccccacaacagactagcattgtagtcaacggggatcccaactcttagaaaagctccggtaagccattacacaagatcattttagtgcacccatagacccactctctccttgctggcatcgacgggcgcagaagaactgattcgatctatatttgcaacatgagcggggaagtcgaattaggacagccgttgcgggtaattaccttgacctctcttttaagttccattcttgttgctccagtaaggaatgcctaggctacggacaatttagagactagatttcctataacaatggatattgctaatcagtatgttgtgaggtacaatttccattacagcatatcaatttcaccatgtaaatgccatgttttttctttgacttcccctgttgtgcttaatttggtggggaataagactga

SEQ ID NO: 104150 - DNA, 2092 bp, Oryza sativa
catctactagtatagattttctttttttttatctctattttcaaaaatccggcagggaacagtgactgttcagaatgaaagtgaggttcagaaagtgatttgatcagtttccaattaaaaaaaaaagagaggatactgcgagcaaaattcggaagagatataaatgtaagtgctccaataagaaacggagtgcaatccaaaaataaacaatgaacccaatgtgcattagacttatgataacaacactgcaccagcacagtgcacagctattagatttgatgctgttttcttttcaagtatttgcttatagcacaaagccagaaacagctatcagataaaatatcagaaagtggctttgcaagacataaaaaataatcaggaaagctgttgatccagccagagagcaaggaacatgatgagcataccacaatcctcgcagcagacatggctatctaaaaaatgtcagttgttaataagctttcctccaaggacttctaaattttaaaatcttctatatataactgaagattaaattgcaacgttaggtggaagccatgcttttggcaagttatagcatacaaatgttgcggtggttcacaggttgttagcaccaaactctaattttcttctgtttaaggttatgatacagtattacagtgcataacagtatgcaaactttgaacagagacggcatatgtgttgttttctgaactcgattttgttttcttcataaatggacactgcagataataaatatttaacattcatagataagatttagttcaatttacggaactttgaccatcaacgacttcccaaatgcttaatttgaaaaaaaaaaggtatacgtatatttgaaatgtacgactatcataatgacaaaaattctttatattttgtacactcaatataataaattattagattttgtaaacctattataacaaaagtagtgattacagtttttaaagttttgaattttatcctaaatatccgagaggagtacctaaaacgcctattttattttcaacggcaattaatggaatgaggggtatgtttctagatcaaaatcttgtttcaaaaaccattagttcaaggtgttctgatctcttttttttttagcagcggccacaaaattcctaacttatatcccaatgatgtgtacgtagttaatactcctttcgtctacaaatataaggaattatggattcaattttatctgcaaatcctatatttctataaagttcatcctcaccaagtgtagttaatgctatttttttctcattgagccacatcatcttaattatttctaacccttgaatgattgatctatggttcaaattatgtccctcctttccttcttctaggaaatcatatcatctttcttttgtctttggatgattattctatatcatttcccttcttttcattccgtcattgaggtatatcaccttagttttgcttttgaataatctatttatatatgatttacattgttataaaccatatcattttaattgtttataactttttttcttccatggttgatcacagatgaaaattatataaagtatataaagtgatgtcgtgtagctatatgcatgttatttatactattatcatatataactcccacagcaactcgcggggtttcattttgaagtggagtactattttcccatttcatccaaccattgcatttattgctactaggcatgacctttccattcaattaaactcacatggaaattacttcgaaagtaatttcacctcaacacttaactttgctaaccaatctagagtctactccttatatttgtagatggaaggagtatcatcagtgatgatgagtagaaacactcctttcaagtaaatattacagtactattttttagccttttaatggtcatgataataccattttttttctactctctctatccacaaaagttacacatattacttttgacaccaagaccaataagaaattaaatcacattggatgttaatcaaagagcgaatataaacatgcaactaataagtatttagatgactccttgagttttaatgaagcatgtaatttatctcttca

SEQ ID NO: 104151 - DNA, 678 bp, Oryza sativa
aaaaacaatatggaaagaagtgtccatataggaacccaataaatccaaaattagaaaaggaaaggagagtccaagtagaaatacaatttaaaaatagttaaaattcagaattaaaaataagcaatattgaaagaaatttccatataagaacccaatacgagattaatcaaaattcaaaataaaagtaaaataaaatccaaaattagaaaaggaaaggagagtccaagtagaaatacaatttaaaaatagctgaaattcggaattacaaataagcaatattgaaagaagtttccatataagaacccaatacgagattaatcaaaattagaaataaaaataaaataaaatccaaaattagaaaagaaaatgagagtctaagtgggaatacaatttaaaaataactgaatttcggatttaaaaataaggaatattaaaagaagagtccgtataaaacccaatacgagattaattaaaattcagaatcaaaataaataaatcaaaaattagcaaaagaaatctaaaattagaaaaaaaagatttcaattaggaatacaatttataaataactaaaatttattataaaaataaagattattgaaagaaaataccatctaaaacacatgacaagataaattaagtaacatgcctataaaggagtagagtggtggcggttgatac

SEQ ID NO: 104152 - DNA, 669 bp, Oryza sativa
tgatgtgtcatttttctttaatttttggttcaaggatattctgatgaggttgtatttataattctaacaaaattaattacaaacatgtatattagagtatatataacatgtaacttactagctatttctttgacttaccaagtcatgagaaaggtgtttttaaggattaattaactatctctatgcgaaggagaaaacatctccatactaaagtggaattgagatgttgaagtggtgttatgctaagataaattactaccacattttccataaatatagggatttctaactatacacttagatgaatttttataatcgtggatagatatagtacattcaatatatctttatacatgatagtgtggttgctgcagtaaacatagcttttcctatagataaattatcttatccgtagaatgacatgaaaaaaagttagggctaaaaattactcattttatcttatccgtagcatatatagagtacgttccatacatccatcttgatacatgatagtatggctgctacagtaaatatggtagcttttcctataaatgaatcattttgtccgaagaatgacatgaaaaaacttagggctaaaagttactcatttgatcttatccgtagcatatcctattttactcactaagttgtcgcaccctttttacgaaa

SEQ ID NO: 104153 - DNA, 645 bp, Oryza sativa
aatggtccaatggggagttcaagaatgctgttggtgagatactatttgagctgactgatgaaccaaacccgttcatttccctggaactcttgtactcaccgggtcacctgcgtcttcctgatgttggtcgacacgcaagatgcattgaccatcccaagactgtttctttcagggaccagattttggttgctctggttctgctcgttttcttctacctcttctggagataattgtacccaggtttgctcattaatcatgccctcctttgtcaaggcaacgaagccgtgaggtcaagtgtcctagaaggcttatttttacagcttttcttggacttagcttcctgtacttcttcattaatcgtgggggagagcaccgcacgggtggcggtgatgacaggtagtttgagtttttgcctctgtggtttcaaattcagattttgttgctgttaaacaatacgtgatagagtggatatccaacttgaagaaaatgatactgggtggattttgatttgttgattgaagcttgattttgctgttgaggtattgtttggaggtgagatttttattctattacgatggaggagttgtttgtaaaggtgcaaatgtttttatgcttcacaaaaatatattacaatatatgatatta

SEQ ID NO: 104154 - DNA, 674 bp, Oryza sativa
attcgattcttattcgtattcgagataatccgtatttgtttccgtattcgagctatccgtattcgttttcgtatccggtaaaaaaatatgaaaacgaatatggtatgagcattatccatccgtatccgctccgttttcatccctagctctaggcccgagtgcttggctggcagggaggccaggccgagcaggcccaagagaagacgacggcccacggcatcggcaccatgcgcggacacgcggcgacaagcaattcggcgcgcgcaggcacggggtccacgctgttttgcacggctcggaggcaggagccgtacgcgtgggacccacgtgcgatttagcgagcgcgcgtgggagcggctcggtgggacgcgtggaggcttcggactggatgcgtgcagatgagcgcgggattcacgcggtggagcgcgcgctctcgcgtgctgaggcgcgacgtggcggcgtgttactggcctggagcaggagcacgcggatcgtgcaagggagtgcagcgtggaggagttcggattgactacgtggcagcgatctggagctattcctttgaggagaaggaaaagcaagtggctgagattgagtccagggtgggtttcgccctacaggtatgaggtatttgagacaatgtcttacggggtattaggctataaatagagagatgg

SEQ ID NO: 104155 - DNA, 2262 bp, Oryza sativa
tttgctggtacacaacagaggtcaaacacgaagttttaatggattcccccaaccaacttcataaagcccttttgaaaattttctttcggagatgcgtcattgttagtttaacagtacaaattacttctatgtcatcgtaatttagtaaattatcactaccatgcaacaggagaagttttatactagcagcacagggcagcagctgatcgctcctagcaggcggaaatgatagcgtgatgaattcggaaccatcgatgtttcaaagatcacgtattggaggacaagaaaacaaaatcgcggttagctttcccgtcataatccgttcctttcaaagagaacatgcgtgccaatctttcaaaaagaagtagtctatcaagtgactaattaaccatccatttcgtgcccccacgccatgttagctgcacatgggcatgggccgcccggacatcacgggcaatctcctactagctaccatgcgttgattcgccttattttgcaagcgtcccgagctttcagctccgagcatcataaggttcacgccacaattcctttccctgtttacgttggttacttgggctgtaccgacggatatttgagctagccgagcattgagcaagctctgcaatctgccatcactcacgttcgataaagtatgtaggaaccgcgtagagcgtacacgagtcttaaattctaaggcacttctaatttgaaaaggggcttattttcactccagacaatagtacaacaaagactcttttatggcaacttctactgctaactgcggcaggattgtactctatccgtcccgtaataaaaaggattttgaaagaatgtgacacattatagtcttacaattttggacatactctttgtccagtttcgtagtattagaatgtctcatgtccatttaaaatcccttatattatgtaatggagggagtataatctaagtgcgtgattggtttgagaatgaggtgagataatctatattttttatgaatggaatggtttagtcatatgtttgtcatgacagatagaatcgttatattttctttacggagggtgtggctcatttgtcaataagagagaggaggtgggtaggattgattagtccgttagtttctgaggtgtaaaactgacccaaatcttatgggattacgaaccatcccatgatccgatgtcacttattcttaaatcaaacaacttgaaaaatggattcgcctcatctcaatctattccgttctttcaaccaaacacatactaaatctaattacagttgatcataagcatttcatacaatatgcgaatttaccttggttgtgtggtttttggtagaggcggattatgtgaaccacttccatcataaataagttaaaaataccatataatataaattttaaatccaatttttgctcgtcaaaatttttaccaccgacattagcatgtacagtactcccttcgtctataaatgatggtattaacatgcgaagtgtttcttttgtccgtaaatattaggggttctaggttatttaacagtagtatagtattgagctggggtgaaattgtcctataggtttaccagattagtaaagataacgccaactatgcaaataaaattgagcaacaaatgtaatggttggatgaattggaaaagtaataatgtaggatccgttatattataggcaaaatttaaacatcaaataatttaattatttgtagatagagggagtataatagaaccaggtctcacattgaaggcattgaactattcacgccatgcgctgaagaggccatgactgtttggaagatggagagagagcgaggagcaagcatgtggtgagtacaccaaaacggaccacaaaatcttgccgtgatggcgactgaagcccagggaactcatctgcaggtcgcacccaaacaaaaagagattcatcatgcacgaatggaacaccacgcctactcgtctgaagagaatctctcgtagcagtagggcgctgcaaaatcttcttcatccatccaaccggctcgatcatcagagacaccatcatgcatttcgtggttgttacagcactggttaatgacggttggaaggaaggttttctttgccccggtcggtggttgtccatgattgtcgaggagaatcgtgctcttcgctcgcttaaacatctcatcaattgcgttagctagggcacgctcaatcatacgagaaaaaagcaatttgcaagcggttcgctctcatttccaaagaaagggagctagtagt

SEQ ID NO: 104156 - DNA, 674 bp, Oryza sativa
tatgcagactggaatactggattcatgagtactaaatgagtatgtaattaagggcaacaaagttttttttatctgttacaaacatctattaattttttaggtatgatgggttcatcattgactgtttcaagagtaggctaaagagctgccaaagtgacaaattgtcgttgcagttcggccgttgtgatgacaacgatggcgatatccgctaaattggcctgtgcacggcgcgggaatctgcatgtctggtaggtcgtcaccgtcatcagaaatcgttaacttgtctctccttatgccaaatgctaatttttcaagcctaaaattgccggggcggacggtgaaatcaaagacgaacttgaatttttagccgcatcgtttgacagtaagccaagcattcaagttaagttagatggactttttgatggatcgatgatcgaccaacagactgacgtagctctgttcactccaccaaactccttcgattgatcaaatgactgtttgattatggagtagaaactgtatatgcgtagcatccgacaataagcaagccagtgaagtccatgaatctgcagtgcggatttggccgcattctgaagaactggacgagaaatgctgacaccgcctgagaccgagaggcatctgtgtctggccagagttggttgagcccgaacaaa

SEQ ID NO: 104157 - DNA, 610 bp, Oryza sativa
caatcggccttgccctcctgtgcaccgacctcctgcagatagtgctccgcgtccaaagcagccatgcaccctggatacaatgatgagttagaagtctgccacaaaaattttatgctcagcagtagccatcaatgatgagttagaattgatcttgtcgacagagtcatgcatatagacaatttctctctttttttgaagtgcatgtctattggatcaaactcctgaaacaagctagcacaaaataatagtaataataataaggcttcatcatgtactaaccatactgaccatgtatcaaccaacatgaaaatcacaaaggaaaaactctgtatgctgcttctgagatgaaaatcttatcatcaggctttttcctttcacacgacaggtaacaaggtagttctttctgaagtatatagaaatggcatactgctttcattctacatcagcagtactggccttattccctgattccaatttttgctaaacaaccagacatcaggattaaaatcagtctcctatgactgtgtccatcaaaaatgccaatttggattgtttctgaccaagaccatacttggtaacattattactccctccttccctaaatgttgac

SEQ ID NO: 104158 - DNA, 669 bp, Oryza sativa
ttttcagtagggtacatgcgtgatctcctcctctaattgctgtacctaacagtattgtcagtgcagcatccagtgacaccctggcgattgatacggggacgactacaaaagcgtcgtgcttttattatcaagaacctgccaccggctttgctacttcacaccgacgccgtgccggtcttatccctttgttaacacagtatcgtcactagtattttagcataaaatggcgattaattaaggagtaataacatattgttttcagccaaagttttgatgcattatgttttatttggatggctactgttgaagatacatgataactagtcgacattttgctggaacttttggtgtcatttggtacgagttctacttatgatatactccctccgtcccaaaaaaaaaaggtaaaccttgggtatgaatctggacatacatcatgtccacattcatatctagggtttgtactgaaagcatattaaaaaaaagaagaaatgcagtgcgcacatttgtcatgattaggtggccagttgatgtgcttaactagtgaatcttaatgatagattaggtgcagcgttgtatgggccctgatttttccgatgtacgtctatctctattcttatactttattcgtcctaataaattttataatggtatctttcagtatatatt

SEQ ID NO: 104159 - DNA, 676 bp, Oryza sativa
atccggaacacatgttcacagcacgcagggaaagtgaacccagtctctgtttattccaattcattcttttatgcaataataagttcaaactccatctctgacaggatcaagaagggagaatggcgaaacatgaccaattattgaagtttgagcatggagaattttgcatgtgccctctaaccacatgaaaatgtaacttgcactctagtaaaaatacttgctgcaacatcagttagcatgtaaacgcttaacaaagttaactcacatcacaggagtgacagagtgatgtactgaccatacttctgtttttgatttttttgcaaaaatacagtccgtactttgtagtgtagaaattgaaatgcactcttctatactaaatgggaagtagcacttttttttattcctaacaatatttggaatgccttaactatgaaaatcccagaatagcttgaaagtcacttatcccagttcaacaaattccatgattaactaccagctacttattagtcaaacatatgaacctacatggtactttggaagcattaaccggcctcaaatacacctaactttttttaggactaatacacccaatcctagcttggaaacagagcacgcattcaacatgcccaaaaggtagttagtatatctaatcaactatgctagatacataatgaaa

SEQ ID NO: 104160 - DNA, 661 bp, Oryza sativa
gacggcggcggcagcgatggacgggcgcagcggcgacggcggcagcgggcgcggcggcgacgacggcggcggtgagggacgggcgcggcggcggcggcggcaagggacggcgacggcagcggtgggggcgggcgcggcggctgatggcggcggcgatgggggacgtggacggcggcggcgggggacgggcgcgcgttgatgccttcagccgcgtcgcatggatgagaatcgcatctgtggaggaggagtatcctgctaggggacgggataaccctagcattcccgtttataaattgagggatgccatatatctggttttgtggttggggacgttttgtaactcgatgacaggttgagggaccttcggtgtactttttccacaactcgcagggcgacagggtctagcagatcaagcgaggccgaggcccaatcgagtttgacgagccggggacgcagaatccaactcctcccggtggaagtcaggttgggctaggctggctagccaagagggcttgtataggtcctgggacgcatcgccctgcttcggccagtacggcgtcaacttctccgcggatttgttcgtctctcatctcttccgcacgccgctgctcctctgcctgttcgtccatctccgaattctcttctcctttcgactctcttt

SEQ ID NO: 104161 - DNA, 752 bp, Oryza sativa
cttgttgggtgtttcatttcgtttggttctgtatgtttgtcgtcgtggttcatatgttcactgctcatgctgatgcgagttcttcgtttctgaaattcaatctggataagttcattgcaggctttaagttgaaaatactgctataatgtttttgtttcactgtattactcctatatcggtaccatatagtatatcggttgaaatgttcaaatcactctgtaataatccgtgttatcgtgttttctgcagatttccggacacgagcaacagcatattttggcgctaatcaggtgagttttgcatctcctcccccttgctatccactctacatgcccgctaccataagttcgcatcgatcaatgcagttcaacttcaaactgcaaaatgatgaaacgacgcgatttattgttgtttatctggccctcaatcatctttcatcagttgttgattcgcgatcgatgacaagtcgaaatcaacacagaacactaggcaacctcacagggtccgcaatggcagtccccattagcgcgcacagtcacggccatgaaagctggcgtccttctccgacagccgttcaacgccggcggtcccatcgccttttgaccatacgtctctgccgatcgatgcgtagtagtacatccaaacgtagcacgccggcacgccgcgcgtcacagcgatacgtgaaaacggtgaaaggttgaaggacggtgatacgtaaatccattgtgttttgtgttgtagcaggatcacag

SEQ ID NO: 104162 - DNA, 630 bp, Oryza sativa
caacggagaagagagttggagaagaataccggttcaatatataactattgtagatttagcaggcccaatgtgaaaagatagatttacctctagtccaatgtgcaaccaaggtaaatattagtggtccaatatacaattaactctaaaaaaaatcaacctaataatatatgtaatatatatttgtttaaatctgttgtattatgtggtgtcatataataatagattcgtttttttaaatggagggagtacagtttgagtgcacagtgtgacttaattatcgtctgcacatcggaaaagtatgtttgcaattatagctcagcactcgaattatctgtttggactcttggaattgaattgatcaatcacccgtcaattgatgtttgatcatgttttcaattgggttctaatccctcttcattgtacgaagatgcttaaacagagagcggatcatctccacaaaccataaggagcccggctttatttggagcgaaacattttttttctcagaaattcaacgggattgtagagagaatctactatacaccactgactttagtctagttcaacaatctgccactgactttgtttaattccataatatatcatcactttttgtttaacttctatgat

SEQ ID NO: 104163 - DNA, 557 bp, Oryza sativa
ttcgccgttcttttcgtgccggtgctgctgttagtcggcatggctgtgtacaccggagcatcgatggaggagcagccgccgaactcgccgcacgacggcgggtacgatgaggcaaccaaaagcacctttgatctggccaccgttagtacaatggctgcattgggtttgcaggggaccatcgtcttcggctacctgaaaacgcccgagaagaagagcgaacatgatgaccctccactggacctcgccgtctgctacatcgcctcgacggtctgcctgaccgtcatggcggtttgcgccatccgctggctcttctccccgaagaaaagcggaaggctctggtcggaatcatcggcagcctcaggcacgtcctgctcgcctctctggcgctgatggcggtggttgtctccgtcgagttcttggacggcttcgtcgtgctctccgtctggccggaggccgtcgcgctggtgctgtactacgcggcacagctctgctcggggcggcagcccgggggaggagtcgggagccggccatggatcgaatttgtcttccggattgtc

SEQ ID NO: 104164 - DNA, 1326 bp, Oryza sativa
ccgtcttatttaaaaaaattataaaaaaaataaaaagacaagtcacgcataaaatatttatcatgttttatcatctaacatcaataaaaatatgaattataaaaaaaatttatataaaacggatagtcaaagttgaacacggaaaaccagagtttgtctttttttaggatggagagagtacctcagctttgtcatttccagattcagcacaacagtattcaatgcagaatagtagcagcctactgtatgtttgcttgcgttccaagtgctcaccagacaagctactagaagagaagcacactgctaagggcatcagcaatgtgagccactactagaagagtgtcctcattaaccgaggagggcactcatagagggctatagagtacaacctcacgatgtattatccccctgagcagtggctgagggcactcatagagtggctatagagaacaacctcacgatgtattatctccctgagcagtggcttcaaaatccaaagcaaccgggtgggggtactcaggccacagtgggtgtcctagtccacagtagccccaggtggcaaattcccgaaataccctggaaccctctagtcaattccgatcgagacgagcccaaccgtacctgtgggttcgttcgttgccgtttcaattcgacaccaatcacaccacacggcgtcggcgacgaccgttctctctctcgctcagtgtctcccccaaattccaattccacatcatcaaaaagcagagttcaaacacagtttacacacaaaaatgcttaactgaaccaaacatagtactacatgggagtaatagtagtacacaaggaaggaaggaccaggcctaatacttgctgatccatccaacaacttatacgatccattatctaagaaaacagcttatacaatcaaacaaaaactccttaagaccaagccaagaactagaagaaaatacagcaagcatcacaaactagtaagtaagctacaggaggttcttacttaaaaaccttaacaacctccttaacctgaaaggctaatacgacttacttaaccacgcgaaatcaagatcgagcaagaagtatggatggattagtgcttactctaatatggcaactaatccaaccaagacaggggcgagaggaagagatcaacaagagatttttaagtatgaatgtcttcatacttagaactaatccaatcctcgtggtggtgttgctcctcgccgtgcggttgcaggtgcgggtggtggtggtgcttctgctgctcgcggtggtgggtcggcgcgaccatcatgccggtctggagcgcgtcgacatgggagccgacctcga

SEQ ID NO: 104165 - DNA, 659 bp, Oryza sativa
tatatgaattagctattccgttagctatagatgatttggagttagcagtggactatactattaaacttgctctaaaaggcataaccgttctcacaattgtaaattgtaatgcgccagcagagtaggctgaagattgaagccactattgcaccatcaggcaaagtgactatccccagatttttctgtcggctatgtaaatcatgtaggactaggagtatacaagaatcaatagtaggactagccgcgagtaactttacttggtaggactaggtaatatagattagtgcagcaattaatctagtgcatacatgcttgatgccaaaattaccagtgcgaactcccaatgataagctcagatactattaggatttaggactaggatatagcctgacgcccatgggtgcttgcaagggttcacaccttcacatggcaatatggcataaacatggccacgtacgtaggcgatcaaaaaaaggtgtataaaaatcgaaatcttcagacaaactgcaggcatgtttgtccaagttcacgttttttgctctgacaaacctgaatgggcattcttcgttcatctcctctgcatatagtactgttctttttcctgtgacatgtggcagagtgacaggtggctgcaataacacgtctctcgctgactcgct

SEQ ID NO: 104166 - DNA, 519 bp, Oryza sativa
gtggtaaaaaaaagggagaaaagaaataaaaaaggaatctgtccgattccttaaaaaaggggcgcaaaaaaaaccaggtgaaaaaaagaccggccaaaaaaaacgaatccgcgtggatgcggtaaaaaaaagagaaaaaaaaaacaaatctaaaaaaaaagaattatatgtggtgcagtaaaaaaatcgaatcctattatatttgacatggtactatatctctattttctctatctctactacttaaaaaaattaaaaacgtttccgttgtccgtaataacgaaagaagggcgaaaaaaacattaaaacagaaaaaagaaagttcgattcaatttacttccattgtccgtaaaaatcttatcttatcttaatctcaatctttccaaggggacgagcagcaccctccatccccgcccgcgcgatgaaacaccagccaaagaaaaaaaacaaaattaagcagagggataaactagattgaagttcccaaaattaaaagaggataaacgatattgaaactcc

SEQ ID NO: 104167 - DNA, 727 bp, Oryza sativa
aaaaagtactaacctgctctgaggaaaagctcttatacaaggacggactgttcatcacttaaagaggatgaggaccaggaactcgcaactgcatcggtactgaatactgatcgataccaggtctccaagaaacagaaaataaaggaagagagacaactgtgaacatttacttgatggtactaatatgttgacctgtactgtgcttgagaagcaaagcttgtccaacattagtacgcgagtcaaggttagtatcctgattcgtatattagtatattacgatactacgattttatcaaaccgaaacgataccgcgatatcctaattttgatagtatctcgatcctactattcattaccacacgatcctacgtaatcttatatagtatcctaattctacaatccaacaaaatattatttaaaatatgatagtttgaaaataatgaaatatgctcaagtttatatataaaaatcaattaaatatatcaaaactaatgtggtttttcttaataaatatctctatttgcatgacatatattattactatattttttatatagaatggctatatgtaattaatataaatattaattaaacttttaaaaaaagaaaatctcttagtatcccgatcctacgatacgatactactttgagcaaaactatattaactaagatcctaatactgacaaccttgtcgcgagtaactcaatttcttgtaaacacacacagag

SEQ ID NO: 104168 - DNA, 683 bp, Oryza sativa
agagtttataattttgttgtttttttaacttgttgaaattgaatttgacattgcatgtttatggaatgatatatatcgtattaatatttcttgtcaatttgttttaaaacaatttgatagttatttatgtgacatgcaagggtattctcccgagggataaaaatccatctccttttagtagttttagtagttgtacgtgccatgttacactaccttttaactatttcatctaaaatttatcatttgcatataggacgcatgaatcatttgaagaaatctagtgggcgtgttttaaaatcttatgcacagtacaaagtgatagtacaaaacaaggctctgtatgggccgacatatcatttcttcacgtgctcttattttagtatttccctcaataatactatgaccctgttccgaagtctgaataccagggtattggtcatgtagaaatgataggacatttcctatgtaggccagattacttgttcttaatttgtagctcaatacttcttcagatgcatatgagttattctagttttgtattaaattaaactcatccaactcggcagagtttataaaaaaaataaaccaacatcaaatcagttttattaaatatactattaaagatatcttgatagtgcatttttttaagatattagcagaattttttactacataaactcggt

SEQ ID NO: 104169 - DNA, 670 bp, Oryza sativa
aaacttcttaaaagttgaccaagtttatagtaaaaatatagtaacacttgtggcaccgaattatttacattgaatttaacattgaatatatattttgatagttgttttctttgtgttgaatatattactatattgttttataactttggttggacattaatggtttgattaaaaaaaatcaaaacaacttctatgatatgaaacagaggtagtactactaaattgagagtgcaagatgagctcatcaaatcatcaattaaacatcacctacgacttgctaaatactaattctgaatttaaagtgtgattaattgataaaaatactaaaataaaaatgaaattcaaagagtgaaaattgatatttatattaatttaaagtttgagattactaagttgcagtagaaaataataattaagacacatattggatataacattttattgcaaattttaggatcattaggtgcttggcgcggctggccaaagccaaagccaaaaataatatgtactgaaaataatatgttatttccatgcaaactgtgcaattagttttttgtttttatctatatttaatgctccatgcatgtgtttaaagattcgatgtgacatttctgggaaaaaaattgggaactaaggcctggtttagtttccaaatttttttttcccaaaa

SEQ ID NO: 104170 - DNA, 647 bp, Oryza sativa
agcaattcagcatacagaaaaaaaaacagagagatacttaccgccgacgagaggcagcaattaggtagaagagagagtgaaaattaaaaaaacaggcgccggatacgttggattgatcttaaacgattctaccttgcctcgattcaactgaatcaaatcgataatgtcgaaatttgggttggagactgttactcggtactagcagaggtagagggacagatggcctgatttagcttggagaggtggtcggcgaccaggtacaaaggccccgatttagcttagagagggaaggagggaaggtggcggactagcggcggcgagtagcggccgtcggcgaccggagagagcaagacgatcgttctggcacactcacatctaaacaaatttatgaggcaaaatttcctgcaggtattacctcgccaaattggaagttcacctggagcagcagagcactgttgaaggtaaaactgtttgcttggctgctggttcgaaatagactgtccacaatgaaaaatctcttgaagaagaagattgttcagtcagcgtcttgcgtgatctgcaacagtggcgacgagactgcaaaccatttgtgcttcacttgcccttttgtggtcagtttctggacaaatattggagtgcaaccctca

SEQ ID NO: 104171 - DNA, 670 bp, Oryza sativa
tgttgataaatgataatattaatgacaaatctaatggagtcaaacagtagtatttcttcgctattggctctgcctcttatctgtaggatgtagtagtgtccaatggtactacaccactactgttgtacgtgatgtagagttgaagacttcagtacaagtatatgacgacgtgtcaagttagttgagcatccgagacattgtggtgcatggattaatcattaatcaaaccgtaatttgacaagcacctaatttggagtctttgattgatgctttttttttgacagtttgattgatgcttattgaatgcgcgcttagtgtggtaccgatgcaatgtacgtactaccgcattgcatacttaaactatagtcatatttcatcttggcacacagaccaaagtaattctacttatcatccatttaaatatgctaccagttattccttgtaaacaagcgattcattaatatttacatttctcgatgcccatgtagccaatcttgtgtggaagaatgtagagtcacgcattaaatccgagaaagtcattaagaggataggttgttggattgaaatatgcctatcaaaaataatttttttagatttagaaatatgactatcaaaagaagatggagggagtagtattcatcaatccaagccttgtggacccatcgtttta

SEQ ID NO: 104172 - DNA, 985 bp, Oryza sativa
catatggtggtaagctggaaggtaacgccaagcgtggtattctcccgatggcaagcatggtatcctagtaatgacaagctgatatcggtgcataacgtgaagtgggtaacttgtatgaggttgacgccaaagatatgaattatgagaagttctggaactgaagccctgtcttcaagtaccgcatcccagtcgaagttagctcaaggtgcaaccaaggacaagtcaggtgaaaagaagattccatctgcaacaggagatcaagccaagcagttcagagtggggaagttttgctaggcaagtttgttataaaagacgcgacgaaagaagtcagacaagaagagaagaccgcccaaccaatcttcttgttagcctcctcgaatctcggggacgagattcctgtaaggggggtggttttgtcacgtcctgagaaattcatcccgaaacaaaaatcattttctaaaaggaataatagaattaattaaaattcgaaaagaaattggcaaacactaaaatacgtacaagaaaaattcgaatgtcgcccggagaatttttgttaaattctccttggtctaaaatgagccctcaaattttacttgaattttcagagcaccggaaatatttattaagcaacaacaacaattatcaaagtttattaaaaagaaaaacctaaaaataatcctccttcctcctttgggccccctctctctctctccctcggcccgcggaccaagtcctctcttcctccctctctttctctccctctccttctctccctccttctcttgggcctccccttcccctcccggcccattcccttttcctcccctcccgcctgggccgcctcccggcccaagctgccccacccagccgccccagcctcctgagccgccccccctcacgcgcgctgaccgcgcgccccgcatgggtcccacgcgccgggttgtcgtcctgctcccgcccggcctccttcctctctctcccgtga

SEQ ID NO: 104173 - DNA, 1347 bp, Oryza sativa
ttcccgatggatcgattgctaggaaagtgcgtagaacgatactagtgcaattgcttttattctggtagcatctgatacagagcccaaggttgaactgagttttggattccaactgtttaggttttacttcttgacttcttggtcatgtcacaaaagtttccatccttgtccccatagaagtacttctacctatggtcatctcgcttactcgtgaattcacctactttaatgacagggcaactgttgtagggttgattgctatcgggagtcttcttcgagtgacacaaatcatgttcctcattatcctttatcaatcacctttcgacctacttcttttcccagcaaccaaacatcttttccaatctcttccattaatcacctttcgacctttctcaaccaggtactcttcactccgggtgttgaggatacttctggggcgatgaggtccttgggcgtgctgtctttcagagaaaccttgaagtagttcgtcaaaagctagactgacgattgttgcctttgatccgaataagacacatctgaaactcttagtccaaacaaatgtctctttggttgatcacttgattttcttcgccatcaatcgtaggttgttttgaacagattatgagcttacggaaatgagaccctaggtctccttaatcaacaacaaaatgtacacaactcacagtacttgcaatcttaacatggatccttcataaacttgtcaaactcattcattatctcatgttcctctgttattacatgattgacagggaacagctataaaacaaaagtacttgaacaccgatataagagtattatggttgctattgactagcactaggcttaacaggtactgcatttgctccagtgaccacttggcgattggcatgtttgcttcctgtaaattggcgaaaatgtgggggccgattttgccttggttgaggacagtccctcgagtaatgcccttcttcactacagttgtaacaaacaataactttcttacactcgggttcttcatcttgtacttgatttatcagctgctgtattggaacatccaaaggtacaacgcagatactggcctctgtctcgtcagcaggtggatgggactgaaatggtgcattgacaccttgtggtagtgcactcgttggagttggagctgttgcaacgcgtgctataggactgcttcgggatgcatggatgacaattcgctgaggagcaagcttctgattgcggggagttgcgtggactgacgtgctggcagccatgtttctcggttttgggcacttgtcagcgaaatgacccatttcttgacaactgaagcaacagatatctttccggactcggcat

SEQ ID NO: 104174 - DNA, 608 bp, Oryza sativa
ttgaaagtttaaaaaaaaaattgaaagtttatctgtgtaggaaagttaagttttaatgtgatggaaaaattgaaagtttgagaaaaaaagttgggatctaaacaaggactaaatttcaactccaaattattaagtcctaagttggaggcgattccacttaatgtctacccaaaattgatgcgcctcgtgctcagcgattccattatactccctccgtcccaaaataagtacaaccatggttttttgcgcccaactttaaccattcgtcatatttaaaaaaattttgaaaaaaaaaacataagtcacgagtaaagtaccattcatgttttatcatcttataacaacaaaacttctaattataaaaaaatttcaaataaaacgaacgatcaaagttggacgcggaaactcatggttgcacttattctgggacggaggtagtaaaatttagggctgtgtttagttcacgctaaaattagaagtttgattgaaattgaaatgatgtgacggaaaagttggaagtttgtgtgtgtagaaaagttttgatgtgataaaagagtcaaaagtttgaatcaaaagttaggaactaaaccagtccttaaagcgaaact

SEQ ID NO: 104175 - DNA, 1334 bp, Oryza sativa
tgcatatttccctttccaattgcattctataaaacttgaaaacaacataaaaatttgtaaaatagaaaataccaaaaagataggataggtttgagtcatgctaggtaagacaagctagttctctttgttgaaatgatgaatagttgctctgttttatatctctgatatataggttcttggtaaatactctctcaaaaattgaataaaagtagccaacaattatctgggaacctgagataaatgggctgcacttgctaatctaagtctaagctgttgcgagatatgagatagtaaatatgagttgctatgatcctaatactagtttggcttgaattctggatgttttgtttttcaaaatgataaattgaaagatcctcatttgatataaattcctaccagagccaaaaatgtgctatcatgattaaaccatatacattttggttacttgccattctattgaactttgtcaaattcttgtgactagtgtagatacttcccatgctctatgatcaagatcatacacccacttttatgcacatgctaaactcctacactgggagctaagcaatattccattccatatccatattaccaccaaaataaattctccatgcttttatgtgctttcttctcctgaaaagaaaaatccttttgaaaaaaaagaaaaaaaaagagaaaggagagaaaggcatggttgtgaaaaaaaaataaagctatgctccatcaagcatgagcatgatgttgaataaaaagaagagagaaatgtagccatgccctctcctaatcaataaaagaaggattttttgggagaagaaagtaagcacaaaggagaagcatttttcttttatttttcctcatacaccatttccactatataccacacacattatgcacgatcttgatcttgagtatgtttagttatctgcattagtctaagttttttacttagtaacaaatgtgaatgcaactatgccatgtttgatccctaccgagctccacatataaaccttagagtaggaatcaacaaggcaacatttggtgaagaattcatgttgatacacttagagagactgagtgaatcacttgaggaacttggttttcttttccaaaatcatttgaaaacttccagaacaagagttgaataaagattgggtgaattggtactctaattgctattctgtctttcaactgcccaagacaaggagaagcagtgtctcgtgggaaccaggggtaagggtaagccaccgtgccaaagattatttaatccgagagagagtacatataccttgcacctgtatctttgagatatgcagcatagtagcaactcctgatca

SEQ ID NO: 104176 - DNA, 784 bp, Oryza sativa
gcaccgcatctgtctcccccacctttcctttctaggcaacccctcctcccgtatcgttttcctccctccccatcttttttctgtttttttttcagccgcccctagcctcctcctcctcctgtttagccgcctcctccaacaccctagccgccgctgccgctagccgtcacccttcgccgtcgtcgtcttggtcgtcgctgtcatcttatccggtgagctttcctctctcccatgtcatttaccggtgtagtttatccctagggatttaatctaatctaatctaatctaatctgttgtttggccctagcgtcgtcatcgtatccgtgtgttgtcgccggatcgtcatcgtcgaccctccctctcctgtccctttggtttggtgagatttctattcgtgtcccctcgggttaggtttagatccctcggtcgtgtcaccgccgctgttgctctaaccctagcgcagctgttgccgtgtcgcttgccggctgtcctgtgcaccgccgctgtgctagctgccttgttgccgctgcgtcgctatttagtcgctgtacgtcgccgtcgcgctgctgctgtaggtgtgccaccgcaaccgctgttgtgccgctaccgtgtgtcaatccaagccatccgatcttggtcgactcggtcgagattaatctcagccgtccaaaagcgatataaatccgttctctcttttcaatggcatattattcctttttaatatatgtcatctaccaaatatgatctaatctatttcccgttttaatcttttgtctcagctata

SEQ ID NO: 104177 - DNA, 916 bp, Oryza sativa
tgcaggtagcccaattggattacataacttgggcggcttgatctcaaggtttaggatcaaagacataatagagggggtgaataggattcctaagaaacatggtgtaattagaagttaaacttgctaaacaaagactagcctatgtgcctaggtttatcgcaagtgcaggcatgttttgtaccctagttgaagtcctaacaattttacagcaaactaagtattgaaaggaaatacaaactaaagagaggaaagtgataggaaattaaaacacacggcacgatgagttcttcccgaggtagtggggataggaaattcaaacacaagatacaagagtatagctccctcccatagtcatgaagtctatatgcgctatcatcatggtgattcttttttgctccagaaggtgaacccaaaaccttcacaaccacataaggtttcccacaaccttcttgagagatcaccggattgcctctgagactgactaggcatgccggaaagccaagagtagtaggaaaaaaccttcactagaagcccttagaaacaagactcttggatggtgcacagtaagctactctcaactcaaactagcactaaactactgaagaaaattataacaactagctcaatggtgttcttggacacgcccttcaattattgagctaaatagggtttccagaaacattagggagtcctagaaaagtgataaatatagccccaaccgagctcacttatagccattcgtagccattggagatcaagcagccagccctcctggtgaatctacacttcaatttgatgaaagtagaattggagatatctctcaagtatctcaattagagaatgaagctttaactcaacatttcactgagaatgagattaaagaggctgtattccaaatggaacataacaaagcacc

SEQ ID NO: 104178 - DNA, 665 bp, Oryza sativa
cctgtactccccttcattttatcatataagtatttagaaaaaaaaactaagatagagagaaaatattctttttagtctctgtagtagtcaaattttaaattttaaataacttaaattctctactaagcatctcatttagtggtgacaacggggcacatcaaggaaaaccaggccccatccctaaccccgatgggtcctcggaacccggtcggggacccaggtgaaggagagggggcatacatgtagggaaataaggtcggaactcgttgacaacgagttagggagtgtgagacagtggtaggccggcctgttgagagaaggagacgcaactgagcataacagagctgcgaagccgaggcagtgaagctcaatagaggtgggcgagctaggaggcgcacttcttcgacaagctagaagcagtgaggaaggtgatgctcggtgtgttgtactaatgtgcgagtagcgagctgggaggcagagaattgcgcatccaggaggatgggtggaatcacgtgatgtcatgagtgaccaattcgcgagcttcggggagctcaaattttgactttttgagaagcatatggtgaaaatgtagaagagctggatttctcaacttctgttcttttgttaattttttgtgtactctattactactatatattattaga

SEQ ID NO: 104179 - DNA, 871 bp, Oryza sativa
cagagaatcaagagaataattttataattactaataggaaaatagttatatttggagcggtacatgtacaacccaaacttagcagttaatttgaggcaaattctcgaagaacagtggcatttcatataaaactcaaaacatctatccaatcaaggtgaaatgttctgaaataggagcctaaagcttattatggctgatatgcaaaatgatgaatccaaactgcctaacggtacggagtcatttaaaaccaagtaataaaaaaaggacctatcctctaacaattaggatcacaagacacgttaggacgaccgaaataaccttgacagctgaattacattgttaactcttttttcacatcgtaagtggctagacaaaattaatgtcgcaccaaataaaacataggatgttaatcgccaatggcacctgaatttggcaatgttaaatacacgatttcctccactgcatttacattcccctcaccatgtttaaactcaggactaaaagaataactcaagagcagattcgaccacgtgaatgatgggtacaattaactatcatgtcgccaaacaatattataatttaaatgttataatacaccacaatatggttgtgcagcaaggtttcttctatactcggattattgaatcttgattactatatattgtacaaaaccatgccaatatataagcaccaggttatgttgaagagcgaattagtagtaagcgatacctccttggtttcctgcacttcacactatttgaattcttatcacagtacttcggaacatctttctccaattcagtttagccctgaaatagttttgcagtcgagtatgtcagtaattgaaatatgatgctgctcgtacattgaa

SEQ ID NO: 104180 - DNA, 657 bp, Oryza sativa
ctctctctctctctctctctccgttcacagactgtacagcactcggcgagagcaacgaaacgacacacacgggagccgcctcctacctgaacttgaagagagaaaacaatcctcgaccgtgcgcgtacggcgacggcgtgggggtcgggacatgggactccctcgctggcgtggcgaaccaccgctagattggcagcatatgcgcgcgaggccggcggccgcgaccgcgagcgtagtgcgtcttttttccggcacggagacgagggatgccgtggatgcgcatgcatgattgctgggccgtaacggcatggccatgtgcgccgcgagaaaatgcagctgcgttgtaccatcagggctactgtggagtggtggggcggcaactcatctgctgttgggagcagggtttactgtacctaactgtaaaaagtcagacaaaatgtatgaaaatttaaattatttttaaaatctgtttggattggtgggatcactgcatggttaccgttaccgtaccctgacaataaacccgattaacgtagtaaccggtgtttattgtcaaccctgattggaggcagagaccagaactattaccctcgggtgaaatccagtagtaaccggcctgttacgaaattccgttcgacaaaatttcaaacttaaaac

SEQ ID NO: 104181 - DNA, 1237 bp, Oryza sativa
tattacagtgcaagttgcttcgtgtgggtcccaccattaccagcttttaccacctttttctctcccccctctctctcctggcttctttccccaccgtagtgactagcgagcgctgagtgcatcaccggccaagcagccaagcggcggcggtgccaaccggaggggcggcgaggcttggcgctcgcccgcgcaccaccctcctcctccccccgaagaacggcaagcgccagcgatggagtagcttggtggcggagggcttgatggcggaggagctcggtggcgagacggcccgagcggcgacggcgccgggcagcgacaacgacggcgacgccagcctcctcttctccttccccgctctcgcctcctcctcctccagcccgtcgactacctcgcccctttcccctctatcctctagcatagtgtgggtcccgcttgagacgtgaagaactcgtagccaaagttggctactcggacctgagcaagctgcacggtttgacgatgtggcatggaatattcgtttttgggtgtggaggctgaatgccacttaagcccactgtgaatggccatggcctaggaggacatgtctaccgcagcggataatcgaggccgttgattgctgatcccaatgacaggtggaaatatttctctggtcgatgattgcgttgattcgtgttcaggcaaaggccgctgaatccaaagcggatcacagaattggcacgcacagaaagataacagttaaaaacgaaggagaaaaaaaaagttgggagaaaagcggagcagggaaggagacaggggagaagcgtcgagaaacgcaccgccccctagccctaggcttgcctccttccgcgccggtgggtgggtggataggggagtaggagagggggatctcggccaccgcccaccgccaccgccgcgccgccgccgcgcgcgcgcgcgcatcgcgtcacgatctcgcgagaccccgaaccccacgaaccctcgccgcgtcgccgcgggccgtcgcggtgggggaggaggaggaggggtgggtactcgttctcccagtgggggagggttttgccgcggcgggaccagtggcgctgttccggggctgcttctccttcgggtcgggggggcggaggaggcccgccgcctcgcccctgccctcgccgccgcgggcgccgccgctagcctcctccgcctccgccgccgccgcggcgctagcggcagcggacgacggcgccaagatgaagggcct

SEQ ID NO: 104182 - DNA, 1169 bp, Oryza sativa
attttagagctactagtagttggctatattattaaacttgctcttagctatttcatttctcataagagttaaatttagaagaggactataagtgggtcccatcaaataataaaaacaatatattagatattccctccgtttcataatgtaagtcattttagcatttcccacatttgtattgatgctaatgaatatagacatatatatatctatctagattcattagcatcaatatgaatattggaaatgctacaatgacttacattgtgaaacggaggaagtatctcatatgcatagagagagagcgtaaggagagaagtgagagattattattttatcccttatggctaccgatatgcatatggagagagaacttactatttatcatcctctcaaatatatttttcatttccgtttgtcagctgggcccacgtgttagcccccttctcattcgttgagtttgtggacccgtgtggacccagaaaggaggctaacatatagctatggactaccaataaactatatgcggtttatgctatctactattattacattgtggatgtcctaagaggtgatttgtgtattaacagtgtagtaggctattagatttgttgtaaatgatatattaaattttacataataattaattatactattaaatatctactctatagttcaacaaatactttcactcattcttccgttctttcattcatcgctcaaggttcagatcatccgcctaaaatccgaacggtccagatcgatcctgcctccacccccctcaatcagcgcaccgctcccgcacctccgccctccgccagaacaccgctcccgcacctccgccatcaccgctccgctccgtatcagccgccgcgccgtcctctgcatcgcctgtcctccgccaccccgccgcacgaggtgctcccgtcgccaggtagccgccgcgccgtcatctgcatcgcctgtctccaccgatcccctccgcacgaggtgctcccgtcgccaggtcgccgccgacgccttccgcggtgatccgatctgccatcgaatccccgccgccggctcgtcctccaagatccccatcggcctgtcctccgcctcctcgccgcacgaattcctcacgtcgccaggtcgccggcaccgatctgctccaccgatccccgccgcac

SEQ ID NO: 104183 - DNA, 688 bp, Oryza sativa
ttttttacagttagttcagaaatatttaggtttcagcattgaacgaggttgggtttttcttcccattgaacaaaaggcatctgattacaatttttctaaaaaaaattatttaggaagttctttgctttttttttcctcaacaagaaaagatggttagcattgagtcataaacttagaggtacaagttgctcaactgctaaggtctgttttatacaggtataatggcaggagaaatgtcaccaaaagaaaattctttctgttgattcacattattttccagttaaatgcgttcatcatttacccatttatttggatcacgtgcattgtcatttgctgtaatttactcatgtcccctaggtaactatattaaacctaccatctttccgaattgaacctgtttcatgtgtagttttcagtggtcacctgttggttgcttccattatatcacacagatttccaatctgactggtaatattgtgagatcatttttttttgtgtgtcatgttctttttatcagatgtgtcattgctgtacagaattaatatataattctcatgtgaacccgttggttgttgttcttttattagttgtgaatttactaaagaaaacatccaaactgaatgacgttggttactgccaaactgagatcaagaaatacatctactccagtagatggggctgcaggaat

SEQ ID NO: 104184 - DNA, 672 bp, Oryza sativa
acttaaaaaactctagtccgtgtgctttgcagcagtacgatgcctacattcactggttttactactttcatagaggtcctgctcctcttgcatcccttgctgatgctgcctccacggtaacccccgctctattctctgcttatctctatgaaatcactacgaagttgctgtgttgggtcacgaaactctattcggaatttgtatttcttttaataaagaaactatgctaaaaaaagtaagtcattggatttgcccaatacaaattaatttagtgatgactctaatacaaaattcataccaactgtcaagtgttaacaaacatgattttaactgttgttaacgtacttttatgggcacatgatgtaaccgtgtgatccattttgtgcctcttcgtgaataaataggaaccaaataattataattagactgtcatgagaaaagccctaatctgggtacagtcaaatcttccaatacggaatactcactgtacaaaaacctccaatccaaatggggcttcactatgaaacaattctttgggtattttcacttttttaagcgtttgaacctatgcccagccctgttgcttcattcatttggctgactgctgtgacactaactgcagcctccgtgggaggcggtttttgtaattgctccgtagctccttcctttata

SEQ ID NO: 104185 - DNA, 522 bp, Oryza sativa
tactatggatagagaagaaggagcaagttcattttatgtctcgagctagtgaagaaatgatttattttcagtgttgaagatcgcactataggcaaaccaagaaagaacaaaccggtgagtcttcagttaaaaaagaaggtttgtcttcagtcaaacaaaaggaaagaaagaaagaaagaaagaaaacggtgagtcttaactttctttcactctgactctcttaaacaaaatctaaaagagaaataccagggagatcaactttccaataacaacacaactttcaaacaaaacacaaagcatatgattccacaagacaagactgatcatacaaatccacaacagagaagttccaatttatgccgtccacaaccacatgtatgtacatcacgcatcaccaacctgcaaatctgcaattcatagtcaaagatgttgtgcatcacaatcatcatccactccactagcgcaaaacatgcccggatctcttgaacaggaacacggcacatcctgtttactgtgcttatc

SEQ ID NO: 104186 - DNA, 965 bp, Oryza sativa
ctaacatgaaattttaataattattaaagacaaatagaattgcaccgtaacgtttagcacggacatattactagtaatctattaaaatacaaatctaacctgccaactattatagctcgccggcataatagtaggtttgctgaattccacgtctgcgcctatccatctttttcttcggattgagaccacgtattcagcatcagcaatgctaggaaaattcaacgctgggcttttcttgagagggacagcatccgttgcaaatttttgttgtaaactacaccctctcaaatatgtgcaaaattctgaaagcaacttctaaccatctaaccattgtgaaatgaaaaaaaaacaaaaccaaaatattttaaccacgcaatgtaattttacttccagtacatatttttaacatatcaaacattcttattattgtttaggacaacagtacctttgggataaggagagagaaactccaataccataatgtgtgataaatctctgttttatgggttcgatatacaagtggtacatctctatcgtttgaaagggacatatacaagaagatttttgtattttcctagtcttttgcctaatgagttcttagcaggccacccttttgggcccaatattgtaagaggtccattacaaagaattagggcaatcttacatggctaacttctatggtcttcgccacttctgatggtatcatcggagacggcgtttctcgtcacttccacgtaggatcacgggcgggcttgttcactttgctactatttacaatcttattttttttcttggtaaagttacctaaaataatagctacatttaatttgttgctaaattttaataagtacatatgaaatcttgctaaaatttgacaaccttaccaaaatttggcaatgccaaaacttgataaggttgaaaatggtagcaaaatgaacaagccccatattcatgtttttctaaat

SEQ ID NO: 104187 - DNA, 654 bp, Oryza sativa
ctctattttttaatttttaagtttgtaataatactgcccaacacggccaggatgaagcgtcgatctgaatttctttttcaattttgagggcactctccttctagagacactcccttatgaacggagcatcgaatttgggattgtggcaaatggcaatgcaccgttgctgtgcacaggtgccggccgggcgcgcttacacggctacacctaacacgcctacactcttttttctcatcagtcatcagaatacttacacgtttacatttgtgcttttgacaatcctagtaggttataattagtactaagtgcttagccgatgaacgaaatgatgaccaacaccaccgacacaccaccaaaactcttgtatggatgtttttctgttgtttgcatatcatttaaatagttacaaataaattaataaaaactagaagatatattaatatgtgatatatcacttcataaacacgtaacttaacatttaatttctacttgtaagtttaatttattttttgttgtcatatacagaagttaaattttaagttgtatgtttgtagagtgatatatcacatgttaatatattttttaaaagctttttataactatttgagtagtatgcaagtaaggagtggaagtaaggagtggacgttcaaaact

SEQ ID NO: 104188 - DNA, 730 bp, Oryza sativa
gggcacaaatttctctatcacatataggaggtgcagagcaaaatgatggatccaccaggccccgcgtttgctgcttccgctgaaaaacaccgtgaaaacaaactaaaatggggcgcattgttcacaaaatttcgctgctttggcttcaaacgaaatatagggcgatactcctacaaaatcgcaaacttgttgtgtggtgtacgtataccactcttagaccttgttcggtttagagaggtttaaagaggattggagggggaataatttcaaatcccctcaaattctttcctcatagggattaaccgaataggccttatgattattcttttccccaattccggaggccattttgtactaacattgctaactaatatctccgtaccttatatgtggttaaattatgagaacgttcgactcgcatgcaacaaagtatcatgtgcattagccatttggcctgcaggtcatcacataaggcatacttgttagggtgcacagtacacacgctactaattaagcgaaggtgtgtcacaccctcacacgttccttgtgttaaacatagcacacgccacgacctgccacacttattttgtgcacataaatggcttgtcctaattttaagtcaaattaatgttgtgtttactgttaaactctcgagtattagggactgaactaaaaaacgtgtgattagacgaattgtgaaagctaaaacacaaaatataataaagtctgg

SEQ ID NO: 104189 - DNA, 660 bp, Oryza sativa
aatcagcttatgataaaagctctgacggttgctgctttacatttaatatatccacatacaaaccgtgtctagaagccaaaatcatcttggcgcgtgcaaagagtgtacaaaatcaggttaccggttttgtgatgaaccagtcgctagtctaactgactggtaagtggattttgatccgtgtatgctgccagccctggggcccctgccatgtgattaccaaactttcatggaagaccaaacccgaaatgtattgccatcaaacggtcttgcctggtctaaaactatggtagtagaatgcctccaggtgcacgctattggcgtgcgtgtgaggtcgttatcagcatcacataaatagggaacctgacgtaaaatattctctttttgccggttactcccacttatcagaagttccttttcaagctttcagcctacttatatagaatttctccaggtatgatctactctgattctattgtgcaacaaatttcctttgcaaccatgtaaataaattaacacaacatttcaaaaatcgacatcactaacagttcctatgtttctctccctgaaatcctaatttagtacaacataccttcaaaatttggtggcgtcagaggctcagagctgatatagtgttgaactgcaccaattccatatgcgtta

SEQ ID NO: 104190 - DNA, 1323 bp, Oryza sativa
agccgggcgtccagtagctcgtgcaccaaggccatcgccgatgccaaggtgctcttccagcgtcgccgacgcctttccatctcctgacgcggttgacgcacgtgtgcatacgagatgatcgatggctcgaattgggatactttttttgttcttctcaatttttgtgggacttgcacgaattgtgtggcgtgacatggacgatggcacaaaattgcaaagaattgcgggcatcgctgtcgtcctgtcgccgacctccattgtcagttggtattgcttccggggccttggctaggccgcccggcgatgctccttacatgtgtggtgacagtagccagatgatggccggtgatagcaagcaggtacagcgctggccgctgcagccttcacttcgccgctccgatgaggacgacgccctccatcagggaagactagaagagcacaaatcttcaaaggaaaggggaaaccgagcaagagcaagcaaagtaggtggactgaaagaactcgccgccacctcacttgcagcatgccatggatggatgccctatcgtccagacctaggaggggtaaaggaaggaagagcatggtcagtgggtcactggcgggtggatcctacaggatgactcaacgggctggacaattcaaagcgttgtatcggtgaccaccttccaaaaatgccgagggaggcaagttatacctgttttaatattttaagtgtctagatatccggtaccacgattcaaggatatgaataagattggacatatattgagggactagaagtagacttactgcgctgtataaccatctcacagaaatcaacccagtaccccgatgccgtgaagcccaccaacaccccgtggattgagattctttaacgaattaacgtgaaggtaaaaagacgtggctcggtcacatgttagcgatcgtcagagggaacgtagcatgaggctcttccctcacctcgtttccggcctttcagttttggggggcgcccgccggcgcgggtcgcgtcacacacacacaccgcaccgtgacagcggcatccgtagaatcgccggcggcttggctcacctgagagaccccgacagcttgggcgccgcgtacgcgctaccgtggccaacccaaaagagggagcgagcctgatcaagcagagcagtgacttgcctagcgtgtcgctgccattcaccggttgacgaacggactgcgatactgccagccaagtaaactgtactatgggatcgcgaccgtgtagccaacatccctttctgttgtcacttccggcaggtcactttttttttcgtcatttgtaatttacgcattttt

SEQ ID NO: 104191 - DNA, 744 bp, Oryza sativa
tgcactgttttgagaactttttttaacaaagatatcctgggacatcttatttctaacttatattaaagaaaacagaaaataccatatcaaaaaggaaaattacaatcaaatttaacaaagtcttctttttcaccgcatccatcacaaccatggctgctctatgttgttccacatccccgtcgatcctgtcactagtggcagagaggacaaacagagaacaagaaaaaaataatgaacacttgtattttttttagagcttgaacacttgtgtttcagctttttttttctctctctcccttcatccatgcttattcataattttgattgttatatttgtatattcatagattttccattgcatacacatattagcatatgttatcccacattttccgctgcatatttttcctattttaatcttattattctctatgtcttaaattataagaagttttataagattatagatctatcaggaaagtgggtggaactacacagtgaatggttgtgctaggtcaagatgagatagtagttaaagaaattaaaagtagaggattatatttggttgaaagaagagagtaggtggagaagttctattttatgacaatttttgaatacgagaagttattggatcttagaataaatgaagtaattttctcggtcattgaaatatcgaaaaggaaccgacaaattttaccaacaaaacgtaccatccgagcggagctgccatgcggggctgcagga

SEQ ID NO: 104192 - DNA, 538 bp, Oryza sativa
gcagcccatgatatatcacatattgatgtatattactcccacctttttaaatatttgacactgtcgactttttagcacatatttgaccgttcaacttattaaaagtaacttttgtgaaatatgtaaaactatatgcatacatataagtatatttaacaatgaatcaaatgataggaaaaataatgaataattaaataagacgaacggtcaaacatatttaaaaaagtcaacgacgtcaaatatttaaaaacggagggagtatatttttttaaaaaaaatatgaacattttaggcaacatgcataaaataagtggaaatcaccttgagggacaaaaattaattatagcaaaatatgttttccttcttactaatctgtcccaaaaaaccaaactctggctatgaacctggacacgcatatgtccaggttcgtagctaggattggatttttttttgggacggagggtacatctgcatgtaaaattcccttgcatatttgcagtgatatacaacaataacatttgtatattttgagtctatt

SEQ ID NO: 104193 - DNA, 632 bp, Oryza sativa
aattcctgcagcccgatatgaatattgtatattgttttctggttcctaatcctacggcacttcaattttgcatgttaattttcttctcatgccatggagaagcggccggcgacagcacctgaccctcgactctaaacggttcaagctctagcctggcttgtttggcaaggggattgggagtttacacgagagaattgatagtgagattaagatgcgaatttgatttttcatgccagactcttgtttggtagaggtggtgaaaattgagagggagtttagttggagattaggtcattaatgaaaacggatggcgatttgtttaggcgaagtaaaggaggaattccctcccaattacctgcccctacccaggtattgaaaaggagggagttcattcctcaattccccatccccatctcaccaaaattctcatctcccaaccaaacaaaacagttaatagcatcatcctctaaactcccaatccctcctaaaaactccctccaatcaaacaagatctccaaaaaaaacacaagcacgaagagcacatcagaagcgatgtcggtggtggagcacggcacatcggccatggtgctcccagtcccatatatgtcagtctcagggacgtctgcggcgcc

SEQ ID NO: 104194 - DNA, 681 bp, Oryza sativa
attcctgcagcccccctccaccactggagtatgtcaaaatcatcatcagggaaatcattttcttgaggaatatcttcgagatatctagttaactcagtctttactttactcttgctttgatcatgaagatattgcctcgtgtgcgggtgaagggggcgagaccttgtgcctgatatatttggtctcaagtctcaacatgcgttcatataccaagtttcaagtagtcttcgtcatagcaaacctggcaacaatccaaaaccatacatgtgagtcagctatatatgtagcatgagattgatatctccattgagtaaaatcaagagcatatttttcacaacatacaccgtaccatatagtcgttatcattgctttcagtgacatcggcatcactttcagaagccatttcactttcactgctctccttattcttatatgatgcatactcaccaatcttttcccacacaaaatccaaggcaaattgtcgaatcttcatggaggtactaatggattcaacaggaaaacgcttcaagttctcaatcaaccactcagcctcctttctgataccctgatggtgcaaataaattgatcaaattcaagtgacacaaactttagacaagcataccagaatgtggttaggtgaaggcaggcatgcacataccagaagggcagaagcaatatcaa

SEQ ID NO: 104195 - DNA, 706 bp, Oryza sativa
cgatccgtaccagatccggccgcgatccgccgccgatcggacccggggcccgggcacgcaggcggatcggatcacttaccgatcggctgctgcggcggtcgtcgtcgtcgtcggctgctgctgctccggcgccgccggcggcggcggcggcgaggaggagggatcgggggcgcccgcgtcgccgctcctccctctcgatctccggcgcggctaagatctcgatgcgggcatgggaggagggggaggaggaggaggcggaggttggggggatgttacttgggcttcgacgcttcgtctcctcctctccttttatcgaacttttgctctccacctccctccctccgctcgctcgctcgcggtgccgcgatgcgctggtggatggttgttttgggttttttacttttttgcggggagaggccaaacttttttattcggcctccggaaccctgcaattgcggtgctcgcctcgattgggaaagcgggggaggagggtggggggacgcggaaatggtataaataatggacagcgggggcggggcaggtcggcctactggcccctttgccgcgctggacgcgacgcgactctacgtggctggaggaagaagacgacctcacctactgctgcttccgccgccgccgtcgccgatgctgccgtgaagcaatctcgctcgctcgctcgctagcggcgcctttaaagcaggggagg

SEQ ID NO: 104196 - DNA, 682 bp, Oryza sativa
attcctgcagcccgaatgtgacacattctagtactacaaatctgatcatacctctgtccagatctattatattataatatgtcatattcagttctagattcgttttttatgggacggagggagtatatactttcagtggaatactgcaagtttaaccttttcactacttctatgtactttgaaatctcaattcatcaatttaacttgtgtttactgccctgttgtgtataattgagcatttgctatctgttgagttcgtctgaaagacagagttcataatagctgcctgtaaaagtgcttttctcgttaagatttagattttaccttgattttcgttagcatgttttccaaactactaaacgatacgttccgcaaaaactttctaacacaagttgctttaaaatatcaaatatatcaatttatcaagtttgtaataattaaaacttaattaatcatgtactaataattttctcgtttgacgtgcgtcaagttaaacttagtcttcgttagttccaatctcgcaaccaaaatatgcttgttgcttcgttagattgaacagcattcaaacggtttggatgagcaggtacaataaagattcatccgtcggcgatagtgtatctacgttggctcgcatgctgtgctggaggagagaaggatagtgagagaacgctagcgggtgact

SEQ ID NO: 104197 - DNA, 561 bp, Oryza sativa
ctgcagcccatataggaatatatttttcaagttcatatgtattgtttacagaataaattgacccaaaaattcataatagttaataatattgaagtaatcatttgaacatcattatgccagtgcacgtttcatcaataagctttatccataaaggcattattaaatgctaagagaacattccatcaactagcttttacaggcaaacacatagcggtaagtagtgccaaggattaaacagtctacatagtcgaggaggttatgaattttctcagcattatttaatttgagatggcatcttagtaccacggataagagccatagcttaatccttgtagatgaccaccgacacactgagaatcttacactgagttacaactgcaggccaattgattatctatccaattatcataattgcataaacagtcataattaagcagcctatgggtctccgtggaacagagaaatttcctgttcatgctgaaaaagatctgattcatatgaaattaatatcaacttcctatgaactgaaatgcatgttttcgaaaaatgccgtaattgtgt

SEQ ID NO: 104198 - DNA, 837 bp, Oryza sativa
ttctccttccccggccccaacaaatcgagatccaggatgccctgaaccgtcaatacacgatacttacctcacttgaatgaagcaatccctaaccgcgagcagaggtgtgtgctgcgtgcgctaagctaggggggtgcggcatgcggcggcggcggcggctccgcggggcatggcgacgatgcggcgcctcggcggcgtgcggcagcagtagtaggcccgcattgcaaagtggtggctctacctttgcctcgctccagaacgacgacgccgttgggtaggaaaagatggacgcggcgaggattggtatcccgtgagaagttaggattagatcgtaccttgtatccatgcgtatcagagaagtatccctaattatttcatttttctgaaaatcagaaaaatagaggatacgtacgggcgtatcggagcgtatccgaatacgtatccgtattcctttacgtatccgatacggatacgctcccagccgtatcagggtatcctaggaggtcagtattgcagcttttgctcaacatatgcttgaggaattggagtagttagttcaacccaaatctgcgtgacgtctcgttccttccttaaaagaataatcttgtttagaagtaaagcgttttagtattagaaaggggccaaaatgttcgcttaacgagagggggcttattttgctattgtagtgttgtgcacagcaaggtttcgtaagtacaatgtacatatattaacaacctgtaatgttgttccccatcacgcaataccatactccgtattagattagtgctgaaccgggaagccaatgaagcctagttttacacggtaatcaaccaatat

SEQ ID NO: 104199 - DNA, 1021 bp, Oryza sativa
tgtgtcagctcacggtgctcctgtgctacatcaagacggtacttggctttttcttaatctaaccatgctttgcatcaactgaatttcaacgaagatgaattgcatctcttcagaggatccaagcagaatccttccaacgggtgctacaaatttcatactactacgcagtccttttcacctgttcataacttccaatgggttctgaatttactgataattaacaatgagatgacactatatacaaggagtactaatattgttcttaagacttgctattacaggtattctttcagcagtactctatagtccatagcagaaaacgcttctgaatcagatttacatgaatgcaattttatatctgatctgatgaattccatgaagtcataaaattgctattcatgacatgaattgcattagcgcaacattgtattgctgtcagttataatgcaatttgaaaatgtgctcaattagcagtgcttaatttccaagatagaagcatgttttgcatgaaatgtatttgcattgaaggtgaattattgcttctacagcctgctttcagttgcttgttaactgcccaagatgggactgaggctggctacagcctctcttttgaaggacatggattgcatatatttcataactcaactgctagtcttcttcacttgttcataattgtgattccaagcttctcaaaatatccgaactgagatattttcagcatcagtttgagaagcttggcatcaccgtcgaactactactcactgccggcttggtttcccaagtaagatgagctttctgccgatcgatctggatgagatgtgcttgcctcacatcgaggcgtccgtgtgatgttgttgtcgtgctgatcagtgaactgtttttgttgtttccgttccagctctgaaccttttctgtttttctttgagccaacttctgaagttcacatatttgcagttgttgattgtccagtaatcccagttagtacaatgtacttgcaatgctggacctatcataacatctt

SEQ ID NO: 104200 - DNA, 1346 bp, Oryza sativa
ttcagtcatcatactgacataactaagccgcatcagtttcagctagccgtgcaacatgctgaccgtgctacatgttcagaaaagtgagtgggaatgcagagacagatataaagaaacacgtctttcggctagctccacaaggtggtggattagacgatctgagttcaaagtctcaactcttctaattatttgatattatttgatattatgtactttcttaatattcgcgtcttgggaatggtcttgggaatgcagagataagcatcctctccatgattcccaaatctaccgttcacgtgttactgaaagcttcaggtatcttcagataaataccaactcttaactgtttaaccaattccactgctactaaattgtactcaacattacatcatgcacataatataggaataaatcgtggcacgttactattaatagttatgagttttctatgcgatacattatttatgacaaaatttatttttagataatgaaataaaagaatatgtatttgttttatttttagaatgtcataaaaatgaggagcattcataaaaagataggactaccaatgctcacgatattttaaatgcccccataaaaaatctactatcatattaaatttcaaataaaaaatttaatttattacatttgttttatttttaaaatttatgtcaaaattttccgtactaattatttagtctcattagttacataaaatgcacatactgtgcactcaaatgaaattttcaatagtttttgaagctaatattcaaacctaaatcatcaagatcattaagggtgtgttcggaacccttggttcccaatactaagtgcccgcacagaaaatggagcagcgattagcgggtgattaattaagtatttgttaattttttttcaaaaatagattaatttgatttttttaagtaactttcgaatagaaacattttacaaaaaacataccgtttagcagtttgaaaagcgtgcgcgcggaaaacgagggagatgagttgggaagaggggctgccgaacacaacctaaagacatttgccaacaaacttaatagtgaaatgaaggaaaatgtaatggcaggggcatgtaagggggtcaagttgaaatttcaggagtataaaagagattaagtgagttttcaagggtatacggtgaatttactcataagtataagcgagaaattcattttatcttttttgtaaactaatttcaaaacagtttgaaaggtgttgttaagctttaaacatcaacatactttttgcctaacttttaatcgacctcagttcgactttcacaacacagataaattaattcgactgcactatttgcccgagttg

SEQ ID NO: 104201 - DNA, 545 bp, Oryza sativa
atcttccatagttggcttggtggtttacaacgtagaataaatgttaactttttataggtgccgtagctttgtgttggacggtaagactttgtagtaatgatataatcttcaatggcttaagtactaactcccctctttgtaggtaattttcaggtgaacccactgcgctagtggtcattgttgcttaacgaggagaatagcgatgtggttaaacacatgcacaagttaccggaggctagagtttgggatttcttttccagatttgcgtggaacttgagtaagcggttggagacctagtatccacttttgtcatcttttgttagttggcttctattcacgagacgacttcgttgtgaggtgttgtagtctaagtacccttgttttatttggtcggtggtgttgttcttatgcaaggtgtgatgctaagtactattgacaatgtatgtttggctatgtacgtatagtttggatgtagaggataggtttttaatcatttttttaaaaataaattgacattttctccctctacatgtttatctatgttt

SEQ ID NO: 104202 - DNA, 510 bp, Oryza sativa
tgtgtcgtgatttatctccgagttctacttggaaaaaagatgatatgatccacgctatatatacaatgcccctgcgtgcgaggaggggtattgagttacaagccatagccaaatccatactgagaaataatccgaaggaagtaagagccatattcaccgaatagatcttgtcgggccgttctggcatcttgaacacccccattgtgtatgtgggtaatgcttggaccacatgctcttgaccaaggcttcttttcctgctgcagataaatacctctcgttccaatcatttaatctgatagcaaacctctcttaattggatggaattgcatagatttcattcttccttggagagttggtagccccaggtatttgtccttaaaacttgcacggtcgaccggcaatatagcttcgattccctcctactccctccgttccttaatacagggcgtgagtgttgtattgcaaagaccaataaaactgtttcaacagtagttacaccgtgtgatattt

SEQ ID NO: 104203 - DNA, 620 bp, Oryza sativa
gacaggttccgccggtcccttcgcgtcagccaatcgacgtttcttcgactgaggagccgactacaggaggcagccaggccaacgaggagtagaggaggcagtcttcagcagccgtccgtgtgttaggcccttttgttccgccgccaactcttttggagtcgtggcgaggtagtgcgtgcgtgtgtttgttgtgggtgttgtttggtagtctggttctcctaggtggtgtgcgtacagtcaagctcggcgtagctctgtgacttgtccacacccgttgtattaggtgtttttatgatttgaaaaatccagtttaagcctagtgtgtgctatctgagttgctatttactttgctccttgcccctccctaaggtgcttatctgaattcttacctcgccatcttctgggagtttagatggctagccgcccccgccgtgctgctcgtgcgccagcccgcttcggttttgaagaaggtagagttgagacagaagcaaatcatgagtcagctaatgagcagtctcaccgcagcaaccgttcgcaccgtactgcttcccgcaacgcagaagttgagcaaccccgccgcagcaaccgctcgcatcacacagcttcccatagtgcagaga

SEQ ID NO: 104204 - DNA, 2677 bp, Oryza sativa
ttcagcaatgtataggcagctgtaccagataagcagggtgctttttttgtactccatataagcagctgtacctgggttcttctccagtctgaagtttgctgtctgtatactcctgaaataagcttccagcgtgagtaagtgcttgatgctggaatattcactgctaactgctcccgattgatttacaaattacaaatgtgtgaatatatgtaaagtaatgtaaactattttatttgtccgttcatcttgtcttttgtcttcagtctctttcactaggttgcgtaagcatgatatgataagtatacaaccagatctgggctttggaagagtgctagactgcacacatggttaacatttgccacgttttttctttgttttgagatcacgttttcattttcttgttccggtaagagaacgcatatactttcactttgatgcaattttcaaccttaccaagttttgataaagttgccaaaaaaatgttaacatttagtttgctattaaattttggtaactatataggaaatcctgccaaaattttagtaagttaccaaaattttggcaatgccaaaaattagtaaagttttttttttcatcaaagtgaacatgcctttatactatcttgttttttttaagaatactttcctgtttcatagtatttttgtagtcattccgtgttggtttagttgcaaggtttggtacagtagagatgtttggttccgtgcctaattggggtaataccagaattttggtaggacaaataaactttgatagccctctttactcgcctatcttgttcatcggaagcattaacgctgaacttttccgtggtggagatcaaccttgcagaaagcgaagcggatgaacgattgatcgatctcgtcctgtcgatcaaattgctcgcatttttcaactttctgcaagcaccgatcggccggctcgtgcgaggcgtagtacagtacaaggtgtcagcgcgtagacaaatacttcttctatcccattttaaatgcagttgtgagttttttatctaacgttaactgtcagttttatttaaaatttttaatgattagtattttattattataagataataaaatataaatagtattttatgcgtgacttatttttaaaaagttatataatttttttaaataagataaatggtcgaatgttagacacacaacctataactacactataaaatagaacgcagggagtaatacaattacctctggacaaaagattgatggtatgtgtgtatgtctgccttggcaaccgaaagtcttgcactcaattgacttccttgccttctggtttgacatagctacacgttgcagagaatcagcgatcttgcgttgtaacatcgggctcagatgtggctgagcagagttgagctcgcagtgttcttcaaacatgacgacattgggaacagtggaacgtgatcacgacaagcacaaaaaaaagtgagagaacggcagaatattaagctcattcccaacccaaaaccctaaacatagtttccataaactctacatcatcaagaaactagtactagatactatttttccaatgcaaacaccactatttcatatttaactttaatactacttatctcacatgatgtcttggatattgtgtagaaacaatgtctcatgtaagacatggttttcttctctttcctcatttattcacttgccacatcattttttattctaggtggcagcttattcaatgctatgaacactatctatttattgggttgggaatggctggcggttaattcaatttgctgctgactattagcccttgtctgcaagtgttcctgacctgttagcatgttgcttttgctggagtagtacttctatttatcttcaaactttagtcatctctttttttcaacataaaatttataaatgcttgaaatggtgttataggagtactatctaatggtcagtgtgacaaatataaccatgcgactttaattcatcataatctaataaccgaaaatttagtagtagtgtagtactactactctataatacaattactcttttgtgcttatatattatgttactctataatacgatgaaaagtagtattatttgtggttagatggcaatagttaaccatgacaattattcgagtaatctataacactgtactactctgcattgcattttgtgggcctaaaagattgctgtaccagagagtataatacaccatacgtacacaaataatactgctctttaaggaccaaacgggagtcactaatgagcttttgtaagctaggaataatcaacgcataataatgatgaaacaaagtgcataattaatcattctccccaagaatcaaaccaaagctccatctgatgacaaagatccaaaccttttgccatcacccaaattaaagtacaacaacaacaccacacaatggaaagccgggcccactttatgacgagcattctcatggtcggcgccacgcgtcgtgcagccattggtggcacgtcagcatcatcgtcaaggaatggaatcccccgggctctcacctcaagcaaagctacctccattccatcgctttcgccttctatataaaccccttcttctccatgagcttgcaagcatgtgtgtagcagtaaatctgcacaagaaaaagattcaagaacagtttagatttcag

SEQ ID NO: 104205 - DNA, 555 bp, Oryza sativa
caaatttctctctatgctgaaacattctgctttatgggtgagctcacatattttggtgacagcagaattctgttattctgaagcataaattttatgtcatgtgttcaacgagtccaatgataggaccataggaggctacataactgaataaattgaatggcatcatagttaactatctccggatggcgctccatccatgcgttcatgtcgttgtgcaagtacttatcattgagtttcttagcaatcatgtcaacatttagctatgctggcaaccatggttgtgtacttgtgttagcctgtaatgtaaagattcatttccttttcatctgaatcaacatgatcaactcttgggtagattctttgtcaaatgtacatatgattggagggaccatgtgtgatttatcattcaatcagactagcaagatgttggtcagttagttctcatgaatactgtcatttagctatatttcttacctcaggaccatattcctgtttatttgtcactacaattcacacttgcatgtcataaaaaaaaactttgatatcatattagac

SEQ ID NO: 104206 - DNA, 2284 bp, Oryza sativa
gtatcgcaaaattcgcgagattcctggctcgtatactagacctaccaatccgttcgcgtctggcgcacgttcgcgcgatagacttacccgagagcaagggggcgaagaaggataagctgtcacgatgttccaacgtgtcggtatttctctctatattcaaggtgggtcccacgcgataaaatggtggaacacaagtgtgagcaagccaaaggcactgccatgtgggtccaggtcgtggtaggctacgtaagggtgacgagaatggctaggaacacaggtaaacacatgttttattcagtttacaggattttcagagatttttctgtttctctttctttgaagttcaaattaaccaagttagaatgatgttaacaatttggtgatttttgtggttataacctatgctacctagattccatttctcaaagtttcactcaaaaatttgaaacattttaattctgacaaaaagatgaaaaggggtatgctgagaactaaattgaatttttaggaggtcaaaactaagggtaacaattcttgaaaaattatattaactcctgataaatactgtagcatttgaataaattataaaacctatatccttctgttcaacttaggcacatttagaagttgcttcattttgccaattaggtttctaattaatttagtttgactaccttgactattttacttgaggtagtaaaaagtttgatacaatcacaaaaccttcatagtggtcatcttaggttggctaagtgacaagaggatattcattgattttatgttgcttagatttgttacatagtctctaggtttatttaacatgcatcaaccaattatgaacgacaaaaaaatcactcaagccaataaattggacttcactacaaacaactacacaagcacacaattattagttactaattctactaaccaattactaagcatgattgggtagattatcaaagagcaaaagattaatgactatactacaacgtttcttaactaccgcttgaccatttaatttggttatatacagagaggcttggacaaagcttggaagctacaaagtagaagacactaaacattagagcttcatggattatctattgttgagtcagcttagtctcttgaaacattgttcccctcgtggaagggaaaacacaaattagtcgagctacacctagaatgtgttggtagattttattagcgccaaaacactctctgaatgttggatgagtctttaaaaatagttttcatttatctaccataaggttgtagggtcattagtctacctataatgatcattaaagtttcataataactcaaaccaacagttatggaaaattgtttcaatttctacccatttttttatatatacacaaattaaccggatgaggttttgaaccgaaatagctttaaaacttccaacttttactaaggatataccccgatttccacttaagttgattaattaaaactgcaggatgttacaattttgtgcgatcgttatttcattaacgacagtggcattgtgccatcgttatttcattaacgaccatggatttgtgtcatcgttgttttttttaacgatgacaacactgggtggtcgttattttattggcggcagtattatcgtttactaatgacagtggtatatttagattcatgatcacattcacaggaataagatgttaacagactaataactgaaaattattaacaaatctttattgatcaaatgcaaataatttaactcatttgttacataattggaaatgtatgtacataatctaattaaatttccgtacaactacaagagagctatatagttttatagtagtcttcaactaaaggttgtacagctcttggcttgtttcatgcttgttgtgagccctgcaaaatacaagatttcaacaatcaatacataaatgagctgtgatagcaatatagagttacaacagagcatatagctcagcctgaataagagagcagtctgcatgcttctgctgtgaataagatactgatctaacagcaaactatgataaatgtaaccctaacatgtaagttattagggtcaactttagtggtccatcatctgtttattattcttttttcattccaccaaagcataatgagctgggaccatatatgatatccttgttacaaaactaggggaaaaaaaagacaccgaagtgacaagagatatatcggaatatcaggacatatcatattgatgcattacttagctagtataagaatgcataccaacatataactaatcctggat

SEQ ID NO: 104207 - DNA, 2560 bp, Oryza sativa
gtatctaattatctctatggttgggattgttttctctgcagaaggacaaaatagtgtgctagcgtcatagttgagcactaaaccttaacttcacactgatactttttgctcaattgttgtatgtcattttatacaaatgtttaggatatatatatatttggcatttagtagagaactttgcgagttaagcgaattttgctatttgatttacacatgttaatcctttctgtcttgatgtgtggagctactgcacaagaaatagcctacagatgtttctctgtcatttatgttttgtctattaatatacttagttttggatgttggatgaattactcttttcttgaatatcgggatattactattttttgtccccgtgttcaaatgctaagtgcagatatcaactttgatatatatttgctcggtattatttacacttgtgtgtgacgttccttgggcaataatattattggtttaattttctttatgtattgcgtaagaaggtttcgtatatagacgcaggggttcttctaaaaatagcactggatacacacacattctagcattcagtctaagtgccttctccaacacaaaaatatgaaattgtagtcgtagcgcacataatcctgctcaagttgccgcgtatgcgaccatgtgtaatatttaacagatattgagccaccgtataaaaagaaaaacggtgcacgacagctaccgcgcggcgttacgccgtgcttacctgtctagtatgtccagtgcatgtgcgtttcgggaccgcctatccatcactcgggtctagattttttcttcccttggatttgtatctaacggactacaaaataaaataactaatacaaatttatttacacaacatttttatcaaaattacagtgcatttacatgtcatatcaactaaatttacatatgtaattttagttatataggattgtaattttatatttgaaataaaataactaatacaaatttacttacacaatatttttatcaaaattacagtgcacttacatgtcatatcaactaaatttacatgtataattttagtttcaattgtcttaatttttcaatggttaaagaaatcgatttttacggagaaaatcgagaaaacaactcaccgggaaggagatttattttgcgagagctctcactctctccggagcgaacgagaaaagaaagggagagagagaacgagaaaagaaagcgcaggcgagagagcgagaaaacggctaggacgacacgagctcggaccagatcggcccacgtggctccccacgcgaaatccaccaccaatctagcgcaccatccgacggccagaaaaacgtcaaattttcgatgagaaatcacgcgacaaacgtttagcaaaatcggtgcgtttctgtgtcttccgatcaaggggggaggctaatgggtgatcgatcgcaaccccctatactcctccctcttctcctccttcctcctccccttcttctctttctactacagtacaccacacaaaatttttaaaaaaacaaaagttagaaaaatttatgtatagatatactatatataaaaaatttgaattcaaattaaaatttgaatcgggtatgtaaacttttgacttataaactttgggtttataaactttaggtgtataaactttagatgtatagaaatactatatatagaaaatatttgaattcaaattcaaatttgaatcagatgtaattcaaattcaaatttgaatcgggtatgtaaacttttgacttataaactttgaatctataaactttaggtgtataaactttagatgtatagaaatactatatatagaaaatatttaaattcaaattcaaatttgaatcagatataattcaaattcaaatttgaaacgggtatataaacttttgacttataaactttagatctataaactttaggtgtataaactttagatttacagaaatactatatataaaaaaatatttgaattcaaattcaaatttaaatcggatatataaacttttgacttataaacttttggtctctaaactttagatgtgtaaacttgagatgtataaactttaggtgtaaaaatttactaaaatagaaaagtaatgcggtaccaaaaaagaaaaccaggtgaagggaggggatcgatcgctgccccatccccagagcgatcgatcgcagaacagcatttccgagatccaagcacctcatcttcggaaaccattgacctagctcgccccactataaattcttcattgacatggtttacttttccacttctccagttcttgctttgcctcttccgatcaactgtccatgttctttttatttgctttcttaaactgccacgtgttatattcccaatctttgtttcttttgggattatgtttccccattattgcatcatatatcatgtaaaattatgctaattatactcttctcatattaatattataatatagctttgtcatcatatattttctcccacactacttaaaaaaaacgatttttccctgaggtcgaaaagggttttcgcggcagatctcccgcccatctg

SEQ ID NO: 104208 - DNA, 901 bp, Oryza sativa
tacacttggcttgtactgctgtaatcatgacaagacgattgtaaatatctgggctctgcaggattacgagcaagaggtctggtccatcaagtaccaggttgaattgccggttacatgtatcaggggggaacttgacgtgggtgattcttggagtgtgatggtttcgtccgaggatggggatgaggttgtggttgtgctggttgattgcggacaatcggtgctttgctttgatactgacggcaagctgttggcgcgtctcgaacatgatggtaatgacatcatggttactcgtatgaagcttaaacaaagccttgttccacatgcattctttccgttgctaaaaagttatgtcgtgaatgatttgcctttcatctgatgtctgctaaatgaagtttgagcacacaaacttattattttctgaattgtgcttttatgtatgaaaacttcttagctgaacttattgtagatgaatgtgcaaccaggatacaataattgtatttggccacatgaatagttggttcattgtgacttataatgcaaaacctactacgtcttgattgaattacaaatacgacatgtcgatagtcttttggtccaaggtggaaacaactctcactgattaatgatgaacaatactgctcacatggttttatctaaaaaaaaatgaaacttacttggtgttgcactataaacattaacctggttttttgcttgtattttcctgaaccgggatgttgtgcacatttgatttgctatgttttttacactcaagggagtgctctaatgctctaaaaactcttaatgaaatggttacggtagagcccagtgttcaatgaaatgaacagttcgcggtagttactgacagagtccattgcatctgcaattgttgggcatgtttgtc

SEQ ID NO: 104209 - DNA, 970 bp, Oryza sativa
cgctgaagacaagagttccacccaactgacttcatcagataacagatgggtcttacactgcaaatgtaaagacaattcaaaaggagataatcagaggggatgaggcaagtttatttctgaagattgtaccatttctggtcaacaagagttgccagcaaacaacaataaatagcataaagtcaactctagcacttttggacccaaaccaataaccaaaagaaaaaagtcaaaatttgaaggaattctgctccagttcagagcatctctgcaaatgcaccacaaagcaacaggccaacagcaattgggaatttgaaaaggatatgattagcagtttcaaattcccaacacaactaataaaattcagagccattgcagttccttttctcaactggactgcagattggattctatctttataagccaaccagagaaaatgtttcattttcatggagaaaggagctgatcaaatatccttcaacctcagatcagtcacatcagcaaaagaaaaagaaaaaaaaaagaggctatcaacatgtcctgaagtggtaatttcatcgagatgtaggagagtatgcattataagaccataggacactatgaagaaacaattcatgcagcaaaataacacttgtagcttcctgaatacaaattcatgtaccatcagttttcaggcaagaagtttaattgcatacataatgcatactgcaattaagaagtttgtaagcttaaacctcatccaatacatagagattgcaccatatataattcagaagcaggcaagggcaatagaaagaagtcttaaaaagaggaaccacctcattcagcaggcatcacacgaaaggcgaagcattcacgacatagtccagcagagatggaaagaatgcatgcggaacaaggcttgctctaagcttcactggagtaatactgaggccgtcattatcatgtggcaaactgccaacagcttgccatc

SEQ ID NO: 104210 - DNA, 2040 bp, Oryza sativa
tgcgactccgatcaggatgccactgctgcggattcgtttgtttatgaatccgcagcctatatgtgcccctgcattagcttctcttgatgtgcttgagcaaccccctctattttgcttctgctgcacctcaatagtcattgccttggtatggtgggcgacatggttgccacctattcggcatgagtttctctcccatcagctctcctcgtgctgccttcaccgccgagacgaaatcccttgaatcaccggattttgtccccttccagatcccacccctcccaccgatgctctccctcggccactttcttccactactcgccaatgttctccatcccgccgccaaatccctcatgaaaatccggcacaaccctcctcagatgatgaaatgggttcgagatgtgggggaatggtggcgtgggagctaggtgcctaggtttacccttgattcgagtggatcgagagaggaaaaggggaaaaggggtggatcaagtttttttttactcaacagctgtgcttccaaaaacatgcggccacagctcacagcagaaaaatgactcgttgttttgcttcaaaatgaaaagttggcctctgctctctacctccagtacatcaagatacagggcaaaaacattcacaaattcagtcaccacgtacacgaccatggttacagttaagaattcacaaattcaagttatcaacagtacagtacaagctgatgcacagctctaaaaattcaagcaccacatgattaggttactaagatttcggcaacaccatgtcaccatcactaggtctgcgagcgtgaaattgaatttattccaaggaacacgtaacaattctggaggccgagtgagctatgccagtatgctcttgtgcaggagatcaaagcaaccttaggtgcaggtgcaaccgtgcagctgagagatgtcgaaacaagaattcaagcatggaagactggcaaactacttatcaagctgaagatgttgacttatttgattaccgaatccatgaagctacatctgaagccatggaacactgaatttgttgattcaatccctctttccatgatggctagtccaccaagcagctcaacctcaacaattaaacatccatcttgcattattaaacataatctaattgaaattatgagttactatatatgcacgaaactttgaatagctgaattttatgtataacaatgcagtaaacaaaatggcaacagcgatcacatcatgaaacaacagtataccattgtgatttccaattaaaaattaatagaatatgaatattactagctatgacaaaacacccgttgggggaagtttcagacgacaatagtaccttcttttgcctattcagattgtttctttgagacttaaccatgcccacttagctaaattgcagtacttttacatgtatgaaacataactagaaaccagcccatgtctgctccttagacaatcaggatggaagcctcatttgacagagtctgcctgcccctatgcaggatatcagtattactaccagagggatgatgcgacagatagactaaacaaaaatgctacagtacagcttgtgcagtatgctcttatgcaggagattaaagcaaccgtgcgtgcagctgagagatgtcaaaacaagaattcaagcatagcaaactggaaaagtacttatcaagttgaatatgttccgtacttacttgcttatctaatccttgaagctatatgtgaagccatggacaaggtgaccaatgaatttgttcattcttcagctgcttgttctccctattccatgatgaccaccatcatcaccaccacttccgtcgctaatagcagctcaaactcaacagttacacattcatcttatattctcaaatgcattttttctccgatgaagaccttaatggcttaattgatttagtaaacatatttgatagtattgatgaacatatgccaacattcctggagatagattaataaagcttgcaaacactagcttcgatggcacagaacctctttgccaggcgaatccttttttggt

SEQ ID NO: 104211 - DNA, 1705 bp, Oryza sativa
accagatatcaacctttgagggttaagtgtcttctgcaatgacaaaaatcaggattccacttagtgttccacttagattcctagatgtatgcatattaacatgatgaggactgtctgagtgtcttatgtcaaagactttatcaataagcaccctatttgtgctcatcacaaggatttattcggacacaataaattattccattttcaattttgatgatgctttttttttcaacactataacactctctacaccttggtctgcaattcaccaacgcaatgctggaatctgaattttagtttatctcatgaagtactgcttgaaagtctttctgtaactgctatatgttttccattctacagatgggctctccatcagtgaattcatattttcttctttcaaggccagaacgctctggttcccctccaaacaaagcagcacctgacattgtccctcaagcacctgctgaagagaacccaactccaattagagaacatgttgatttttttagagcagctattaacattttgggaacagataatggtactaaggatgttagtctggcagatatatatcctaagcaagtaaataaaatggatattctttcactaggtctacctaaattaagcacaggtataaaattgtgcatgcttcattttgttgtgctcttatatatattttttcgatacagctccactgaatctttgtcagatataatgtccctgtaatcattatcattttctctaatcttgtttagtaagatcaactgcggattacctaatttgttttcttgaacttattgtaaacttcttttcactttttaagaattgtcagatgacgatataagagaaacagcttatgaggtccttcttgcctcactatttgtcaggtaattttcataggaatctttctgttggccgattttatatgtaagtggtgtcaaaattgcattatatattgttgtttaaactcagcttctttaatgatgtgtaaccaacagcggaaaaatactgttctccgaagagaagaaagaaaagaagcctaaattcttaaaaggtctaaggtctaaaacagaagtatcaaatccatctcctcagccagaaaatcattattcccaacttcttgatttgatccgtgtacaaatggaggcaaggtctctttcaccaagttctgtactgtttatttttcactagtttaacaaaaaaaagtttcattctatattcttatttttatctgtgacaatgatagcaaagtatttatgttcacatgcttgccaaatgtcaacgcacgagttgtactctcttattgtttcaactagattatttttcatatttttgttgttcgttaatcatttggagcctttttttttgtttgtcctgattacaaggcaagtgaatactgttaactgtggagcaaactcactatatcaaaatgcttttttttccccagatctctgaatctatggatacattgacaaggcgagctttaagacatatcagtttgaggatcgtgcaagggcaacttgacgtgccttgcatatcattacagctcttaagttctgttgggaaatctgatttccctacagaaagactgcgagtgcagtggcagagaagacaggcaagcaagtttatttattcgtgcctatagcatgggagtttgtcctaattattgtttataattttgatatccaggcaaatgttctcgaag

SEQ ID NO: 104212 - DNA, 679 bp, Oryza sativa
tacattacctaatcagccatgcaaactgcttaagcttgtggcattaagtcattgttgggtaccacatgaaagatgatcagtcatttgatcactcttgccaggtcctcaaaatttccaagagttgcttgttgacccagggctgtcttatgattgaatcaatattcattccactctaaaagaagttatatccatgttcagattacaagctttatcactgatcaaacatgcaatacaagtatgattcatcgaattagagccattggtcatcggtttctttttttctttttttggttatgcaaaggtataaggcatatgtgcagaacttgcaagacagtttttgatgtaggtagaatatccttcattatttgtcttatgacctgactatgttagcgacctgctgtgcccatacaagtcatgaactgaaaaaggttaatcgtcaactgtataaatacataaagtgatatgtgacatacgtgtataactagtatgactagtatgcagtctgcataaccaagaaagcatgaaggggaaatttattgtgaactggaaaaagacccatgattgttcttgattgaattaacggtgcaaattattttattaggatcaatttgcaatatttttatttttttttgcaaaaaagttaaattctaccataaagcttttcacataagtttctttg

SEQ ID NO: 104213 - DNA, 698 bp, Oryza sativa
ttaattgaacgacaacaaactgtaactctttttcttctgaatagaaagaccctgtcaaacaatgtgctattggtatcaaacatgttggcacattatcggattgcatatcagcagtaccacttgtccatataaacaaatctaggcacttcagcaacaaaggaaatgtagaggacttgataggaagtctatctattcacaatgtgctcattctgaattctaaaaggtaaaatcgtaaaacagataaaacaccccaattaaagaagaaaaggatgatatatagcagtaaacagaccttcttgaaaagcacccaagcaaagagtgtgtcatgcaatttctgggtgatacccaatatagtccaggtcagctttactgtttccagtatttcatcagcctcctggatgtaaaatcaaataacaatatcagcaactcaggataaaaccgttgacttactgtcacaaggcagtccaagaatgtttcagatttagtcatttacttattcaacaaaacctagacattttcatttttaagctgaccaacaaggaaataatgatgtatagagagtaaagaagagcaaacctccacaagctgcccatcttcgagaatatcgaacacgatgcaaagtaatttctcatatagtctaaagttgagatgatagctctggatccaatgataggtctcgcctttaaggttgaatttct

SEQ ID NO: 104214 - DNA, 1091 bp, Oryza sativa
ttacataactagaaaggttgagcatcctaatagaaacagtactactatacattggattatggctggaaaatggacatcgagcgcagttgtcaattggtggcctatgagctttgtttccacgtattccacctttataacaatgttgtcagtttgaaaaaacaacaattgacaggaatttactacctgttgattctgcattgctcagctcatgttctcaacagattaaggtcctctttgtttaggcttataaaccagcttttgagccgaaaagtctaagcctaaacaaacaaacggctttttcgtttggcttttttaaagccataagccactcttacactattaagccaaaagctaggttggagaagcttttttagcttatgtgagatagaggtataactacaccactaaacttaggatttcaaatccattgccttgtaaatcatataagccaaaaagctaacttaaaagtctaagccaatgagcctaagcctaaacaaagaggccctaaggctcctttgatttgaaggaatttcatagagttgtttggaagatttcatttattgggaaaagtttatgcagcctttggaagaaaggaatagaatcgggaaaaaccaatatgggttggtttcttatgcctctatttcacaggaaaataaacatgagcttatagctctttactttctctttttagaagtcctgcactctatccctcccacatgtgattttgtctgcaattcctgtaataaagcataatcctgtaagattcagataacacgtgacaatcaattcagtttatatgaatcttatgtgatttcttggttgctcttgctttatggggtatatcaatctcactgatacatctaatattctgatgtttctaataatgtttaatgatatgtatattttgtttgaacttctatatgtgtctatgtgttctgtataaatattgggttgtaaaattccaatgcaggatttcatgagtgggaaagttgctttccggaatattatgaacatcgtatcagtgggtgtggacactcttattaatgagcgaactacccaaacttatgggattcttctggagaaaactgtcc

SEQ ID NO: 104215 - DNA, 670 bp, Oryza sativa
tagaaaccatggcatacattcatctgtgctgatcatttgcttcaaaaccacaaaaaagttgggaccaccaattgactgggtaacctgtggcttgcagacagtgctcttgggactttggatagtagaattgctattctatgtaggcatgttgaatagtcttcttatagtaatgtgctaagaacctgcatgatcataatattgtgaaatgaggttcattacccattgcaaagtgcaatttactctactaatactagaatctaccacgtgatatgtaatgctaacttctaacatatagctaggtgtaatcgttcaaataactttggatggagcaccagataaacatggaaaatgatgagtagtttgctctctgtcatgtgcatgaattattcatgattatttaccagcggcagccgccaatgatgagtcagttggcagggcatggtagatagaagatactctctccatcccaaaatataagggaggttggatgagacacatcctagtactgcaaatctagataggcaaaatcccttatattttgggacagagggagtgcataaatagatgttatatgaattttattttgtgtgttcaaatcttttatagaacttcattttttttattaaatgttatgagatttgttgctgtaaagatctgatagtttgaacaa

SEQ ID NO: 104216 - DNA, 648 bp, Oryza sativa
ctttatcattagcatatgttattatattatagtcctataaaccaccttagctgtggtatttaccctatttttttcattcacgccaacgtttcctagactacttaacaatatttttctttaaaaaaatctataagatacctgtctcaaaaaatcatattaatttattttaaaaaatactaaataatatttttcttaaaaaaaatctataagatacttgtttcaaaatatttttttaaaaaaaatagctaacacttaacgaactaatcatatgttgatgatgaccgtagagacccttagggctactattggaaaaaaaaattcacaaaactataaaaagccttgatcgggaactattccatgaggctgttgaacatgcttacgcgaggtaaggaaacgtacggtaagagatatgagcgtaacaatggaaacggaaagaaaatagacaagcgaagggggataactcatggatccaggccagctggtgtgcagccgtcagccgagaatgattgacaaaggagaaatagggccgaacaatctcaacaagatatgaaacaaatccgaaatcctaaacaaatggctcaaaatctatttagggcttaaacattttcaggtaactgaaaagtcgacctatggccatgccattgactg

SEQ ID NO: 104217 - DNA, 623 bp, Oryza sativa
tgaaatcagcgagctcgatatatactccattaagctaagctggttgatctctcgtgtgttccaaattaatccgcgtggttaattagctctagctagagatcggtagctctcgactagttggacatggccgccacgggcgtgctcgtcgtcgttgtggcgctcgtgttcgccgtgacggtggctggcggcggcggcgccggagtaggaggtgatggcgggttcatcacgtgggaggacctgagcatgccggccggggcggcgcggagcagcacgtgggacgacacggccggcggtggcggcggcaagaggagcggcggcggcggcggcggcgagcagcggacgacgatcgtggtgtcgccggacgggacggggcactcgcgcaccgtgcagggcgccgtcgacatggtccccgccggcaacacgaggagggtcaagatcgtcgtcaggccgggcgtctacaggtacgtgggtgttcgaccgatcgatcgcctccccactacctgtccctctcgtaaccgccatggacgagttaatgtcgtcctatctcgcgaagctttttaagactggaattgaagctgcaatggcgctgacctcgccggcgacggcgtgccgtgcatggagaa

SEQ ID NO: 104218 - DNA, 783 bp, Oryza sativa
tttaagggggaggaggagaaagagagagagagagacagagagagagagagagaggcggcggcggtggtggtggggggtttggtttgctagggttttgggcccgatggacctcaactcacatatgggccctgttgggcttttgtctcggccgctggagtgagatgctgctgtgtcagagtgcgctcacaatctttgcttgtagaatgtttaactatgtactccctccgtcccataatataaggaattttgaggtttttgtttacactctttaatcacttgtcttattcaaaaaaaattagaattattatttatttttttgtgacttgttttattatccaaagtactttaagcacaacttttcgttttttatatttgcacaaattttttgaataagacgagtggtcaaagagtgcgagcaaaaactcaaaatcccttatattatgggacggagggagtagtaatgtagcagataggggtgaaaatggagcggattcggatggatagttgtcataccatattctaaattatattttttaagcagatttggagcgggtgcggataatgtacgggtgcggatgagaagcgaattgtttcggatgtcggaaatggtacggataaaaggaacattaatacaataatcaataaatgactcatcgtaataattagatgattaagtgctaaacaacatgaatagatgatgtccataatataaaaatttagctatgcgagtgtgatataagatgataaaagccttagactaaaaaaatctatgttaattgatga

SEQ ID NO: 104219 - DNA, 667 bp, Oryza sativa
ttagctgtaagaattttgctaatgaaatcacattttctttttcatctaggtcttaaggtatcaaggactgcagacacctgctatatgctatcgccactaagttaatttcaagctagttggggattgattttgcaactgaatcaaactacatatcttggtctgaatccattcctcaattttcttcttggtccatctccacgctcgttctggcgttcctttgttggtcgatctcaagtttgcacctcagcatttcctcactcccaatattacttgtgttctttcttggcagcaaactcgatattttttcttttttttgtgggctgggcttgttaagtaacaaagagaattgttgtttcattgcgtttttagatggatccctaggtttgttttctaatgagccaaataaccacactgaggttgtactatgtttgaagcccaacagacaactaaacacaacgtgcctgcttatatgtttgaagcccagacccgacctaataagaggtgtattttggacctgttaaaatttactcctatttactaatgttacactttagaccatcttatctcttcatctcgctcaacctgtttcttcctgaactcctggtgaatagcagcatggtgctcctttgcgagcgtggcactgctgtctgctcagcactcgaatgga

SEQ ID NO: 104220 - DNA, 727 bp, Oryza sativa
ccctagctggaaaggaatctgaatttaaagaaacaaaagttagatgtttctttcaatgaacaggaactttgcataacaaactgttgtcatttctgtcttttcaatagaaatcagtaaaatcagcatgcaaatcattgtagcatgtaaccccaccacctcaaaaagcttgagttgtaaatcctatccatgtggcaatagacagtgttgctaaaaacaggcaacaaactaagctgctggcttgttataaatctaggactagttcagacaccactagcctacaacttttactgttatacagttgtacccactcatcaaatgaattaattataactagcaatgtgcccatgctctgtagcagacaccaaataaaagtactaacgagatctagagttaaaaatgcattcaattcagaaggatatatatacatgattacctgagatcaatcataaacctaaaaatacacatgcaaagaatgacatcttttactatagatagcataaagtcgcatgtctacatatatgtagtaacaaaagatctccaaggagtgatgggtgtattggaccatcacctcacatcctatggagtaaagaaatagttcaaatttattacaaagaacttcataaattgttgcctttaaatacagtagacaacctgaaacaatttagaatgtgaactgtttgtaactcagtctcgtaccaaaaggcactatctgctggtctataaacat

SEQ ID NO: 104221 - DNA, 2190 bp, Oryza sativa
aattagtcataaaaggtattttagtaaaattaaatatttaatttccattattttatatgttataataaaaaattatagtcaagatatgtttcaaagattggcaggttagttccacttctactcctaacaaggtcttctttgtcgactctgccgatgatttaaaaaagggcgaccgaagtgtatctctgctttgcctatgttgctttaacctccatccttcagagggccgtttgggtttgcaactaggcttcatcttgtgcagcttgccatggtgtttttgttcccattgttgttgtataagttctggctgttgcagtttgcaaaagatgcaaagttaaggacctgattgctttttcctcttgttattgagtctttctttacattattactacaatcgatgcatttagatattgtagtaggtaatggtcacggtaatatatgataaattatttgttgttacgatgataatcttaatgacaaatcaaggcatataaatccattaatgttatagctacactttttaaaaattatgttagaaacatatttattattaattattattaaacatttatgtccattaacataaacaacatataaacatatttaatagatggagaggtcatagtcgtgtgaacacacgacttaatatgctagtttttcaggactaatgtgtaatttgcacattcacaaggaacctctatgtaaaactggctatattcccagtttgcacatatatatattattgtgctgaggtagtaactcggtttatgcttaaaaaattgtagaatactctaaaattactaatgcatgcgtatgagagttctatataaattatgattatgtctaagcgtctccttaatcattcagacttatcatagattatatccatatactaaagtagtcttggctagaaactccatctcaaagaccataccatgaagtaatgcgtctcaactccgttatacacaccttcttaaccgacgatagataagggtaatatagtacgatggaccaaccaacgacccatccatctgattcataatactatacccttttggagaagttgtttgaaaccaccatcacatcacgaatacgatgacaagaggaaaagaagaccctatagagagatcatatcaggtacccaaccagaagtgtgtgtgagttccacacgcacacgtgacaccatgcctaaaacttgaacaactcgaattgcatgcacatcatctctcgagaaaccatatgtcatgaagtgcatcacagtcccattaaatacgggcttctaaaatagcggtagtagatatagtatgataatataatagtagaccaaccaacccatcccattcataatgtgcataagatactactccctctgttttttgagaccttttcccctagtaaaacttttttaaatttaataaagtctataggaaaacacaatagtatttttaatacaaaacaaacatattatgaaaacatactcaatgttagatttaattaacatattatgaaagtgacttattataatataaaacagaagggtttcctagtgcgtcctttgagaaaagttgcttgagaattgaaaatggtacaatattagagcaagtttaatagtatagccactactggctccaaatcatctatagtcaattcatataatagttacctataaacatatagtacacaattaatatttggtcccacgtgtcatacgtacatgcatcttgaagtctgtgctacagctggctataaacatgtagctcgctgttcttctctcttctctcttatcttctcaaaatgtgtttatagctggctttatagtctgctattgtacctgcttttacgaacacattgataaaaattaataaaggagatccaacggagaattggagagggaataaggctatcttatgatgccataattagagcaggtacaatagcaggcttatagcatgctataaatatattttaaagagataaaggaagagagagaagagcagcagactacagatttgtagccagctgcagcatggactccaagacgtaatatgtgtataacaggtaggaccagatattaatagtatagtaagcaagtattgtataaattggctattacattggctatagataatttggagcaagtagtgggctacactattaaacttgctgttaaaataccatcataattgttga

SEQ ID NO: 104222 - DNA, 661 bp, Oryza sativa
ttaatcacatcttatcataaatgatgaatatttttgaccaaagggaatagtttagacaatgttgtcatttaacattttgctgtggcagccagatccaacaacatggctatttttgactctccatttgtctatttggccaattagacaaaaagattcctttccatatctgttgcacacactccaacagactctccaaatcctaacgactagttccctctcgtcaggggatggcggcggcctcgggaggggatgacggtggtctcggcagcggatgacggcggcgtcggcaacggacgacgacgcagcggcctcggtagtggagggccacatccggtcttagtaggggatagcaaatggtctcgactgtagacgatggggcgttgacaatggattacgatgcgtcggcctctgcagtggacgacgacggcggaggggcagcggccttgggtgcggacgatggcaaccttggcagtggggcggaggggcggtgtctgtgctggcgggggttgcgcgccgacacgctagatctatggagtggggagagtagttgcgtgatatgacaggaggaaatcgctccatttgagggagagagagtacgggacgggaggggagaggggaaaacgcgtggggccatgattggcaaggtgattttggctgctca

SEQ ID NO: 104223 - DNA, 707 bp, Oryza sativa
tgcagaagttggtgactagaatattccaaaaaaacaatcacatataaaattaatgtccgggttgaaaatgaattatgctattaatgtcacatcaagtgatctcagttgtttgaacaagacttcagaccaacaaaagcctcaaatgtataaaaagataacaatatgtaaaattgataagacataactggaattgatctatatatcagaggatagttgtccgaaacataaatcatttttaaattcttaaaacgcatgcacatgtactgctagtggatagagacattttatgtcactcctgaaatatttttgttttttgacacaaaacagtgtgtcaatgttaaatcacacgtatattatcatcatgttcaacggcacaatcattgtcattgcaacaaaaaaatccaaaacatgtaagaatgaacacaactaatgtagttcatagtatatttgataacatagataagctaggtatgatgcttaatttcatataaaaaggtatatttaccacttacaaatgcatagtcttggaaacaagatgactgctttacaaatgtacactagtgcgagaaaaattggtcctaccatataatctcatatcctgtccatagtaaacactgaaccgaaaatgttcccctttcccacttagcgtccttgtgagtccctttaacaatatcactcatcaagtccaattaacatgagctgtgttt

SEQ ID NO: 104224 - DNA, 793 bp, Oryza sativa
tctccgcccggttaatcatttcccaccatttcctttctctcccggcgccggtggatcgagctgcagtttctttttggttcttggcacctactaggctactaccattgttgctgttgtccggtgtacatccacaacttctttgcctgcctgctgttccttttagtttctccaagctcctgccaacagcagcacagcctgtgtgtcaccactcaccagggaggaggccccactcctcctgtcttgttgctcactcactctgctggcagcttcccctaggttgtcctttgcttgccctgggtttggttcttgggtccatccatcttcagagttttcctttttgctgaatcctttgatctcggatggatgatggccggttcttgataagccttgctgcaggttctcctcccgagaagatgtggtaacatttcttggcttcttgcgttttggattggaggcaagattgcttgtgaggatcttggttagcctgaaacttcgtttgctgttcagaattcggggggctttgttggttcttggcctcttgcctgttggttgggtttgaaggaggctgaagagagtttgccaatggagccaccaagtgggttctgggcctccctggggagcttcctcaagttcttgccctacttctgcggcctcctcatcctgggggtcatcaaaggtggcttgctggtcttctgtctctgtccattttggtaatttttgaactgattccatgtgtgttaagtctcatttgggaataattgtgtgtgtgtgttttgggggggggggggggggg

SEQ ID NO: 104225 - DNA, 1283 bp, Oryza sativa
ttccacgaaacaagtaacaacatctccggtgtgatctgatctgttcatttgatttgatcgtatacacgcacttgcatatcgcgtctccttgtgtgggggcgagtggcttaggaaggacgctgtccggcttgacacgtcggcgattttcctagctggctgaaggaggtaaaggtaaaagcacctttgagagaatgttcctcgttcgtgtcaaacagtcaggtacgcccctcaccacatgcacgaaagttgttaacaccacaactagcaagagcgacagatgcaaccaaaatatatgggggtgtgcctgattttgtgtttaggcggtgttcttccctcaccttttccaactatctctatcgtttttcacacacatatttaccaaactactgagggccgctttgaatcgcagaaatggaaaaacgcaggaatagaaaaaatacaggattctgataggaatgcagatgtaaaatagaggaaaatacaggaaaaacataagaatgaccgtttgattggaccacaggaaaaacgcaggaatcggatgagagagatagactcaaataaatttttccaagaggttggacctcttgctaactttcctccaaaatctctgtaggattacacattccataggaattttaaaagatagtataggattcaatcctaatcctttgtttcaaaggctttcataggaatttttttcatagaattgaagtccttcaaatttcctacatttttcttacaaattaaaggggccctaaacggtacgtattttataaaaagttatatcgaaaagttgattaaaatagcatattaatccatttcgtccgggccgtcagtaaagcctccctcttcctagtccatttcgtccttcgcatattctgaaaccgaacagaatatatgcacattttcacatgctctgcttgcacattttgaccgaccaaaaagtttgcattgttgttttgaattatcaacattgataactgatatgtgtatactgcactattattgttgttcaaagtgagatcacaactagtaaacggtacgtattttataaaaagttatattggaaagttgattaaaatattatattaatccatttcgtccaggccgtcgataaagcctccctcttcctagtccatttcgtccttcgcatattctgaaaccgaacagaatatatgcacattttcacatgatctgctcgcacattttgacccaccaaaaagtttgcattgttgttttgaattatcaacattgataactgatatgtgtatactgcactatta

SEQ ID NO: 104226 - DNA, 1357 bp, Oryza sativa
aattcctgcagcccaggcggcgggcgggctgtagaggggcatagtggcatcatttgatgggacttctaaaaattataaaaattaaaactacaagtccaatttttaaaggttcggaacttctaaaaagtaaaaaaaaacaacgataattatgttcgattttaaaatctcaatgacaatatagaagggaagtagcgagtgagccgtagaggagtacaatggcaaagtcacttacggtttgacgggacttctagaaagtaaaaatgaaaccaaacgataattatattcattttttaaaatctcaatgacaataatgagtagagacagtggacggaccgtatagaagtataatgacaacgtttgacaggatatctagaaattataaaaataaaacctaatgtaacaataaactctaaaaactataaaatccaatttttaaaggtgtggtagatcgagcaagcaaataaaggagatgacataaggggtaataacttgtgtgacttttaaaaactatataattataaacacaaggatgataaggtttggtctttcaaagtcttaagacaataagatagctatttaataaattttaagtaaaatcatatcatacttaaaaaagtatatgattttgtttgggtgctagccgcgcaattgcgcgggccacccgctagttttctattaaggcaaattgcactttccatccggtaaaatgcatctggtttctcttggcaccagtttaacacatgcttccactttacattagggtatattaaaataagcttcgtactaagttctgtcatacaattgaagaaaaaaaagtaaaatatgagtagaacatatgacactttttgaatctataccatgtttcataacgtttctttcagaattatgaaacttttattggtttgatgatatatcataatgttaagtgaaactttttgaaagaaaacctatgctctgttcgttctggggagacaggggagattgattctcgttttccgcgtgtacgcttttcaaactactaaacggtgcgttttttgtaaaaaatttctataggaaagttgctttaaaaaatcatattaatccatttttaaaatttaaaatagttaatactcaattaatcatgagctaatggctcatctcgttttgcttatctccccaatctcctcaatccccttcccctcaaacacacccctagttatgcaatataaagtgaaagatatacttaatttggtacagagcaaaacacaatgcgttttatctggtgtaaatactccatatgagttactagtatgtatacaaactttcacttggaacttgagaataaaatatcttgttccgaaaaaaaaaaactctaata

SEQ ID NO: 104227 - DNA, 1617 bp, Oryza sativa
ggcccaccccggccagcgccagcgcccacgccggctgcgcggacagcgcgtccatttctggagacggggcgggcagcggcggagaccgcggcgaaggcggcggcggcggcggcggcgaggagagtggcgagcgtgtgcgagttgcgatggaggcaagcgcgatccgttcaactgcagatataatagcgcgggcggggagagagagaggaggggacggatggggggcgggccgggctggcaagcggcctgcatcgccgggggagagttgggtggggttggcgtgccacctcggctggatgaacacgccaccgtggaacggctcaagaaaaatattttttaaaaaaaaaggtaaaaacgcataggcttcatcctaccgctatgaatttctctgaaagactttgccattaaggttcataaagtcattctatcgcatctctgaaaaactaagtcgatatatattaagattcacaaagttatatgaacgtctcgttgccaacaagtatgttgcctatcactaaaaaatagttagtcgtaaatacgagcacatatgttaagtctaagacttaaacccgtgtggaccacaaggaagctaaccaattgagttatgctcactttgtgactaaagaaaaatatgggtgagaaactgggaaccaaggaacttaaaaagtacaggcatggttgatagcaactgtgatagccgctcgtgaatcatggtaatggagttgatttccatttaaaagaaattaaattaagttaccatttcatctataacggttagattaatatgcttagtgatgaaaccatcggagaggggtttatttaataaatggtttttataaccctatggagaacatgcgaattcaattatattttttacactctccaatgattctataaccctacaatttttacagaggataaattcatttcgtacggaggagaacaactgcttgctctaaagtctaaactctgcagccatgagcaccttgcctcaccttcaccttgggtgcacgtaccgttcaatttcggtgccaacggcacattaggtgccatgaacacattaggttgcatgtatggttcaccggaggcgtggtgaaccgggaccagcaggggttgggccgttgggcggacaggtggtgcagttatggttgttgaggtttgatgagctgaagtaaatggtgtggtcaaagtcccacacagatgacgggcacggcaggatattaaaagcccccccgcctgatttctactcctctcctcgcacaccacacaatcaaccatcgcacatcgcagcgcacacaaaacgcaccgcacgcacgcgagctcagcttcttttcgtgcgaacaaaacgggagctcgctgttggtgaggtgaagcgcgtactcgcttcgttattgtggttagctgtcgctggacgatcggttgctcgcccaccaccacccgctcaccaccatcacggttgcatcacctcaccgcaggtagtatagtacccatcactggagcagtggcgccatgggccaccgtacaaaggtacaagatggacgtttcgacctaagaacagtagcacgagcgtatggggagaaaacttgatcgatatactctttttttttttctggaaca

SEQ ID NO: 104228 - DNA, 636 bp, Oryza sativa
ccccacaccggttgttcctctcatttcgacctcccaacagtgttttctttcttttttttttctcctcccttgcaagttactgtgctatactgctatatgctgcttcacagttgttttgtatggttcacattgtgtcattgtgaaaaaatcaaatgcgctcgctcaccccctatgaacacccccaaaacgctcccgcacacgtgctaactcagcgtttctactatggaactgtcaactacatcatttgctattaagcaaataaatattaaattttcaaagttaaattagagttgattttgatttttttttatcgtagtttgttttcaatataggcttttagtcgctaataactcatatatagaagttttctgtaaaaattattacattttatctctaataagtgttacggcttactcataccgtttggtatttgactgtgtttggtactcataccgttcacgaatacttatccattttagagataagatatattttcaagaaacacagtacaaatgctgacactcacaatgcatgcacacctacccctatgaacacatatacgcataccatttctctatgagcatctactaaatattggtccgacatatcttgaaaatgacaaaatcaccacgggct

SEQ ID NO: 104229 - DNA, 650 bp, Oryza sativa
aaaagttttaaacatgtctaaattctgggctacacatccaccaaacattgtaaagatagccaatggcgaggcagaaaatgaaaagacttcttgttctggtacaaccgtccgggctccgtcgcttccgcctctactaccaagaaccgtcgatgtatataaaaattagtcgatcactaggaaaaaaaactactaatcattcaagttcgacggtgttattgtctctgttaccggttaggcatgccaaaattagatattacttgaagattgccttataatgcataaaatgactaagagcacaaggggggaacttaaaaaaagagttaaaacaaaattatggactactttatgaattagtttattgttgttgtacatgttttcatgaatcagaaggattattaatttcttttaataaactgacttgataaatcgcaacccaaagactggtgaggaggatggtggaggatgatctcctagcctttggtgggtcccatccatgagggtctgccggtgtaatgtgggcccacaagattgacaaaatgctgttattatttttattatttgcattggcattatttcaaccggtagaagaattaagcatctctctctctccccctttttgtccttataaaaccgtgtttaattaaccgaag

SEQ ID NO: 104230 - DNA, 535 bp, Oryza sativa
ttaattccgaatttcaactatttctaaattgtatttctatagggactctgctttttctttttcttcgattaatgtgagaatttctaggccatgtgagcaaacgtggaggctcctttttctattcctttaataatactagtaatcgtgcacgtgcaaggcacgttttttttaacatttataataggagagaataaaatatagagtaaatttcactttcaatcatttttatcaccattgttttgttttggaccaccctttaattaacgtttttgctttggactgggtaatcttgcatttgttccacttttgattacccgattctcttttaacatatatgaaagattttaagtacgttggctcctatttatcaatgaactcccacagcaatatatagaccaattcttttgacatatgacaagttggattaggtggttgaaaaagttgagggtattctaaaatgccacaaaggtaaaattacctggtacctggtcgaaagtgaaacatctcatttcatggattatctcttaaagagtgg

SEQ ID NO: 104231 - DNA, 2568 bp, Oryza sativa
attcctgcagcccctattctgtaagatcattgtatttagccttgattaataatgggtatatagaaagaaatagatcatttggaagcttaagatgccccttaagattaagatttttatgtgtatctccttaaaggaattgtgttgataaaagataatttggctaagagaaattcaaatggtagtttgagatgttgtttttttatgaaagaaccttatgaaaggtgaaacctaaactgaaacataaatgagccacatcatccaataaatattagccattggattcatgaaaaacaaaagagggtgaatgaatcaagaccgttggattagatggatgataaaaaaaatattcaaataggttttcggaagctactagaagaggaaaaaaaggaaaaatgaaagagagccaggaaataagtaaaggaagataaaagattacatatatatttttacgatctgcacctatagcaaattattttttcaaatgagcccttcatcttttaggtaagattaattggtagggattgaaggtagggattgaactattaagagcatattcaaaatgtatactcgtatgataaatttagtttctataagttaattgttaatatgtttgataagaaaaatgctactgggacatacatattccttccaatgagaggtcattatctcccaaatatagatttaatgattttcacactgatttaaaacaaaacaaaattattccttataaacagacaaaatatatgtacgtaggctacataaagggtgaacaccaaagtcgaataaggggatgatagagggggtcatgtaacgatgaaaacaactataggatgagatgtaaagtttacaataaataggaagtcatttattatatcagcataatatcactcatcccacccatattcttttacgagcaacgagaagcccaagagagatggcttgccactctaatgtaccatgttacaggattttagagtccggcgaacgcgcgacatgatgtgctagttttttatgaaaaacggaacatttttccatcttttcctatattgtcatttttctagatttctttggagatcaattcaattctcatttgaattatacccaccacatagtatttctcatatgtttgagaattggctggtgggagttaataaaaaaattaagaaacttattcttgtatgggctttcaccgtatgttagactatttggcttagtaaaaatgatacagtttatgataaaacaccaacaaaatattatttgcaagtacttttcaaggcaacggggatgggctcaactacaaaggtatgataatgatatcaagctaataaatgatgcatgtcgtaaacccgagtcgataattatgcacctttttaccaactttggatggagattctcgaatagaattcataaattcagggttcttttatcttgtgtggttgggcccaactacaaaggcatgatgatgatatcaagctaataaatgatgaatgtcgtaaatttgagtcgacgattatgcaaatcgggattctcgaatagaattcagcaatttagggtctttttatcttgcgtttgtgttttctttacagtgtgtgctaagtttgtttatgtgtggactttataataattggttgtagctcgttagcaaaggtcgaaatgttactccattatcttcttataaaaggaaaaaaatacgaattaccccctaaactatcgtggtcgaccaaaatagccccttgaactcaaaaaccagacatcgctcaccttgaatttttaataccagacaacaccccctagtactattgcaagcggtttagggttcaaatagcacatgtggcagtccagtcatccttttttttaaaaaaaaaatcgctaggacccacttgtcagaatccccacccacctctttcttttccatccccttttgaagcgtgcgacggccggggagagggcgtgacgctaccggcactcttctccctcctcttctgaagcgcgcggcggcggggggagacggggtgacacagtagggtgcgtgcgatcggcggcggcatggaggcagaggtgagggcagcgcgtgccggtagcggcatggaagcggatgtgagggttgtgtggcaagcacacagaggacacggcgacagtcggagtgctgctaaatctatcgtctatctttcttccctttggtgcgcagtgagattggggagggcgcgttgcgacggggccagaggggtagcgccgtcagcgagggcgtcgggaaggagaggagattggagcggaggcggcggtgacagcgatggagcgggtggcggaggagcaaccgggcgcggggatgtaacaccctgaaaattcgacgacaaaaatctaaactctaaaaatacggattttcaaaaactttttaaattaattgcatcatgccgatcttattcgcctatttcatttgaatttgatctcgaagtttattaatcgtgagtaaagattagttgtggataggaataaataaagtattatcgcgaccatatttggatcaattaaatttaaatatgatggaataagaattaaccctaattaaaa

SEQ ID NO: 104232 - DNA, 657 bp, Oryza sativa
acacgcgtatccataaaagggacgagttgctctgaaaactgctgcgagagcatgtcggcaaagctctaaactctcaactcctttccccaagttgttaggcacgagtgactgagtgggtgggttatggcgccaccgttttacataaacacggcacggtgatagtctgatagaagcgtatgctaatggaaacaatggcccgataatatgtaataatgtaaacattatacaggcgtggcgtgacagtaaagcacaactgctgcttttacaacaggatcccagtcaaaagtccttcatacttttacctactaaaaaaaatgtccttagcactcgatccagttgttcatccgtgagccccgtccacgacagtccaaatcagtacttcgttcgtctcaaaatataagcatttttagaatagtgccaagtcaaactttaaaattttaactattaatagcgataaattaagaaagattaatcatataaatttgatgttactatatttatcattaaacaaacttcataatatgcaactctttttatttaaaatattttacttttatagatattattggttaaagtagtatattagacactatatccagatttaaaaatacttatattttgacacggacggtgtcattgcaagcgaattttttcaac

SEQ ID NO: 104233 - DNA, 668 bp, Oryza sativa
gcccccctttgcgagatttctgtgatctgaacaaatggtaagaaataaaaagaaaacgtgtcagcggtcttcaactagagcaaaagaccagaaggtagccttgttcttctaagtgattctcatgacagatatatcaggtgattctataaaattttggaaatcgctattgataatgtgaaaaacgttttgaaatttgcatcaccaaagaacgatttgccactcgatgaaggcccacatgtcactgagacaatagcgaaagatcctaaaccagtgtgcacctcattggagcagcaaatcctaaagtttcaatttgttgacgatcatcaacattcagtaccatacaatactgtacctgctcatctacattactccctctgtcacataaaaaaccaacatagtactggatgtgacacatcctagtactatgaatccatacatttgtccagattcgttgtactataatatatcacatctagtcctagattcactttttttgggacggagggagtacataaacaaaatcgaaggaaacgtaattcctacaccagaccattctctttgtaaattagagaacttacagtgatgcattgccatcgtcatcaggctcgccactatcatgggctgcagatgaaatacctgtcacatcaattagatcgggctgcaggaat

SEQ ID NO: 104234 - DNA, 924 bp, Oryza sativa
tgaaaatcaacacacaaaaaagcaaaaggccaatatttgttcagataaaaagtactgtatccacgattgaccctgcaacagatgatcgacgggcaaatcaaagcgaggcggccaaatcaagcgtccttcatcttcttggtggagatggagatggatggcgtgtcggtgggctaaggagtctgaaccatgagttatgaaccgagagattgaaggaagagcatgcgccaccacggccggcggagcagcaacgactgaggacgctactgcgaagattgaggaacaacaccgtgcaggacggtaagcaaatccttttcacatcggagtaggacggcaggaagggcgctcctacctcggcgccggtgggggaggctacgatctgcggtgggatgacgtgatttgcaatgagagaaggcgcacggcggcagctagcgcacaatttgcaggtaggtggtgggaggagtagcggcttccgtagcgtgtgctatagtagcgacagaagcgtgcgaggaggcgttggctcggcagcggtgtcatcgggttgtgtccagtggcggggatagcgcttagaggcggtgtttctgcgctagaatagcgcgtccgctcgtccgctcggtagggatggggatggaaaatcagtgtttttgattccaccgttgcattgcatcgtaagacagagtggccccacaaccgtctcgagccgttagatatatagatcggacggctgaagaaaggaatgaaaagatgttgatttcacctgtagaattgtaaggagacaactcctcctccattagtatagatagtatagataatagattcctaaatctccttacctatgaactgcgcttccgatttttgaacatcagaaccaaccgagatattagcaaatccctaaattatttctgatcgaatcttggaaatgcaatt

SEQ ID NO: 104235 - DNA, 1051 bp, Oryza sativa
gtgagggacaaggacaaggtgctgctccttgaagaccctgccctcaaggacatgaagctccgggccgccctcgcggcccgggctaccgtccaaagcccgtatcagccttttatccaagtctaggtctagcccagtctggtccggcccatcttatcgtgctaactgctagattaatcgtaccatcagctgatcaagtctctaaaagcttaattcctgtctggaattgacctgatgtatggtgattttttactgttgctgttaatcagcagtgagtaccagtccatgggaagggcaaaggggccctcccatgtgagagctagagtacctgccacttgttatgtctctaattgcgtgatttgtgccatttctaggtagttaatttgcgagtgcttagtgtggttgtatgtcatgcattgtgtatgtgtgctccattttctgcaagtagtagtacctctaatgtggaagggatcaatgtttcatgcatgtaaggatgcaactgcgtgcaatcaactgagattactgctgcagattttattttgtggtctttttctaacaaactatttcgttgttgggaacagaaaagggcacagctctgaattcgctgcaagctcctatagaacatatgcacacaacaaaaaaaaatagcaaaagttaagtaatagcatgctattaaatttctgaagtcatctttgtcatttgcaacaatcaatagtacttgactggcataagtagtcttacaattcagaagtttatcaaacatatcatgaatgattaactagacgcaaaaagtaaagaagaacaagacatgaacatgcatgggcggatctagagtgtaacaagtggggcacccactcaattttgcagcgaatgggggcaaatgcatccttgacacacttctaagtctacctgagcggtagatccttggcctccacttatactattttctgtctccgcctctagttgagggttgtgttttgtcatggtgtttatttgagacatctacttgtgtgcacactgagcctcatcttttcacttatgcttatgcttatct

SEQ ID NO: 104236 - DNA, 645 bp, Oryza sativa
aagtattaattattttaaacttaaaaatgattaatatgtttttaagcaactttttaatattttttaaataaacttaagaaacatgcgtacgaaaacaatggactttttctctctagcatctcctatcagacactgtttagtctacttctgctgagtttagtttcaaaatttgttttcaaactttcaacttttccatcacatgaaaacttttctacacacataaaccttcaacttttccattacatcggtccaattttaaccaaattttcaattttggtgtaaactaaacacacccttcattaagaaaaactcctgctacacgcctacacacacagcagaaagaagacttgagaaaaaggtccttggaaggaaacttccacaaatgaaataaagtctagggaccaaaaagaaacatggaaaagggcgcaggcaataatgaataatttgcggtcaggaaaggccgcgtcttttccccccgagcctacgcgggccccacatggcggccagctgggggctatttagtggcctacccccttgcgctttttccagggctcccgctcccacccccacacagcttgtggccgccctcgctccgcgccacgtgcacgcgatccacgccgtccatcccgcccctccccgcagcca

SEQ ID NO: 104237 - DNA, 710 bp, Oryza sativa
aacttttttttcccttttggaaggcagaggggaaaggaagtgaatcttttgtaacttgtccatacacaaatccacaaaaacacaggagtagggtattacgcttcgcagcggcccgaacctgtatacatcgccgagtctcgtgtgtcttgcgggcgagtgatctttccacactcggagagagagagagagcttgggattgcaccctaagcccctggtcgaaccggcaaaggggggcttgcgcagtctcccggtgaggggccacgagctccgtcaacgtgggtatgcacgtgttccgtcgttttgtgggttctccatgtctacccactcgatgaagttgcacattggacgatatgtctgcgtaagatgttacaattgtgtacgaagaagttaatttttttatccatttgaacttcgaatagatgaagcatacctgatcaaagttcgcacattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcattagttgtgtgctagtgggaaagaagatatgaagaggttgccttcagattgtcaattatatagcgtcgttttcagtgcaatatatgtgaactcaatgagat

SEQ ID NO: 104238 - DNA, 710 bp, Oryza sativa
tgaatttcatacaattgcacgatattattgtcagcctttcatgcgctcaacattcgctgttcgtgcacatgaatattttttttagcatttctgttatatgctcatggtgcagggtgtgcatgaacttatgcatgacaagaccaaaaaaaaaaactacttgagcatgaaatttcatgcacaccctgaacttcaacttgagctgtgtttttatttcgtgtgccaattttttttttaaatatacggacacacatttgaagtattaaacagcgagatgaatttattaagcctaattaatccgtcattaacaaatgtttactgtagcaccacattgtcaaatcatggcataattaggctcaaaagattcgtctcgcaatttatagtcggactgtgcaattgatttttttcgtcaacatttgatgctccatacatgtgtccaaacatttgatatgacggaaaagttaagtttgaagaaaaaagttggaatctaaaaacggccttgaactccatttctgttatagatatgaccaaaaaaattaccaagctacaagcctacttgcacgattgcaatagagggtacctgctgttagtaagatggagctcagcatcgacaagcacaacccaaaataattactgttcttacaattcatcaaggactcaatgagttcaaattttaatcaggaatccaactcaagttcatgttgttcatcact

SEQ ID NO: 104239 - DNA, 1224 bp, Oryza sativa
cctgcagcccgcagacatgcattgacatgtggaggagattcaggttcatgaacaatctcttttattattgtattgtttctactattcttttgatgtctataaaattgtggcatgttgggtaggttaacttcaaaatttagataatatttagacatatgtttatgttggtattgaaaacatataatattacaatcctaacacgagtgtttaatcagcggcgaagccatagccccctgccccccgcattagcagtggcacatgtcaatctaaggatttaatggatattacaagtctcgtgtaacattattttacaataaaatatctttcttaaactgaaatcttcttgctgtagcagtgacggcgtcatcagtgtctcgccaaaactctgaccatgtcatacgatgaatctctagagaaatcttggcaccccaaccttcaaatcgtggctttacctctgtacagtggcggacccaggatcgaatcctgggtgtgcccacgtcaacctcaagtgcaaaaatcaatgtccagtgcttataaataccatgtgatctcaagagcaaaaagtcaaagttttagtgcacataaactccctattttccttcgcatatagttgattggttcaacttgatctctccctacaaataatagaaaacacaccttcaatttaaactctcactaattttagtttttaatttttcaatcaatctctgtcacctccagagagaagagagaagatatcagtatgataagagagattgagagaaaaaaaaaagtaagaatgtaaactaggacggctggacagggaagtcctagccacttcgctggtcgctatgagcctgcgacttctgccaacttcccatgtagccatggcccatgacagaggttcttgggctttgatttctgccagcttgtttgaggcaatgaagcaaccatccaatgtctaggtccattgtgcatactactcgctattttttccccaaaaaatgtgggtataccggtgtctccactcctgcccctgcctgtgtactatttcactgtcctatatgcatagaaatattcaatgcctggctctttaatattagctacttatgtttaaactttagttgttatacttggtatactttgtaagaaattccacaaattcttgacggacacataggtgtggcatataatattagcgaattgtctttgtctttaatagtctgtgtagctctcttttatatc

SEQ ID NO: 104240 - DNA, 1103 bp, Oryza sativa
ataaattattccaacaataatcaggagatatgttgtgtacatacactttctttatgacggggtctgttctctgcacgataatcgaagtaaccagttacagcatagaaaaaacatggatttatgtcctcctgcatggcgtggttctaagaaccttgaaccggtccctgaaaattgcaaaaaatgtggaactattccccatcaattaagctggtggaggaggacagagagggcgacgaggaggatcgatggcggcggcggcgcggggcggttaggggaatcgcgatgacggtgggtgagcgggcggatcgccgccgctaaactacccctcgcgtggcgaagcaaaaccccaaccccccccccccaacccccataagctaagtaccaaggcagcgttacgggcaagcaactccgggagaccaggatgggagatgaggagagagagctcaccggaacgcgtcgcgacagcttcccccgcggccttcgtcgccggtgatgatcgtcgtggaaaccctagctggagaggaagcacccgcggcagaggcggcgagaggcgcgcgcgtggcgtggcgtggagaagcgaagcacaccgcggttgcatgagctctgcccatggaggacgcgtcccgcgtccattctgtgtcattggcatgtgggcctgagtgcgttggatcatggcgtcatcacaaggatgccatcgttgttcaattctccgtttgcgttgtgcactcgacagcggcatatccggtttcacggcgtttggctgccccgtctggcctcgtatgaatttttttgaactgtggactgaccaaaatggccctaaagttatttgattttatcatgggccgatcttctttttttttcaccttcttctcgtagagtatgaattgagccggaatttattcggaatgagatagagacccacctagagtattatgtaataattgggtgggattcaaatggaacaatctaggatggtagcgacccacccaaaataagggcttgtttgcataatgtcggaccaccttctttgcaagaattttggattgtgatttgtgactgacgctcggggcgtcgggcccggttgttacatcagttgtaagcac

SEQ ID NO: 104241 - DNA, 1048 bp, Oryza sativa
cgcgcgcggccggtggcccgtgcgacgggggcgcggtggtcgcccgcctgcgcggcgggagggacggtggccggcgacgcccgcgcggcgggaggggcggtggccggcgacgcccgcgcggtgggatggcggtggccggcggcccttgcggcgggagggcggtggccggcgatgcctgctcagcgggagggcggctggacgacggcgcctcgcgcggcgagacggcggctggacaacgacctacgtggccggagggcagcgggacggcggcgtgcagaggccattcgcgtggaagaggatgagggagaagaaaaggggaactttagtttgggttggcaggggcattttggtattttctaaaaattctgacaacacaatacacggtttgagcaacgtatctaatggaaacttaacgggaggggcatggaagggatcaaagcgaaatttcaggggtacacagaggatcgtgtaaaattcgagggtatagaagggattaggtgagttttcatgtgtacacaagggatttactcttaaaagattacaaaattttcgtgaatttaaataaacgataagtccattttacaccctcgaacttttatgcttgtttaaaatacacccctgaactacaaaaccgggtataatacaccctcaaatctggggggttaagtgtccggtattgaaagttcgagggcatattatacccggttttgtagttcgggggtgtattttgcataagcataagagttcgagggtgtaaaatggatttatccctttaaacaatataaaaaaatcgggaatctgtagcggtaattttaggttgtttggtctcacgggtataggacttgtctggtttggagccaatttttaccctaccaaaatcttgatagtaccaaaatattggtaaattttgatactaccaaattaggtagtatttaatttgaactattattaataaaatttagtagcaaatcaaatatacacttactattattgaagttactaaaattttggtagggtaataaattggtaccaaaccaaacaaacctat

SEQ ID NO: 104242 - DNA, 1426 bp, Oryza sativa
ttctttcatcataaaatataatcaacttttatttctttttacaaaatttatatttttagaattcacgtaagaagttcatatttgatgattcacctatactctaggaattaacaatctggctctgcccctggccctccgttttaggttattggattttttttaagtttgatcaaaatcaaactgttttaaatttgaccaagtttatagaaaaaatagtactccagattcgttgtactaggatatgtcccatccaatacaaggttgctaatatttttgaatcaagataaatttattataaaaatatttttaattattaatttaataaacttaatttggtaatataaatattactatatttgtatataaacttagtcaaacttgaaacaatttgactttgcccaaagtcaaaacgtcatataataaggattttgttatacaacggatggggtagtatttaggagtccatagtttttattcttaaggaccgaatgatattaatggttctttttcaaaaaaaaaaacacacgccttgcttgatttctacccaaactatatcaagagcatgaacagatgcatgcatgtctaggtatgcacgttaagtagtagtcctagcggtggagtgaattctgagagcacaatcgatcgatcagaattgatcagaagtatatataatgtgctaacttaattatagctgcaacggccatcgatgatcctgatggatctgatctgatgcaaattaggcataatatatgcaaattaaagcacgccaggcacgtatatagtacgtactacgggggcttgatggattaatcaggaaatccatcacaccacagtacgtacatacacacatatttttctcattcaatatcactcttctctctatctagatagtgagacacatgagagaatgagaggtctagagagagagagagatgatatcattgttttgagaagtgtatctttattcggcctctacatctaactggacaatatatgcaaccttttttttaattaggaacttagcctatcaaatagagaacttagcccttaaataacccaatctgaaattcgctgctatgaagggcttgtttggtacagctccaactcttaaatataactccaggagttgaatctggagtggagttgtggagctgcctaaacacaactccacaactctagtatattttgtgagagagcttcacccaactccactctcagttttggtggagctgaaactgtttggctgagctctggctccaggaggggtggagctggagctgtgtcaaataggcccaaagatttgaactcaggatcttaaggtgctagtcaggtcactgcaatcctctcacatgcatgtagtatagagacgatggagttgtggacttgtgaattggcggtttgctataaagtaaacccttgggctaca

SEQ ID NO: 104243 - DNA, 854 bp, Oryza sativa
tggtacatctcgagctggtaaaaagagaccaagaggttcaaagtccccaagtaagaagcagcaaccaaagcctaagaaccgtttcacagatgccactgagaaaattagcaacacaatggaccatttggtggatcagcttggtaatcctcctcctccacctccagtgccacagttttgtgacccttatgcttcattgtggaagaggattgatgcattgcccattagtactaatgataaggttgtcgttggaaattatttgggacgccaagagaatgagggggtgcggggatttcttgcttcttctgctgacacgactgtggagacttgggtgtaccagttcatgtgcgatcgagatggtgcgtaggaaaaatgaatctaactgtcaacatttggatatgttgttgaccttttgctcagttagaatagctgtactaatcagctatattaaaaccttgtgaaatatgtttatgtccaagcaaatagttacttttgggaaaacactatactagatgtgggagcactaattaggttatcttggatcatgtcaatatgtcaggttcaagctggtagcttcttttggtttctagaactgtcattatatagtgatgatgcaaaagtacgaactttctgcttcagtgtgctatgtaaatttctctagtgattgagtattgttgcccatctgtgatatatttcgaagctaaagttaattatgtggtttgtatatttatgtgaaagttgagtgttgccctccaatgatattttcatatacgcttctgcatgcacttctgtagtggctattgtctggtagtattttgatttatctcacttaaatgttgttgtctaatttgccaatt

SEQ ID NO: 104244 - DNA, 779 bp, Oryza sativa
tttatttcaatttattaattcgactccaatcacactctagagttctttctctcttttctttatcatcactcgacttatttatatttctctgtcttttgactcgaattacactcgaatttttttatttctatgtgcttcaccaaccgaaactttttttaaaagtgtggtttgagaaaagtatgaagtcttattatcttctttataatccattgtctcctccagccgggagattaccattcacccgacgcagcgacctcaacagttgcctatgtcctcaaattatctaacgtttgatcttgtatttctcttcttttatctcatgtgtgttttcctttcctctcaaattttgagacatttggaaacaataataaaaaaagaaaatatgaaaataaaaaaattcaccgtcgtcacaactcaagagcaatcactaacaaacttcggttgagtccatcataatcttgtttgttatgggtgaattgccgatagcttcaagcaccttcatattcatcagttttgccaatcaggccaatgtgtgtgcttcaaacatttgcaccgcaagatagaaagaccaacttgtattaggaccgtcctcttgtagcatgcaagtgtgccagcatgataggcatagaaaaaattaactttcacctctggatttggtgaactccactgtctcgattcgtagcaaaaacgactgtcggttatatagaagagtggctaaattgcaaaacaaaacgccatgtctagttgcttcctctcctgccaatgcctaccagcacata

SEQ ID NO: 104245 - DNA, 3797 bp, Oryza sativa
cacgctgaacactaggcgcgcgcatgcgagctagctgctctagctaagcttgtgtgtttcaccgtgttttttcgtgtgctatacagtaaattaaattaaaattcctcctctcgagttaagttaagtacagtagctagcaagcagtaattttatttatttccacgagtagtaattaaactagcaatatgtatgcttggacacgtatcgatcggctgcctacttgtattgtgaatttgtgatgtaagttatttgtgtttatgttactctatttattaccacttgtcatatatatgtggaatttgcatggataattaaatatacttgtttagcggattcatttttgtcgtgttcgtcataactagtcatttgagaccgtttaccttttgtcacgtgggctaagaggtacttgggctgttgcgcctgttgggcagttggtgtaggcccaggcctacggccgaccggcatatagggtttgtgttataaaaccggtcttgaaatcacatcggaaaccaaacgcgaaagaaacatcataggagatccaaacatgatgacgacaccgaggtacgatatttgataacggagttcagccgaggcctacatctctggggcactgattacgagcgctcctcccctatccagcatatacagcgtatcagagttacaacgactcacggccagtcaccgccggcagccgctccctctcgctatgctatgtcgccatgcggttacaacaggcacgcccctctatttatgagagattctatgacagagtccgactcttactctagtcctaatacctattacaactacaagtcctaaactgtaacggattacgtacacatattcgacacaaactctgacaaactccaccttgacgaatatgccacgccaacctgaattcattacttgtttgaacctttgtgtacccggacttgagttgatcctattttgccgctcacgtcgagcagccccgacaagtctccaccaggctcaccgtgaacaagagactccgctatccctataatttctttctcctgactccacctgcaatagtgctctaccttctctcatatcactacagtcgtcttgccaaacgaaattgaattccttcatagctgtcacatcctaaacttctcgaagaccatgttcaactccatctaccgtcttaaatttgacttgatctaatccatggtcagataacccacgtcatcaccaaatagataaatcaaactcaccagacacaaagagaaccctttcttccttgtcgtcttgtgaccgagctaaaaatccaacatccatgcttcttcgcatccgtagactgagtatccgataatttgagaaaatcaccattgccttgaatcatccgaagatattaccaccatagcgcttactcttctccttcagtaacgtagattctatatatcctcatcatgcaaaccccgcagattctgaatataccctgtgctgctaaacagaccgttgacaccctcaacgatttcccgcgctgttgcccgggaataatagaataccctgttcaaaaaaatactccacaagccttctgaacagtaacaagcagtgacagtgctttgccaaccagtgaacagtacctgggcgcatgaacagtacctcgaacagtaaccaacgtgaaaccgtgcacgatgctagcccaaaaacttgccggcccaagttcccccactttgttttctttttcttgcgggtcaaaaaagaaacgaggttagcagccatctcacgctacatttgactcctgttctcctcggtcaggtaccaaaacgtacatgttcgagtcgatctcctctgcgcctcgacccgcctgcaccaagaagccgtgtccgacctggaaagcacatccgccacatgatccttcaccgcctccaccccacacgggtacgtgctgcttcccttcgccggaaacagcccgcgacgacctccgccagcacctacacgatgacgacaccaaaccgtgttcctgccgcccagacttcatcgcaaataaatccgctccgacctccgattgaccacccgtcaatctagccacgagccgaagccaacaaatcacatgtcgtcttcctagccaccgaacgacccgagcgctacatctagccgtctccgtgtcgaacgcagctcatcgaaaggcctgggccaccccgctagagtgttcgattccaccaatcgagaacgccgatcgcctctagcttcaatcaaccctgagcgtcacgcctgactgtctccccattgaaagtagctcaccggaaagtccgagccacccgcccggagtgtccgacccaccgactggatcgccaatcgcttccgccaccatcaacccgagcaccacgtctggtcgtctccctgttgattgtagccatcgaacggttcagaccgccgcctgatttcaccaatcaaattccgttgatcgccgccacgctccaccttgcgtccatgtccgtccctggacaccctgtgtagtcgtcgcggcgtggagcacctcccttgtacctctaccatggatctcatgcaggctctaataccacttgttagaaaccggctccgatttcacgtcggaaaccaatctcctgtggcgtttcttccgcgtttggtctcctgtggcgtttcttccgcgtttggtttccgacgtgaattcggcgtttggtttccgacatgaattcggagccggtttctaacagtttgtttagttccacacgatcccctgtgaccaaatggcccagtatcatctgggcctgtcagcccaacacggcctatgaccgcttcagcatttcggcccgatatgcgctgccggattccgccggtttgattcattttgacaaaaacatatggaagtagagctcgccgggaaggatcaggtggagaaataaactgatcggatgcacatccattcttaatttcttagtattattcatagcagttatatctaaattcagcatccattccttgtaataaaaaatctaaacaaaattcaattacatctgcagcataatttctctgaccatgtcgccataagcagagcaagacaaccttgctactactactgctcactccactccaatccaggtattaatcgatcttgtattgatcatgcatatgagaattatccttggcctctctgtcctgtctgctcatcaccaagcaaccaatgcaacctcctgtctgaccctaagccatctaatctaattaactaattaacacaagatcatgagctcatcacacagatcagatcaccagagacaagctagcactcacatggagtactgcactgtactactgtcctgcccattcgtgtgctgaattgctgattataattagcagctctctcagtttctggagcagtaaccaccaaccaagctgcctctgctgtctgctgctcgtgtgcacggcactgtactacttgctcgtaccacacaaggacagctgcactacaacctctaatttgatccataatttagttaattaattaatcagtctcttggcagaattaagctgagctgagctgcatgcctccgagactcaaggttattcctcaacgatgtggttaatctaatctctattattcgagctgttggtttcactccagccatgagctctgcagactctgaactgccactctgtgatgcctgcttaacacagctggcctccctgctcacgtgcggataaactaagcgctaattctgcactaagtactccactgacactatcttaatcactttcgaatccattatgcttgcatcacttcacatgcaaattgtgtactccaatgttcagtt

SEQ ID NO: 104246 - DNA, 532 bp, Oryza sativa
ttgataattcaagaaacacgtaaaaattcaggagaaaacagtacaagggcataccatatgcattgttgtacgtgcgtgcaaaacttcataataaatattataaataaaattttgggatcggacacaggcaatcatttctcacaaattaaagtgggtctgaaaactcaactgcatgtactcctacttaattaaattcattggatccaaataaaggcgatacttaatgtattgatgtagtttaaaaggaaaaaacttgccagacaaaacatacgtaagatcaagtagcctgagaatatacctgcaaaaccataaatatttcaattactttaatcagttatagaatgatagtatgcaagacaaggagttattattagttaaaatggaccccatatggcatgcatggtccagcaaattaattaaaaatatcgatcgatccgcgttttttgctgcgtgcagaccacaaagatacgatagtcccctatttgccctaatgtactacacacgtcacagagattatatatatatatatatg

SEQ ID NO: 104247 - DNA, 792 bp, Oryza sativa
cgtacgtactccataattaattactgagatacgccgaggtttacccgacattgtacgtactgtatttatatatatgtacactgcttgtgtgtatagtgtacgtgcaagctatatatagtcagttgattaattaatcaacgactagatcgaatctcatgtagccagaatattactccctccgttttaaaatatttgataccgttaactttttagcatatgtttaactgttcgtcgtattaaaaaaatttgtgaaatatgtaaaactatatgtgtacataaaaatatatttaacaatgaatcaaatgatataaaaagaataaataattaattaaaatttttaaataagacaaatgatcaaatacgtatttaaaaagtcaacggtgtaaaacattttgaaacagagggggtatgttcgagcagagatgatcgatcatgcaagatatggtcattatcacatgcatgcatgcagctagcttatctcgagctactactcctgcttagctcaattaatttaaagagagcttattagatgccttaatgcatggcagtacgtacatatagctagagagatcagtatacaacgtgtagcgtgcaggtgtactttctgctcgtcatttataacatttgttttgtggctgccaacttgtagtgatattcaattaatttcgtttgctaactgtgatcgagctagcttagatatgcatgcatcagttattagcagttactgaggaacaggaggatttgttaattaattggagtactatacatgtacatagcgaagtacgtccctaa

SEQ ID NO: 104248 - DNA, 699 bp, Oryza sativa
ggatctaaatatttcatcttctctattatatattattaaaaaacaatagcgcttctgcctcaaatttatgtccatttctgcacgcagcagggttcggagtttaaaactccgacttcccatttgggtcactagtaaacattaggccatcaaagtggaggaggagaggaggaggaggtggagcgccgatgacctcttccggccaaccggtgaggccaggcaatagcttgatgggaggcggtggggcaggaagcggtggagcgcgtcgtggcatcgaatcgtcgggaaggagaagaaaggaaaagaaagagggggttaggattaggggagcgtgcataaatcttaaagcaatttaatgatctaacaattataagatttagatggtttttttaagacattcccttaaaaaaataaaaaccgaagatttagatggtttttttttaagacagtccctttaaaaaaaaggtgtgaccagctgagggaagagaaagtcattgtcgaccggaaaataaactgcttgtgttcttgtgtgttgtcgaccttggtacggctgcgttctggcaggcacatcatgaagctcagcggggtgggtcggagatcaaaatttccgaccctattagggtctctactggccgttggatcaagttatgtgactcagattgagtagatcagctgctcaaagcgtactcaacgaatcgcaat

SEQ ID NO: 104249 - DNA, 697 bp, Oryza sativa
attcacaaaatacaacagttcaggtacaggtacattattatccaacagtagaacatcagagtacatacaatcatccagtttgtttcagaaagttcaatgtggctaaaatgttattatgattactcttgaattaaattagtgattcctcgaacggtttatgtaagcttaaactgtgcaaacagaaactacttttaggccaattgtctgtctgaatcgaaataatcaaacatagtgaatacaaaaatcacaagaactgcgaatcgtcttgtaaacacggtcatgttgcttgagattgggagaaactgagatcgatcgaaaagtatcttacatatgaagttatgaacaaagaaggctgcgattatatactaggcaagaagaaacgctcttgataaagcgcactccaagttcttgctcgatttggggggtggcaaaatagctcagagggaagggagaggaggagagcttaccggccttgtaggagatcggggaggaggtcgtcggcggcctcgaggaggatgagctcatcgtgaggaccaaacgcctcgtggtagcacagcgacaacgaggcgccggcgccggcgaggccagcaccgcgtcgggccgccgccgccgccgccgccgtcccattccctctcggattgggccgccgcgtcctccatcgccgcatccatggatcggagattcggagctgtgggat

SEQ ID NO: 104250 - DNA, 736 bp, Oryza sativa
aaaagacccttgcttttatctccaagcattacttgactggtcaagcaagcataatttgatttccaaagttcatgatcataataactcggtaatctgaaaatacagcaacccacacagaagcacatactgaaacaaagaaaagctagggaataataatcgagcacaactgctgatctccctagggcctaaattcacaccaagcataccacattagcactaacaatgcctaaatcagctcaactgcaaagaacctgggctatatcgaagggaggcacccaaaaaaaaaacaccagcccacacgaatcagcctcctcaatctgttcttccaatacaaatccacacagaaacacaggtcgcatcacatccattcgacccacaaaaccggggaatccccacacggccgcgtgactcgaaaacagtcgagcaactactgcaaaccactacgcaatcgatcgcgaggaagacctcggaccgggctgaatcaagcataggagagtaaatcgaggagagagctttaccctagtgggagatccggcggaggaggaggagatcgagcgccttgcacgaacgggattgccgcggaagcgaggcgagcgaaggggattcccggatttccttccacttggtttggtatagcaaaatcgattagttaattcagccaaacaagcaaacaaatcgtcggggtgggaaggttgggctgaattgggccgaaaataagcgggccgtagttttgggc

SEQ ID NO: 104251 - DNA, 1155 bp, Oryza sativa
aagagttcattaactaatccatcacatgcatttcaaaatcatgcaaatctttcttccacaagcaacccaacctgacaggccaatacatacaggtcatcagaccaagagctttctcctgatttatctgccaaattaaacctgtcatattttaggcgtatctttatatgcgtatattcataaatatacaattgtgactaaaatgctagtatttgctattctttttcgtggcatctagcaataccttctccatgctgcctaattaacaagacatttcaaaaatattctccttaaatttcaatgttcaaggtcaacaaatggcgtcgagtatttgcaaacggagagaaaagggaattaatactttcttcatcgcactaacaatcttccaaaaaggacaaatgcatatttcttttagacaaaaaagacgacatatgtgcacatttggtgttatcttgtgagtttcggtgaaatttcaggtgaaagcaatcgctggaatgatgttgaacaaccatgtactcaaaagtactttcaaagcgatgactgatacaagaagaacttaagcaaattggggttcttggaacaacttgttgctcacgtcgacgaattgtcttttttgatctgtgatttgacaataattgaccatgcccaattatccaaaacttgccttttatctacaagatttgttgacttgacatagatgagaattattttagctggaccaaacaatattccaatggtaaaatgttaggcaattttcaccttttattccatgcatcaagaacaaggaatgtgcttaaaatcccccaaaattgaattgtttcatgtgaacaccctactttacaaacattttcacatggctatatttcagcgtatctgaaatgttagtacagtggcaaagttgacaataacatgtgttagtgtgattgctccataacctgtataaaggccaaaataattgtacttaaagaaagcttgtcttatcttccaattggtgattagtgctaatatcaaatagtgtgctccattatgctaatttaacaaacttgatagaatcggagagatccttgttggtgcaccggaactttccaggaagcagcagcaatcagatgagattaatattgttttaattttgtagagcacccatgattgtgatttggg

SEQ ID NO: 104252 - DNA, 853 bp, Oryza sativa
cttataaaccgttttgttaatatgctatatggagtagtatataccaacaaaagtagtactctaatattatatgaaaatacatggaagtagtattatttcatcggtttaattaggttttacatgctaagtatacttttgagtaatttttactggttaaaatttacaaactttgaccttttaactttgtataacatgccttaaaataaacatggagagtactaatatacagtactacatctgtatggaatgtgaacatgctttctatatattaatatataaactgaagatttttttatttaaaaaaacaaacaggtttcagcagctggctggtggcaggccggctgggtagctagattaactagctacagtagataaaagataatattatactccctccgtcctaaaataagtacagttttgcactattcacgtttaatgtttgactgttcgtcttatttgaaaattttttatgattagtatttttattgctattagatgataaaacatgaatagtactctatgtgtgactaaatatctttaaatttggtcaaacgttgtgcacggatattcacggctgcacttattttgggacggaggtagtatgtatgttgcagcttcagctagctactgtgtgaagcaaagagatactactcctatagctaggcttttgatttgcagtgctattaagtgtactttgtttgagatcaagcgtatggatggaatgttcttagcacgatatagcagctggatggtcctgcaccaacctactgtaaccaacaaaacacacacacacacaacacagtacacacactctctagtctgaatatttctcactactcctatgtacttgtca

SEQ ID NO: 104253 - DNA, 642 bp, Oryza sativa
tcctgctagttaacaccgtcaagtgtaaaaactaacggaagtgctatataaagaaggaaaattttagaagtgcctagatagggaactttttaagtttaggtgctatagagggaagagcaacttttttttgatgctagatagggaattttctctacaatgatcatacttcccatacgggcaattgcttatttgactctgttttgaagtctaataactaatttgaccctacttttttaggtttgctcatttaaccctgtttttcaaaattgaagataaaggttgaccctattctgtgaagtctagataacggtgttaactgagtgacgatttctcttttttgcccttgctcgtttgaccctaatgctacattttaacatattcgtaacaaatttgacatagatttgagaaaattttgacatatttgatttcaatttgataaatttagctttagtttgacaaatttgactttaatttttttaaaaaaaattaagagcatttctcctatcttatccatcccaaaatgtataaaataaagcaaaaacatggcaaagagcgctgcagtcgccgtcgccgcaatggctgccgctctgagcacgatagcaaccgacgccactcccttccaccttcccgagcacagcagct

SEQ ID NO: 104254 - DNA, 746 bp, Oryza sativa
ttgtgattggaggaaaaatagaggtaggtagaaaaactgaatggtggaggattgtgattggttgagaatagaatgttggtggagaagttgttatattttgagacaaattctaaaggctataagttattatattttgggacggagggagtagatattttctgctcctttgccctgatatgcatgcatggtcagttattcatttcttacgaaggccttcctctaacaagttatttggtttgttcattatcataataatggaatgacaaatctcacacctaatatatgctaaagcatagcatagcagtgcagagcatgaatatgcatgtgcaggtagacattggcaggagaagaagcaactagacatggtattatgttttgtaattcagccacttctatttataacccaccgtagttgtgctgtgaaattgtggagttcactaaatttgaaggcgaaagttagttcactctatgcctctgaagcacttgcacgctacatacggtctagttttgctatgagatagtggagttcacctaatcctcaagcgaaagttagttttggcgcaattgcacgctacaagcggctcgttctgatctgagctgttctttctctcattcgatgcaaatgttgatcacactcatctgtttgattagcgagaatgatgaggatgaatgtgcttggcgccatcgacaactcagtcatgagtcacaagcaacaagatcgtgatggactgaacgggctgcaggaa

SEQ ID NO: 104255 - DNA, 653 bp, Oryza sativa
caaccaaaacatctgatattgcttatgattgtattctcatttcgagtaaaagagttaaccaataggaggagtgcgttttctttttcaacacattgcactggtcgtaattgggctcaatctaaataataactgggctagtaaacgcaatatggaaagcccataacctgtgttgggccaggaggtcagatcagtagtaacaaatggactgggccgtattgagttagttgggcccacatcgaagataacttgtgggccatgtatcgcttaaaagacattctggggctctctggtctgggcaagtagtatgccgtacctaactaacctaacaactcaagaggcccacaaatggaccaacctttgtgcatcaatcaatcattcataagcacatattcaatccaagcaagtgatacatgtgtgcaaagaggcgtatatactcaagttctcagccaagtgcacacgtcatgatgcccaaaatccctattagtgtaggcaaggagctttcctgtctcaaaataaactaatctagaatagaatatgatataatctattttgagatagagggaggatatgttaagagcactcacaccatgtattttatagaggtagtataaagtttggatagctcctatggagatgagcccgttcctttttca

SEQ ID NO: 104256 - DNA, 728 bp, Oryza sativa
caccatgcatcctcaacgctaactcagtgtttgggtgttacttttataataattggttgtagctctgatgagcaaaggccgggatgttttattccattatctaaaaaaacgctaactccttactttttcttgattgaaaaatggttggtgggactagagggtccaaatgtcaaccgccgacaccaactcttactttaacttctgtgtgaagtaaaattgatagttgacactggtggagaaatcatctttgatcggtccagcaaaatccacaatagtcccggatccaaaaagaactgggactaaagattgtttttagtcccggttataaaaattttgatctttagtcccggttggtgttaccaaccgggactaaagatctttagtcccggttcatcccttgtcagatgtatgtcagggggccgaggatctttagtcctggttggtgttaataaccgggactaaagatcaccactttagtcccggttggtattatcaagatgatctttagtcccggttggtaatacgaaccgggactaaaattaaacacgtagtatataatccctatcccttatcctctcatccacagttacagatcgaatctcacccctctcctcagatctatcctttctaactctcttcctcatcccctcttctccaactcctccccttcctcctctcctcccccttctccccttcctcctccccttcccatccggcgggctggccga

SEQ ID NO: 104257 - DNA, 687 bp, Oryza sativa
ccacatcttgggattgttcagcaataatttcaattatgattgaggatttgttaatacttgggtattatctgaaaaatttagacatgattcttgagctgctaaccaccaacactgtttgctcataaaaccgctaaactttatttttagataatgatagaagaataaaactagtgacaagaaaattgctagtaataaaaatgatagtctggttctggaaaatttgaagatccaagattaattagcatctgattggctgctcatgtgcatcctttatgaacagatgtgactactgacgatcacaattaaaaagcatcgagtagacatgtgcagtgaggatgctggctgctgctagtagtgctagtacctaacatgatgagcagctagctagcaagcagcccatgcgttatttctgaacacaaaaccctcggaaccagaagaatgcatggtatggtgaagcaaattgaagcagcaaagaaacaaagaacacaatcttctcctcacccctaacccctacacacatacaattctccttaattaattcgatcgacatcgatcttgatgattccctgcaaaaccaagagataactttcatcattacatatacattcaggtgaagaaattctgacgatgatgtggtgaggtgaggtaattaagggtgagctagcatcgtcagcggacagggtaggg

SEQ ID NO: 104258 - DNA, 660 bp, Oryza sativa
catgtcccctaataaagtcatgaaaaataatattttttacaaaatatatcaatatgtgataatcacttcacaaacatatgcaagttaaaatttaatatacacaagtagaaacaaatgtgtatgaaccgaaaacaacaaatatatatgactatcaaaggtgtgcgtacaattcatggttgatactccctccttccctaaatgtttgacgccgttgacttttttaaacatatttaaccgttcgtcttattaaaaacttttgtgaaatgtgtaaaactatatgtgtacataaaagtatatttaacaataaatcaaatgataggaaaaaaaattaataattacttaaattttttgaataagacgaacggtcaaatattttttaaaaaaagtcaacggcgacaaacattttgggatggagagagtatttgttatttttgtttcttcttctataagtcgaattttaacttatagttttatagagtaacatatcacatattaatctgttttattatgttttgaaaaattaatatttttagacggcattcatgaaacgagtgtatgtccacgcgagtgggaagaaaaccactttccatctacagggctctttcaattacgtatgcaccatctgtatgtatacactaatatagaaagaacctggtgcag

SEQ ID NO: 104259 - DNA, 1694 bp, Oryza sativa
gtttgattttttttaatcaaactttgataagtctaattaagtttataaaaaaatttagcaacatctaaaatattaaattagttttattttaataatatgtttattttgtgtaactgtatggattgcgagaacaaaatatcagttatagaatgatgtggcagaatgtatatcaccattgctaacattttaagtatagacaaccaccgatctgatccgacgtggcaggtgacgtgtgcttgagtacgggcaagtacattttcatctcgaggcttctccggatcaccgtcgttaacgtaacacgtggagatgtaacaacagtaaaaaggccaattattattcagtttaccctactgcctttctttttctcttctgattggcagattggcatacaggattcaggatttacctgtctgaagaattggactgttgttgtggcagctctcccatgcagggatgtctctgcttggccatattctgcttctgttcaccgaacaatgcagattttttgttggcttcagtcagcttcattttccacttcgtccccaacacattctccagtgtgggggcaaagctagcaactttacaagttagcactaatagcactttaccaagttgttatatctttgatgaacgattgttatattattaatacacagtgcactcaagcatgcaagatgctaggcagcagcaatgcagtagtaatatctgaaattaaagaagatgccatctgcccagcagatagatcagcagaaggaattgagcatgatgaagcatcagatgtaggcgtgtacaagtgtaacgctgctgctttcaggaccatcctgaaagaaacaccctttcttaggctttaatttgtcctgcactaactgaacattttgcaaatggaggctttcttactctcttctttcttctaggcatctacccacatccatgcagtagcactagtacagtacttgttaccatcatatcatatcatatcaagaatggcactgcatatatacacaactgattgagtgtgtactagtaacagaaatgttccaacccatgattggggtgatgagcacaaagatgagagcaatgagcaattgagcattgcttgctctcctgccggtttgtatcagaagctgacacttggacgacatcaccaatggccgatgcttctctcgcagcacgtacactccaaggtactagtagtagcagagtaggagagaactttacagaagtgtatacacgaagcatatcatatattcatatcattcctagaaaacaaaaagcgaaagaaattaaaaaactaagagtagtagtagttggtaggattgtaatttgtcaggtgaggggtgaagttggcgagatagctctacagaagcagaaggctttgcttggaggcgaaggccggcaacgcggagatgaactgaagaagaaggagaagaaggagaagatcgagccgtaccaagcaagcagcttttgcaacaaaccaaaccaccaaccgatcgatcgaacaaaccaccattccccacacagccacgctcaccaacccaaaccgacgcgtagtcgacgagttcgatcgattgcccgaccgtatccgtacaattgctgacgcaaccaaaccatcacaaggttaaatacagtaaaagaaaaaataaagaaattctcttcttcttgtagtagaagaagatgatgccattggagttctt

SEQ ID NO: 104260 - DNA, 767 bp, Oryza sativa
gtgtgattcaatcggagcctagcatgtcgctgagatatagggagaaacatccagacctttatcttgggaaatcagaaaagggggtacattgtgcacgcgttagtttcgaccatcttatggtgttgttccttagtgaatcgcatggtcagatgaagtgggtgttgaagcatcgtagctgaattgcatccttgctacctcgtcgcaccacctacgaagaacagagtggcgaatcatggatcttacatggtgctaactatcaaggagattttcacgctgatgctgacgatgtatcatggatgtttaattgggaatggcagagggactcttatgatgacgatgatgatcatcatgagagcaaccgccatgccaaacatgttactttcttaggattccatccttttgatgaagaggttgtgttcctcggtgaaactttcagaaggggatttgcctataatctgaacaactcagagatccaagacctgggtaacttgtgcccaaaattctatgatctcacttatcaccaggcgttgatacaaacgtcttttgtgtacacgccttgctggattggattagagagagctctctctctctctctctctctctctctctctttctctctccctgtaaatagctagtactccctccgtttcaaaatatttgacaccgttgactttttagcacgtgtttgaccattcgtcttattcaaaaaatttaagtaattatttattcttttcatatcatttgattcattgttaagggctgcagga

SEQ ID NO: 104261 - DNA, 694 bp, Oryza sativa
tttcttttacgcaaatgaggtcaatcatatcttttaattatttcaaactaaagagtaaataagctttccctggatataaaacaaaatttgagaaaaaaatgcaaatgaggaaatggaaacaactaatactgttaggttccggaaatctacctcttgacattttttttatttggatgaaacatgtgaagtgaatggccaataacaccataacaaaagttctgcaaggggattgaagcaggctaaattaaccaaccatgaagcaaattaagatactttttccacatactagattcggtgctgagaaataagtgaccgtaatcaactaaaaatatggcacatgttttcagcaaaactggttagaaaaagactaactatatttatggtgcatattttccaagaaaaagtttaaataaatacgtttacactataattacgttataaatttcaacttttacactaaatatatgtcatataaaagaatttgattatctacttgaaataggagagaaacttactacatacatataagaaaacagagaggtatcaattaattacatgagagaagcaatcggaaaatcaagagaaaaatatggaaccatatatatatagcttttaacaaaagggggaaaaagtggaattttggacacttctttaatgacgttactcattccctccgtgacaaaaacatgccgtt

SEQ ID NO: 104262 - DNA, 730 bp, Oryza sativa
ggtagccaaataaaccaaacattcccttagttttgcttgtggtaagaagccaaaagaaatagaactggaagattaaaaaataataagtttacgaaattgtgaacctaaacataggggtgaaaacggtaacggtaattaccggccgaccggcgttcgttttcgactttctaccggccgagccatatggaaatggtaatcgaccgaaacaaaaatggaaatggtaaaaaatatggaaatgaaaacggaaatggttttgctgttataccgatcgtttccgtatttaccgtattctcgcggaaatcaccgtttcttataatatggtaattaccgtattctaaatatgtcgatattataggacatgtctatacttgacccacagcttatagattgaatgactcttcaataaaatctctaacttttgtatatggctaaaatgaagttaatttataatttatatagtataagcttgaatttatgtatatatataacatacttatgtaaagttaaatatatgtttttatagtttaatgtttccgtatttgttaccggttttcgatctgtaccgacatgtttccgtccgtattgttccgttttcggttttccgatatttccgatatcgttttcgtttccgactttaccgtttccgatttcgtttccgagaaaaatatggttacggaaatggttgaggctgttttccgatcatttccgaccgttttcatgggctgcagga

SEQ ID NO: 104263 - DNA, 556 bp, Oryza sativa
ggtggtggagctccgggagaggagccggcacccgctgttcatgatgtgggcggacgtgaagcgcaactacttcacggtgccatgggcggtggtcgccgagttcgtcgccttcgtcaccttcgtctccaccattgtccagatgtactcctccttcaagcagaaaggaggatgatctcgtccagaccgaccgccatggaattaatccatcgatactcccaccgtcccataaaaaaccgaatctaggaccagatatgatatattctagtacgataaatctagatatatgtatgtactgatttgtagtactaggatgtatcacatctagttttttatgggacggatagagtacgcagcgagctactccgatctttttagcttatttctttcttgcctttttttttcccaatttaatgacagaatttgttatatgttcttgacttaatatccccttggatttaattcattgttttatgaatctgtacatgttgagttttgctccattttgtccaaactggtttcatgcaacacgtacgtacgcaatgctcttcttcaatcc

SEQ ID NO: 104264 - DNA, 676 bp, Oryza sativa
cttttgtaataagtaaataaatattagtttttatgtcattatgtaaaaataaactttgacatgaataataccttgttcaataaaatcatgaatataatagttttatataacaaaattatacacttccaacaatatagctagtccaacaatatagctagtctacaatttccagatttccttcatgcataagggcaaaatggtcattttcataggaatttaaacattcaactaacggtcaactaacggaatatgtatgaaaatgatgaaaaccaaaattcaggggcataccaggaagtggacaatactcgggagcctaaaaggattggctaaactttcatagatatataaggaattttctcttagatcagcagatatcgtcaccaaagtgttgacagatcgtgtcagcaacgactatgtttgtcttttgctccactatatcaatcttcttaattttatttattgactgctgagtgcaagtcttaagtcttgctaactcacacgccgttcgtgtcaatttttgggttccatttggggcattaattgtatttttttaggctcattgtaggttttcctttatcacgcctttggcaaccacatcggctaaactaaagagatgattaagacaaaaccaaagagataaccaagacaggtcagatgcggagttactagtctccca

SEQ ID NO: 104265 - DNA, 529 bp, Oryza sativa
ggtagatgggccgagagtgattcggcccatcgaacccgggggaggcaaaatagacttttgcggaggaatttgatttggaaggatttggattcgggattgaactcgacgggagataattttcccgctaggcgccacgacggaacgggcgctacagaaaacaagcaagaaattgttatgcatgccttacattttaaaacaagatgaaaaaaaccatatgctttattaaaacacggattaaagaataaaaccataatgatatagccgcacttggaacattgcaaaccaaacgctatgttggctgtcaagatgctccatgtcctggagttgtgtagaactagtataaaatatatagaccagaacatgagactttgccatctctcagtcttttactacttcctccgttacataatataagattttctagcattatccacattcatttagatattaataaatctagacatatgtatgtgtttaaattcataatatctatgtgtatgtgggcaatgctagaaagtcttacattgtg

SEQ ID NO: 104266 - DNA, 2406 bp, Oryza sativa
ccaatatgctgccagatatcgacatcaaagataagcctagacaaacccaatatggtgtctacggaggccaacaagagggatctagcactatctctgatctcgccgagtttatattcgaggaggaagactatcctgtcattgattacgagttggttatccatgctaccaagtcgacggcggttagataggttatcccaaacattgtacttgtgtgatttagatgaataagagcaataccggctttggccaacaggagtagggctattacctataagataaggggcccgaacctgtataaaaatccttgtctccatctcttttacctcaatctcgcatataccctggtactaacgatccccatactatccaaacaccaaatgtcgacagttttttcatgagaaatgatttttttcagctttgttttgctctctttattaactctcttatcgcatcagtttttttcttacatgacaacatatttaatgctatagaaactagctgaggtggatggttggtactgctttaaaagctagatctgaaatgctatcaaccaccctaatttgactatatctttaggatactccaatatcagatataattaataattgaattttagtgttggatctcaatccagaggatctctttcatcttttaactatcttccttctcccaaaccctgtgttttatattggtgctaccaccttaccaccatgctatatttgttcctacaactttgcctacttgcaagacatcatcaccgtcttctctcccatgcaattgaagatagatgagggtaagaaacctgtcgtttcgaggcttgatgctactcttaggaacattattgatacatcgactttcaagcatcttgtagttgagcgatactgccatcaacagtaccattgtaccaagatgaaaaagactgctgaacatggatagaacgagagtcgaactcgaatgccactcttttcatgctagttaggaaaggaagccgatataaacagctccatgttagggaattgcctctgactttgcatagggttgacactaagagaaaataaaagttattagaagataatatatggtggcgattctaacttagcatagggttgacaatgagttgttagaaggtaacatggggcgatcgataacacgatatttccaccagagacaaaagaagagagatgatagcaggaggctcatatgaggccggaacataaacaatgagcaagaactcaataagcaatagttggccttgccgatatgaaaggttgaagaaatcagccatgttgttggatacacatcaaactgacataatcgttggacataataatactaatgagtagagattacctattggctggcgcacaaatcggatctcagttaaaaaaatgatgcgtattctcacttggctgagatgtgatgatatttatagtagctctcaactctatgttgacattttgcttatttgtgatctgcggctgttgatttcctgatgagcccttataatattgaaatttataattagatatgtacttgattttttttgagagggtatgtacttgattaacatatatattatatttatcatttggacatttggtcttggtctatttaaaagtgtgttagagggatacacattcatgggtgtgtgtatgtgttccataatagacggatctaccataggggctaaggggtcttaagcctccactactgtcattaggaacatgagagccccctctaaaattatttgctatacatctataggaaatggatatttaagttttatctagtttattcagccccacctgttatttcttatttctgtatccgcaactgttccgctgtaatcaaaataagacaaaacgaaaaggtgccactgaaattttacgcacacgcactcgcgggtgtattaagctagcatatgctggtgtttggttttaaacgacggttgaggaaacccggattaaacaaccctaattatatggaggctattgtcaaactggataattttcgcctggccatcgtcaaactagattatgtttttaggccaacggcctgacgtcatgattttatagaatgcaactaaattcaaacattagacttaaaacattactatccaagaagaaaagcattagactcaaactgcattgttgacatgaggatttcaaactttgttgcaatatttgactctttcggtccctgtgcagtggagcatagtgccggtcaaataataactctatgtatgtatatatggagacgcacttgagtgcagtggtaatagacgtgtagtttcaaccctgagatcccgtattcaatcttcaatatactcacaatttagagggacgtctttccctctaaatctcgtttttaataattctatgtatatgatagaaaaataatttaact

SEQ ID NO: 104267 - DNA, 1674 bp, Oryza sativa
ttcatatttagtgagtattatagtagttagtatttattattatgttaatacataataaaatgttaaatttaaaattattaatatgatattaagtcattaagaagatatagcttgttggcgagcctaacgagcttaacgagccagctcgcgagccaagccgagctagccttttagctcgttaacattaaagagccgagccttaacgagccgagctggctcgttatccagacctaggttgaactgataaacaattttatgataggaggaaacctcgttccgtgcatggttctctcacccgaggtgtatacctcccattatcattatttgagtgaaaaatattaaaccgattaaactgattattagaaaataagtttataattggcaatgagctagctaaacttttctggtccacaagatatagatagtgatatataccttctggctaatcaggtatagaatgcaactaaatttacaaaaacaagctttcaatactattctaatttgtaagtttagttttgatatctattttctatagctatgtatatcttaattatgacgaagtgtatacctctcccagataagagagaacgacttgtagttgtttggcacaaatccaccttagcaacatcttcatttgctaattaaaaagagtataacctatgatgacaatcgacgtaagtttaggggaatcataaaaagtaaaaaatgaagtacaagttcatacagtaaactagctaggtttttcaatgacgtaaaacacatttttctccctatatgttccatataatctatcatggttagcatagtcaacacacgcacttgattaacttaggccctgtttagttcccaaaataaaaacttttcacccatcacatcgaatgtttggacatatgcatggagtattaaatgtggtctataaaataaaacccattacacagtttgcgtgtaaaattgcaagacgaatcttttaaacctaattgcgccatgatttgacaatatggtgctacagtaaacatttgctaatacgaattaattaggtttaataaattcgtctcgcagtttacaggcagaatctgtaatttgttttgttattagacaatgtttaatacttcaaatatatgtccgtatatccaatgtgacaccccaaaacaaatattttttccatcaaaaccgagccttacagtaaaagtaagccggccgccaaatgaatctagctaggcctcaacagctaaattttccaacacaatatatatcttgtgtggagctagattttaaaaacaaaattaaatttcaaatacaactataattcgctttctaaaatacaattttatgattgtgccgaattcggaaccaccatgattaatgggatgtttggttggtagccattgaataccacagctacagtattttcgctacaacaccgtgttttctgaggcggggaaaaggtctgccacaggtctgtggcgaaccacgccgtggcgtggcaatgtttgtctgggatccaaacaaaccctaaataatgcacatgtttatctggttctctgacaaacgtggtcttctaaaccttccggactaaatgtggttgctcattatataaaaggcatattttgagtgggcacaaaggattaagaagagtatataaaccaagggaaagtttgagttaaaattaatata

SEQ ID NO: 104268 - DNA, 1065 bp, Oryza sativa
tggaccagctattatattgtaggatcagtacaagagtctcgttgcatagaatcaccgtggactaatctgcagttatactgtcatacaaggaattatgtcccatcttacaaccgcatttcacgaatgtccaaaaaacaactctatttttaatagtagttcaggttcgaacaagtgcacagtatagaagttcaagttgtttttagtctttgaaagttcagggttgtcaaatagactattcctaaaaaggagcatattcctgactggcttatcaacacttaacatatgtacttcatacctttgtcctattaatagtgcaggtgtaacttttcatctgttttcaactagtgattactcctaactttcaaaaaagttccatgtttcacattataagacattttgggttttgaatagattcatgcatggatctatgtatgtgcttcatatatgtgtccaaatttatatggatgttagtgaatctagggatggggaggccaaaacatcttataatgtggaacagagggagtagtactttatttgccataagaaattgtgaactaactctgatatgataagattgttgaaattgatattaaccatgatgagcagtagcttcctggtagtcttgttcataatatgaaaaatgagaagatttgagagttgagcctatagatttgtttgctgccaatctggtcttagctgagagtgaagcaaatctaccttgatatttatttgacagcaatcttataattctcttgcgcagatcagagcagcctctgaggatgcattagaggtggagagaactacaaggaaatggttgacaataatgaacaaagattgcaatcgcttttgtaaaatactggttggtatctgcttttaagtttgtatgctaactttggagtattgagtgttttcctgaactcgactgacattttcaatttaaatgttcaatgccagagattagcagggaagaaggctgtttctcattctgaagttccaagaaaacgaaagaagataacatttgccgatgaaactggaggaaagctctgtcatgttaagatgtttact

SEQ ID NO: 104269 - DNA, 1139 bp, Oryza sativa
ctgagtagacattttaagcatatttatatggtgatataatccatgttattaatttttttcatgatttttcataattctctaatgtcatgtaaagcaccaagataggccatattacttgtttgcattataaatctaatttagccgtgaatatttgtgaactgataatgagtatatagtaatatactccatattttactctctccatcccagaatataagaagttttagagttggacacggttattaagaaagtaggtggaattaaatagagagatgttattggctgagaagtggaggtaggtgagaaaagtgaacggtggagggttgagattggtttagaagtgaatgttgggccgagtttagttctaaaatttttcttcaaactttcaacttttccaacacatcaaaactttcctacacacacaaacttccaacttttccgttacatcgttccaatttcaaccaaacttccaattttggagtgaactaaacacacccttggtgaagaagttatattttgggacaaatcatgagtactaaaagttgttatattttaggacagagggagttatatttttcataattttcatgtccacttggattgcataagcgcaaacttggataacatgcaaaaatgtagaagtatggtacgtacacaagttattcttttatattgatatattcatggttgaatttattttttttatctgcttcgatactatcaatctaatttagacttgtaaaatgttcacaacaatatataatttctaccaatttaaatgttttattgctgtttggttgctatgcaaagaaagggttctatgtccaaactacgtattttcgtatatagcaaaataggagcaatattaatctcaaattattagtttaattataaatttaaaacaattttaaaaataaaaacaagagttattgcttaaagtttctgttcatttaactatctagttattcatagaagtgtttttcatagaagtgtttgatataaaataagagatagaaaagggaactgcccatacgtatagttttgtatatgcgtgattacgtacaggagggagattcgtacgtacgcggaggtagaggtggaattgagggattgtatatgcgtgtatatgcgtgattgtt

SEQ ID NO: 104270 - DNA, 712 bp, Oryza sativa
ttcctgcagccctactggtcctctatactggactcagtacgccgaacccactctctatggcatagtgatctgacgcctgctatactatattaaacacctataccgcttgccgccattgattcacgatatatcgcgctacattcttttacgccacacatctgcttagcccaataaccacacaaccatagcagaacgtccacctgagagatcgccaccccattcaaaaaataatgcctctcttattaatataacactcatacctatacttactccatcccaaaatattgagactgccgtctgatcttttaaaaatgtaatgaccgctcaggattataaacaaaatcacagtggttgtgaaggcttttcctatcattggacttattgaggaatataaagttatgtatacatatagcagtacacattacataagagctcttgaatacaacgagcgggcaactatatttaaaaaagttaacggcgtcaaacatttagggggaaggagagagtattttgaaagacacatcattatcatggatgaaaccacaaatatgcataatcacgaacaattttccgtcgcccgcggtcaaaccgtctctcctacacattcatctgtacggcaagcaatccgtacacaccacggcattctgtacggccgctaatctcattccattccgtgcatccgatccttccccgcattgaagcgcgcgaagcc

SEQ ID NO: 104271 - DNA, 511 bp, Oryza sativa
cctagacatccctagtggctagacgacctaaccatgagcagtctccttcttccagatgaccacgcaaacgcttggctaaaaaaagaccacgcaaacaggaacctcacctcgaccaccaaatcatatgctgctgcctgtggatttcattgccagctactgaaaatcaaaccctttacaatcccggtctcatgtagcttattatccccatcgattaatctgtgtagaggctctgatttgaaacctaatccaagtctaggcagcagcaggaaagcttccctcgaggcctagagcccaagacggacgaagggcgaaggaaacgatccggatttgggagcgatgcgtgaagccgattgaaaagtaatgaattttttaagttgttatatatattaaggatttgttggtacaagataacgggtccatcaatttaagtgaaaatcgatgacaatatagatctaatctaacgatataaaataacgggtccattaatttaaatgaaaatcgacggtgagat

SEQ ID NO: 104272 - DNA, 2020 bp, Oryza sativa
agctcagtaaacaaacttccaggacagcctaagctgaacttgagcacattgaatgaaaatatgttagtccatgaagaagctaattaattaaatggaaggggacgtaaatttcgagtacgaacattgcaggtatcaatttcggttttgattttttttttttgcagaaaggaccagtaccaaaaataccatttgtaatttatagtctaacaattctttacccatcaaaataattctccagaatttctgttgaatttggtaaatgttcaccatcacactcctagaaaaagcattttcccatgcaggggaaatgcgtcatcctaggcagatggtggctccgcctgcacaccaacgccgatcttcgcagtcgggtaggaggtccgcctgggaagatcattttccctagcggactggagctagacacgctgcctgggaaaatatatcttagtccgcctgaaaaaatgagatgacgccgcctgcgaaaataggtaaaaaatttgaaaaaatgttacaataataatttgtgataaataatgttccaattaattaattaattgatgcttaaataatattagtaactaacaaacatttgatactgacaaatatacatatattacataagtgaatagtgtcatcaaaatgttaaaatattttttacattgtcacttcgagtacactatctaattatattatggcatcgcgttgttcggttgttccactcctgaagattcttgtaagcttcgcttgtagccagaatgctctctgcgtcgaagaatcgtcctttgacatgatagcactcatggtggatgaagtggtagaggtcacactgcacatttataatgcatgtatcgtcaaagcttgttcgaagttctattctaggcaactgcatgcatgaaagaagcacaatatattagtatcatctagatgtgcagttctccgatgcacttatacattgagtcaagagatttacatcctctgcattaaccatgtatcttccattaaccctgaggaatttgcatgcataatacccgcagaggaccgtgcctctagattgcttgtgacacttcatgacatatcatagaagaaaatagttaagttttgtaattagtaaaacaattgaaatacattaagtgagtggagtattaccggccaatatgtatatactaacagcttctcccttgtttgaatctactctccacccttcttcttgtagtagttgtatgcactgtatggattttttaccgtttcatattaagtaggagatttaattttaatacattattagtagacatgcaagagtattagaatcacttactattataagattgttagaaattgtttgtacgtcatgtgatgataatcaagggggtccaagattgtcacggtgccgtagttcgggtagataatgaaacagatgtaataatcgcttcatagtaatgacgttgtagttagtcacggatgaaataacacagatatgtacaaaaaaatctactggacttacttaaagttgtacgcggtcaggatgactcttattgtgaaagtgtaagtgttgacagtccttaaatcataatttatgaccgtcaatgcctgcatataatgagataaaatatgatatccaacttagtggtagggattattactaataatttccactagtgttggtgaaatatgtgtatgcaggtattttacaaagaaaacatatccgtcatgcgacaaaatacacctccgaacaatcaggacacgtttacacagattggaggcccaataagtcaataaaaaccacttagaattggaccaaaacatagtacataatgttaggggcccaataagcaacctcccagctgaaggagaggccaggaggagtgtttttgggttcgaccgaacccttcctagcgcatcatgccatctgctttcacgtggacagccctgattactccctaatgatggttgaagggtatttttgtcatttcccatggctataactgccatctggagcctataaaaggaggagaggatctcgttc

SEQ ID NO: 104273 - DNA, 1361 bp, Oryza sativa
ttcattctgataacttttattcataaattatactcctacttgaactcttataattacttttctatttttttaaaatttattctatttattattttgaactttaattaatctcatcatgtgttctagattgtattttatttcaatagtctttattttttttacaaatgttagttatttataaattgtattctagttgagctcttatttttctttttctatattctgaatttattttactttttattttgaaatttaattaatctcgtattgtgttctatataaactattcttttaatatatttcttatttttattttaaattttaattgtttcaaaattgtattcctacttgaactcttggattttatttgatttttaatttttaatttttaattttaattaatattatctccgtcccaaaatacctggcgctttgagtttttatttataatatttgatcattcgtcttattcaaaaaattatggaattattgtttattttgtttgtggcttgctttattatcaaaactactttaagtataacttatcattttatatatttgcactaatttttcaaataagacgaatagtcaaacattccaagcaaaatgtcaaagcgaccactaatttgggatggaggtagtatcgtattggtttcttataagaaatcttctttcaatatcacttatttttaatttcgaattttaattattttcaaattgtattcctacgtgaactcttattattttttttctaatttcagattttattttatttttattccgaattttaattaatcgcgtattggattcttatattaactcttatttcaatatttcttatttttaattctgaatttaagttatttttaaattttattcatacttggacttttttttctaatttcggattttatttttatttttatccaaattttgattactcttgtgttagattcttatatggactcttctttcaatattgcttaattttaattccgaatttcagctgtttttaaattgtatttctacttagactcttttttctttttctccgattaatgtgagaatttctagcccccacagcgaacgtggtgcctattttcaaagctgtttaataatataatactccctccgtttcgaaatgtttgacgccgttgactttttagcacatgtttgaccattcgtcttattcaaaaaatttaaataattattaattctttttctatcatttgattcattgttaaatatatttttatgtagccatataattttacatatttcacaaaagtttttgaataagacgaacgattaaacatgtgctaaaaagtcaatggtgtcaaacatttcgaaacggagggagt

SEQ ID NO: 104274 - DNA, 637 bp, Oryza sativa
  unsure (1)..(637): unsure at all n locations
ttcagtacaggtcgacaccctaccgatatcgatgctctatggatggaatgcttgcgtgcttggcgcctcccaagccgtgccgatactgaccatatgttccccatgcccccaactgttgcatgcaccacgccccactgctatcttccccttggccgcttgacctcaagttgctaactggcatcacctacccacagatctaccatctcaccctcttttacatccgctaccaccctcctacacgctagcccactagcgcgagcacaacaaaaggcggcaatgtgacatgggccatgtgcatggcagctcaaggaagctgcaggggaacggctgcacggcaagtgggagaaagcannnnnnnnnnnnnnnnnnnngactcgtgtccagccgtccattgaaatggtgacatttgctgactttttttcctcttttggttcctgtgttgctgccaggggattcaaacaaggaattgccttggataatagcattcagttatgtatgcatacaaggtgcttgagaaaatactccaagagtcaagactaacagattttagatcattcagtatcttcttaatttgttgggttgaagttgtcgggtctttctttaccaaatggggaggtggtctgaatggaaagaggcc

SEQ ID NO: 104275 - DNA, 513 bp, Oryza sativa
tggaaaataagaccatgctaactaagaagcaacacagccaggtcccccaatatatatgctgacttgcaaaacagagaagtagaagttaatgaatcttgtttattactccatccgtccctaaatatttgacgtcgttgactttttaaaacatgtttcaccgtttgtcttattcaaaaaaatttgtgaaatatataaaactatatgtatacataaaaatatatttaacaatgaatcaaatgatagggaaagaattaataattacttaaattttttgaataagacgaacggtcaaacatgcttaaagaagtcaacggtgtcaaatatttagggacggagggagtattaccattagtattatgacattgcagcttattgctggcttcctacttccttgagcagcagctagctccgctaatcggagcctttgctagtaacaaaatccaagaatcttacttagagcactcaatggtggaggagttcttgtccaagctgtaacattccgatttgtgcttg

SEQ ID NO: 104276 - DNA, 684 bp, Oryza sativa
atacgatggatcacattgagataggccggcttaactggcgttgatagaattttgttgtagcattatttgggagccaaattctgatgagcttatttggattgtcaacatggcccaaagttttaatgggccaacgtggaagaggtcctaatttagccctgacataacaggtagagaaaatttgctactccctctattttcattttaattaacgttttggacaataacacggtctacaagatatatctttgaccttatttttctattataatatatacaataaataaatgcatgtttacttttattatagtgctttaaaagataaatttatatatgttgttctagtttctttaaaataaatatttttaaagttattgatggtcaaagttataaaagtttgaccttaatcatgttcaaaacgtcaattaatatagaaccggagggagtatataattaggaactactaggcttgaaattaaagggtgaatttttatatttttataagagcaggtttatggaaactgcacactggatatcatgatgtaacatgagaaaagaagaaaaccttggttggaattggcacaccttatcgttgcttttgtccttatccatgctttgcaagctcagttcttccatatctcaattcaatcaaagtgtcaccatcaaaacacgagtggcacattttac

SEQ ID NO: 104277 - DNA, 524 bp, Oryza sativa
atgttcgcactcctcccccccttgatcatattcagcacagtgaggtcacaataaacatgcattagactgaaaaatgttccttttttctacaaaatcgtatttgatggcagatatagagataggaaatgaattattttgaacaagttacctggctttttgacatggaaaatatgtcttacgaaggacaaatggattatattttctgtttttcccattgcaacgcacgaacatttttgctagtaattaaaaaataaagaatattgaaagagtagtctagagtccatatagaaatacaatttacaaataactaaaatcctgtattagaaaacaattaataactatcacatgtatacaacacggaaatacaacacaatatgaacattacacgtttatagtttggtcaagttagtacaaaatttaaattatattgttattttaaggtgttttaataacaaaataaaaaaatatatttgctattatatgagagaaaacataaagatgctagccgcgtaatttgcacaggc

SEQ ID NO: 104278 - DNA, 701 bp, Oryza sativa
tacacatacatcaccaaaccacaatatacatatgtagggtacgtttgatatatgctagctcctctccaatattcttgttcgagctggagatgtaactaacacttttgagatctacatctctagtataatatagagtggacttgccactccactctagaaaacacattataaagatagaacggcattctatcacgctccttacctccactctactcttggaggggctgtatcattcaaacgactctatatcatccagacatgtttaaaatgtttggatgcctaacggccgtagagcgccaatatgtacataaccactctaaatgtatgttggctaaattccctccataggaagcctttgctctcagcccattgcaactcaaaagcccaacaaacttgagccattgattcatgtcttgatcaatggtgaaaattgcctcatccttttatggtgcaaagaaaaaaactctagtctccattgagagagagagtgggagggagagagagagagagtagcagccattggagaggagaagcgaccaacaaatcacaagagagggagagaagagttgcaatttgttcagcttggtggcttttacccgatctttatcaagtcggcgattggaggctcaaagtgcctcaaacgtagttggattggcaccaaacttggtgagtttgttcgtaacctatagcgggcggcagga

SEQ ID NO: 104279 - DNA, 1416 bp, Oryza sativa
ccttgtgtactaggtaccagcccaaaaaaacagagaaaaaacctcgatagttataactagtaagcactcaattgttcatcatgttgacaaaaattctataggcccaatagttatgctccttaatttaatgctctcattgacaatcctatccctcaactatctaatccaaatgcaacttcagtgtaattaacgaccatattaactttagtccctactctccacttaggaaaaaaatgatatattagcttctgaaacggtctccaacgttaaactttgacgataacttttctttcacaacatatcaataacaactatgaaaataacatatgaaactgctttctagaacagatccaacaaagtctattgtgtggtactaaatacagatatatgtgttgttagcttattagtaatagcaactcaaaaagtttcaaaacaatgttaacttcttaaaacatatgctcgctttatattttttcaaaggagaaggaacactgagcatgaattgtgtcgaggcatatcagcagcaagcgaagccgtgagaagaggcgctattggaacaggatagcatggagaagttggagatggtgcagtgctgtccggcaggtggcagatcaccaacgttccgctgccccgtctagtggtgacggaagctgaggagtaccagcaccaatagtgtctagaaaggtgacggttcttataataaaatggtacctatggatatcaaataggtaccagttattataataaattagtacatatgaatgcagcataacaagtgttagtttttattgtgagctggcacatatggacgctacatatgtgctggtaggtatctgttgacaataaagacgggaacctatgatgataccatccatatgtttatattaagttttcatataaagtcagatgaggataaattttatattaagtttgtagagcttgacgagattgacaactttacagttaatgaccttttgatttgacgctgtttggatgtcaaaaggtattataagttctcaggtctatttaagtaaatttttgaaatttctaaacgatcttggattgagatctacaattttgtaggtgacaaaatttttgtttgagctcatctatggtgttaaatatggattgtaagtttcagatgagagtagtctaaaaagaatagtatttgcttccaagacaacaaatgtttctaggtgttaggatacaaatgttcaaacccttctaaccccgtactcatgaaaatggtgtgaaaatcttgtaagttgtgggaaccgaattgtgatcatgtgtagatgcttagtaaaatacaaaatattttttggtcttttttcgtgcctgcaaaaataaaaaataaaaaaagggtgcacctatataggtgccattcttagaaccggcacaaataaggtattatta

SEQ ID NO: 104280 - DNA, 4895 bp, Oryza sativa
caaatgttacatttaaagaaactaaatttgatgttttagatgttgctaaaattttatataaacttggttgaatttaataaagtttaactaggaaaaaagtcaaagcgactaataatatagaacagaggtagtatgtacttacacacatacttgaaaatatactcaatagccatatctagtatcctgcatgattctgattcaaaatggacaatctagttataaaggtgtgttttctaaagcattttctcccgaaacatatgttttttctcagaaaatgcaaaacataagggtttaacgttagaaattagaatgttagatagatacctcaaaacctgaacttttgtgaacttcgttcttaaaagaaaagagttcgcattctcatacgccatctattttatttcaaccatcatttgcctctaacaggaactgtatgattttctactgaccaccataatatatataatttatgttcactacgaaattctttagagcttcatggaaaatccataccacacagagtttgaaagagacatccattaaaagaaatgacatggaaggacagtgcggttcatttggtcttatccttttaacttttaactgaaactgaatatggaccagcttcaaccatcgcagttccaccaaatttaggagaggaaacgaaaatagacgatgaattttcctcgcaatatctccagcaaattggagctacaaaaaagatgagccacaggaggcaagagctcaccaccccacctcgtcactgtcgaaatccatataatgagtagcatttgttactatctcaagtattagattagaaggacatctaccttctgttcattttaaacactgcaacttgacaaaaaaaattaattcccatatgtttgcaaattgctaattaattaacatctacttgaatatttgtgatttgtcaatacttatcagctcacttctaaaaggattaaacgccgtactggcagtgtactcttccatccagataagattattctagtccatggttatcatcctacggggctctgactatatctagccgaccattatctgaaaatataagttgcgtatcatgcttatcactgatcagcatgacagcatgtagtatttgactttgcacatgctgccttgtcacttcccggccggaaggactagattgccttttggaaaaggcaaatattagctaaagatcaagttgacctttgtaattttgtcttttggtttcatgtagggtcttcttccaagaagaaatcagatatgtgccccaggtctcttccttcctccatgacatatatcgagattaacctttcttcagtgataatttttacggtccttgaaaaagtatctcgaggtacctaaattttacctaaaaaatttgatacctcaagatacatagtacctagagatactaaattttacaatagaaaatgtggatatcccgatactttctcaatgatggtaaaattaacctttttaagtagctttcccctgtttttctctactattcatgtcaaacataacatggctttattcagaggttgtgtagattattcggctgcgatagttcccaaggtaacactcccaacatgagacacaacacaatacatgacaatgacatttgagtaaaactaaatatagcaaccagaaaactcatgggatacattgactacggaaccatatcatttgggtgcaagtgctctgccttgcaacactccaaccccctacagggaggttcaggtgcttaaacaaacataccgatcatgctatgtaaccgacgaaatgtgttgctaagcaatatgagggtgcaaaggttctatttcttgatgtctcacattcctatatgttctccaatttgtaaatccaaccattccctccatttatcattagctacataatgcatatctaccaatcaaatgcataatactgaactctgaaggtgatgacatatctctagttgctgatggtcaagcctggcactcactgaactatgtatatatattgtatatatacacaagcatagccaacctggtgtgcttggtttggttggtgataagtttaattccattgaagcatttgaatgcatatcatgtacgtaacatttgaatccataccacaaagagtttgacagggacatccaatttataaaagaaaaaaaaatgtcagtgaggaacagtgacttctcattttggtcatatatatccttcagctttgtactgaaactgaatctggaccaggcaaacgtatgaccatcgcagttccaccaatttaggagaggagaaaagacggcgaaatttcatttcaatacatatctccagcaaattggagctataaaaacgatagccaggagctcaccaccctacttgctcttcctaaccttccaaaactctgaagagtttctccattatcgttggcttgttacgctccaaagctttcaacattccagactccagccaaaatttccatattattccaggtaaatgttaatccctgtgtttaccatacccgtgctagcttaatcttgtctaatttcggggtagaattgaccgttctctgacctaggggataaggagaaaaaaaaaacaagctttctagtgttcttcaggcttgttgctgtgagttcttgtttgatcgtttcgctcagcacaccattttgtttgattttgaagcctttgaatggatcgagttttttggtttccaaagatgcatttctttttctcttctctgcagatggttcttagccctgcaaaataattctcgtttcgtcaatcgtcgtggcgattagttgttagttttcgctgctatttggatgtggaagagggaatggttttttaccatatatgagatgcagggcataacgaactggaacttaaattttgatcattttgtttagttcaaaaaacatatgtggttttgttggttatgttttcgattttatcagcgagagaagatgccctgacgatctgattctcaaggtcttaggctacgaggcttcctttttaatttgtgattgattgtataggctttgaagtatcaaaaattatttaacatctatgtaatgtaaccaccaaactgtggtgttttctctactcctctttaagtgaatggcttgacaaatgttatccttagaagaaacgtaatatgttcattagattagcatgaactagcattctaggaaaaccattctagtagtatgttttatggtgtaaattgttaattactcctagtccctaaaggctttgacatgaatacaatcagtaaagcatcatggtgagcaaagaaatttctagcgtactccctccgtcccgtaaaaaacgaatctagaactagatatgacatattctaatactacgaatctggaacatatgtatacccagattcgtaagactagatatgtcacatccggtattaagttgattttttatgtaacagatggagtatgtgctaacgatatcctaacaatcaaaaatggtaaaaaaaaatatatttattaatttaactatccactgtcaacttcaatgtgacgctgaaaaaaattaaaagtacgaaattttgaaacaataatattattatattagttttatgaaaatgatatcggtatatcatgtctagaacttccagctcatgagctttaactgcctattgttgggtgatttctaataaaaaatcacccagattttttcaactcttagatttacatttaacggactataaaagaaaaaaacaaatacatatttacttacacaacatttttatcaaaattacaatgcgcttacatgtcacatcagctgaatttacaaatgtaattttagtttatattttattttagtttcaaatatcttaatttttcaaccgttaaagaaaataatttttatttagaaaagaaagagagagagagcgataaggaagcggagaaagcaagagcgagaaaacgtcatccgtgcttatttctccactaatctcggcgcacgattctacgcccaacaaaacgttaaatatcatagaagaaatcacgatgtttagcaaaatcgtttaaatatcatagaagaagtggcccgatagatgtttcctaaccgaacggccccccccccccacccaaaaaaaaagccctgctgcgacgtgcattgggcctgcacgaggcccgttttggcacgaagcagatgggccgtgccgtcccagcctggcacggcccaagtccaaaaggcctacggagctcggacttctctcgtacgcctcgtgaaatcgccggcgccactgccgcaaaccctacttccgatccgcccccgccgccgccgcaaaccatacttccgccgcctcgcgccgtcgccatgccgcccaccacaccggccaagcccgtccccggccggcgtccgcctcgcgacgtcggaccccctcccccaaggctgcctttcgagggcagcctgggccatacacccctaacccaccctcaccaccacacacacacggtaagtctgttaggttttcgatctagagtttgctgccaattacaaagaaactacactggatagatgttgtctactttgtctgtgccaactgcggcatactctgtgtgtcttgatgataaattgtattgtatatgtagtagtagcttattctgagtaatgtgtgttagtattattgatttgcctgcaagctgctgtggtgtggtggtacccatcccatgtaagactgttcttctgtttagagctgtgccggcactgttcgaagacttgcgcgatgtcggtagctcacgtaaactttggtgcgttgtgctttcgcgcttgcttacgtttgttgttgcttcttgagtcaacgaagctacggtttcgcttcgtatagcaagtttagtgtacttgtaaattgtaatccctaccattcatgcactgatcttg

SEQ ID NO: 104281 - DNA, 1022 bp, Oryza sativa
ctgccccccgagtacatgaaccgcttgctgaacggattaaattaaaaaaatcatactgaatttcaaatttctaatataatttgtctgaaatccatctgttcttagcggtttatgaaacggaaatctgagtaaaccacgcgctaagaggtggtttccaatttgataacgactttgtgaaccaggatgtagactcacgttggacattgttgatatactctctttccaaaacataaatgaagtactctcttcatttaaaaatcttaaacctattttattttctatatatttttaaataagataggcatatatgtagtctcaatatatccaacacttacatgaagatattatccttttatttttgtagtgctaaattaaactattgacctaaccaacatctgcataatacttattagttgcatgcatgaatatagttcttggttttgagctaatttttcttggtcttggtgaaagtagtaatatgccttcgaattttggatagagggagtgttattttaatcagtcaaagtatgttgataaaaaaaataatatgccttagaatcatatttgtatgcatagatgtaataatacttcatgtcaaacgaagagataggggttatatgatgattaatatggaattgagggaatactatttttctagtataattatatactttgaggcaccttttagctaattttgagtagcattttgaagtgcccttcaacttttttaataaatactacgaacattgttctccatcttgaaagcacacagacatcaagctcatgttcatccatcttgaaagatggaattaatgcctatccgcccagttcataaatttctatttaacttggtaaatgtgaacattaatttaaacacacatggattatttatattattattgcaccgtaagttacacaaacaaattccaactaaatcgtattagccaatactatcttctagatgaagaatatatcaagattaggtccgggcaagaagtttacatattaattttactctaaat

SEQ ID NO: 104282 - DNA, 626 bp, Oryza sativa
cctaacaatagtatcatttttcagtatattgacttttaaattgctaagaacttagatataaaagttgtttcttttttttttttggaggcttatcagtgtttagcccaaaacactagctccttccaaaggttcgaaagtagcgcatttgaacgactactacaactaccaaatatagttcatatcatgggaataaggatccgttcagcttaattttgtatagttttccgtacgatttggtatggcccggtcaaagtcaactcaatcaaagtggggtccatatatatgcatacatgaacttagcaccatgaggagagctagcctgcctaacctggcccagagaggccataattgatcgcttgcaagtacttctgcactgttcgtgtgtttaatttaacatccacctactttgtatcatcagtctgtctgtattcatggcgccgttttggaagattccgtggtcatgaaaagtcctgctgcaaagaaatggattcttgagatcttggggcaatctaaaagatttttccaaatctaaatttggtataaggttttaggagattaataagatgacgggcacttaaaagaatactacaaaaggctcataagcactaaatacaaacattgtggaa

SEQ ID NO: 104283 - DNA, 854 bp, Oryza sativa
cttgacctattgcaatgaacttacatggtccactctcaggccgttcattggttctactccttaaaaggcaagtcctaatgcaaccttcctatcccatagttgcaaggttgggcgcgcaatcaactttttttttaaaaaaaaaggaggaactcgcgttgagcttagtctagattcatataggtcgtttatgcttgcagattgttgacagccaacatgaatatgatcgaaccaagcagtgttgaagttgaggggatttgaagcttcaaacttgatcaattgggaaagaatctatagttaagatatgaaattggatcgatgatatagtcgtccaaaaattgagcatacttgttcactgggtggatcaactatcttaattttaaatgctttatatgctttatgcatctttattggccctatttgaattcaggccattttctcactttacttacataaaattcatctgagtggtaatgtgtattgaaaaacctagatggagtataaactcgataacacacattcttctaatttcatatgtatcaattcaagtgcttatagtttattttcagatatgtgtatgatcctaatgtagttcatatggtatccgcattatgagaagagttctaatttgaaaacatgctttttctattttttagaagccactataaacaagtacagtgtgctacacataatttcatgatggatgtgcacttgtttgtctgtctttgcttttctatctatgcctgcttctcttctcacagctgtagatgaatgttgaccgtggagaagattgtctcatgcattttttaaaaaattttcatgtcaatttactataccttgaagtctccctcataaca

SEQ ID NO: 104284 - DNA, 913 bp, Oryza sativa
acacccttttactcttttcctcaagctcgaactcattgtgcaaccatgatttcttcttggacacactcctcttacttccactactacactgttctgccactttcatagagccagcagattcacaggaaaaagtgtgtgtatgtgtgttgggagggagggggtgtgacccaccgggccaccacactaacctctattttgaggcaagctatttgttttaaattagatcattataactagcgtataaagtcgtgcattcatgcgactttaatctccctctatactaaatgtgtgtataatttggggttttaaacatatattgacggttcatttgtattattttcaaatgattcatatgtaaataaaatgttacggttagtgcaacggatatggttaggattcgtattcatctttttcgtcacagtttccctctacttattcactcaacaataaacttctaatttttcatttgcgctttagctgccgcttttccaccaaatcactaatggctatgtccatttttgtaggatccctttatcttccaattatactagcctatgatgtcgcgcgttcgcgcgactttaacagctatgttatatgtgtatattagcatataatttaaattggcatcagtaaagaacatttcattatgttaagtatcggcttaagaaaagtgtagttgatctttcattttaaaatttgaatataggaaaagtattaggcttttctgtccgtctctcttttctttgctcactaggatgacctaaagttaattgtttttacaaatcaaatttgaaatggtcaaatttcaaaattagcttcatttcttatttagccatgtatctaacatccagtataagtcacagtcaacttaactttgtatcaaatgagtaaatatttgctacctatgatcact

SEQ ID NO: 104285 - DNA, 530 bp, Oryza sativa
taatgcccgattgagatgacttaatctctatcgggcattaactaaagcccatcacagatgagtcatcggtgatgggctctatactaatgcctgattgagattactaattgagatgacttaatctctatcaggcattaaataatgcccgtcagcgatgattattttttcattttccatatgaaatgcttatattcaatttatgtggtttttttattttcaatttatgagaactttgttgttgacaatttttccatttgaaatcatttactacccgaaaaattattttgactcataaaataaattattatattgcagttaattattttgctacagatcaacttacaaatataaaaatttcatatgaaaactggaaaaatactcatcggtgacgggcattagttaaagcccgatagagattatgtcatctcaatcgagcattagtacaatgcccgtcacgaatgagtcatctgtgaccggcgattccatcattcgtgataggcaccaacttggggcccgattgagatatggaa

SEQ ID NO: 104286 - DNA, 1063 bp, Oryza sativa
atgtcgagcggcgacaccggctttcccaagtacgagtgacggtggcaactcgaccttgcagaggagatgggcaacaatgaagacctgttgatgtgccactgctggcgccgatagcacaaaactgactatgcgtgcagacacccgattgcacgccactcgtgaaaagatgcttccattgtcatcgacgtgaagacgcatttgcaacatgcgtctaccacgcgaagacactcggcaccatcgcatggggagacacctagccatcttgatcttggattcactgaaagtctgggctgctacctttccttgcacacacaaggcggtaatgtgcttgggcggcggcaaggccatgagattgttaggtttgtatgaaagcattattttgacttctaaattaaacttatatcttatacaaatagagtggtatgacttttataattttacttttagcggaccaaaggtaaaggccaataaatagaaagtgatgagaaacctcttaaagctcctttggaactaaggaattttagaggaatttgaaaggattgaactcgtataaaaagaattccagtagggtcctttggaatgaagaaatgactctcctaaatttatttgaaatatcttaggatggcctcaaataataggaattttgaagaatttttaacatgagattgaaatctattggaaaaaaattcagacgtgtatatctcttctaattccttttttcctttgtttttcttgtgttctatctaaatggttatttctataatttttcaatgtttcctatctttaggttttgagattttaggaacaataaatttctctgtgtttcaaaaatcatgcattccaaagcagctcctaagtcttaaccaactccgttttgccatgggtttcgatcataccattggctggaaggttctagatcgaccatggggcggatataatcaagggccgacctcaactaactcattgtcactttacttcactccaccatcatgtcgtgtcgtgtaactgctagttagcccaatctcaattcatctggaatagtatattcttgccaagcgttctt

SEQ ID NO: 104287 - DNA, 706 bp, Oryza sativa
gatatttgttcacaaaatgcatttggcactatacacatataaatttatcatggatctgaaaaaataaatattttcatgtagttttcattgattatggttatagaattctactattaatcatctgttcatgaatattataggtttatgtttaagtaaaattaggtatcataatcatagctataatataaactgttttgagatgttacttttttttaccatagttttgcaatatttaaatgtgggccggatcaactcgttgatggtcatagcgttgcatgttctttttcttttgatgttttggctatctcccacgtatgagggaatcaagatttaggcattagggaggctctagaaaactctagaagatcagaccaaccagttttgctttttttttttccaccgatctgatcatacggtatatatcctccctgctttttgataatcagatggcacacattttttgctgacgtgaatcaatagggtagagttttgagattgatcattcactgatagagatttgaacgcaccacacgtctattttttttctctttttctacgatcaattgcggatagcttactgggcattggctagctgttcttttttgtttaccttttttgggtcatgtttgttagatggttctggaggggatataagctgtgtttgataccaggagttctcaactccccctctagttttccacgtgca

SEQ ID NO: 104288 - DNA, 696 bp, Oryza sativa
cttagttttatattaataaaataatatataagtatgcttgttatggtggatcttgtctttggaaagttcactttccagtttcaataaagagttatattggaaactagcactggaaattcaactctaagatcaatagtcctcttagttatgctatgcttgagatctttttactgtcaagaaggtcgtactttatttttgaattgcagcttgagtaagttatttcatggatcaactcagttgatgtgtcattttattttatatacatattctgttgttattctgaccactgagatttaatattgagtacatgttccacaaaccttcatatctgatctctccatcttctggagtttttcttttttatattgcttatgggctcccaatttcttgcagccatgtttgattaagcaaagtatccttttagatttgctattagtagaatgcatatacttacaatgaagcaaatcttttggtgcagaataaagataagaagacacctgcattatttcttggccctgcagataaccctcatgtttcaaagtacaaaatggtactgaagcaactccctatgtctcttcagaagcaaccgtggtcagatgttgagaaagagaaacttgctaaaggaataaagcagcaataccaagaggcattgattttgaactcgatcaataaaggaaggtgatactgagttgttta

SEQ ID NO: 104289 - DNA, 796 bp, Oryza sativa
tccaaaataagatttaaagcggacttatctcctttttccttctttaatcagtcccacttactcttcattttctctttattttttacctttcatctccccttcttacaatgttgatccagtggggtagagaggactcgagttcacctaatacccacgctggatccacccctgcatgcatgcatctgtgtacctagcctgtacatgtcaaacctcacatccaatcaagcttaattatcaaagttctctagttctaattgcttctctcatttcgatacaaagacaagacaaagattcttctgcagtatcagtgcagcggagtgtacaacacattgattggtaccgccttatcaccatcgattggaaaaaaaacaacactgttagggtttttctacttaacaacaaccacaattcgaccaagaacaggcactaatgggtactcatcaatgttgcgtttgtaggtaaaccggcaccgataattagagcccaaaccgatcgaaatggaacagattcttaagtctattggctcgtaataaatggattattccagccacatttgcctcccgtcaaactctccgtggtcctcctgatctttcccttcttccttgttatctcttctatctcctggtcaccatttagagaggcaacggaggccgctcgggagaacgaagccacgaaggtggcacaatggggtgggtttcaaggggccccctgggggcccaaaaaaatgtgtcactgtgacaacaacggggatgttggcctccacctgtctccccctcactggtggcaaggccaccat

SEQ ID NO: 104290 - DNA, 1000 bp, Oryza sativa
atatacataaaaaaattagtactcccaaggatgttagtgaaaaagctgtacagcttatgtggctccgtcactgggtgccggtttctaaccggcattgatgcccccttatcagtgctggaatctagtgtataatttgtactatatatgtggaatctagtgttccaaagccggaatctatcatcaaaatacttgaagcatgtctagtgtatttatattatctatttgtacaaacacatttagaaaaaaaaaactgaatagttaaatgaattaaaagaatcaattacgttacatgttaaaaggcagaggtagaaagtacgttaattaaccactacacacttgcaaacaaaagaagataccacatattattacacgcatgcatacctagagctaattagggttagctttactcattaatcgatctcttcagttaacgcatgcagtatatatgcagctaactatacctatatacctctatcaatcgtacgttcgtatagcgcagtagtatagtagacagcctgttcatcgatcgatcgatatattgcacgcacgtgtcagaataggttgcacacgtgatgaattaggcgtgacagctacccacttgtgtagctaggacttgtttggcacgtactgtactgtactataaacataggagtcctctgtagatccagagctaagctaggtgttatatatcctctgtacacgatatgatcgatcgtatatatgcatgcgtgctacttaatttggcatcttgatgtgatttgtaccatcttatatatcaactccctccaattttaaatatatataatgccgttaaacaatttatcttattcaattttctctgcaaatatgtaaaaaatataaaccatgctttaaagtaattaatgatggaaaaacaccagactaaaacccgagactaaaaaaactgggtctgagaccaaataaaccgaactttaggtcattggactcttgttggtctgagccaacaaaagatcaccaatga

SEQ ID NO: 104291 - DNA, 1072 bp, Oryza sativa
agaaatcttgcacagtatcttgcgaatgcctgcttgctgtgacttgagtgccgaacaggcccgatggtatgcttccaccactctgggctttttcatcacaaatctatccagcccataaaattaggcccacgaaattgggcctaaactacagcccatccaaaaacagggactcaaaattatgatttctttaaacaaaatttattttcagaccaggaacacattctctaatcaatcaatcaatcaattaattagtacttagtacaaacaaaattatgacgattgcttctttgctctctcactgcatgcaggccccacctctgtgggacaatggacacgtgtcaccagcaccttaaatgtacagtcgacgacgtttcttttgttttttaaaaaagaaagaagaaaacatgcatgtgtacacaaaacgacaacgctaagttaggcaaattaaggccagtgaagtatataccagtacaaagggtaggtccgtgcagagtgtgtcatcttcagtagctcagtttgaagacgagcttaattaaattgcataattgagatgtgagacctaacaactttgacttatttggccaattttgcatcggccaaattaacaacacaagtagtagcttgatccatacaaatcatgaaaactatctagttatattaaacaagcgagaacatgttcctattatcttgcttagttatatagtgtcttgaacggaagattcatacatattcatttgaacatttaggttgttttgacttatttgacataggctgaacattttaaaagaaaaaaacatgttcattttagctacttcgttggataattgccacaaattatttgctccataatttgaaaatatattttctaaaaagaaattattttcatggaattgtttataccatgttctaaactatttgttaagattattttttattttttaatgaagtagataattcgtagcaataattctaggcagaactcccttctttcttttttcttccttttcattttttaaagaaaaaaatcgaaccgttttgctgccaccgtggaacactcacactgtcacacaaa

SEQ ID NO: 104292 - DNA, 937 bp, Oryza sativa
attcctgcagcccttcaagtcaaaaataaaataatctaaatatcatacaacagaataagcggtgaatcacatcgcattaccatgacgccaccgttgttggccagaggctgaggatactgccacctctgctgcttatcatggaagtactgtagcccgtgctggtgttaaggttgccaaggacatcgagaaggcaaaggaaggcaggtcggtgaggttagaggaggcctgatccggtggtccctgacctataagcgcccagatttgatcgcctagctagcgatgggaacggaagggagaggaggaggccaccatctcccaccagggcgatcgcccctgatgtctaggcggttgggtgggaggggaagggagagagggaggccaccatcatcagccaggttagtcgccccaggcgtctaggcgggcagatatggtggccttgccaccagtgagggggagacaggtggaggccaacatccccgttgttgtcacagtgacaacatttgccaggctgaccaccattgtgccaccttcgtggcttcgttctcccgagcggcctccgttgcctctctaaatggtgaccaggagatagaagagataacaaggaagaagggaaagatcaggaggaccacggagagtttgacgggaggcaaatgtggctggaataatccatttattacgagccaatagacttaagaatctgttccatttcgatcggtttgggctctaattatcggtgccggtttacctacaaacgcaacattgatgagtacccattagtgcctgttcttggtcgaattgtggttgttgttaagtagaaaaaccctaacagtgttgttttttttccaatcgatggtgataaggcggtaccaatcaatgtgttgtacactccgctgcactgatactgcagaagaatctttggcttgtctttgtatcgaaa

SEQ ID NO: 104293 - DNA, 3164 bp, Oryza sativa
aggaatgatttggtttttgacaaatcttcatctatcacatatatgcaggtaatcttcagggcaacatattagctccggtgttgggcccagctacaaaggtatgatgaagatggcgactttatgaaggttgcatatcgtaagcttgagacgacaattatgcaacttttgccaattatggttggagattcaccaatagacttcaataatgtgttcttcttatcgtagatgggttatttcttattttaggtgcgtgttctcaatgtttggttgaactacactctttttttaagtgcaactttataataattggctgtagcactttttgactaaaggccgggatattctattccattatcttaaaaaaaactgcaggcccccaagttcgttctcaagaattatagaattatttaaattattttatcatgtcatgattcttgttaaaaattaactgttacatccaatggaatatccatgtactttttgtgtgctttgttttcctcttcattcatcaactaataatgttcggccctttttttactgcaataatccatatgtacgtggtttgagaatcgataacacgtacgtatgtcctcaataattgtgcatgatgcaattatcaagtgttttgcatttcattgctctattaattgaaccggtgtttttttcaccaaaatattggggttgtgttttgctatatatgggcagagttcattctaactaggatagcccgcgcatttgcgcggtatgtgtattagtttgtttcgaaaatagttctaacaaaacaaattaaaattaaagtaacatattttctattttaaattgagtgttctttatatctctctttcatgaagaaatctcaacaaactttcattggttttttttaccatcctactagccctctctttaattacaaacttttattggttgagagcgtttgtatggagtttatttgatttttactatataatagatagttaacatagcatttctgtactgagatgcaagctagaaaacttggataaaaaagtgagcaggtgagataataggagataaaatgatgggtccaccatattaagtgaaaatcaatgatatgatgtttttctttttttttctcggatttttttagatttctctaatttattagaacgccacgtgatggtttagtagcgtttgtagaagtcacgtagcggctagtgcacttttatatataacctggttttttcggctttatcattttaatttccgatcgtaacgatcgtacgttacgttcatataaccataacatgtaatttttttgggtcatgtaatttttttttggtagtatacatacatacattcctctccatccatatgcattggacaggaaggatcttttttggtttttttttctgtttacgaatagtacatcgtaccttcctctccatccatatgcatcagatccatattagaaagaatgattttaatatatttaatctaatggcttgaaatatcgggtcatcaatttaagtgaaaattaagggctagatgtttttctttttatcagaatttggtggattttctttaatttattagagtgccatgtggcggcttgagagcatttttaggaagccacgtggctacttgagagcgtttgtataaagattaatggacttttagtatataataatagataatagattgagtgacaatgagattccttattatatcccataaaacttctaactatgtatctaaacataacttgaattttattttatagaacagagggagggagtagatgacttattggctctgtttagtcccaaaacaaaaattttcacgctgtcacatggaatgtttggacacacgcatggagtattaaatgtaggaaaaaaccaattacacatattgcgtgtaaattacaagacgaatcttttaatcctaattgcgtcatgatttgataatgtagtactacagtaaacattaactaatgatggattaattaggctggcggaatctgtaatttgttttgttattagactacgtttaatacttcaaatatctgtccgtatatttaatgtgacaaccaaacccaaaaattttcctgaactaattaaacaaggcctaagtgttgtgaataacgtactaccgatgttatagtacgtacgactggtgccgccaaccaacaattggagggagtgaggcccgtgtgaagattgcttgttggtcacttggagtcagggtttacaaaaccaatggtgatcacgtgtgataaccttatcagtttttaaaaccacgatgaaaccccactgtaaccatatggttaaaccactttaccgtaaggtttgacaacccaacccaaaacgattcggggagaagccatggatataggttattggcctgccaccaccagtgggtggacatcacctatgcgatgtgcgatgcgcgatgcgatcagaatcgtctttcaggagaggtggaggcgagcttgtcacctccgaccactgcagcaaccaccgccgccggaagctgccgtgcagagcacgctacctccatctatataagaagctgatctcctctctctctctctctctctctctgaccccttcgtccccaccactcctcatttcaaaccaaaccacgcccacgcggccgcctccatcgatcgagattcgagaggaaagctcgatcgacatgtccaatccaaacttcccccgcttccccgtccctggccatggtcgagagcctcagccgggaggcgccacctcttcctcctcgccgggatcccgcttcaatggcctcaactccggggcggcgccattcgttcctcggatggtggagggcgccgggctcgcaggaaggatgatgttcgggtcaggcgccgcggccggcaccggcgctactaccaggagcctcgccctcgccgcggccgttccccgcggcgccaccagtgtgctcgctggccctaccgccgccgccgacttcgcccccagcagccgcgacaccgtctacgtccccgtcaaccacgacgttcccttactccccatcggccaccacgtcaacttgggctccgcctccgccgccggcgacgccatgatcagctcctccggcgctcccgctggagctcaccagtacatgaccaacccatacgccggagacgccatgatcaactctccgccctcgct

SEQ ID NO: 104294 - DNA, 687 bp, Oryza sativa
attgagtttcaattctcaatctaatagtagagtgtgtagcacaaaaatatgataacttacttttatgttctgtttttttatcaatctcaatttaccagtgctaaagtcaggaagccccgaaaacgttctagaataccatgtgaggacaatgtactccctggtgacacatcaaattcttcaccttctatgaatctacctctttctgaatctattgatgctgaggctgctgtaaacacaaccacagcaaattcaaagaagaaaccatctaggtatgattcataacatttaaactttacatagtttagttgtaatgaatatgcatgttctgtttccttatcactagtttcttgtgtgcttgttttacagaagtagatcgaaaaagcaaactgatgaaaatcttgctgtctgtgatgtcaacaactcttctaattgttctagtggagccaggaagagaaagagatctattactgacaaaaatcaagttgtgcaaaagaaaatgaaggggtctatctctggtgataatgaggctgtcgtagagacagtgggcactatcagtgctgataatgaggtagccacgaaacggaagactggctctacatctgttggtgaagaaggcacaaccaagaagacaacgaggggctctctctctggtaaaggagaagtcaacaagagaatgaggggctctat

SEQ ID NO: 104295 - DNA, 690 bp, Oryza sativa
caagagagcaccatcaaggtaataacgtgttttggcatgtcttttccagatagagtttacgtgaaaactttagaattatattttcccttgagtttcaattataccagtatcattattttctctcgacaggaaatcagccgaagagaactcaaaagctgatagcatggctaatgcagcctttgggtcggaccttccaactgtggcttctgaagatagagatgctaataatggaaatgtgaaaaatgggagactcaagtcaatgccgaggtattttactcttccctagtccaatttatttttgtgtgggcatgtgaatgttgagttatcgattaaggatggctgttaagggtcaattgagctttgaattaaatttctcgagcttttcatttgcagacccaagcagataaacatgactgagggatctgcagacaaattttccacatccacgcggcttgctgattgcatgtcattcggccgaatcaatggatccagcagggttgcaagacacttatgtgtgaggtagcagaacagccaccttttcttttgtcatactactaaaacctaagtagttgacatttttttgatctgtttcagtgtcaagccgttaagcaacatgatccaatcaaatggaccttctgatgtgtcagctaaggatcccacttctgctgaaacagatcccacttctgttga

SEQ ID NO: 104296 - DNA, 2199 bp, Oryza sativa
ccaactaacaaatagagtattacttaaaaataaaaaaattgtgcatatactttcattagtattatacatatgtgtaaaatcttaaccttaaatttattatattttagtcgtaacaaaaaaaaaatctgacaaccttaaggctataaatccatcaatattttctttttcttttttactctataaaagataatttgaagaagagattttacacatagatgtaatactattgaaagtacgtatatatttttctagacttttttgtgatatttattatttgatatgcacggtgcgtagacacgagggtttgtgtgcatatggtaggtctaagatgctaagatgatattttcagcgcatcatccttgtaattcagccattcaggaaggaaggggcaacctgacgccattgatatgataatcagtgagtgcttgtttatttaccatttgaattggtggttttaagtgattcaaaggattttttttaaagagaagtgattaattaagggttgagtaaacggttgcacacttgcacgatcaaaatacaagctgaagggagatgattttcaattggttggttgcattacgaccaaagtaagaaagataatactagtaatgtataccggctttgacaaattatatactgagaggataattggaggagtattttgtattggtttttcctctctttttcccccttcccctgggtgttgcattggattcttacacctggattagattagcttcaatatataatgatttggataagcttacccgccagagtcaacaaattatcaatcgccgtatatttggattaccggttgttgcgatcatctcgttggacctgtaactacacacccatggagcccacatcgatctcaatcacctacccccgcaattgtctatgtgtaggtctaataaaataggcaaatgttcgcatacatttggcccagtcaatctacattttgcctaccacaaaaagttaacttaaaaaaaaactccaatatataaaagttattttacctatggagcttatatatacacacgcacctttgatatcaaaccattttatcaaaacattagagctcaaatcataactgaagtccgtattgaatctgatatatttagttttggtgcataaattaacttagcggaaaaagaataacgcgatgaagaaaaaggaaagagcaaattaaaaggtgttcagcgcaagttcgccgcatcgagtagatctttcgatttgtttgatccaactggagcagaacgctgcttgcccgaccggtccacctggcacatcaaacttagccacccgcgagcacgtacatcgcgcggacgacacgagctaaccttgaacaagtacccaactatctaaggttgtttttctgagagaatattgggagcccttccctcagtacacaaaacaaagcagcagattaacgtatcgtgaattaagtactccctccgtgttttttaatagatgacaccgttgactttttctcacatgtttgaccattcgtcttattcaaaaaaattatataattataatttattttgttatgggttgttttatcactcatagtattttaagtgtgatttatatcttatacatttgcataaaatttttgaataagacgaatgatcaaacatatgagaaaaagtcaacggcgtcatctattaaaaaacggaggtagtattaggtaaaaaaattaatattttttaaaaaataattttcctgtaggttttttaaagaaaagaagtaatgtttaatacttctcatattataagacttccttgcattgtctacattcatatatatgttaaatgaatctagacacacacatatatatatatatatataaaatgaatttagatatatatgtgtgtctatatattaattaatatatatatataaatatagataatgctataaagttttataatatgaaacggaggtggtagtactcaaaataaaataaaaggttgggacgatagatcgatccatcgagagcgcaacggcatgcagctggcagtggcaccaccaccgcccactgcatctgcaccggtccaccgcgccgcgcgcgcgctggaagtggcgccgccgatcggcctcactctcagctgcatcctgtcgccaccagcttgcgacgacgacgaaaatgattgcccgccgccgcgacagctctcgctcgctcgctcgatcgatcga

SEQ ID NO: 104297 - DNA, 518 bp, Oryza sativa
taagacacggacgcttatatatacacaaacacaactacccttctaagcactcatatacttccactgtaagaacatatgagtacctccaaaagttgatatatcttggaataatgaagttatcatagacgtctggttaccgatgagtaacgagtacgccatctatcactagaaaaatattagcataaatatgagcacatgcgttgtgttaagtcggagactcaaacttgagtgggtaatgtgtaggttccaaagaaagaactttcgatatatgattttctcataatactattttattcaatttttaactaattcatttggaaaatatataaatcagataatagtgccaagagaagaagaaagcataatagagatattgacattatcgtcaagtcaaaatgtcgttatgttaagacgtatatgcacgcacgtctcagtaaatgtttaacaaagtgagaaagcaaatatgctccattccacaagtgactaccacttttgattattggcaccaagactgatgg

SEQ ID NO: 104298 - DNA, 608 bp, Oryza sativa
gatatgtttgaaaattaattataaatattaaacgtagactattaataaaacccatccatgatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaaatagtctatatttaatactctaaattagtgtctaaagacatggactaaagttaagtccctagatgtaaacaccacctaagtcaccgaagctgagtccgcctgaacccgaccccgtgtatgaaagatcgtacgcctgggcccacaagcgctcggctcgaaacgccacgtcaccacgctgtgagatctcctcgggctcgaggagaagcccaatggggcaagacaaagtgggcctttggcctatttcccccaaagcacagacacgtggacagagagaagcttctacacaatctcgccgcgcttcactctcccagtctcccaagtctcaacgcactccggt

SEQ ID NO: 104299 - DNA, 2387 bp, Oryza sativa
acacaagcaaaaattccaatccttcttcgatttctaaccaaaattagctcacccaaaacagcaaaaatcccatccttcttccattattaaaccagattacactctactaaatgcagcatttttttcccttttcctttaacatgaaaatagcaaagtttttttttgggtagaaactaatgcggaaacagtgagctaagcatcacctaaccacacacgcacgagcagatacagcagaagagaacacctgcaccagtccacatcgaaacgcgatctcccgttcttaaaaaaaaaaaggcgatcttttcaccaactccagaatcccagatcgccatgaactccggaagaggagaaaaacaaatcttggcacgccaagtttttttcaagcagcccgaaacgccattggctatgattagaaagcttttcttttcaaactccaaatctcaaacgggtcgatctcaaaaaaaaagaaggattaatctcagattggtcaaagaccaggggagaatctaccaatgaccacccagagaccactttttttacccgaccaccgtaacaaggaaaccgcacggcgagatccgccgccgccaccggcgagagaggggaactgggagagggagagagacgcaccgatccgtgaagagcatgccgaggccgaagcagaatgcgcagagcagcagcatcctccaccgcgcggaggaccgcctgtccaccgcgccgcccttccccttcatcatcatcgccgccagccgagctccagcgccccccccccccccccccgggatcttggccgcctccaaatcgtcggaaccaaaaaaaaaaaaaaaccctgaccaccaacaagacgaagaacaagaagctccccccgttggcgcggcaaggcccaaacccgcgaggagatagagaagaagaacagggaggggtcagagattggcggtgagccgaccggagaagaggaagaggagagatgaggaggaggaggaagcagctgctggttttgctttggtttgcttggcttcgccgtctcaaacaaacgaaactatggagcgcgtgatggcctcctccttgtttttgcctttcctttttcctcacagcttttaaaaattattattcactattaacatttcagtttccttttcctctctttcttttctttttcttttgtttttgtctttctccttttgagctgtgctgctggtaagtacagtatatttcttctgttttccaactctgtttcttcctcccttttttttcttcaaaaatctcttccctcgaattcagtgggtgggtccatcatctagcaacccgggctcgtcgatcaatatgtaatactccctccgtttcacaatgtaagtcattctagcattttccatattcatatagttgttaatgaatctagatatataaatacgtctagattcattaacaactacatgaatgtgggaaatgctagaatgacttatattgtgaaacggagaaagtagtattttaatattgatataaaaatcgaaaatattatctaaaaaataagaactaaaaatagaattgtcgatttgtccggcctttaaaaaaattttcttggctttgcagctactttaattgtggcatgaaaaattcttcatttgaagtataaaagggagtatattaagaatgaatatacaaatgaagcaacattgcaatggttgtagaattaatacaaaatgtactttggtgtgctttggttggatacaaacccattagttgtttaatcatgtgatgttacgctgggctaaattattactattagccagagaggacgggagtacctgctgcttggttggattacctgggacagtgtgttgagttaggtcaccaatgcctctcttggatgtgaccacatgagctaattttgggtctccacatgttacaaaaccacattttgaaatttgaacagatgaccaaacataagaaaattcagtacaaacaagtaaaaaaaatatacagccaatttgatatgctggcattcagaattaaaatggataaacttaataactaggagtagtagcaaaaggggaataaaagaataatccaattagatgtgctggcgacattggagctagccaacacggttgggaatttcttttgccagtcaagccggagattcgatagtcaagacgcaagcaccactctgattaattaggaaacaatggttaagagaatcattagtgcatgctagttgttaggcaggaagaagaaccatggtccaaaagtccaaaccgccagcttagctcagctcagttacgtgcattcgtgcggcaacaccaacgtgccatgcacgatgagttggctggtagtgacattttacgcaattccgatggttggctggaaactcgtcgatacattgtatgaca

SEQ ID NO: 104300 - DNA, 5020 bp, Oryza sativa
aaccataatacctgggattatgcatcacgtgtcaaaatccccatggttttgtgcaactttgaccataattaagtggggttttatgaaatttactcgttttttttttgcccctttactagaccagcttagcatatggataaataatataagatgatttcatggggttgtaattaaaggcctattatcataagaaatcttcttttctaaggacattacaataagttggtcatgacactgccatatcattatctatgctataaatacttgaaaagtatgcacaacctttgtactgttacaaaatattgaggcttctagccaatgttatcagcatatttaatccatcgtcacttcttttccatacatcgttgtacataaacacatcatagaaataatattatagagcttgtgtccctatttcatattggtgacattgattcatggtgtgagaggtcctatttgtatatataagtgtttcatagaaaacataatcaaataggccttactcatgaatcatgatagtcgtgtttaagtaaaggtgcattatgtgtctgataaccaaaaaagtacacaagccaacaaatctatgacatgtcattgttgccatgttctaattatgaaagaaggaagtaaaaatgacatagcaaacacaaccattgtcatcatgaattgactgccaaagtttataactaccctttacataacactgtttttttttgttatgttttgcttgtaataacctcttcattttcaaaagaataaatttcacaaaactataagtattttgtacaatttatcacgaactacagatttaagagcttgtttcacaaaactacagatgtaagaacttgtttcataaacttatagatttagtgtattcgtttatcaccgaactacacatttagtgtcttaatttatcacaaaactataggttttatgtctccattataaaacctatagctttgtgataatggagacaataaacctgcaattttgtgataaatgaagatattaaatttgtagttttgtgaaacaagttcttaaatatgtagttttgtgatatatgtgcaaagtacaagtagttttgtgataaacaaagacactgaatctgtagttttgtgaaacaagttcttataaatttgtagttttgtaatagatcgtataaagtatttgtagttttacaaaatttactcttttcaaaaatatattcttgcagtataggattcccgcatggttcaccaaccaaaagaccaaaggagaggtgtatgagggattgaggggagcattatgcaaatacactagtaagtgataattccataaaaaagctagaggttacttccaagcacactaaggccctgtttgtttcagcttaagattattgtaatctagatttatagaattagattactataagctggattataataagccgacatagaataagctactagctgtttgtttctctggattattatctgtttgttagttgttagtcacccaataatctaaaataagcacctttagagtggcttaccagattatagtaatctggcttatagattataataatctatcataataagctatttgtttatttcagcttactcataataatccagattataataattctaagctgaatcaaacagggcctaagtctctgaagattgttgttatgaaggtagggcttggcacgatgagtcgatgactagaaatagtagtggatgagctcaatatggttggacgacaagagaagagaactataggacggtgagaaggaggaatgaagaaaatggaaagggacaagaaggccacaatggtatatatcaaacacaatactatgttttaatatgttatttttacaattcagtttgtagattcttagtgcccttatttaaagagttaatttttagagtactataaattattttttcccttatctttgcttaccagtcttgacaaactaagttaaaataagaagtaaacataacacagaaatagggggaaaacgtatgtctagataagatccactttcacttcacccataaaaagggggaaatcaaattgcttagcattaccaataaaagcaatgtaatcataactattcaactcgatcaaccaaattgtccaaacacaaccaaaatggatacacatgaggactccggcttgcaaccgatgatgcaatcttagactaattaataatagcttttcgacacctaaaatccatacagagaattggtaacaattacatggaattcctaattacatatggtttctccccaaatcaattgagtgcatcagtgcaataggtagacaactcctataaccaccacaaatatatgcataatcttttaaaagttatctttttttttgtttgtgccccttttgaaacccaagcatcagtcacttcaattcaccaagttgatcttgagctatttctcaacagattcataggactatcgaccaaagaggaagtgttcctttgaaggagattggaggaggtggtgaccctagtatctattgcgtatgaattgtccgctatgtttagggaagccattgatgaccggtgaggatcgtagggtttaaggtggctactagtgaaaaggaggatgagaggaatatacaaaagtgaggagggagaggaagaagatgggcgatgacaagaaggttatagtagtatatcgactttgcttcttcttttttttttcagtttctagattttgagcaacattctttaaagtgacattttttatagtggcataaataaaaacattctctatctaccaatctttattcattcagttaatataaaaaataatattgaaaacaaggaagaacaactatctagataatacccactttcacttcaccaaccattaacaataataaaaaaaataaacatacaatatattatctacacagcaatatcatactaatttaatttgattagttaaatcgtaataagagaaaaataggcacaacacatacacaaccaccctgactctaagataaagttcatctagaagactaccggtagtaataacgcgtgagttttctattccaatgaaaaaaaaaggagaaggaaaaaccgtatctaactaagtatagccaccgtggtagccaagagcccccccacgacttaatcctataaaacccccgcgataataatccgcaacctagctccccccaccccctccctttttctctcttttctttttgttgttttctctctcgctcgctctcgcgttgcgcctgcgccccttccaccccgcagccgccggccgcttccaattcgactcctccccctcgccgccgcggaagccgccgggccgcgcgccgccgccgattccccggcggattcgagagactcgtccgccgatcagaggagaggagaggaggcacccgcctccaggagtagaggaggaggaggaggcggcgtgaatttgttttttttttcttttttggtgtgtgtgggtgtgtgaattgcggttcgtgtggttcgtgtctagtgggtgaggcaccccccctagggtttgagggcggcctcgctagggtttgggcccccccgcgcgaggggagggaggaggaggctgccctagcggaggaggaggtggaggtcgccccctggtgttgtggggaggaggaggcggctgaggcggaggtcggtgtggtgtggttgtggtgtcgcattgcggaggacgattgattgtgctggtgggcgctgattggatcggagggaggaggaggagccatccctctctccccgccgttgctaggtgggtagatggtgagaggcgccggctgccatggagcaggacttaccggcgctcaagccgcaatggctggtgcagggccaggtcaccaccacgggagccgccaacctctggaccgtagcttcgccccgcccaggcccaggtgagctccactggccttgccaattttgtgtttttttttcttttcctttgttgcacttgtgattgctagtatgctataaatgtgatatatatccccttttgggaattgctatgtgttatatactgtatagtggcatcaggatatcggtgtgaaaccggtgatagttgttgattcattccatagcaatcagacatgagtttagggttttttggtggttctgtattgagatgttcatgggagcaatcttctcttaatgtactctctaactcgtagttttggttgatatgattgaatttgttatgtagtttcataattgattattaggtgactgatatggaaaagttaagagtaatcaggtagatttcatctgtatctttttacaaccaatgtgtcctgtatcacgaaataatgcttattgtttgagtgctataaggtgtttctaggcacatgctctgttggtgtcactgaaatgtaacaaagcttaagatactactctcttcaaataactgtaaacatatagtgatattgttgaaaatcttatcatgcttgccacaacttatctacaagagagacatactttagttatatgcacaccaagcaagtgattactactcaatttatgacatgtttgcctctattaattatatacatgtcaatgtaataatatcaccgataacatttaacaaagttcatttggtgggcctagaaaaactgaagtgataagtatttgtaatctttataaaatgacatgacattttattttgaccatatggaatagagtacagagaagtttctttggctgtatcagttgatttattgtagtgcttagtttttttcccgataacaaacaccatgctttgcattgaggatgtttgtagagtacagagaagtttctttggctgtatcagttgatttattgtagtgcttagttttttcccgataacaaacaccatgctttgcattgaggatgtttgtgatgtttagtttccactgatatcactggatttatggtagtgcttagttttttttcctgataacaaacaccatgcttcgcattgaggatgtttatgctatttagtttccagtgatatcactggatttatggtag

SEQ ID NO: 104301 - DNA, 671 bp, Oryza sativa
ctaacaatcatctttcattcatctccgcaaaaaaaaaaaacaatcatcacatttaaacatcatgcaaacatgctatatttttatagtttttagaatttaagagcttttcaaaaacaaacatgttaaattatcatccaataaaattcacataatatttaaatgtatatctttattatgttttatgatatcctatatacttatatagtttaagtatatagttcattcacttagtgcttaaatgattaatctatggtccaaattatctttctcttttttttcctctaattaagtcatatcacatcaattgtttttagcctttagatgattaatctacggtccaaactatctccctacttttcttcctccataaagtcataccaccttactttttacgtttaaatcaccattctacatactatataaatttaaattatcataaaccacattaatttacttaatctgatgttatttagttatcttgcacattattttttttattgttatcatactaaatttccgcagcaatgcgcggggtttcacctagttatcacaattgtttagccaaccgcatgcgaccaaacgcttgtgtaaatgttgcattaaagcaaccacatttgaaaatgtatttcaacattttttttaaaaaaaaagatttcttatactatgaatct

SEQ ID NO: 104302 - DNA, 704 bp, Oryza sativa
attcctgcagccccgggatgtggtggatttgcttccttaccagcattttcgacatataaaccgaagggtgatatatcttgagggtgatcgaaatctgtcgaacaaactgtcgcaaatcagtaaacatataatgatgtagtataattaatatctggtactttttagaaatttttcttgcattcgacgacatttgtgtttacatatgcatttcaaacatatcatcctctcgtatgtctttgggttcattgaagcaaaaacaaattgctgtaatggattgggttgatatgttggtttgcaagtcagcagtattttgatgaagactactaagcggattaaattaatgttatattttaatccctgatgcattcataagtccactagttagttaaactattcccatttcgcatcagcttttcaatatctctttttcctgtacgaactgggtggacttcctcgcagaatagaactttgtactaggtaatatgttactgtcaaatgtccggcacactagagttctgcagaagtttttcgtttatcgtgcaaagcacgtcttgatatgccatgtactagcatgatatgaataaacttgctttgtttggagtcaattagtgttttttttaataaaaattcttcaacactacatagtttttgcattgctggtgtagataaaattagcttgaggtctttgctacagctttcacctt

SEQ ID NO: 104303 - DNA, 863 bp, Oryza sativa
tgatttattaaagtgaacaaggaaccaaatcatacagccgctagctctgttatcattgcagtcaggtgacgtaggcaaccacttttgactatttcacgaaagctttgtgcaaatttagatttgcaaatatcacccgaatatactgcatgatacttctgccaccattttttatgattaaacccgatcgatttttttaattacattcatgttgtcccaagtttacagcacaagttcttcacttcttccccttgctagcagattgaaattaaaacgttgccctcccaatgagttcttccaatatgaattcaataagatcaagatttaccattgatctttagtttttcaaacgtgcgttaaaagtgtgtggtatacttcttctgtgtaataaaaaatactttaaaagttagtataaaactaaaattcgatctttgaatgacatagaaccaaatttatcatttacttttgttgtgttaagcttgtgttttaaaaggataaagttcatttttttactagatatatatttgaaagagtgatttgtactttgaaatatctttattaccgaagttttactttggatcaccctccctcgaatcttttcacgttggaccagatattcttattatttttcactttagactacccaaactcttttcgcgagcatatcaacggcctcaagcacatcggcatcctcataccgatgatctcccctatttacatatactcacatatttgatgaatgagagattggatatggctagataagaatgttatgttggtacaaaatgaaaaatggcaaaaatagctaattgatggaccatagtaaaattcaataataaaaggtggcataaagtataaatcacact

SEQ ID NO: 104304 - DNA, 656 bp, Oryza sativa
tacgtcgtttggtaggttcttgtgattcttcattgtctataaattgagaaaaaaatagttaatgatgaatttattcaacacggtacaataatatgtagatcttccattttattatattttcattacctaattatagaaaagagattaaacaacgtcacacatatatactaaattgtcaattgtcagccccgttggcagacaacacaactgtagctaaaagagaagttggatttccaatcaagatataccatgtcactcacacttcagtgtatcaatgatgtcacatagcatgtatataaactgctaacccattgtgtattcatgtgcataaattagttggctcacaatgagacattattactcttaaaatatttaagattgtggtggtgatggttggtgacttggttctacttttacatcccaccgcagcgtgtgaggcctttatcctcactttgtttcctgatttctcacccacccaacttatatgtattatcaaaaactcacatatactcaggaaagtcacacaatgtgtcctgataaaaaacacaaactctggtcgcaacacatcagcacatagcgattaataagcaatttcaatcaccagcttctatcaagtaaaaaatggtagactaacatatgggttgggctgcaggaat

SEQ ID NO: 104305 - DNA, 1035 bp, Oryza sativa
cctctttgcccggcactagaatcagctgaccacatcatccagagatgcaaaaatgctaatagcctatgggaaaaaatgaacctcctgcacctggcaaaccattctgaatcgtcctcagcttttctgcaagcagtcgttgacagaaatcattcaaatagaggaattgaacctatctggtttgcagcttgtgcatacacgttgtggaaagcacgcaacaacatgatttttgagagacaaaatgacaacttgtaattcatcattcaacaaatctcagacacactaaagctctggagcatgagagccaatgaagcaaccaaagaacgaattctctcctggtgtgcagggctgtagttgtgactttactttgtatatacccttgtaattccagccccctgttttgtttcttttcttttcttttatctattttaattttcccttttcccctttcttaatacccctctacccccttgctataacctgtaacttgtaaacctcatttctcttaatgaaatgactataaggtagaacatgctctaccttcttgcgtcaaaaaaatacaagtatacaacagcctgataatcccgatggcacgtactactaccgtagtaccgttcaccgttgtgcgagctactagcttctccgtggaatctatggcacccaaaattctcggtttgtcattgactctgatacgattagtaatgttacagactgcataagttcgcttatccttgagaccttgacccaagcatcatgttctttcctcagctgtttgatgactgaatctgagaagaggtttcatgcgaacacatgtcaccgtcgaatctgaagctgttctccccatccgaacagagaaattccgctccgtgcgtgtcgagcaccgtccggttacggcttgattgtcaacttgagggaaggggattgagagtttacatgagagaattgatggtgagattaagatgggaatttgatttttcatcccagtctcttgtttggtagaggtggtggaaattgatagggagtttagttggagattag

SEQ ID NO: 104306 - DNA, 775 bp, Oryza sativa
tatatctcatcggtattttccataagtcataggataaagggtatgacttatccataaccctgacataatgaattttcttataggtcatacataatttatatacataaaaaacaattatatattctatagccattaaagctcatcccttgcgtgttactccctccgtcccaaaaaaatacaaaccctgggtttccgtgtccaattttgactgtccgtcttatatgtaatttttttataattcgtattttcattgttgttagatgataaaacatgattaatattttattcgtgacttgtctttttaattttttttcataattttttcaaataagacggacggtcaaacgttggacacggaaaccagggtttgttttttttttacggagggagtacgcgctaaaataataggaagtacatgtacaatgatatttattttttccctcttttctagtgtattgcaaattaatggtgaagtggatattttcttataccaagattagcataagtagatccgaggatgattttaagttaaaacgaatacttaaaggacaaatacggacaaaatgaatcctaagaactaaattaagctttaggtaaacttaagagactaaatcgagtattcgttcaaaggaaacctgactcgatctttatgccatcaccctatatggatatattctcttatcattctgaatgggtattaacactattactgctaatctagatatgtagcttcgtcaaccatcacggcacaaaaatatcttcatatttgctcaca

SEQ ID NO: 104307 - DNA, 959 bp, Oryza sativa
agagaactacgaaaacatatctaaatgccaatcataaaggagacatatctaaatggcaatcgttgtctttgaaaaaaaattggtaatcagtgtagagtgtcaaacgataagaagatatatctaaatggcaaccactttatcttttttatgaaagctgtatacaaatttagttttgcaaatatcaccaaaatatcatgcatgatactcctacatccagtttttccccttttggcgaattcaactttttttagtcacatcactatcccaagtttctagcctatagtacttttctagtatttcttcctgttgctaataaattaaaaacatcgtgttggtggcaaggttcaccaaactgtttagaggtggagttaccattacctcaaggtttaacggttaccacgagatataccattgatataccattaaaaaactgagaatgttaccgcacggtttataaaccctggttggtggtgaatgcttccaatagaaatttaaagtaagagattaatttacagttattcttgtctcttcgagcatgtgctaatttggtgaatttttttatatatttgagaaaatattatatgtcactgaaccaactttcacaatatttatatgatgttaaaaaattgaagggctcaaactcattttggccctaattccaaaatgtcccatattgcaatgcaacacaattgaaactatagccatgtttagatcccatctcaaaatgtttcgccctgtcacatcgaacgtttgaacacctgcatgaagtattaaatataggctaaaaaataactaattgcagattgcaactaatttacaagacgaatcttttaagcctaattactctatgatttgacaatgtggtgctacagactatagtaacatttgctaatgacggattaattaggctgaataaattcgtctcgccgtttattgacgaatctgtaattagttttttc

SEQ ID NO: 104308 - DNA, 699 bp, Oryza sativa
tttggaattaaaaaacaatattaaaagccaagtctaaagtctatataggaatatatataatttacaaataactaaaatttgatattaaaaataattaataactaacacgtataaaaaatataatatgataattcagaaataaaaataaataatattagaagaagagcatagagtctatatagaaatacaatttacggaaaatttgaaattaaaaaaagaaatattaaaagacgagtctagagtccatataggaatatatatatatatatatatatatatatatatatatataatttacaaataactaaaatttgatattaaaaataattaataactaacacatatataaaatatatgaatattacacattagtagttttgtaaagttattgcaaaatttaaaattatgttatcattttaatatatttgaataatataatgagaaaacatatatgctattatatgtgagaaaatataatgatgctaccgcgcaatctgcgcgggccaccatgctagttttaatagtatagcccactactggctccgattcatctatagttcatctaatagccaattcatacaatagttacttactatactattaatatatggtcccatttgtcatacacatattgcgttttagagtccgtactgcagctggctacatatttgtagcccgatgctcttcgggctgcaggaa

SEQ ID NO: 104309 - DNA, 2420 bp, Oryza sativa
taagagagttctaaaaaaaaaagaacacgggatgaaaatggtaaacacatatgaagatttacatataactgttactccctccgtttcacaatgtaagtcattttaacatttttcacattcatatctgtctagattcattaacatcaatataaatataaaaaatgctaaaatgacttatattgtgaaacagaagaagtatatattatttagactgcctttgacatcaattgaaatgatttaattttgagaggaaagaaagagccgtgtgctacggtctggcggctgggatgaccaagggggcccacaaggcagccactcagccacgcacgcacagtgtcagctatcacctgagcagctgatcagttcgtgaaacaactgctgatttttttggaagaaggtgaaaataaaatcctatcataaggtcctgggattagtactgtctactgattaatctagcgagatgtgatacattacactcctctctagctgtatgatcaagtttgttctgtggctgtgcatggtgctcatgcttcctctacaactggcgctgctgctgattagttctgctggagtttattggcgcggtggctactggctagctggctgccggatactgccaaggtctgtaagatttatgcagacacaccggctcaacctttgcatattaattggcagacaccccaagtaaaagttttatttgttggggttaaaactgaacctcgtagttgctttcaacgactagggattaacaagtggagtgggggggggggggggaattcggatataggccgggtagttatctcgaattctcgctatgagcgcgattcaaattgtaagtttgtaagcatgatttttttgaatttcaaccagtatgaaatagatctagagaaataaatttgaacagatgcgtacaatttttggctgccagaaaaaataagtctcgagtatagccaagctttgagtctaactacatatggtgattggactaagaaatcaacttttttttcaactggtggcaagttgtagatctagaaatttttagaacatgacagaatcatcgacatcatcagttaccaatgacacattgttttcaattattagcgtgagccggtgagcccaaggtaaatagacttggtctccaccagtggtggctctagccacctagtgttaacagaaagtggatcagtcaccagctccatgcctctgatgttaatccagactagttttcttactaattttatttttcaagatctagacctagcttcataacaaaatgatcaaacatggatataataagatagatctaagatgaaactgctaacttgcttctatcttgagaattcagagaaaaaaggtttggatatatatttacctcatagtaatggcccggatgacggaggtcgcatgaagtggtatatctaggcgagcagatgttttggggaagacatgctcatgataatggaaaaggaagaggggccactgacggatgaacgaggatgggaatgattgaggtggcctggggcgcattttataggacggaacgaatgttctagaccaaccaaatgacgtcatgaataataaaaaggaaaaactttttgtcactctactttagtatcaaaaattgcaaaatgtgccgacaataataaatgatttatataattaacttgatcatgtaatatcgtttcattttatttatggcaattttattgtttttaatccttcgggtcttccagtaaataaataacacatattgaaagttaaacccttggttgaaaagaaaaaagaaaagaggaacacaattaccaaccaactaaagtatgcttaataaaggtaggccacaggtgaaacagttttgcacatcaccaaggacctaagtgaaaaatgctaatgcatgctcctaagattaaaataggtgacatggaaaatccagtgagcaggaaaaaaaaagaaacttttgtaattaaacttttccttttgaaatttaatatagcgtaggggcctccctacagtttcaccgtaaagggaatattttctacaagctttataattgacgtggtgatgcagaaatgcctcacgcaacatggaagcgccatgatctgacagccttgtacttcatgaaagccttgggtgattttgtttggatcactccttatgtattgtattgtagtagtagccagccacttttgctgttgtatcttgttttttccctaacaaatttcactttctgtttgtatcttgtactacaagatgattaatacatccatagtgaacagaaagtgaaagatacaaaccgcctcaaatttgtcaacagataaaaaggaacctttttcatgtggccaactcaaagaggttaatgtatctttaaactttaccccacattttctgtagtgtgtctaatattcttatttctttcgctacgt

SEQ ID NO: 104310 - DNA, 507 bp, Oryza sativa
aaagcagttccaatcgatgcaaagtaactaggtgtcagccaaagtaactaattaacaatgaacaagtaagtatgtagggttaactatactgaactgaaaataaatgccatatatatatagttgcatggaatggaagatgaatatatatatatatatatatatatatatatatatatatatatatatatatatatatatatatatagagagagagagagagagagagagagagagagagagagatctctaaagagagatgagtaataattggatcactaggagatgtggcacgtggtggggtggaagtggtggggattatgattattagtgggggggggggcgttggaaggagaagggtggaggcggagcctgagggggcactctagcttgatgttggggccgggcagcctgataatggcggacggcgtgagctcgatctcggtcttggcggccatggtgacgtggatggagtagatgccctcggtgtcctcccggcggaaggcggcg

SEQ ID NO: 104311 - DNA, 636 bp, Oryza sativa
aaaaaaacacaaggggccaataagatatgcgaagaatcgttattaacatacttttcagggaaaatgaacggagatggcaactttgagtgcatcccacagaatattcatgagtggtgatctatatgtttgtcattttggtttactccctctgttttttaatatatgacaccgttgactttttgagatatgtttgactattcattttattccaaaaaaatatgtaattatcatatattttattgtgacttaatttattgtgaaatgttctttaagcatcacttaatatatatatatatatttgcacaaaaaatttgaataagacaaatgatcaaacgtttgtcaaaaagtcaattgcgtcatatattaaaaaacggatgtagtatttagtaaggtttctcaactttttgtactgagcatttttatcagttatgtcaagcgatgattgagatttgcaagccataaatgctgacgtcagatatgcaatatacaaaaaggaagaaacaggaaagaaaagggttgcatacaaatttgccaggagccaagtttttgtagataatgatgacatccccagcctgaagaccatgtgtcttcagaaattcacctgccaatatgaatacgaaatatcaatctaccatg

SEQ ID NO: 104312 - DNA, 876 bp, Oryza sativa
tatgtagtcagctcagcacaaggtaaaaataattaacaagacgagatcccctggtcgatcctggtcaggttgcattgaggaatcaagctagcatgcaggcatgtgcggttggtgttttgtgatggtgtaggtgctgtgcgataatcatctatataaatcagagcgaaattactctctgctaccgatagaaagtacgtacgtactgtagcggagcttatataattaagctcacatattgtacaagaagcttgactaaagatgtaattaatgaagcgtgttcagttcatatatagatgcatggtcatgtcgttggtttgcacaaggttaattaagctgtatcccgtataccttacatagatgaaatgagccattaagagagaaagaaaactagttgatgctaataatatgaaggaacacgcaactagcagtatgatttcatcaagctagggctgcataagcattgttaagctcgcaagtgggaagaagaagaagaagaagaagaagaagaagaagaagaagaagccatgaattaagtaggtgaggtaggtaggtgaagctagctagcttttgtttggagtggaagatatattgtggaagtgcagcagcacgggggtgttgcacctggggcatctgggctgctttgtgttggacacggccagcatcacgtacatgaggcaccgtgggcacccagccaccaccatcgccgccgccgccgcctgctgatcttccgcctccgacgacacgcacgaccttgccggcgactccatggcttaattcccacctgcactgcaccacaagcttactcgatcgatcgatcgatctgtgtcttaattctagctagtgtggtggcctcgctgatctcataagctagcacta

SEQ ID NO: 104313 - DNA, 672 bp, Oryza sativa
cactgtatatggtcatttgccctcttgaaattaagccacaaacccagagcagagctaggtagctaggtccattatattggagatgaagcgtagggtagtacaacctttgtgaagtgcatactgtttcttgtccttggaaggataacacaaacatgtacagtaactacaatatgtctggtgctagctagctcttaccaattatatgtgatgagcaggcagtatagcaagaaacaattctgcaattgagcaatgctattgctaagctagctagctgcatgttccacaacagtggatcttagcaagtgacgcataatattaattgttgtgcagtatgtgtggtccttatgaaacagttttccttctctgaattaactattattgcctagctagttaccttgagatttttacgcaagttcatttggagcattcatatatactccacatatttgctccgtgtagctagagtcctaaattatactcgtacgcagcagtgtgcgagatatgatctccaggattgaactgcacctagcaatgcttgctgttcccgaatagtacgtactgtagatacaggcgacaggatctgcaggatatcatgcgtgccacagcccacagtgaagatgtcggcagctgcatcaggctttggaacgattaagaaatccgagatgatcacat

SEQ ID NO: 104314 - DNA, 841 bp, Oryza sativa
tttttttttccctaacagcctattttaaaaaactctttttcctaacagttgaatagaaccaaatagaagctcactccaagagaatgcaaatgattgaaaccaaaaggggagagtgtgtgagagagaaaatgatgaaccagaaatattcgttcagctctccagctagcagacaacaggaataaacaggattcctgatttcctcatgattccctgttatttaatacatgttgtattgttaaacttaaactaatggtttcgtctacagaggttgtttccggacacagttgttagttgtttatagtatgcactataaaaaaatatttttttacagacaccctaacttttaaaacaagctaaaatgtgacatttatgtaaaaagatttgaggtgtccagtaaaaacccgtttgcgaatgaaaataaggttattttcaaacgcggacaaatttttccactcaaccggccgaacatccttctatctcttttattttcttctcttctttattcctctactttactttacttcaattgtagatccgtcgaaatggtaaagagaggggcggatccggcgacctctccccctaccgtgaggatgtagaggtctctccacctctctcgcatacggatctgctggcggtggcaacaggaggggcatatccagtggtagcctcttccccctcccacatagacggcaacagcggaaggatactcccgagctagggtttctaggatctttttggaatttttttttgccgaaaattctttacgtagtcgggcagcataccatggaaaaattcctattttttagacacctgaggctatgcgattgctacacctgcctat

SEQ ID NO: 104315 - DNA, 673 bp, Oryza sativa
acccttccagttttcatcatcctccataacacataatctaactaccgtaatggatgctaaccagattttgcctagagtggttaagagcagtgatgaattggaaaccagaaacagcaatgttgaatttcactctgagacagttcgactctccctgagtcgaagcaaggccatgacagtcgtgctactgtgagtaacacactacacttaacatgctgttgtatctgatttactacacaaatttctatcttgcatttaatctacattaggcaagtacatagcataagtaatggagcaagtatctatcaattactcaatgccgatatagtcatttgagcagaagggcaaatgaagcagcaattccttactagtttagtaattcaagtagcttgtaaagatgattagccaaaacactgatgcagtacacaggcacatacttctgtcataattagcaacttcatttcctttgtgttcatgggagtgtgcttttatgccagaaactactcaactcgggagaataccaagtcattctgcgcaaggagctgacaaagagtgatgttggaaatgttggaagaattgtgctacccaaggtgtgttccgtatttctgtctcttggaagttctctagtatcattctgtgagaactttcatgtggtctaaactatgcttcataatgt

SEQ ID NO: 104316 - DNA, 712 bp, Oryza sativa
cctgcccccccttccgtttctagccaagcgcttctcttctcttcttctatccatcagtcagtcatagcagaagatgatgaactacactacacagtacacagtacacagtacacacacaggttttgcattttatttctggaatcatcaatcatagcaagcacagcagcagccgctagcatagcataaataatgcatcaaagattttccttaattttctccaaacaggacaacataagaggaaacaagacattacgatgctttaatttcatcatcgatcaatataccaaaacatacaagtgatcaataacagacaaacaaacattcagtcattcttctcttctactatcctttaatgccaaaattactcatcctatactcttctagtctagtgtagtctaataaagtcaactagtagcaaatgaactcttctcaagaaagaaagaaagatcccaactcttctcaagaaagaaagtgcatatgtcacttgacaccaacggacgccatgagatcctcgtactcagccttgtcatcctccgtcttcctttttcttcctcctccacctccaggtcctcctgacattactgcaccactcggcacaaatggatcgtatattggcttctgttgtgcttgtgccaacacatgaaacggccgttgtgcttcaactgccgctggcgggagagggaaagctccaacaaacccccttgtccctgcc

SEQ ID NO: 104317 - DNA, 1337 bp, Oryza sativa
  unsure (1)..(1337): unsure at all n locations
taatttactaaagttggtacagtctctaagttaacaatttttggtagcttgggacatgtataacntaagctatttgtgatacgccctgtagtttaggtgtgtgtaattaccctataaaaaattttggtgtatttttgcaagcttcatcacatatatgaatggtaaaatttaattatatatgaccctaaaattagctctttgctaatggacactccattttatttttaaaacgacatcattaaattatggtaatttattccttggatatcatggacaacaaaatataatgtccttttgagatgataaaataatttattttgcccttgtaatattctcttaactaaaattggatgttgatgttgctctcctctaactttgttgttccaatatagcaccagattattaataaggcgtctattgacaaacatgcatcgagcatatgatgcacatgttatacacatatcaaaagtgcaaactagctatctccatgcaaagcaccaaatagtgacttatgtacaagtttccagtgcagaatttcatacaaaaggattatccgaaaactttttgtagaaacttttttataagaaacttaccgcatgggtttttagaaataaactcgctattaaacatagaaaaagtcttcctctaggaaaactgtccatcaaaaagttcccacagaaaaatatttataggaagataaaaaaattatatagaagattaaaaaaacactttctgtaaccttcttatgaacatgggaaattttatgactctctgaaaaaactgccgcaagttttctgagtagaaaattttcaaatgtaactatagtatagtactatactataactacattataacttgtataagaatactaaaaatcatgtaacttcatatctaagttaattatagtgtaattatactataattacaatgtagttacactaaatttacccaaaaacttgcaataattttttagcagtttctaaaacaataatttgcaaggaaacattatgttgaaaaacctatataatgtaaatttgttcaaattttatgtatattcaaaaccatgttaaaacattgagttgtcatctctaagcccattatcgtacagtgtgcacaatcataatcctaatccatgttataaaagaagatgttaaaaatattaaaacattcataccacgcaaccacagtattttacgtgttgtatatcctctttcccttttaaaccaagtagtgattggtagcctctcatattggaactaggtgaaaccccgcgcattgctgcgggaatttagtaggataacaataaaaaaatgtgtaagatagggggatccactagt

SEQ ID NO: 104318 - DNA, 620 bp, Oryza sativa
gattttaattttttttatatggactgactgttcaagcagaggtcaaatttagctggtgtctctctctgttgggttgatttgtcttgtgggggcatgacaaccacttggtttgttggttgtctctagccatcatctttggtccctttttctcaaccaaaccattagagcaaaatctttttcttaattttcaaggaccttgcgaaaaggatatttgatctcaattgtgcgtggaatcttaactcaaattctcattttatgctaaacaacccacattagggtcaccattgaagagaaggtttagtttcattagttttctatcatatttctgttagacgcaatgcataaatctctaattgtacgtgtaacagttctagcaaacaaacataaaaattggaagaatagaagaatggcactacactaaaatggccttcaccgttccaagataaggcagcatgtttaatttgtttccagtagtttcttccattataagctctacagtagcttcagttttgcacgaatctatcaattcaatttccacgttgtcgagaataagtttttctcttacaggcaaaaaagggaaaacaaataccaggcagccccaaaaaagaaactcaagatga

SEQ ID NO: 104319 - DNA, 698 bp, Oryza sativa
aaacatgtatttttcgtgtttgtatattatctttcccttttcaacttggtagcagtcagtctcacatgttggaattctctgtcattcatatatctagtagtcgcggagaaagaaagaggtattaaaacatgtgccccactcaactgcacaaactagtattttcagtgtggtataatattatctttttgttttcaacttgttgaggttgatagtcttatgcattggaattctatgtcattcttatctatagtagtcgcgcaaaaagaaaaaaaaagtattaaagcgtgtaccccactcaaccgtgcaaactagtctttcccttttcaacctggttgcggtcggtatcctcgtacgttggaattgcttgtcattcttatctctctggttgcgttgaaaaaaaaaagtatttaagcgtgtgtcccacttaactacacaaattttgtatttttttttcatgttgtgtatcctctttcttaacttggtagcgggtatactcacacgttagaattctccaacattatatttctctggtagctgaaaaaaagaaaaaaaaagtactaaagcgtgtcccccattcaaccgcataaatttttattacttggtgaaaccatgtgcgttactgcgggagtttagtatgattgcaataagtagaaataatgtgtaaatataagcttggatacgttatatggtttataata

SEQ ID NO: 104320 - DNA, 708 bp, Oryza sativa
cattagttattttttaaaagaaaaaaacaaaaggttgttatacatatattagctagatggttgtttgtcttcaccactatatatatgcagctaagtaaggccgacaacatcatttctgatcactatcggctaaatcgtccattcggtctggtcagataagacatgagaggtgctattttacaccgcggcccttttgttaattattattttacaatttttaagttggtttccttgcaaattatatattctcaatccattaatttgaactgtttgaactgagttttttatttgacaatcgattataacaaaagccagtactgatcgagaccaaattacatcatgtatagtttttatcattgatcaatcatcaacgatgtggaccatcaagtttttcattgagttttatgccttacactcaattggattcatacctactttgttatttggcttttcttttgtaatgatattaatttaatcctgtaaggcagttaaacaagatgttagcggtagttcaacacgatgttagcggcggttcaacaagttcacatctctaaaatgatttgtatatcccgcagcaacgcgcggggtatcattttttaatgacagacccacacgcgcctacaccattacacacgcaacatcacactcatacaatcattaatcacacgtcacacattgtacataaaagtattcttacgttcacgttgt

SEQ ID NO: 104321 - DNA, 843 bp, Oryza sativa
atgttcgattttatttgagcatagattactacccctgtataacacaaatttgctgataacaattattaatttgagatgatatttgccagattacattgagcgcaattttcctatgatgctatacagtaatacagatctccggaccaggatcctctgacttcatatgtggatcttgatccatagtaggtcctcatgtgttccgttcggtgcacaactgtcctatgctagccattgtacaatttggatgattgctgaaagacctgtaattatgatgttccaaagtttgtttaatcgactcttttgcattcggtggcatctccatctttatccgttcagtggctcagaacatgagtaacatgaacacggtcgaccaaagcgtgagagcaaaggaggcaatcaggtgcgtccaccctccacaagatgatggagcataatactcttctccgacgtcaaacaactgagccaatcatccctgcattgcagaaacgatgatcaccatacagctgaaacaaaagagagaatgtcactggagtcgatgggtgaacatcggtagactggcatgccgatgctcatggcgggggcaccgttgattgcatcaggagtacgtagcggtagagagatcttggaaggaacccaagcttcctgctgctgtgactctgatcactccaattccaattccacaggcaggcagaacgatgaagcgtatcatcgttcatcacgaccgatatgactatcagaggtttcatagccgtcctttctttgcctagcactagtagtgaagcaattgcaagtctttgcctgtgcatatcaataggccgtattctatctaatattaaaaaagaa

SEQ ID NO: 104322 - DNA, 1385 bp, Oryza sativa
aaggaaaatatattctcataatcccagctggtagaaacaaagggatggtagatatttttgcaactacatcgggtggttttagcaacaactctagggggtccgcaccacacaaggagttagagtcaacaccgagcggacgaagaagtatcctcgaggcaactagcacaatgattttctcttccttcttagacacaattacacagcgatatactcggcaacttggaaatatgggatattgatatcttttgtaactttttttttattttttttctctttttactcatatgtttttaatctaatacttttaatcaaatagataattatattttttttatagttcctatatgccaagaattgaaaaaaatgttctaagatttaaaaaatatacactataaatatatgaaattgaaatagtaatatatgggattcacattatactttttaattttttttcttgaaaatgtgcaccaaaaaatataactactcatgattaatattacttacccatttaaaaaagagtaccattaaaaataatctaatcaaacagtttctccatttgattcaatccaagacacttttcagctcaacgtgctatgctaagagaacataaacgtgctatgctaagagaacataaagataaacttaagtgatagaggagattgtttgccaacaacacacatgaaggaaaaaaatattcacatccatggtatgatatactcaagttcatcaataatttaaaaatattattaaagtttcataatttttaacgcaaatttgttctttaccacattgtaggtaactaagatattatcgtagaagctattcgatctttttcctataaccttattcttctctacttccgataatgatattgctaggtttgagtcaccagaccttacaactaaatagtgctagctagtttatgtgcacacgctatgcaatatatgttatttatgattttacatgagttagtagtaatgatcatgatatattaataatagagtgaattacgttgttggtacatagatttattgagtgggtgtagtttagtacataaacttgtgaaatactaattaaggtgcacagacttgtttaggatatgcgaactaagtctaaaacgatatattgtgactaatcatgctaaattagagttttattgggatgtcacatatataaatgacaacatgagacctgacttatgtgtaaatgacctttatatatatatttaaaaaaaggttacttatagttaccctcataaatgttccccatcaaaggaacaatcatgtaaattcactaggacaccaaactctagggttgtaaacctataaatagacctcaagtgaagcttgcccttcggtacgatagttcgttgtttgacaaaagta

SEQ ID NO: 104323 - DNA, 549 bp, Oryza sativa
gaatctgcatgtattgaaacagttgaatcggggaagatgacaaaggatcttgcactccttatccatggccccaagtaagccaatttatgcatatgtgtgagttttttcatggtagttcagaaacttaaatgtgtaacagctcaagacaaagtgttaatataataatacaaagtagatagtcctacagtgacatggtttctcaaaaagtagagttgcagtgatcataatagaaaacttaggcagctaatattactcgagcttttctacggatggtgatagatcatagcaagcatcaaataattgttcttgctgattgcaaggcagttagtacaccaaatagtttaaatatttttcagaagtggaaattttaagcgcttgttctgctgcacatttttagaccaaattcctgtatactcgaaccttttctttttttggatctgtgcggtagggcagcctgtttcacatataacaagaaaaatttcggtgtttgtatcagtgtgttatactggttgctgctattggcttattggctccgctgctctgttttat

SEQ ID NO: 104324 - DNA, 660 bp, Oryza sativa
ttgccagcaaaatcaaattccagttcttgagttacatttatattgtgtgtactgacactgaaatataattggcttgaatagaatgtttactttcagggattatttgaccagatatgattctttttttttccagatacattggtatgatctggcaatacagcaatgaaatatatttgtttagaaaataatctacatggacaactgtctataatattatgacataacctgtagcacatctacaaatttgagatctagtggggctactatttctatatgcttatcagccatagggtacaccgcagtgccacatacttattacatgcataccagttcttatgaaaatgatctgtaaccttgatccctttcatatgttgatgtgcatatattttttgccggttcaaatgctcttacatattttcttggtttagtggagcactacttttatttaatgcaatatggaggcatgtggttgagctgtctttcctgaaacttctgtcgagcacttgagtatacaatgtaccacaataaaccagtattttcttagaagtgaatggtcctctgccagcaaatatgttgaaatttgtatccaaattatgattgatatttcacacctgtgatacatatactatgttccttgtgtactatacctttttttttttt

SEQ ID NO: 104325 - DNA, 831 bp, Oryza sativa
ctactaactctttataatatgcaatctaatcgaactctaggagagtaaattctgatccagtttggttgctaattacgttaagtggcaggagcaaagtcgtatccatcttgcccgccccaattttgtccacttggtagtatgccatcattgtgcatagtaaggggccttcgtccatgtggaacagtgggagagcttatgttgcgaaatgcaatatactatggcataataaactgcttaattcggatattatttatgtcgtactacatgattcgctactcaaaacaactggatttactgatgacactatggctaccactatgaggtcccaactaggtgtagttaatcttctatcaacaaattcccaaatattcttcagggagactgcttgtttgcaaaattgtggctatcgaaattcaaaacgctctcatcctatgtttctcatcaatagattccctgggggccattgccctgttacgggagtgagatacttgaaccccacatactcgaaatgttccacccaatgacccaaagctagtataatgtgattctgtgaatatgtgatgagaaaggtgcaagttatcctctgtatatttatttctatgacaacaatggtacgccaagttattttctgctcggctctccagaacgacttcggcttcaagtgagagtcagcatccgatgcgggtgacatttgtcaccgtgaacaagttgccagctcgcgacggattttacgttgccagagacttacacgagtgtgggggctcgcctcacgcttggcggtttggcagttttgggccgcgacggcgacgtgccgaagccgcatatgcatcg

SEQ ID NO: 104326 - DNA, 603 bp, Oryza sativa
tattcatggacaattatcatcttagcaatgattttacgagtggcctcatgatcataatcaaaaagagtagcaatgagagaggcacctgccatgtcaggattaaagccaagcaaagcttgagccttctgcctgcccaatttgttcaaatatgccgtgcacttctttatatggcgattgagagttgaagtagcaccacctttcttataggcaatgagcctatagcaaaaacttcatttggccttcgtctcagtggcccctttctccgtttttgatggaacatccacaaccttgaaaagcttccaacaatctgaatgcttaacccttgccacactctttgcaggggatacaaaaataaccttctttcgtttccctttcctctttaatccttgagatccagagttgccctcatctgtagattccccatccacttccttatcttgacttgaggaatgaactgacaaatgtgagggtgtgctattagacgaaacagacagcataaaaaattcttcatttttcgagtctgatccctgcaagttcaattaaatagtcagattgttatgctattgcttaccacataatcagtacaggagggtataacatagc

SEQ ID NO: 104327 - DNA, 1395 bp, Oryza sativa
acacaatgcacacattctcccacaatgcatacatcgattaaaactccatgccaattactccaccttagcatgcacgcattctcccatgttgtattaattgtattccgatgaaatccgtctccatgcagttatatgatgatcaatttaagaaattttgatttctattacatgataatcaatttagaaaggagggagtaattagcgggcacataataaagatgagttcaaaacgatggtgacaagagaaaccattccaccatgctatgaaaaaattgtgcccatcctaatttgcattcatctcaaagcgattgtaatatatagatccaggatttgtacggatagtgaatctcataaattttgccatattagtcgtcttttgaaacaccaccttgtatatatgcaactactagtgtaaaaaactacactaattcatatagacaaaactattgattttaacaatgaaataaggccaaatacttacaaagactacactagttccactaaaaaaattattcatacccttgatttcagaagattaaaaaaaatataaataacaaatatattacacaactcctacaattcataggataatatttatagtatgcagttcaaattccatccaatataaaaatttatttgaaactttctgggagctatttatgctgcatgtgtgcacatacacattctgttgacattggaatatttccagacagtagagcagcatgcaaccagaatatgattcaaaaagtaattaacagaatgaaaagtgttacttatgaacagttaaatggatatttctgaaatgacaacattgagacgaaatgacatcaaaagagtgcaaagtctagttagtattgatgctagtacaagacactggttaaagtaatgtgtgcatagactgtattttcattgttgtggatgatatatatgttaagttagataatcattcacttattaacaagccgtgtttatcactcttatgaactcctaatgcaatcctccctccttttttaaatatatgacattgctgacttttgaacatgacgtttgtccattcaccttacaaaaaaaaatagtgcaaatatgtaaaattataagttatgtttgatgtacctttaataataaacaagtcacaaaaaataatttatatttcaaacgtcatatctaaaagtcaatagctaatatctgaacatgatccatactggtgaaatagtaggattccaacaattcatctgagtatatggaatagatcaaatcatgtgtgaggggatgaattgttgcaccagtccaataaatatccaacaaattagaaaaaaaatcaattccaaaagagaccatctgtccaacaaattagaaacaaaaatcaattccaaaagagaccatctgtagacagga

SEQ ID NO: 104328 - DNA, 969 bp, Oryza sativa
acggccacagcacatcattagagacatcttgaagtacacttgctgtaacagctcagtttcaatcggtacctaacacctgcacaaatggggcaacagcttgcctttcattttggagaaaaaaaactaaatgctaatgctataatagatattatgtgctacatggttctcgtgagagtcatattccccttgattgaacactatcacacagccaaaaaatgttccaaaatgcatatatgcatgtaaaagttagaccaaaatgacattaaaactattagcaatacaatttctaacccctgcagcaattcatgagcgacaaacctacaaatatcctgtttgtcctaaattagaatagataaaatcaatgtaaaatcagtggttacataagatagatgtactaaagaagtaaaagatatgcgcaagtaatgctatatgaaatcttttaaaatcaaggactctgttacgtaagcagtgacactgcagggaatttacatacactttggtttggttgatcatctgctttagagtcagtgagcaataagtggcgttccagataatggacatgcatcgtttgtcctattctgttagacaagaatttttactaagtaaatataaatgtctaacatacaaagctggtcagcttaacagcatttcagtttaattgggtcttaaacactgttttaggagtaaaccatagcgttgctataagttcaaacacttacattttgatagtgccagtttttcattcagctaggcccttaacgcaactacaccaaaacaaccaagtacttttttcattcctttaccattccagagttgccggctgtcttattttttcagttaggtgaaagcaacttaattttcccacaacaaaacaaaattattcagattctatataatatatgccttcactgatatatgatatttttcagttactattgttttcgtctctccttgacaattccagaaaaa

SEQ ID NO: 104329 - DNA, 722 bp, Oryza sativa
gcatgagacccagtttcttcctctcttcgttctctctcttaattaatatagtaccacataagctaaaagtcctacatggcaatatagttaatgccatagacaccattctaggtggagggttgggattgccctaatattgtgattcaacgcttgcagcattttaatgctgcacattatttggtcagatttacagtattaaaaaatatctcatctggttttagattcttatattttaggactgggacggatgaagtacgtagtacgttttcttcaatttcagacttcaacttcctctcttttttttcattgggacgttttttaaactattaaacggtgtgttttttaaaattactataaaaatattatttgaaaaattcaaataaatttattttcaagtttataattataaatacttaattaattatgtgttaatgggttttctttttggtatgcgctgaaaatctctctccaacttagagaaataactcaaccggctgatagtaatgcaactaacagtaatgtaaccaatgaatataatgtattcggaaagtagtagtactccttattttgttgggattactattcgatcgcttaattactacaagtttctgatcgctttacataattaaactatgatgatgcaagcaaggcaataacagagttggcttgcggatagtagacagggaagagatgccctagaagcccttagctagattgtcact

SEQ ID NO: 104330 - DNA, 673 bp, Oryza sativa
cacttattttgggacggagggagtaaggagtagcttagctagctagcctagctcttacgtggctacaggaaaccactggtccaattcgtgggaatcaattctttgatcgatcggagacagactgcacacacggagcatgtaacctgagcaacactgtagtcgatctgaatgcatgcgaccctctctgaatcctaataacttgtcgcaataaagaaaaatccccatacattatggatctatagccaggaatagttacttcttaaaatcgatctgtaaatgcgatggaataaaatcgatctataaatgcgaggaataaaatcgatcgatcaattgaagcctgaaaatttaatttctttattggcctgctgcagaagcttacctgcagcatgcaatgcccctgcgtgaaagggactggagcatggggtgagtgaattaattgatcgattaattcgccattatatattctcaatttatttatttcttattttctttgtttgcgtttctgttgaaggaaaaagaaaatgggaggagaaaactggtaggagttgtactgctgctagtcttggcatttggatctggacctgaatgcgatgtgtgccgtttgcttgctcctctccaaatccaaggtggcactgctccgaagcaaaagtgcttgcatgggttgtagctgctg

SEQ ID NO: 104331 - DNA, 669 bp, Oryza sativa
tttgccttcgaataaacagaacacaagcaggccttgtaatatttagtatatattcttgtcatagcttttccctacgaatcaaaatgaatatccttgtctcaaattgaacggtatggcggctgtttgactagtctagttttctgcttggaatttggaaataccgtggcctgtttggtggagctttagattctgataatcagctgtttggtagcaagcttctgaaaatctggaaatgctctgaaacccagcttctccagcttctggcttcttagttcaattttcagaatctgtaactacagattctcagaagctgtggactgtttgggacagcttctagcagaagtagcttttgggaaaagttgcagctggaagaagctcctccaaacagggcctgtctagctgagcaaggacaattattgggtgcacagagtgtacaacatgttcaggccttcagggttgcactgttgcttacttcgatacactcctacctagtaaacacaaagaattaattgactgactggtggcctggtggggctgaccgattgagtaatacacagtactaccattatactctatgcataatctattcgatctcccacacctcccttcatatgaggtttacctgctgtgacgcacgcagtcatgtaatttttaattattttgatagaa

SEQ ID NO: 104332 - DNA, 867 bp, Oryza sativa
tgttccttgatgttgatatactagtaccattgccaaatgaagggcgagggagtgtaatgtatacggcatagaaatcttgtataactagtactatacgtcataccggattaattttgaagtgagaatttcgttggtgtctctcccctttgtgcctagagaatcaacggaccgttgtagtgcgaaatcttgcacaaagcatagtatatatgtacttctatacttagtgttatgggacgatactaccttcgttccaaaatattgctatctattagtatgcgatttgtttcatcttagaatgacagattcgtcgtctcaaacagagaaattaagtatttaatttgaacgagcgacttattaattgatgcatgtaattcaatatcacatgcatgtctgatttaattaggcaaaattgttttttttgacctgcatacatctaatttaaacatgcttttgaaactttttttttttgcttggggtgtttcttctggtgttttttaaaaggtttctcctccatcttcctacatttttcattcctatgcatgggataagagaagctacatactccgtatcactctagtttctatgtttcttctaccccgtgtttcgaacagagccgccctttgcattaccagtgttccggatgaaaaagccagtttgccaaaaaaatttttaaacaaaatctacttgaatatattagctcgtttgtaaactgaataccctatattctaacagatcaatcgaccatgtagggagtgaaggcggaatgctagctaggcttcctgttgtacaacacagcatatactccctccgtttcgaaatgtttgacgccgttgactttttatcatatgtttgaccgctcgttttatt

SEQ ID NO: 104333 - DNA, 4479 bp, Oryza sativa
gccgccacacgtcgccgccgcgatccattgccgtgatacgcttcgcttagccgcatcagctataagcttagctaagctaagctacctcacactcatcagctcgcctttctacgagcaccaccacgctgtggccttatcactcgatcgactgatcggctactgatcgatcggtgacaggctgagagaaagccaagctaaaacagcagcgaaagcagctgcagctagcaaaggtgaagagagagagagaagaaaaaaaaaagcaaaaccttaaaaactaaaggtgagatcgctgtgtatgcaatcgtctcccaaatctttgctttgccgtgatggttctaatcaagcaaaaagcctcgccgtggcctacctatccgaacattacatgtagaaaccgcagctttagagcctggtccaaagcaattttttttcctgcctgtccgagaagaacaccccatgtgtacgcttaccatatgcatatgttcatatatccatctgaatcctggctttatgcgaaagtttgcttttggttcttgggcagctgcaggtttggttaagtgtttggtcactagagcttcttcagaaaaaggaggctctagcaaactgtagctgtggaatttcgatcgatcgatcacacatgtcgtttttgtgttggcactgctgcgtttcttatccgcgaattaaagagtggtcgtcgctggtgaaatggtgattcctagaacagtgcagaggggggtcaactcggatgccaccaaaaattgcaggataaaaaaatggtgtgctttagataagatgatgaaccaagtgttgagagtgattaggacgcatggttggagtgctttattgcggtgtcttttgaagataatatgttgattatgaccacagaaacagggtggaagcagagtgaaggagtagcatcagttgggcaaatatccagtgcaatccggccgggtgcattggcatagaaaataaaaaattattgaaaaatcgaggtctacactgttaaaaaaaatctggtctaatttattttattagaggatgagggaaaaaaattctgaaaaagaaattggaaaaaggagaaagaaactgcacatcggaatttgtattgcctaacgagttcagattaatttctttgacagataaatccatgttctgtcaatgttattatactctttcatcaccatttacatcatatttttccagacagagggtccgtgcacttctaagagtcccattggttggtctaataaaccaaaggaaaaatcaaaatttgaatttttctaacttaattttaaatttaatttttcaagatatttttgacataatttttttagcgttggcttttaaatcactacgaacaaaaacgttttacctataaattaatttttattctctaatgaaccattttggtttattagggaatatggacgaccgataaggttcaaacttcatctgcctttatatgaggtccgatcgattggcaaagatgtgtaaaatggacatacaaataaccttttggtggtatacaatgcaacttgttctttttttcaacaaaaggtgtttgctatatctcgtgttgcatagggatgttagtgagtttaacgcggactatattctctcctttcttggagagaaggataccacaatttttatgcatttattggattcccttgagacaagtaggagtagttgtttcttcttcttcttcttcttcttcgaatagtggctgtttctcttttcacctcaatcgttccttttctaatcaaatcatgctgataggcgccattacctgtggaggactaactaaaagtaaatgacagccaatcctgtcaaatattaaagactcacaagcacaatcccaaagtgcagaaaccatagcacaaataaattgtggtgcctttttgtctaattaaattactcactttagctcatcacttcatcagtcctttctggatgtttcctttgctacactactgaagtaacattcttttagaccactagtactagtactatatactccctccgatcaacgacacactctacaagatatacctttaaccttatttttctattataatatatacaataaataaatgcatgtttacttttattatagtgttttaaaaaacaaatctagtttctttaaactaaatatttttaaagttattgatggtgaaagttataaaagtttaacctcaaccttattcaaaacgtcaattaatatagaatcagagggagggagtagcacttaaacctaccccttaattgcattggtcaaataagtaatacgtctaggtgtcaagctgctaatcgaccataaaagcagattagtgcaacaaattaggccaggtgtccctacggcttatcaatttgtggtttcgtcgacatgaccggtaaaccggccggtgtacttgttgggagggaaagacaaaaaaacgagttcatcatcaggcagaaacagtagtagcaaaagtaaaggtttttccataatcactaataatgcaatccaaagcttagaaaaaaggcagagtttagtttgttctgatgcatgcaagcactacaactatatagctccggtagtgttgttgaactggatatttagagtgacattgtcctttagttagctgtcgtcatggagcccatgatgtacttaatttgtcgatcgatgatggtatatgtcaatccttgttaaggtagtggtatgcattgtagacggtgatgggatgcagctcatcagttgcccataacatggtcactcacttagtcctggatagatactcttttctttgtactagagaattgctatttagtcgccggccagcagcaaaataattaacaacatccttgagttgatcgatctgtttgcttgtaggcgcaatgcatacgacgaggcatacgggtcatacatgtaagtgcaatatagattaatcattgttagaaccaatataacagattttaggttaattcataagtttgactaaattttacagggaagagtgtattaacgtcaacgacattgataaaaaatgaaaactaaaaaaacttatgaatctaagatgctcatttgatattgtaaatattcttttatatatagaaatttagcttaaatttacgacaaggcaatatatacccttgtatttgggacggtgggagttccggttcctctgcagtaagagccactattgatgtgagtagaacagtgaacaacttcagtgaatatatagtagcactttactgtgactatacagtatgacatcacttgttttaatttttaagacaaatttgattaattgtagctcttttattgtacagtttatccaaaccattcatgacatatcaaacgattgtttccctagtacgatatattgtagatatgtaagaataactaacatcagcacgatactcttgtatgtattagttctagtacctctaataatagagatatatgataccctgttggtatcagatctgatatctatgtaccatgctgacgtcagtatgataccgtaggtatcgaatctgataccttcgatatcaaacatgatactctataggtattaaatctgatatctaggtactataagtactacacagacgtcgttatagtatttcggtatcggatttggtacctttagtactagcctactaggcatgatacaagattatatctggtatcatcatgataatattattatgatattagccattccgttaaaacttgtataccgttttgtagcatttctgtatattttagctctttgccgtattacatgctacggtagtgaatcccaagtccggagtatataccatgtgcgacacacgtgctggcagaacatgctcgatcctggtagtagattcatgtactccagttgttagctcgactgatcgatcgcactcatcgccgaaactcgatctgtcacgatacttgctttaatctcgatcgattagcaaccgaaggggacactcttgaaagtgcaactaatcacatgaacacacagttaattacttaatttctctgtagcaactatcaaacgataaccaaccatatgtttgcatgcagcttgcccacgtacctgatgatcactctcgtacagttaaagttaggcacagatcaccgtcatcacttggcacgtatacgtgtaacacaactacattacccacctaaacacgtgtcacccacgctttgagctcgccgctgtcacgtttttttccatgtgagatgcagttgcctctcctctcctctagctaggacatgtttagttgggaaaataattttaccccttcatatcatattggatataccgatatatatttaaagtattaagtgtagtctaataacaaaacaaataacatattcccttattaaactaaatttattaagcctaattaatctatcattagcaaatgtttactgtagcacaacattgtcaaatcatgacgcaattagacttaaggcctgttcactttgataaaaaaaaaacc

SEQ ID NO: 104334 - DNA, 996 bp, Oryza sativa
gggttaaacatcgatgactgttgttcgagtcgtgaggtggatgatccacctatataaaattataacactcacagatattacgcaccggtgggtgtccattaaatagaaatttaattaataaggttaggatttatcaccatgcatctctcgtcatttcgagcttttgttaggaattgtattagtttgtgtatgaatatggtttatgtggtgtgactgcgtgtatgttatccgtgtaataataaaaaaggcatataggacaaattttgtgaaaccaaataattaaagtttggacggcaaacgtgtattttcttcctgattatttcgatcttaacttgcactgtcgtatatcgacaattcgacatcacgaggagtaaaaggaacacaccatcgtttctgatgtctcaagcagacattgatcagttctctactcccctatctctctcatgggaacatcctactgaccgtcatataaaactggtccgcgcgcagttgacctttgactcccagcaaatttaaaaagaaaacgatttaaatccatctactgctagatgaaagctgccgcacatatatctattcctcatccaggcccccacaccacgcattgcatcgcattacaatgcatctatagggttctgcatttatacttcaacgatgtacagccactgaactactgcagcaagactgtagctgcgtatagaagagtataacaccgttgtcttttttactataactttggatcatcttttaaaaacattaagtataaatatatgaaattataggctattactatatttaatttctttgacaataaaacaagtcacaacaaaataaataatattaacatatttttttataagacaaatgtttaaacaatatacgaaaggttggtataccatcatatattttatgtacgtgatggagggagtatatacttagtagtacatgtatagtggtagttgaacttgtcgaagtatgtacgtatcatgcatgcatgca

SEQ ID NO: 104335 - DNA, 665 bp, Oryza sativa
caacagctaattaccaagtttttgcgatgttatgtagccaatatttatttctggccatgttataccaagttatcatttatgcattgtcacgcatcagtagaaaagcatcttgctcttcatttaaatataaatacatatcagtaaagctttgtatagtgtatttagctaccctgaatagaatgcaagaatattgaccaatttgataacttgacatgtacctgtaattgcaagaacttgaccaacatcctcagacgagaaatttagtccgccaaattgtttgtcactttcagaccatagagaaaatatctaaaatttgatttcaattatcatcaaaggttgaaaaaacaactttactgaaaaaaaattcaaaataatgtgtgcaccatatttttctatagaaaggatgctatgaaattaatcatcgtaagaagagaactcccaagacaaaggagaaaaaaatgcaaataaaaaatattctatacagttataataaaacatatagtagtagagatatattaacatatccatgctatcctaatctaatcattcaatttatatgtaatttccctatgatttcattggtggagaggaacaaaattgaaatcgagtaattcatttgtctatgttcgtattaatgacaagatgtggtgaaattgtgaccattg

SEQ ID NO: 104336 - DNA, 997 bp, Oryza sativa
agcagtataaaaaaatctgttaaaaacattacatcattaaggaaaatcagttaaaaggcattttcgcatatcaatattgcattgcagactgaatgctatgtatctaacacggagtaggacatttcagtgtatgcttctgctgactgttgacatagatgccatgtagtgttgtgaaaatttcagcaaccgaggtaggtaaaaaagatcacaaacacaacgaagaacctaaagatctacaaggtctgaatcagcatcacctacagtcccatcattggagatcctatcaatgaagttgctattggtgcaatgaaagattacaggaattaattatgtgcccaataaggtttggatgactggcactatgacataacaggaattaattgcgtatctaatattgttcgcacagtgatctccctcaaacaataaattttctagttaacataatagaccccccagctaacccacatcacatgaaccaggacgtggcattactagtttgcaactgtaacaccatggacaacgtaatgaccggtgtaaacggtcgtcgtgtgtagtatgagtcggagcatcacagcacattgtaattaacggttgtaagcagcactgaaagcaaatatggagaagtgcgtagtaaaaacagcaacaacatgtcaacatccccctattatagaaatcttgttgaggcaattggcttaactaacttggtcctgttaatctactattatagagaatcagcgatttccccacaggaacaggaatcattgacatgactgaacaccgaccaaacccatatggaactgcacatggacattgcagtaacatgtagcatttgcaagaaagaagacatgttcctacaggtaccaagatccccaatgttgacatgctgtcatgttcctacgtggtaccaagattctctttgttggcgatattcagtcaactcattcgtactacactagaaaaagaaaaatcctagaaaaccatgagttaaaaaaaaaaa

SEQ ID NO: 104337 - DNA, 694 bp, Oryza sativa
ttcttaaaggcaaaaggttttagcatgaaaatatcatgaaaaaaataccaatcttatcatattagagacataataactactaagtccaacaacagagttgaactagaaaagtttgtggactatcaaattcacaagtaaaggaataattttacatttattctgtactaaaattggtatagaattttcatgcaagtgtgttatgcttgttttatttatgaattgtataggttctcttgggcccaagaacgccaaaatgcagccttcttcccaggtatataattgatttacaagttagaaaccaacttctgttgataactatgcattttatagtgcaagtataataaatgtactgcatccttgaaggtactaatatcagatatattccattgatgttgcaggggatcaaatgatattctttgccctaaaatggattgtccccgttttgcttgcggtcaagctttgatgctttggggtcagatcaacattgttgtccgcagtagtggaatcttctcttgatgctaattcaccgagttccgtcaaagttcttggtatagcatgcttgtaaagattctttcttgagttcacaaatccatgatttatccctgttaaagttaagaaaaatcaaatatctcaatgttaaaattagaaatagttcctaaatgtttctttaacacatacctctcaattttgattt

SEQ ID NO: 104338 - DNA, 737 bp, Oryza sativa
attcctgcacccccagacaacaatgatgcaaacaatagaaagatcagagttatggttccttcacaattaatcgtgtattggtataagctatgaaggagcatccaacacccactaatcactacttttgataaatcactaacattaagggatagaaataaatatccagataaaatcaaaatacgaggtaactatcacaaagctcaagacttggtgcatttaaccagccacgtggtctattaaagcaatgatgattttttgttacttatgcataatagtgatgtcgtaaatttacctggaaagaaaaacgcatgttggcgtttttgtgcccaagaaaacctacattaaccaatcataattaatatgccaacaagacccatgatacatatcaagtcaaccattgcattttttataagcagtaatcagcttagttactaaccactcaagtcaaatatttattcattttaattaagtaatccctctgtttcaaattacttcttattctaggtttgttttaatttaaacatttgtatattttgccatcaacttctagacattcatgtagtttaatatcataagatttatgtttgtagattagccttgatatatactttcataatatataattcacatggtgttaacctatacgattttctagaaattaattgtcaagaatagatacgtttgccttaggacaatactaaaatgataactaatttgaaatgaatggaacaatgaaa

SEQ ID NO: 104339 - DNA, 2107 bp, Oryza sativa
aacttgatggaggtacctttgaaatcgagatgggtttataacgaatgggctagacaaaatctagaggcacgtggctaagtctagggcactttcacatcacctttctcctccatcgttgcttctcactcctagttgacaactgtcgccaccacggccgagccacactgtcatcgtcgtcaaccatagccacaccaccatcgacctgcgccctcaataacggtggatctggcgttggtggcctcgggagcgacgaatccgccatcgccaggggcttagcaggccttatcatcaccatgatcctgggcattgggatgtcaatgacggcggtaggccttgggacaccggatctaacgttaggccttagtagtgaggacttcattggcgatgacgactacacactatagtgaggatgtcggcgaggctcatcctacgacgacatgtgttaacgatggtggtgcgagggtgtcaacgccagcagttccaccatccaccaaggtcccgaacgaccacttgcttttggaatttgtgaatttttgttttggagtttttttttttgaatttgtgattgtgtctataaaaatttgcaggttgtgattggatcggaattcatgaattgcaggctttaattttatctaatttttcttctttttttgccaacaggcaagccactttatagtaccacctggaaatactaatttttactggtggttccatccgtagaaattgttttcacatatgggtatcttaatttaaccgtctataaaaaatatttgtagacggttatcgaacttcacaatttttaatctgtcagaggcatgtcgctcaaccatctctacaagccgaatttgtccgctagtgaaaactaatttcgcatcagtgcattgacacaatgacaccacaaatagccagattccattggcaggtttataaattcacaaaacctcaggggtatatatatgctattctcccttaatttaaaatttaattaagcatcaatcgtgtaatgggcagtacgtgtacgtctagtaaaaggctggcaatgcaagagtgctagctacacatatgtgcttaatctctaataaagtgctctctaactttgccctttataaactagaaagataaaagtcagctcagcttctaggcatgtctggttatacttatccggtgctcaacaagctaagacaaaggtcactgttttaattctcacctgataaaaagcaccaagtaaatttgttttttttttgggggacaccaagtaaatttgttgcatatgaaattttacacatacatataattttgttactaaaaaaataaagaagtagttaaacacaagaatgccattaattatacttcaaatctcacatatatttccttcaaagctcttacatatatatacatatggcgtatttacaaattagggtcccagtgctaaacatagcgtatatctacaaatatacaggtccgatatcatatatatacacacactgcaattacccaacaataggaaaatgaattctgccatatcattaaactccatagctagctcacacatatacatggcactttttgtacgaagactgtttttatttcagaaacgtgcgtcaacgatcttgcggtcaactccatcgtaggttcatcgaatccaacctagctttaactccaaaaacacatcattttttttttgaacattaaaaacacatcatcaaccccacatatctttcctcctagaatctccccatccatatcaatgatatcatggatatggtacatctccacacagaatttaacacaaaaggggctgtttggttcccagccacactttaccattacttgccaataaaaattgccacaccttgcctaaggtgaggtgattaaattgttagccacaacttactaagcctaagggaatcttgccacacttttttgagccattgacacgtgggacccaatttgttggaggggaatcttgccacaactgtggctacaaccaaacacctgtcaaatttgcctaaccttaggtgtggcaaactgtggtaaagtgtggcttgcaaccaaacacacccaaaatagttatccaaactcccaaggcagcatctcagcaaccatg

SEQ ID NO: 104340 - DNA, 644 bp, Oryza sativa
ctagcatcaattatcatcctcctatattcatgcattcacatttcttccattcctctctcagttattatggtctccaatgaacttgtcaccatttaccaaatgacccagacagcaaaagcgctaaactcagtaaccaaaaaaacgaaaatctctacctgtacatacttcaccgcagggtgctccatgagctgccgcacgcggcgcgcgtacgcgagcagcacgtcgccgaccccggccgcgtccaggtcccacagccgcacgtcgtggcgcggcgtctcgatgaccacgtcgtggaacccgaaccccaccacggcgcgctccccgggcgtcgcctccccctcccccgcctcctccggcgccggcggctcggcgtcgcgccgcagcgccgggtacaggttctcgatgacgcggatccgccagggcgacgcgtcgggcggcgccggcacgcggaagatctccggcgcgcactccgactcgcggccctggcagaaggggcaggacggcttgggggcgccggcggcggcgccggcgccggggctagggttggcgggggcgtgcgacttgaggtcggtggggcgccgcgagcgcgccggccagaagactacccagcggccgaacacggcgtcgcggcgcgcctccgatgt

SEQ ID NO: 104341 - DNA, 947 bp, Oryza sativa
atcttccttagatggcatcggctcacacaccatggtagtctgtacaagaactttctctaactggtgaaggacagcatgccaacatagaccctgtgtgagctgacaaggtggcgcttgagtggagcctcgtcatgacaagcaaagaaggccgctactgtctgccataggcactgcttgaagcaaaagaaaaaaaagggagggaacaagaagaatatggcatgtgggcctaaaacatgggatgagggtagggaggccaattttgcaaaaaagttggtgcgtttttgtacattaatggcaggagtatatacagagttaatggcaatggcatataaggggcataaaatttctcctagtggcacagaagggaacagctatttttgattggcatataaggaaaccgatatgatgtagaggccgggttgactgcgacagacctaaacagctattttcttcccgctaatttttatggcgggctgtgtacatccaagttggatgtagaggccaggtttttactccgttttctaaaacaatataaggaaaccggtatactttgagtgacacaaagggattttttttcctaatcaaaagcaaacaagccaccagggcacaacaccaagcatctaaagcatctttagataataaccgccaagcatctgggattctgggtatcataatttcataccgattctcatgaacagatcaaactgctagaaattactctactctttctgtgaattgtgtcttactactctacccttacaattaaaatggcaattaaattagtaagccaaaaataactggataagtgtccagtataaactgactaatatctgggttccctcaggcacgacaaagccttaatccaaagcaaacaagccaccagggaatctaatcatctttttttagacaacaaacgccaagcatctgagtatagcaagtgccaagaa

SEQ ID NO: 104342 - DNA, 600 bp, Oryza sativa
caccagaaggcatctgcagaagaagtttgaataaagcaaatatcagcaaaagcttgacatgttaccctgagagatacatttaaacgattagcctatcatactagatagctaacaaacagctaatggaaagaactgataggctccgtctagaggaaatgctattcatgtaattgcttatagctttctcagataattgttgaactaaatatgctggggttttaagtcagctgtgtattactgtatttttcagaggaactgaaatagtttggagttttgacacaacagagggagcaactaaagagaggatgcactttctcctgtgtattatttataaaataaacaataagagtgctcctgtacataacattatatgcatgcttaccttgattcctaagcaagccaagtgaaaagttgaagggcagttatcgcagcagagcaaatcgccaccatcaccacaaatgccacaagtatcatcatccggatcatcaccaggatctaccttgtaaaaccctttcttttcagattgtgattgcttcttccacgcatcaactaagcattgtgacaacgtagccccaccatcttccagaaagatgttttcat

SEQ ID NO: 104343 - DNA, 614 bp, Oryza sativa
ttcataaaaccctaggtttttaggcgtccgtaactcaaaacctcaatttttactttgtttcatgaaacccctagattttgagggtaaaatggttcattaaaccccaaatataagctttatatcatctttcaaactaatattgtagtatgtcattattagttgggattacgttgagtttttttttatgaaaaactaaggaaaaaaactagtcaagatctagaatgtgtacttcaagtcaactaatataaatttatgaaaaaaataattttacataaatatgaggtattcttcaaacattttgcctcaaaacatgagctttcttgaaaagaacaacaataataatgggacttttatgttatggtcctatggacgccccaatatctaggattttataaaatttactctttttttccttgtccccttagatgcgtcgctcctaaatttaggattaatttcgtaaattttgataagcacactagctaatttcttccaatgtaggatgtagcagaaaaaatagaggaaatgtatttttatcagcaaaaagttttccacaatacaaaataaagtgtgacgtggcctgaataataagcacgaaaaaaatgacgtcgattcct

SEQ ID NO: 104344 - DNA, 647 bp, Oryza sativa
tttatatagttgttaatgaatctagatatataaatatatctagattcattaataattatatgaatgcgagaaatgttagaatgacttatattatgaaacggaggaagtagttagttagattttttttccgtcgttctcgctttttgagtgtgggttaggagcacagtcaaagtatgtgcatattgtttttttattcctttaaatataaataacctattattaataatttttttattttttttgcggggaataaattttgtatttgattgtactatctgccacggctcgattataaaagttgatttgtaatggagctgagtaagtagtgataattctcctacctaaatacgcatatgccgtgtcattgtaagtggtcaaccacgcgtctataagattgatccgattagcagaacaaaattcttccaacgcacgaggcgatcgaccgaccgagcgcataaacacgcacgcacaattattggccggctccgtgccctccgtgtgcctcaatcatcatcctgtcaacatgcatgagacgtcgttaatttgtactatcgtttttctttaaaaagaatatcaatgtggttttcacaaagtagatgaattatggattccaaatttctatcacaccttgaaatgtgcaaatttta

SEQ ID NO: 104345 - DNA, 620 bp, Oryza sativa
cactccatgctgctgcaccgtggaacaagagtgataaaaaccatgccaatcatcacaagagcaacagtgttcccgaaccactgcaatatatatgtcaagaagagttaggaaaaagtaaacggatatgttaacttataatgtgtgaagaatctttgttagatccgggcaatataaacgtaagcataagaactttcaataagattttagtaatatatttatggattatcgtaagaactcttgctccaagggtgtcgccgtgtcggcgtagtggtaggtcgtcgtcgtcctccatgtaatctcaaaaagaaagaacccgatttttttatatctaaacatatgcaacccagtattttggaattatgattctaaccaattaacctacccacgtgaccaccgtcaatatccggttgattaggaggacctaatgaagtatatgagctatttgggttttctttatttagacttaggtttattggcttaattttttaattcaacttattagcttacatgatttataaggcggtgaatttaatatcctaagtttagtgatagagttatacctctacctcaaataagcaaaaaaaaacttatcccacttagtttttggtttaatagtgttg

SEQ ID NO: 104346 - DNA, 1041 bp, Oryza sativa
ttttaaataggctagaatagtaattgctggtgagtgaagatgtggcatacttggataggattttaaatagactaggatagtaattgctaatgggtgatgatgtggcatgcttgtatgttaagctttagcttctaataattgttaatgggtaataccaactatatagaaagttagatatgtgatatatgctttaatggtgtttttttaagtatattgcgttagtaagtgacaatgacggtggatattccagcatataaatgagatatgtaaagcagaacttaaaagtataattgcttatggtatattatattcccatagttggagtacttggtcactatctataggaataaattgttggatgagcgtttgagaaaaatattatatgattattagacgattcttcaaggaaaaaaagaacgattatgtgattgttggtttagagggaaattcggaatcatgtgactcgattcattattatgaaaagcagcccacatgctttatctaaataagttgaattcacatgctattattttaagtcgtgacatcctagttgttttcttttttatgggtcatgctagttgtttagcattatcttttagaggagtctattataatctactttgcaggttttgcaaggacttgatttcttttgttcaatttgtagagtatataaagttctttgaaggggaaaatccattaaagaaaacataagtcaccatccaacgtatgcttatttgtaagtacctttttccttataacttttggctcaacgataaagcacatgactcaagatattttttctcaagtcagtaaattaaatgaaagaaaaggtcaagtaacttttcattggagaaataaattaaatgaaactaaaaaaagattgtccaaccgaaaaaggtgagtgacttagcctaatttgaatgatccgaagggatggcacattatctgattttgtgataatgtttgagaataaaatgaattaattgactattacaaattttaaaagttgtctataaaagcattataagcaacaatttataa

SEQ ID NO: 104347 - DNA, 2330 bp, Oryza sativa
atggatttgctggggaaggatctcactcaagttaaagaatttgagccaaggtacatacattttttgttcactcccatgtttatttacttacttaattactgtttgttgaaatgtatggtgaattttggtgtgatgtagttgttcatcaatttaggtagagacggcttgttagcagaaatgtgggatgtctctaatctctagaggaatgttctggtcttaggtaatcgcttcacgcgtttgctataagtcatggtcatttgtagttggttgatattaggggttcattatcaaaaaggctgagtcaatggttgttttttttttgccttctgtcccttgatgatggtggacttcttttgttattccgatgtagtggccgtgtaagatgataatggggcaagtcgttaaagtattgtgcaactctactatattttgactttggttttggtgtgtaagcatagatgcggctgctgtgagcacagtccatctggtcatcatcagattaagaaattagatggctggggtcatactctgaagaagtaatatcacaatacattactaataataaaaccccaatttgtcgtgcttggataacggtgaagaccaagccatcttcttcccttattgggtagctgctctagattttttttcttcaatgtgtccaaaattggcggttttcttcaatgcagcaagaaaacataattgaatatccaaattacatttgtcgctatctatatttgtgcaagaccacctgtctaaattgaggcctagccactttgcactgcactgaagttgtcatgtacttcgcttttggtcagtttttctttgtaattttgggtaaaatgtaaacctgaagctctgcaagagatttgatttttaagactgagatgtatccatgcagcagccataatcagatttaaggtgtgacatggacatcatctttgtaaatataggtcatgtccatctgtcagtgaaatgttctgaatatgtgctactcaactaattaattataagtgcatttgccaagtttactctttccagatatttttcttctccaaacttacacgtcaaaatggatatttgattgtcaagctgcaagcaatcttttgtttttgtcatttctatctaaagaactggttaactgttttttcctcaattagtttgcagcaaaccaagtgggtaattgtatatcaccttgtatgaccctctgcacatccaagctaaagaccaagcaagctttcaatctagatcagcagattcagcaccatctttattaaaaaaaaaaaatcaatgcccagggcggttttgtacatgaaccttcatttttcagaaaaagtcattgggtttgttgtggattgcttccatctgctttatattatcgtatcatgagtggatacattgaatgttgattatctatgtctttcacatttaaactagtaatggcacattaacacaaacatctttcatagtcttattctatgatgatgggaacagcataccgacataattatccgttgttgtgtcgctttcgaagttcctttccctttacagctctaattgatttgaaactctccacgctaagtagtgtatatccttgattgccatgactgctcaaacctcttattacaaaaagatcaatgtatcattgttctttgatgcttatactacattttcttgcgtgcagcgaatctggagactcggatgacgaagacggcaacacctgcatctgtgtcatccagtaagcagccccttggagatcatccctgtaaattctctgaaaggaaaaaccgaaaaacaagtgtctgggtcagccattagttgtttatttgtcagtagagagatcagagagccccccattgtgtcgttggtttatctggaattgtggatggaattgggttgtgttgtactatcaatcagcagcagcttcaccagtacatgttgcacatgcatagagtttagattttagaagattcctgcaaagatctgatgattatgttcttgtctgaccttgttctggtaacctggttggggtgttttggtggcagtataatgattataaccagcattgcattaggctgactggattggctgaaatgtgggccccctcttctgtatgcccagcttgatgggctggtctgggctgggcttagcttgggccttaggccgcccagtctgatgacaccgtccggtccgaaactattcgggattcagacttccaggccaacttgattcataagaatccacagaaattttagattaagccctgtatttctcctgaatcctagtaccatttggacgaaaaatcctgtaaaaattgcttgtgaaattaccct

SEQ ID NO: 104348 - DNA, 635 bp, Oryza sativa
ttggtactgttcatgtccaaagtttgaccgttcgtcttatttaaaaaaaattatgattagtatttttattgttattatatgataaaatatgaatagtactttatgtatgactaatttttttttaatatttttcataaatttttaaataagacagatggtcaaaatgctgaacacggatatctatggctatttattttgggacggaggtagtaccaaatatgccctgaatttgtgcggttgttgatataactaaacgggcctttatcgggccttcggcccatgatctctcttcctctctgcttgattagtactccataattttttttttgttttattgttctactactctttctggaagaataattagtatgctgctaatcattatcacgagatggcgatggcgatttggtagattattgttgatgcaattccaagatcagcatcaccggcgacagaaaacataatcagaatatcagatactccaggaatcaaatattgggctgataaacgatgagagacaaatatcaacgatgctactggccaaagttcagaatccaatgttactggatttggaatatactacctacctgggctcctgagggagaccgagctggatatgtactgtacaagctgat

SEQ ID NO: 104349 - DNA, 1605 bp, Oryza sativa
atgtgtgagcgagtgacaggtggggtcgagctacgtgggcccggtgcgtcagtgattggggtagggtgggtttgggtgagagatggtggtggcgggaacgggaggtggactcgtgttacggggttggtgggtgtttcagtgagtgacaggtggggtcggattatgtgggcccgatgtgtcagtgagtggtgtggggtggggtggtgggggtagaggtggagggaacgggtacgagctgggtgcacccgataagcgcacacgggtgattgattggttcgttaggatggctgctgccgacgctgcctgaataagagcacctgcaatgataaagtaggtgttatctataaaatataaaacatgtacatctcaacaatagactaaattaatagtaaatcatctcaatattatgtctacatgggtatctatagctctctaatacattgcctcgtttttctctatagactatctacaggttagtagatagcttcactctctctcttcatttaatctcttccaggtaggaaaatatgctgacatggatctcttatagagagcttatagataaccattgcggatgccctagccctaagggcagtcccaacccataacactagacatggtttccataaactctacatcataaaaaaaactagtactggacactactcttccaatgcaaacactactattccatactccctccattccaaattgatctacatatttcataggtataccaagaccaagaaaagctaataactctcttatactatatttactctagcaacaaacttaatgcatgcaccatccccactattttctagccaatagcaaatcaagatattgcatgtgggttataaatacttgtgtgcatggatgcatgcatcaatgtccatttactccaatgcacaaataacgaatagacctaatgaatgaacacaaatatgtagatcatttaggaataacctcaaaaaactatatgtagatcaatttggaatggatggagtacttcaatttaatgctacttatctcatatgatgtcttggatgttgtgtagaaaccatgtctctttacttatttattcacttgccacatcattttttgtcctaggtggtaacttatttaatgctatggacatcatcctagtcattgggttgggaatgccctaaccaccctcttaccaaattggccacagtaattccttgactttgatggtaaccaatgctgccctctttttgattatcatccttgttggaatagtttaggacttgatgcttcacctaactgtaatatatatataatatataatgttcgatagcattcattcgatcgtggtgcagtcagcccgtacaacgctttgtgtcagcagctacgatagtaacaatgcattgcgatggttgtacctttgcagtcgaacatactctttcattcaaagtttcaaacaagcagaagcggatggacaactgcccatgatttttgtagcgataaactataatgaaaataaattaatgtggataaattactttgatggttaaacttgtttctatctatatagtttaaactagggtttagaaaactcccacaccactactaccaacagcattg

SEQ ID NO: 104350 - DNA, 925 bp, Oryza sativa
ccatttttttatataaaaaaaatagaagcagaagcagccagcagctagcgaaggtgtatttgtctagctgagctgatgaggagagaggccgggaggcaattgcatggactggctggctagtggacggttgcgggacgaaagcggcgtggcgcgaggcgactgggcgcccacggatggcagggatttccacgcccaatcaccgcttgccgcgtcaaccagttgataagaaatacggatcacgcgcagatttcatccttccctccatcaacacccttcgttgcgcgtgctattgttaattttgttattttacaccattaaactattttattgcttcacttaacatttattttttttctcattttacatcttcatacatgtccaactgttttagaaccctatggacctttttttttctcattttacatattgaactattgaaaatcaaacacgtaaccccttaaaggtatttctcttttttctctccctctataagtactccatatgccctaaaatataagagattttgaccggattgatctgctttgtaaagaattccttatattttgggatgggggctgtatcattttgcaatgaaatttggtaggattgatatatacagtataacttgcctctcaactttgtttataatttttctaatcaccgtttactagattggaagctctgagactgatttactttgaggtttgaaatttcaagcatttagtcatgaaaaaatttgaaaatattttggaatgataatggtgtcatctatggctctacaaaattttagcttaaatactactcgtataaagagaaacaaagaaaaagaaatacaaaagtttagtttaggggtaaaatgataaaaaaatagtttagtgggttaagcgaaccaatgaaatagttttgggagtaaaatgaagttgtt

SEQ ID NO: 104351 - DNA, 679 bp, Oryza sativa
gcagagaaccccctacactagtgggtatatagtatgtacactgctatacaaatacatctaacaatgctcagcctaaccaactagttagagtagggatcaagttaatagtgtctctgccttgagttagagatggaaagctttgagaagaagggtgtccacttgatatttgttagaaatctgtttaatcagttcacgcgggtctacttaaaaggttgccagattattgtggatgtaagcaagaaatatgtaaaaggttttcttcaccaatcgattatgatcagagcctcccatcacaaccgcgagccaacctgccctatgcacgtctcatattcttccccacacataacataaaggaaacaaaaagttgtgaactaattaattacctactttttttttctaaaagaacatattatagtgcatatagtttgtatgtagtatgccatatgcactataactggataaaacttatttgcaaatgctggaagcttacctactcttttcatatgttgtctaaattatttgcagtgaccgtttacatctagtttggagtttgtcttcttctgctaagcaagattcatttggccgagcaggattaatggctcttgcattttgtgttgcttcatgcgcatgtcatttaaatacaaatgatttaccatgtgattatgctgggcaagaaagg

SEQ ID NO: 104352 - DNA, 563 bp, Oryza sativa
ctgcgggcgggtattaggattatttattaatccttagactgtttctcttctagacttttgggcttatgtaacttatagcatttagtgtaaactcagcactagcattaagtgtaactcttggtcttttgtatcactaactgtaactcagctatatatatgagttttcacctccacactttgtgtgaggcatctattctacttcttctacaattacaaccgattagtacaagtatatacaagttgtagtatcaagcttgatattttacctcactgattcaatctaatctttgcagcttggttttttgctcttggcatgcttttggaaatttgattttcctccatttttggttcttgtgatagctattcttaatgatggtaagaacattgctgtctgcactcatcatagaggttaattttattaccaaaaacaggacagactcctattgtcctatcatcatagatgttattgctcaatgaattttcgtttctttgtttccaatgatatctgctactcaggaaccataatgactatatccaaagataaggttaaaccatctccctat

SEQ ID NO: 104353 - DNA, 695 bp, Oryza sativa
acaaagaaagaagatttatggacttcaaccagtgtgaggatagaaatcttgtacaaaagaagaaaaaaaacaattacaatacctcatacagagaaaaagagaaaaggttatagatttaagttgaatccaatggtgtgtatccaaatggcaatagctgtaattataaggataggaacagtagttgacttggttgagatatcaggttattggtcggaccacatgctattattaactacattcactgagcttatatgatgttcaaaacagctatgcaagaacaaaagtacaaaactaatatttctaaggcacctagcaaacccaagcaggaggttatcatgtgttgtctttaatacagctacagaaggttccaggttcaaagcctggtgggtgcgctttttcatccaatttctgtgaggtattatggataaacttgggttgacccaagttaatcaaatgcagaaataatctgttaacatcagaccacccagggtcttgcggcttacagaaattgcaaaactgactgcttttcacatctcgatcaaaataaccactcagtatttcaacagaacagggaaaatccactttacgttgcttgctgacaaatatgcaaatattggactcgttgtataaactgcagtcttacttatcttactccatatgcactttaggcttacagagaaagtatatagatagcc

SEQ ID NO: 104354 - DNA, 3670 bp, Oryza sativa
atgggaaaatttcagtttgtgaaggtcaaattcccttttgccgaggaggcctgctgccaaagcaacgcagccacattttcaaactgtttgacattcctggctgcatgaatcaaatgtgcacatgactaattataatactgtagtaaaacatggcgagagagagaaacaattcaagagctgcaaccaaaagccaatgcagaggtttggcagatcagagccttcgctcgaaaaggaaaggcaagagttggcttgggttagtacttctgttagattagtatactgttagagcaagtttaatagtatagcacactactagctctaaatcatctatagtcaatgtaatagccaattcatacaataattgcttactatactattaatacttggtcccacatgccatacacacattacgtcttggagtccgtgctgcagctggctatagatttgtagcccgctgctcttctctctcttcctttatctcttcaaaatatgtttacagctggcttataacccgctattgtacctgctcttaagagcatctccagcgtgaatgtaaaatcgatttaaggtagataaaagcgaaccatacacactgtggcagccgactcatggtgtcagacagaaaaatcgaactccaagttaagtcgaactctagagagttaaaaaaatatttgttgtctgcatagaaagtagacacattgattggttgatggattctttttgtgggccccacaaattgatttcacactgcagctatcgatttcactcttcattcgacttcaaccaatacaatggtcgaaccaaacactgtggttgctctaataacacttcattatctaaaagaactagtataataatacttgggagctgaaacttgagaagcataagtaccaaccttgaaccttttggtcgtcaaacacgaggaaagattcgactcatttttccttgaaaaaataacacaaagcttctgccaaacacattacacaattcataaacacagtttgatcctctcaaaagacgaacaagaatcacggttttgatcgtaagccatgatgaaaactgaaaaagccagagtaaacaagaatacgaacgatttgtttttcattttcagaggacgggaactgttgggaagttgaaaattttgaggcgatcgacgcctcaaaaattcaacgttccaagcagatggattggatttgaagtcgcaacaaacggaaaatttcaaacactggctgccagagcagtctcgatcgtttcttggtcctctcgtttgcatggctcacgtctcccttttgacattcaggcgctcctgctgcatcgcacgcttgtcctgcaatctaatctaaactgaatccgaggcgtgatttctagtgatatttcgcgttatccctgacacagccacatgtttgatgcgttcgtacggatgtcaggaaggtgaagatttgtacacaagcattggtcaaaatctcaaaattcatggaggcctgctaatgataacttgaggctctgttttgggacggagggggctctgtttagttcaaaaaaaaactttttgcgaaaacatcatatcaaatctttagacatttgtatagagcattaaatatagataaaaaactaattacacagtttgcatataaatcgcgagacgaatattttgagtctaattagttcataattagtcataaatgctacagtaaccacacatgtgctaatggtggcttaattaggcttaaaatattcgtctcgcagttttcaggcgagttatgaaattagttttttcattcgtatcaaaaaccccttccgatatccggtcaaacgttcgatgtgacatccaaaaatttttatttcaccaactaaacttgaggcagctgttcaggtcaagtttgttcttgcaaggagatcgatgattatcgagcctcatcagttgaccaaatcggtttattagtgataaaaataatttataaataatttttttatatacatttttttaacaaaatggaaaccaagctatgttaaaaagaaatgtacgctatgaacacaagttttcatgtagataccatgcacaccaactaataaaatttttttaaaaaattagaaaaatgtgcatgtacttccaaaagcgttgtacttatatgtaaatctttacatcaaattaattatattttagccgtaataaaataaaataaaataaaatttctaacatttttaaggataaggatataaatcgatttgatttttttctccatttatagaatggatttgaagataagattttacacataaatataaaatatgatactattaaaagtacatgtacaaattctttctaaaatttttagtgaagtttattagttgatgtgcttcgtgtgtacacgagaatgctgctatgtataagatatgttccccaattaaaatacttaaaatcatttttaaaaatttaaatttcgatagctgttgaatcttttcgggaaccgacgaggcgctgatggcttgctgttcatattggattttggaacgtggtcaggatgctgatgctctgcatatagatcacgtctgatgcacttgcaagtctcttcttgttctctcctacacgtataccacgttttttatgcaaggaaataatatatcccggtttatatatttagagttaccaggtccattgttatcatgcgtttctgtcttctaatcaacatccatttgcagattaccggggggcaacatattagttgcacgtgcaaaagcacgctggttgaagaatgcaaggtaaacattttgggtgccatattaataataactttgcaatgtaaaaatgtactactataagaaaataacgcaggaaatcttcttggtaagatgccttcacattattttcttttgacgaaagtattttttttccttaccgtgacgagcattaattctatatctatatactcttataaaaacccatagtagtggtggtgggttcacccctaccacccccaactaacacgtggatttatggatcccacttctgtgatttgcttactctcttctcttcagttttcagtcatttgaaatttgagtaagacgagaaatttcactcttttacttttgccttttcatatgaaaatcattgtttcatcctaggagaggtaagatattgtattcttaccaagagaactcacagtgttatgttttatattaaataaatagttgcaatgtacgggtattcacagcaatgtacgggtattaaataaataacatcacacaagttttttttttctttcatttttgcgattgtcgtccgccttcttacgacactcctttgaaccatgaaaaagggaattcagttcactgataacgattcatgaacctcatgtttgtcagtttaaatagtattctcctattttatttattatagttttctgctgtaaatgtacagttttttttttggtacaaaagctacgagaaaacaaaaggagaggtgcccacgtactacagtacaacatgattaccaccgggaccatgcatgtatggatggttcgtggtgacctggatttttcacattttggttcttttgaaaaacttatttcgtaaatagacccttgaaaaaacttatcccagaaattgtccttttttgggcgccagagtggctggtgtcgtcatccaacgggacggcgccagagaggctggc

SEQ ID NO: 104355 - DNA, 684 bp, Oryza sativa
tagctaaaaggaggccctgatgaatcattccattgcgagctgagctgagctgaaaagatgtgtacccgctttgatatatgccatcctgctccatgacacaatcagaaattatatccatgcatattctaatactcctcccgatttcttttagttcaggtccaaactgccaaaagagaaagacagatcaaactaattcttcatttaatcaaataagaggaaaggcttgtggtgcacacatactgcatagcccaactgttgcttcgctgtgggttagcctttgagaggtttcattttgcttcctttccctcaggtttggctaaggacctgcttgctttgtagttaggggatctgattgtctaagtgtatacctaatgcatcacgtatgaattgtgaaatttaattaatcgggtatgtgtacgtacgatccatgtctccagggcctactgataggtgattgatgaggatgcacggctcctgctcgtaaagtatactgatattgcgaccggttgataagttggatacttggatccaattgtccgcagttcgcagaatgcaaactagtactatcaattaatttaaacagtagtacttactttgtagtagtaagttgtaacactaggtttatttcttttcagctacaggctaagcttattgtggatgtgtcttttaaattgttaaacggcg

SEQ ID NO: 104356 - DNA, 1345 bp, Oryza sativa
ttggtgtcataacgtgtctatcggtatcatagtatactaattatacttagatcatagtataataatatatggataagtagttttgttataggttttgccgaaagtcgtcggtgtcgcttgacaccggccctattactgtagctccgcccctggtttagatcactttcgcacactttccattagtcgaccgtctttagatatagaaaaacaaatttgtggagcatattgttggagtgtagagattgttgtatgagatttgtaaatttatgagtttgttatgcgaaatattacttaccatacaaaatttagatgtggcagaaaaaataattctatttgtttttagttattaaaaaatatatatgtactccctctgtttcacaatgtaagtcattttagcattttccacattcatattgatgttaatgaatctatcaataaatctgtctagattcattaacatcaatatgaatgtaggaaatgctagaatgacttacattgtgaaactgagaaagtagcatattttcttacactagttgtatattttatttaaaatattgttctacaatgctaatggtttcttttccatttctttaaaaaaatgctacacatacttttctcgaatattatattaaattttatatgttcccccttatggatattatagtcaaacaacaaattgccggcattagttttctcaaatttacatagtccttgacatcaaattgattttttttcaatatccactaaacaatcaactaacaaaaaggatacaaaagagataaaaactaaaatccagggatatataagggaataattaaaattcagggcactgaaggattggcaagcgataaatcccttttagaaagaaaatcctactaataaggaaaaatgacaaattaaacacgaattaaagagccaccgtaatgcatgccaaaacagaccgtgatcttgccctgacacacaattaacaacaataaggaactgtagctgttatgccatcgcgatcgtcctgcatatgagttgttagctgtgtggaccctgcatcacatggccgcgacaatatggtgcatccacgaataatggccgcccctagctaagatacgattcactaatcatatacccgaacgaggtggccgaagcattccaaagcataacaacacacaggcctggactaaaaattaaggtttcttttgcaggaaccagataaaagtttgggtatataatactattgttactactatattaataaagtgcgtgatttgacaagggaaattaaaatacaaaggacccagaggccggataatctttgtactgtacgtcaaaattaagcgtgcgctgccactgg

SEQ ID NO: 104357 - DNA, 721 bp, Oryza sativa
agaaatagaacattcaggaatatatacttcatgtaactttagttcagccaagtatacgcaatagcaggcttgaatatgcacatggagagaggattgtgttgcaatttgtgtgaaatatatcaggtccaaaaatgtattgaaaagttactgactatagaagaagaaagatgaaaatgcccaaaagcttatgatgcagtttgttctcaatagacaaagatgctttcagaaaatataaactagacattttatttcaaaattatataaattgtgcatgccgaattgttttttgatggatgctcaagggacaatttgtttgtaaatttgttattgagaaatttccacatgtatatatagtccacatttccttatatggtaaaagataatatatgtgcgttagatttcactctggtattaacatggctgcatgtccccttaaaaagtcatgtaggtattttagaagcttgcttatcagagaaaattatagaattaaattagcagctctccgtacctccaaatttaagttattctgaaccagatcaacagtgttttgcaatatctctcttccctgaaagagacatcatagcacatattaatcgcaaccagcatacttgtacaacatttttctttttcttttttcttttcgaatttacttctgaggaagagtaaagatgttctcacttgcagtgtaataagctcagcaagtggctttgcataaaacctg

SEQ ID NO: 104358 - DNA, 705 bp, Oryza sativa
tctggactcgggtgtgtgggggaagaaaaagactttgccctcttctcgtcttctccatgtgatatgggctgcttgtttgggcgtgggcggtgggccccacccgagagattatccagacgaaatgaatgaggccgtcatcacagcctgtcaggccgtgttcggatgggccgaaatgtcaagaccggttcacgtgaggaataagttcactgtaagtccctttatttgtcgcccagcctaattttcgtccctacaacacaaaaccggatacaacgcatcccccaacttacaaaaccgtgcaaataaggtccctcggtggtatagtccctgattttagctgatgtggcgctctttgactaggtctttatccaatgtggcatcgacgtggcgcttacgtggcaattcgatccgaaaaaaataaaatccatagtatccacatgtcagttacacataaataataaaagatggtgggacccacatgggaactctaaaactgagaggagagattttttttttgtttgtttgtttaccgtccgacctcgctctagccgtcgaccaccacgccgtcgacagggacgatctcgccggccctgaccgcgacgacgtcgcccacgcggacgtcgcgcacgctgacgacatcgcccgtcgtcgcgaggaccgccttcgcaggtagcatgcccatcaacgacgacatctcggcactcgcct

SEQ ID NO: 104359 - DNA, 1179 bp, Oryza sativa
gaccattcttgaccaacgtgaagctaaaaatacaacagaacatagttggaattgcagatagaatgtaccgggtgtactggtccatgagccccaaggattctctttacaaaactgtcactaatgagatctccttgacagcattcctacataagagaatggtggaatagctaatgcaggaataactaagcatcagtttcgaatgaagtataagaacaatgaggcaggaataactcacatctgtttttgcttgcgctagccaggcactcgtgaaataagcatgagggccaagggaaagtgcagcgtggagaatcgtgacatgcttgcagtaccttatgcaagttactttgaccaataaggcaagccctattgcttgagagcacatatgccagtttcctgtgacacagcagttctaggccatcaatgcatggaatgacaaatgcttgatatgcagaatggtgaaatgatcaaaatacgtggaaagaaatatacagtgaagtgatgcccacactcaggccagatcctcagcctcagctaaatccccagccatttgaatagcacggaagatccccataagaatgggaacagaactggtattgtgaccatgctcatcatccatttcagatgagtgttctcaacatcataacaagtgggctgccaatagaacaaaggagaaagtgattagagcttcaaaaactcccaaacacatgtactaactaaaaatccgaaaagtgttatgcaaacatctcaaacaagaaaacacctccaaaattccgcagagatcttgttttcacataacttcatgggaaattccttatcatatgctagggtatgggtcaagaaaaccacggcatacgctggatggtctacaagtgactctttcctttttgtgttatgatgaacaaataatcttctttgctcctttagcacttcagttaagtaccttgtcgactagggaaaatacaggtcaaaagaaagaagacaccttaaagcatacaatatgagattgtatagtacgttaatagaaacaagaacagaagacacctacttcagtacgaacatctctggagcaatctgttgatgccagcgcaaaagcacatgcatatttaataggaattgcatgttccattataaggtcatggagtttgcagatgaatgacttgcgaacagtatatgaagaat

SEQ ID NO: 104360 - DNA, 657 bp, Oryza sativa
tgtcagcgatggagaaggacatggttgctctggcctttcgacacggtggcggcaagcaccaggccaactccatctcctcgcctgagctccatgtcaacctcatccgggagctcgaggagcggctcgaggtcgtcccgtgagggtagaagggctaagcgctttgggagcctatatcgcgtggataactactgtgagcaccacaccaccgccttccgccttagccggcactcccgccctcgatgctaccatggtggttagatcctaatggagaaccaccgcacttcccgtgtgttccataccacgctgccctccccaccatccctcattgccaacccccgcggctgcaagctttagcaaggtgctggtggtgggcaccttcaaatcgaaccccctccatcttgccgctagccaccagatgagatgaagagggttgatcggcctgcatcttgccaccagccatctaacaagagactaaaagtagaggggaagagaggaagaaaagagtgaacacttatacatgggtcccatcgttttttttttctgattgttatgccatgtagatgctacatcagatgaagaccaagtcaaacaagtcacttaggctcaacatcatctgaaaccatttctaatactaccgagaactcgattgcaccggtt

SEQ ID NO: 104361 - DNA, 676 bp, Oryza sativa
catttactaactaatgaaaacaccactataagatggcgaatggatgttaaggagtacttcagtgtgatttgttacgagaagtctcatattccctccgtcctaaaacatctatttttgtcacggatagaataactcataagctagcgtcttaacaaattttgcactatagcacacattgttagatttattaattgatggacatttttgtattttttgcctaatatttaatacgagttgtaataataaaacattacatagattccccgtaaaaaaaaataaaacattacatagataataaataaaatcctacaacctccataactaattattaactatatgatctaaatatattactacctccaacccatatatgagatttttctatgtaactatatggaccaactagaaacccttccgctcctccggaaagatataatcctttttatcaagagacgaaggtagtaacacctttatttttattatattgataatctctcgttctaaaaataatctgtagtacactatgttaatgccatctcctctgttttagattgtacgtgaggtgttctgattttctcctaagtcaaattttttcatggttgactaattaagtatatagaaagatatagcaacatttacaacattaaactaattttattaaatccacgttgaatat

SEQ ID NO: 104362 - DNA, 647 bp, Oryza sativa
aatataatttccagcaatggcgccaaaatattcttgttatattatggtcacagatatgatccgcgagcgcatggatatactattgtagttgtagcatttcactcggatgtattccaagatatcgtatttatttaatcccatgtgaagattgataagagagaactatgctaataatttatatattacttgtatacatcaaagtctatgcaggggttaattcatttcaaggggtaggtgaaacgaagaaggaagaaccaagttactctcactaaataaattctaggctaagtagagaaagaataagaaaataaatcattcctatacttctagtatacagttatctttagtttacactcgctagtatacaatcatgtagccaataccccctaactatgccctcccggtgttttgagagatcactcctgattgccgagttccttacgacaatccgtcatggccatccaaccagaaatgattacgaaggagtacccatgccaggaaagtgtcttagtactatatactaatgtggagaaaaacccgtactgagctgtcatcatcagtggcccacctctactgtcccgtagtatataaccccaaataatgatatttaataatctaagcaccacacttacattattaaatactac

SEQ ID NO: 104363 - DNA, 711 bp, Oryza sativa
ttgatgttagtgctaagtacacattaccaaatttatttgctacgtctaggtaaactgaataatagaaattaataaacctgtgtgtgcaccccccataattccaagttaagcttattttcacaaaatttggagattttaacagcatgcgatttctgccttgaaaaggtactaccttcatctcaaagtcttttttttttgggacgaaggtagtaacatttgaactccgatggtagtttaattgcttcataatagtgagtcaacttgaaattcgcagtcggtgacctccacggtgatctaaaccaaacgagggcggcgctagtgatggctggtctcctgagctcggaatcggatggccatgtatggacaggagggcagacggtatagaaccatttcctgtcctatgtttgttgcatttagttcattgaattttgtttaaaagttctttttcacagaaatatactcaaatttataacaaaattagtaattgcatttgcatgccagccaaaactcaaaatgtgtaagtttgtactatacttaatttgcatggatcacacacagtacattgtgcttccttccttttagcatagatgtaactgtggtatcttctgctagatctcaggtgcagctactcttctgttctgcacgtatcctcatctctccacagagaagaagaatgtgaaatgttttcatttttgtacaggtgctggttca

SEQ ID NO: 104364 - DNA, 2012 bp, Oryza sativa
acgtagttaagaaatatcaccagtcgtcctcctcctcaccgtagcccactgccatcgtcgtcactgtagcagccgtcaataagggccaggggctagcggatccaccccttctgatggtggcgcctccggatctaccaccctcaagctccaccatcatcgcccgctatcgtcattacccctcccggggctgagagtggcagatccacccctcccgagggctgcgccaccggattcgctgccctcgagctcatcgctctggttggatctcgcattcaccacaccaagccccacaaggtgtccgaggacaccaccaccgccactcccgccgtccttcgtgatggatcctcagtcactgagcttctcgccgctcaagcctgacatcagccgctcctgcccaacgctccagccgtgcgcacgagatggagagggagagtgagagagagaaagaggaaggatagcataagagaggagagctgaaggagcggagatgatttagtttttatatttagtttgcagtgattttcgcaagcgggcctggagaagtctgcggaaatctaatttttgcatgcgaccgcttaagaggctcacctgaaaaaataagtctattttcgcaggcctcttaagaggctgtatgctaaaatgcattttctcatggaaccctttgaaccgatcctgggggagtgatttttgtaggtgggagcagttatggtctgcctgtagtatagaaaaatcaattgtatagtaacgtacgtctatgagtgtccaacattgggtgctactgctcataactctacaaaaattctagctcaccctgtattgcccatgcaagtccttaagtgtgtatctggttatgggatgaggtgacaggatgggacgagattcagggataggtggtggaacatgatcatttttaaggagaatattcccctagttaaaatctagcataagtttatatttaaaaaactggtgaaccaattcaacccattttttctctcgctggcaacatacgggtcacctactttcgatcatcccttaaaaacagaatcttcgaatccctcatgccaaacatatagctgtgagcctgtgactatctaaaaaaggatgggcctcacccattccacctgaccacctctccaaagtaaaaacacactaagatatttccaatggccagttggccaccactgggatatatcacatccatagacccgtatattctattagccaccaccgtgatcacatcttgagaatcttctctctctcacacacacacagttatttatctctagatcagggcacacatatatttgttaataaatatgtttgagctattcccattaaattccaacagaaaattttggaggagaaagtcttttcaatacccctaaaaagtcacttacattgccacagcaatagaccaaagaatggcagatatgaaataacgcgactaccttgttgatgatatcttctactgtagtcctgacatttgatatgtcttctcttatctacggcatgcgattgccattggacctcacgctcgtctcatcgcatcaaactttctgtcgtggcctaatgggccggcagatgtatgtatgaacctgggtctcggttagttccaccacaagaatctaacgagagtcattttattttcgttttcaataataatgtaagaaaattggatctgctaagctaagtgtgaaaaagcaccaatttgtaacggagggagtaccaagttgcagttagatgccccaatattataaccatcaattgcactgtatctggacaattattctgtacattcccagtggatggctttctccttttaattgagatctttggtattactatctggtgatgtcctccgtagatcgatatgcaatggtggattggcggggtgatatgagagctaccatggccatatatatatagcgaagtgtgcaagctgctggcctagctatcaagggaaaaatatgcggtggaaaccacatatgtgatggaaacttgaaaactaatgt

SEQ ID NO: 104365 - DNA, 1929 bp, Oryza sativa
ttttgtcagcatgtggaacaagttagacttgtatgtgaagtgcctacgcagcctttgtctctgtcactgaacaaactgctatcaaaacttcaatttgtagcataaagagaatcccaaggatcaggttagataagtaaccaccaccttagagcaggtacaatagcagattattagctagctataaatatattttaataagataaaaaataaaagaaaataacaatgtgcgtatgataggtgagaccatatattaatagtatagtaagtatctattggatgaattggatgaattggctattagatcggctatagataaattagagctagtagtgggctatactattagacttgctcttataacatgtctaaagcacaattgaatctctattagacttgctcttataacatgtctaaagcacaattgaatctcgtccactcattgcggggagctcataaactggttagtgaatgcaacttgatatcgagatattgataaacgtttcatccacatcttctgctcatcgatctcaagctgtgaaaactcatgaaatcactaggtcaattgttcagacaaacatataaataagtcgagatgattatttgtgggctctccatctacaatagtcaatcgaaaacccgttggtttttatccgactcttgcacgtgtgacccacatcaacgcgtttacgctgccgatatttgtgaccttccctagtttgtctaagacaaccatctcataaaaaagaagtttctctgacacaatttgggcttaatgtgactatcgtcatctgtaattttgtcatctttctctagtctaaactttgaatccttgtcagacctaccaaacgaatgccatgtccatgtcaaggataaagtgcacgataatatatagacagcaggtaaccaagtcaattgcactgttttggtatcatgctttctgagagacagacaagaaaacactacaaaaacgatccattccaactggaattgggatgaagacgtacaggtcaacgagtcaaacatgtaaagtcttcagtttacaaattagtccttgattgcagcaactaaacaataattgaacacttacaataatgatttgttagtaactagagaagttaagaacttgcgcacatgagtatggattggtacgaaaaatgtcaccatgttaaagacttcacatttttatccttagattctgcaattttaggtttgtgctaggcatggcaacaaagcaatgcgccattttaagtggatcaccgagtcatactgagaaaaatctaggcaaaccacatgatgattactgacttaaaattcctctctaactaagcaattggatcatccttatcgcctatcagataacacgcctaggcaaattcatcttagcgggtacgttgtctgaaggtgctgcatcaggaactgagcagagtgtacatgacgaagtgatgagggcatctcgatgtttgacatgtctatgtccggtacttcctctgctatctcctctgtcgtgaaaggaatgctgcaatttgcagaggttagataggaaggatgatgaatgtacaggtcagataaacgtatgcaatcaaagctcatggacattttgggggcactaacctcaagtcgtcatccaagagaaatgaatttgacactggattttgtgcatcgctgctcaccatgtccctcattttggcaacaacctgcaattaaagaaatccacaagttagccgaaagaaagaacatggccatagatcacagttcacagctcaagaggagatgagaacatgcctcggctgatacactgtgggtaccatatttgtcatcccagtacatcgtacatagacgatatatctgcctcacacttaacgcctgacagatatccgtaaaacaaaataagtgcgcgtgtgaggaaaataaattctatgtgaagtataa

SEQ ID NO: 104366 - DNA, 1016 bp, Oryza sativa
gaagaccaccacccagcctctaagggcaccgcaatggttatctataggctctctacaagagatccatgtcagcatattttcctacttggaagagattaaatgaagagagaaagagcaaagctatctactaacctggagatagtctatagagaaaaacgaggcaatggattagagagctatagatatccatgtagacataccattgaagtgatttactattaatctagtctattgctgagatttacatgttttatagatagcaccttactttaccattgcgggtgctctaatcgtcagatgtaaacaatcatttattaaagtttgggcatgctaaaagtctagaaaaaatacaatataataggaggaaaatcacatagtcctaacggcatatttgtctttccacatctatattaatgtcaggatttagctaaaagctactctctcttttaagtcatttgactttttttaaaaaaagttctttagttttaattaagttaatagaaaaaattagcaacatttacaacaccaaattagcattgaatatattttgattatatgttcttttattaaaaatattactatatttttctacgaacttgatcacatttaaataagtttgactaagaaaaagtcaagcaatttataatatgaaacgagggagtttgttttcttgaatgaagtcaacaaaacaagtatatacatgccttatttgggtagctgaaaatcatatcataagaaagagtcggtgagaatttgaaaaaggttagtcttttttagcttctggctttaaagttcacgtttcagattttacagctacatattttcgaaatttagattctgagagtcttatgtataataagctctcgtaaataaagtttataaggatgattttacgtgcgtagtgagtatatagcgtttaaataaaaaataaaaggaaaaagtacgaattaccccctgaactatcacggttaaccgaattacctccgaacccgaaaaccagacattactcatcctga

SEQ ID NO: 104367 - DNA, 3826 bp, Oryza sativa
attatagaagattaaagacatgttgtcagcatacacaaataatcataataactttagttaacgatcacacggcatgaacacattgatttgtagccttgattaaaagaaaggttatgagatggggatgaaaggatttgagactatatatatcttcgtctcattaatttgttaggtctcataacttaataaaaatgtaactttttaagatggaattttaaatgatagaaatacaataattttgaaataaaaatatagtaagtaagttgtacgaataattatgagcataaaagaaacggcagtgctaatgcccatctcatcactttgcaaaaggagaggagacgatataaagacaaaagggagcgcccgtttgggcgtggcccgcggccggtccgccacgaccggaaccattaccggttgcaatattgcatccctccaagattccatcagagtcttgagatcgattcccgcgttcagttccccgcgatcgccgcgcttttgggggcgtacggatcaaccacggcagcaaagcccggacaaggcatgagagagatctatgattagcatcgccaaatgttgtgagttgtgtgtgtgtgaccccatcgaaatatcactgctcacgcaaagaccgttttggacatgcagatgcttgggtttgaaactgatcatgttattatatttgagccaatcttttttttaagtaatgagatgttttttttaagtaaagattaaagttaaggcaaaatatttattttaagtcatctcattgatcaaattttgtattttaaattcattggatcccctcttaagcacatgattggctggcgatgcttagatttcagtgtattgataccggtgtactataaatatttatattgtacgtacaaaatttaatcctaaagttaattatatttagaaacagaggacttgtgattcaaattagtatggagggaaaaaaagggggcaaaagtgccatttgttaataagaaactagtcaataatataaaagtactagtatgatattgaaatgataaggtaagggatattgaaactagtcagttatcaaatgttaggggttagaaatgttagtgaggatggatttgggtgattttggaatagaattgtagctagaacaggctaagtgtaattctatactaatatggttcactaaaccaagattgtaaatctaaatgtgtaatttttaagtttacacgaacccgtgctcaagcactgagatgtattacactctaagagcaagtttaatagtagagcttattacctgctattagtccatcttatcataacatatataatagattaactataagattacctttaatttctcttctcctctctctttttctaacttatgtatttaatgtatttgtcttgtagcatgtgtagagctaactcttgcataagaaagagccaatgcccttcatttttgttatcttctcctccacatgaatttatagggcccgtttgggggagctttagattctgagaagcagttgtttggtagccagcttctgagaatctggaaaagctctgaaacctagcttctccagcttctagcttcttagttcattcttcaaaatctgtaacaacagattctcagaagctgtgtactgtttgggacagcttctaacagaagcagcttttaagaaaagctgcagctggaacaagctcccccaaatagggtcatagttggcttaaagcatgtttataatagaggtgatggccacctccaattttatccacattatacgtccataaaattaaaattaacttatataatgcattgaatctaatacactaatcccaatacacttaccactaatcaacccctcactttttctcttgtttcttagagttcgtgtggaggttacctcttgcacgatgggtgactcctcttcctctctcttctcttctctctcttctatcctccatatcatcgtataaacatatatgatactttggggtttgtacatatatagaacctttatagtataacctactattatccttgcttaaaaaaaagcattacccgctgataatgggaaatttaactatttcatactattaggtttatcaattattcaaatacccctattagatttgccttaatttttttcccttctaaggtggtggcttcttaactatttgccacttttaccaatgtgggtatccagcgtaaaaattgatgtaggacccacctattagtctaaaacctctccttttcctctctccctccggtccagccaacctcaccaactgtctgcactactccagcctgccccgctatcctccccttcatcaatcctcgacggttaacagctgttgaactacaggaccgtgggatagcgacggggatgcttggagggccccgctccacactgcactctcagggatcctcgcctgcttcccggccgtctccaagctcatcctcaagtgcgaccgccatcccgagagcatcgccgaccccctcggctcggcccttcgacgactcaagctttgctccctctgtctcgttgccgcgctcggcaccagcctccacaagctctccgccagctcatgcatctttggtgccaaggggattgagggcgtcctccgcgcctgcctccatctcgaggagcagtgccgacagttagcgaggctggtcgaactagaggaaaagaggaaggggagagttgtgagactgataggtaggtccgcatcgatttttacactgggttaccacgtcagcatgccgtgtgggcaaaagttgcaaactcaaatagttaaaagaagccaccactttagaaggaaaaaaaagagaggcaaatctaggccctgtttagattccaatttttttttcaaactttcattttttctgtcacatcaaactttcttacacacacaaacttctaacttttttgtcacattgttccaatttattcaaactttcaattttagtgtggaactaaacacaaccctaagagcaggtacaatagcgggctactagacagctataaacatattttaatgagataaaagatgagagataacaacagcgggctacagatttgtagccagctgcaacacggactacaagacgcaatgtgtgtatgacagatgagaccattagatcggctatagataaattagagctagcagtgagttatactattgaacttgctctaacagaggtgtagtgacaaacagttaaatttcccgctgatagagagcgtgcgcaggcaaaaacgcaaccatatccccaggcgcgagctctgtccccgatagatcttgtgcatttgtgcagtgtgcacgcgacatgaatccaccaacgtctccatgggccgcctcaccctgctccctgccctgctcttctcgtctctctctctctacccggccgttgggactcgctgacttgggagcagagccagccacagagacagaccgggtgtgtgtatactgtacagatacaaaattcaaattcttgcactgccctctgcgtggccccaccttgccaatcctcttgcacctcgtgtcactgcgggtgggcccaacgggacggttgacggttagtgagtaataaatgatttatctctcgctaataatccactgatcctggagatgatgctgcattacccactaatcatatattaaaaaaagcctaaaatgatgggacaaaaagcccatatataataaaaaataaaataaccccggaaacattctcatcccatctccacccaaaaaagccccaaaaccctcttccaaagccccctgtgagtggaccccacctcccattcccaatccgaatcccaatcccgactagtgcgcgcccttt

SEQ ID NO: 104368 - DNA, 891 bp, Oryza sativa
tcccccctcccccccttttttagagtctaccctagcttccgcgagcgcacggtgccgccgtgcgctcacgggagccagtgtgacggcgccacatacactaaggaggttgtcaccgtcatcgttcaaatgctgtggcgaggagttgctcgagagatgaagggtaaggaattaccctcactgacatttgagcctcataatttcttaaaaaaaaaatcttctaataaaattgccaagcaaaagacatgtcaacaccagtagaccaagtcaatgtgacaaaattgccagcaaaattgctagggggatttacactaatttttataatttttatagttggggaaagttctatacccgaatttgcgaaggacacgaatgaaactcgacctgttaatgagggatctaaagttaactttttccctattcttaagcaaacccaaccagtgtgaactatgaagtgtcttgcatctaaacattactactatttttgtagtgtctggcatcaaagcaagtgacgtatgctcctgttgggctgacgcgtggttgaggtaattttagaaagctctatagtttaacgaatttcacgaatccacgtatatatcggagaacttaattaggctattttttatttttttaaaataatgagaatttataaaacccggcttctacaccaacgtggcaataacattctgaaccgtaatttgaatagtaaccatgattctaattctatccctactttttcaggtttatctgggaacatgccgtgaacacaattcaggatataacgaaaacacgtctttccgtgaacaactataataaacacgtgctagttgattattattatctgattttattggaagcacctataaatcgggcgcccgattgtttttaaaaatc

SEQ ID NO: 104369 - DNA, 648 bp, Oryza sativa
gtcgccgccttgccgatagaaggtaagagaagaggaagatatgaaagagaaagaggggaagggatgagggagaatatgagatgaggtggagagtggagaccgctgacatgtgggtccgcttgatgacttagcaagtcaactgccacgtaggtcaaaaccgtctccaaaaccgtctagggagttgatttgcatcggtttttggaattgggggatgggttatacctggttttctggttgtgggatgctattcataaacggccatgagttgagggagggaaagtggacttattcctattgccattgctatatgctttgctaccatagaacactcggaaataggccaaggcccaaggcctctatccaaatgggccgctagctagcaagcctcttcattccgggatgacgccggatgtcacactgcattgttgccagtcatggtgaagggcagtgtaaaacagtaaaagtgccctaaattttgtgacataaattacttctgctgataatatatatagtttctgtttgcatatgaacacaactgttcttatttacagtgttttcttttgtaagtagtactttcgctatgtagtaggagtataaaaactgagaaatttggcacttcctgggccaatgatatatttttaagtgtga

SEQ ID NO: 104370 - DNA, 864 bp, Oryza sativa
caggctaaagaaatgatcttttttttttatttgagtaaatttcagaaatctacaactatttgggtcaaaactatcaatttgctacacgtcatactcatgcatacatgccaagttcacacgcacgcacaactggttacagttgcagaacttgcagtttaatgataaaatcgtttgatatagttacaacagttttgcgaaatgttcgccttaatcttatagaaaagcgatacctttgaccaaataactacagctttctgaaatttactcctttatatatattttgcatcacgagaaacaattttaatcacttaggtggatatctactcatttgttgcatgtgaacaaaatgaatatgaaaaaaaaaataaaaagaataattaatacacgtatattcacagatgaattctgttttttttagttcatcaaactctgctcactcaattctcttccacttaacttttcacatttccctcattcccttccggttttacactctctctctctctacatacttgattatatattagcaccatgcaataaatggacgaacatccacccgagcgattacaatcctctccaccaacatacaagtttaaattcaacttctataaattgtaacaaaaataacaaatttaactccaataagtatatgcatattcacaaatgaatttattaattttgttataacttgtagaagtcgaatttaaaattgcatgtttgtggggtgatatatttcatattaatctatcttatcaacttttctgaattttttttcaataaacgggcgaacatccaaccgagcgattacaatcctctctcttggtagctaactaaagaagtgatcttcttcttcttcttcttcat

SEQ ID NO: 104371 - DNA, 1506 bp, Oryza sativa
tttttcaccctccgaggggagacgcgtccggtttacccggggagggaagaagatgcagaggcgcagagcaccaatgcatatgcagcagctgcaggcggcagcagcgaccacttgtgacctgcactactacacgtcctccctcctcctccttcctctgctggcttcttgctgatttggtgtgatctcttctgatacgcatcaacacgagaagcatcgaatcgagtgtacatgtacagtagtcgacagtactactacagtatggacattcagccagctgcatcgatctgcgccgttggatcgacacgacgtgcggcccggatgcatctgtcggtcgtggactgtagcaaaccacagccagtgatgtgatgagtgatcaatcgatggatctctatatcagctgacctgatgcgttgggggatccaaggttactactgcgcgtgtatggatcaatctttggtggtagccagggtttacaaaaccatcttattattacgtaacattctcagttttttaaaccacggcatactttgttgtaaccgtaaccgtgcggttaccgtaataaccgtcaaactatagagtgacggtaactctacacaaaacagtttgacgaattatggtggtagcgtgtcctcttgttttctagggaacgaaagatgagagagttggttagaggggtccgtccattggagtactagcttaatttgatctcgattgatacttgcaaaggttgatgtttaatcatagattcggtcctcgatctaataacaatatctaacccctctgctcaatctaatttagtgctagtacatgtatctatctggtcccgttgcgtgtcttcttttctactactgctcatttgctttagttgtgttctttagttcatcggccagctgaaaaatgcttttattttcttagaatccctgccgtttaatttgaaaatgatgtgaatctgaacatatattcatggtagttcatacgaaattaatagtggtcttcatataatgaagtttactgcattacttaggatgcatccatttggaatggttgggatctcctcttctgccgtacgtaaaatgggacgagtcactagcacataactaattaaagtattggattaaaaaaccctgaaaatatattaatataattttctcaagcaacttcatatataatttactagtgccaaaaccgaactgtttagcgatttgaaaaagactgagttcctgcttgaggttccaactctcctccctcgtttttttttgaaactgctaaacggtatgtttttttttgaaaaaaaaagtttctacgtagatttgttttagaaaattatatcaatctatttttcaaaggaaaaaaatctaatactgaattaatgatgtatttgaccggtcgagcgtgtaataattagcccgggacagcagtcgcgggagagaagccgatggagcatgcagcattgcagcggcagaggaggtgtgcttccttccacagtactgtagacgctgcatgcgc

SEQ ID NO: 104372 - DNA, 631 bp, Oryza sativa
gattttgtttgctaaattaaaaaaaatccgtccggaagaacctcctacaggcacccacgggtaataacgaaatttcagaaaattagatctgaaattgtaaaccctgatacgatgctgtgagatatcgatcccaacaacttcaaattcagtgaggtatatgtatttgtggtttgattaaaggcacgtatttcaaattcagttgatacatgaacatgttcagagcaggtttgatttggtcataaaatcatcaaactcaaatgcagtctaggtcatgcaataaatttaaattgaattcgtacagcaagttaatcaaatttgatgtgtacaagatatgtttaagtacgtgtctggtgtagctagctagcgccgtggatttgaaggaacgatgatttggtcagtagcttgagggatctgaattcttggcgtatgataaacttgagttcaaaaaatacaagacacatcagttttatatttcaattcgtgtaaaccattgaattcaattcatgcaagggaactgaatttgcatatttcaattcatactcttagctcatttaaatcgacatttgcacgatgatgagtagtgccttttgggggtggaactggtataagtttgacttttgcggaacttaat

SEQ ID NO: 104373 - DNA, 655 bp, Oryza sativa
tatgagatcgtcggcctctaagaattaagataactaggtcagctgacaacgatgacttgtgaggagtcacaatagctatgtcaatgcagtcttttttattcgctcttcgtatgggtttttatcggtttttagatgtaagatttttttatccaatttttcaagcccaagggactattcaactccctttttttttcttcttaatataaagtagaaaattccctccctcttgtggttttggaaaaaaagaagaagaagaagattgaggtaactatcgggtagccatgaatttgaagcaactatatgagtggttgatatttgtggcttagttttagcactaaagtgccatatgtgttaatgtactatagccctcaataaaatgggaggccattcctggtctcctatatatgtactagtagtagttgtgtccaaagcagcttgagagagagctttgttaataatggaagcgtgcgtatagcccatatataacagtggctagcttgtatgcgccaggcttgtatcatgcataagtcatccaaacagtaatccattcgtaacagggtagattaaactgtactccctccgtactcgtaaaagaagtcgtttaggacaatgtttaagtcaaacctggggaatataaatcatgaatagctctcaa

SEQ ID NO: 104374 - DNA, 1659 bp, Oryza sativa
aatcggactgcattggtcgacattcggcgaatttcgttcattttggtgcagcttcagacaagtctattgacctcccactttcacccaccatatatatactttttataaaagagaatagctagtgatggtggtggttttgctaccaacattactaccaattcccaacttttaaaataaataaataaatgatatttagggctagagagtccatatgtcaactactttcatcagtttttaatttttgtgggaaggaaaaaacagtgtgagctaaaaatgtccacatatgagtaacaaatatctacaacaattaagatatgataataacatggtaatgttaattttcttcacggacaatatgctagtttttcttaatgcttattagaaatttggctcaaaggtagccatttttccctgaaatttctgaattttgccaattttgatggggcctttttttttattactatttctttgtgtttgatcgatgcaccgggaaagtgtttcaatttctttgagaagatatccccttatttcttgcatgcatgtcatctaaatagtaataaatttttttaaaaaaatgataagatagattaatataaaatatatcactccacaaatatgtaagttcaaatttagcttctacaagttggaacaaaaataacaaatataattgtgaagttaatttgttcttttttctgtgaaagttgaatttagtcttgcatgtttgtgtaatgatataatttctattaatccatattattaaattgcatcaaactttttttataactatttagatgatactccctccgtacccgtaaaggaaatcgtttaggacaatgtttaaatcaaaccttgaaaatataaatcatgaataaccctcaattgaaaatataaaaattatatgaatagatttgtctttgaaaaatactttcataaaagtatacatatatcacttttcaataaatatttttataaaaataaggagtcaaaattatgttttgaagactgtgtcgctgttctaaacaacttactttacgagtacggagagagtatagcagaaatgagggatgtccatccagggatgaaaatccaattcccaatgcacccaaatggagtatactgctagttagtcacggactcacatgtctgttgttggcacttggagacattttgtaagacagcaacaacttaacctccaataattgttctactccaagcgttcacagctactaccaccataagctcgctcgcgcaattagtatatcgatcggccagaggaggaaaaaatatataaagcgcgggtgcacgatgcgccgccgcgtcgtcccggcggcggcggccgtttccgcccagctggcagccgccctcctcctcctcctcctcctccacgccgtcaccgtcgtcgtcgtcgccggcggcggcggcagcgaagtggccgtcgacaggtacgcggctgcaggcgcgatgctgctgcttccgcggcggcggcggcagcagctggaggacgaggtggtgttcccggcggcgatggcggtcgtcggagctgagcagctgcagcagggcgggtccttcagcgggctcacggcgaacaagcaagtctgcctgcagggtcactcgtgcgccgcgttcgccatgccctacaccggccatggctgcatctac

SEQ ID NO: 104375 - DNA, 967 bp, Oryza sativa
ggatcccccctttttgcctccttcctccccttctcctatgttcgcatctctcccctctacaacaaattgccctccctagatctccaccttcatagcttggatcaaaaagcgaaatagaaaaatggaacgaggaggaggagaggagtaaaaggagggattagatcagagtctcccctattgtctcctcacaagttctctaaagaaattataggtgaggtttttccccttgttatatcagttgttctagggtggttttagtggtttaatttgtggataaggaaggttagagaaggagttttgtttgttgtggttcgaattggctgttctgcatgttggcagatttacagtgtttcggttttttgaagtttcggagagctaaatgatattttctgcgaaagtgtataactagaaagttgtagataatatttatatctatcttctgaccgaagggcgcgattttatctcaagtggtttagacgatacgaatttttgagtataactgttgtttttatgccataatctggatagtagtagattgaactgtttttggatgggctaaacagtggaacagccaagactcctatagacaaagttgtagagatttttcttagctttccatattggtaaagtacactctgattgggcaagtagaactccagttatgattgttttagtgcggatagtctgaattttctggacagattgtgaagcctgctttcaagcgcaaattagaccattttaatggcataataaaaatataatttccacataagagttgtaggcattgttctgtagatttccaaaatatatttatttgcggtcatagccttttcatatttcaagatataaaggtttgaagcaacaatattgtttatagtgcaagcggcgttccttgttattgcgttttgataggatggggcagtaggttcacctttttcattgttttatatgcatgtttgaatgtgtt

SEQ ID NO: 104376 - DNA, 756 bp, Oryza sativa
agtagtttgacctatgaccaaatcaaaacatctttgtaacctcaaacggagggagtaacattatgtgtgcgtatatatataagcacgcgcccaaagtgcccggagagaaactggatcgagcgccgccaggacgacgacgataatgctcgggagcgaccggcgaccggccggcctcgtggcgcagctgctcctcatcaccctcgccgcccttctcatcctcctcctcaccaccgtggccgcggcggcgccggcggccggcggcgggtacagcgccagggtggtcatcgtcgccgggaagaagagcagcggcagcggcgccaccgccaccgctcaccgccgcgtcgtcgtcgacgatctcgccggcatgatggcggcggcgctggggcggcaacgcctggaggacgtggtggcgccggaggaggagctcctcatcccgggcggtctcgtggttggtgcgggcggcggcgggggcggctacggcgccttggaggcgaaccagccggcgtgcccccgcggcggctgcgccggcaagcagccaggaggggcgtacacccggccgtgcacgtacggcaacacctgcttccggccaagctaagccatggctgcatttgcaaaagataattagcagctgcaagcacacatatctgcctggtgcctgctagctcgatttgtgataattgcatgcatgtattaattaattatttactccacatgcctgtattattatgtactccctctatttcaggtaataggccg

SEQ ID NO: 104377 - DNA, 1602 bp, Oryza sativa
tatctaaatttataatagaaatatttagatatctaatatttaaggtatgaaatgttgtattataacatacatggatcgtaaaattacctaaagtgatatccttagattgtctcaacttcatcctcgtgtattctcgggccctgttcaatcgtttcctttcaaggcatggtcgaatggttatattgctaggatactccaatacagtcggtagcatcgtgaaacaatatagatgttgttagttcgtccacaaatagaagtaccatatacaattttattatgcaagttccgtatacaccaactaacatggcgggtttcactaaaactttgagagaatattttgcacgtactttcaatttcaataatattacatctatctataaagtataatttcaatttcattatattttagcaagataaaattctaatagatatgttactttttttatggctaaaacataacaaatatgaagttggtacttaatttatatgtgtatgcaatactattgaaaatacatgtatattgtttatataattttttatgatatatattatctggtgggtacatagtgtgtaaatttatgtgtatatacgatacattcccccacaaatataagcatttatatgagctttagcagagaataatgtttagcatttactagtaggggaaaatcccactcgaaatgtagcatttataataaaatgtaagaaacaatggcatatgatttgattctgttttgttttgtcagttgattttctctcaatgtatctatcttctttcacttccctcggatgcttggctattattttttatactctttggtgctttcatgtccacgagcctccctaatttcaccaccatcatctttaatttatatgccttatctcgcctacctatcccccctgtatctggcagctcatgtgccacacgtctactagccactccgatgaatcgtctccgcccccaacatcgactcaacgcactcctctatccccatggcaatgttgggctatagtggcaccgctggtgcatagctgcccaccgcttgctagccactccgacgaatcacctctgtctccaacattgatccaacgcgctcctccagccccatggtattggtgggttctggcggcaccgctagtgcatcgccatccactgctagtcgtcccttaaatccccaccccctccccgaaattcaatggctaatgtaattgactgatgttttttacaattaactgctgaacaacaaagggtaaaaattttaagacagctgatagaatccttgataatctagactgcgaatgcaaagaggcaaagctatagtagtagataagtaaagtaaaatatgagaaaattcgattggtagcataggtattgtccgagtaaaataatagcacaagaaacttgtttcttcgcctgaaagcacagctctgttagagatttctaaaatttagcacttccgtccactaaaaagaccaaaaagaaaacccttaggtcaatttcttcttcctcctccttccagtccctcactgcatacctcttcccctgttcatcgcttgcctcttgtctcttatgcatgaccgagacaccacgcataggcaagg

SEQ ID NO: 104378 - DNA, 557 bp, Oryza sativa
cgtaaatataaaaatatttatatcatgcttaaagattatttgatgataagtcaagtcataataaaataaatgatagttatataatttttttaagaagacaaatagtctaacgttaataaaaaattaacggtgtcatatattaaaatataaaagtagtacatatccagcagatacgtacaacgatcacgtgaagacgtgattcatccctcatcgccatcgatcaaccacaacacgacgatcgatggagttacgatgcaaaacaccgaaacgccgctactacaccaggtggcaccatacgtacacatacgacacatgcaacggacacacgtcagatactcggatcacagtcaacacgaagaagaggcccagcagcccacagacaatttagttagcgcaaggcccacaaaactgtgcggctcggcccacatctcgacgccgagtttgaatttacgcccttcatacgcaataccagaaatagcgcgtcactcaacctacaaaaccaatatacttaaggtcttaggatagtatatatagtgtccattttagatgatgcgata

SEQ ID NO: 104379 - DNA, 922 bp, Oryza sativa
aggaacagttattagacttgatctgtaaccagaaaaagaagaagaaaactgaaactaaaatagtttctgaagaattaaggcagtctacttgtaagaaagacaagaattcagtaaacatggtgaatttgaggtttagtttagtactcctacaagaagatcatggctaactggtgatgaagaaaaacaaaagtcgggtcatttttgtagctgacgactgaactggacctcaaagaaagctggagcacacaacaaactgtttatcttttcacaaaccagagaaattaaaggtagttctagtactaattcagaaaccaacagaggtcagattggtgcttccagaagaaagcccttgaagctgaagcacaataaacagtaatcttttcttcacaaacctgaaaatcaaagttaatttgctactagtactgattcagaagcaaacaaggttatcttggtccttccaaaagattgccatacattcaaaatcttctcatgcgaagtttataactgaaccatcaaaacaaatccccccaaaagaaaaaaaaaatctctctctgtgggcaggacagtctgcaaaatgaccttgcccatgcatgcaaatgcaatggcaattgcaggaggtcatcagtttggtccctccctaccccaacacaaggtgacaaaacaaatgatgggatctcttagacatcactgtttgcaactatagctcctcctgcattattattgaagggaagggacctcacaacctctcttctcttttttttttctctcttgtactgtgctttgtactactgtgtgcattatgttgttgcatttgtcttagtgtgggtactgtctactcctactccactatagtttaggtgaccaaatatgctggttaattaggtggcgtttggatcagggactcaagtatgggggatccact

SEQ ID NO: 104380 - DNA, 592 bp, Oryza sativa
aaaccagcgtgacaggattgttttgtcatgtcatctcgaccgacatggtcaaaggttcagatcgacatggtgtgcatcatggtgttgatacacgtagtatgtacttcctctgtttcacaatataagactttctaacatcagtggcgtaactaggatttaaagtaaaagtgtttcatctatatgtaatatgtcaattaaaagggtggtccactatataatttttactatattaactagcacatatactataatttcaaatttttaggtggtccatggaccacggtgccacctagctagtacgcccctgtctagcattgtccatattcatctagacatatgtatgtatttagattcattaacatttatatgtatatgggcaatgctagaaagtcttacattataaaacggagggagcatatatgggacagtagcagacagggtaggtagagcgtcgtgggtgaatctttggcgccgcgccggtcgatcgatcgaatgagccatatgcatgcagacggtgaccagaacagaccaaaccaaacaaaaactgaagagagattagtggtagctagagagaagaagataaacagggtcc

SEQ ID NO: 104381 - DNA, 1552 bp, Oryza sativa
gtggattcccaagatataaaattcttgtgtcagtctctcaaaatcagaagatctattttctataatgggataagaccctcccagctacacatggttcgggatgttcacaatatattgttatagctaggaggggttatatctccttctaggttaggtcttttaggacggagggagtactctcccccccccctctctctctctcaactggagtacttcctccgtcctataaaaaaataaagtactagatgtgacacattctaaatacaatgaatctagacatataaatatatatttatctagattcgttgtattagaatgtgtcacattcagttctagatttagtgcttgtttggttattagagatgcaagtgggtttttttagtctgcctatctcatttctagttcattttttcttctaaattttgtactaccacgtggaaaatgaactaccaagtatgtttttatgcgggtagcgggactacccacttgcatccctaataattactcactccgtttctaaatatttgatgccattgacttttttaaatatgtttaatcgttcgtcttatttaaaaattttaagtaattattaattattttcctattatttgattcattgttaaatatacttatatgtatacatatagttttacttatttcacaaaagtttttgaataagacgaacggttaaacatgtgctaaaaagtcaacggtgttaaacatttagaaatagagggagtatttagctagcatttggattgctactaatataaagccaaattctcatggtatcagtggcggacgcgggtttaaaatacagatggggcggcaaagctagccttaattaggtgttggtacaacgcacacaaaccatagtcactggttcacggcattggcacaacagcgcacggcacaaatatcgagaaagttaacaacgaagattggtagttaaacaaacatatatgacttgtatgtagagatatgaaaaaaaaagaaatactgttagacaatatggggaagcacttttaatagttcgaggtataaaaacgagatgcaaaattatttaggggtttaagtgcttcgccaaaatagttcaagtgagtaaaatagattttttaaatatatttacaaatttaactatttactatatactgtattatacgctaaagaaatagaaagaaaattgaattttatgtatggccaaaatcagaaatagtcaaaatggttacttatacactaattttcataaatgttcttgttcttacttaaagtatttgatttatctgattatttaatagtagactgaagtaaaatgaggtttgggggtgtggggcgacacggatcgtagttggaccgactgactcaccctacccaatgggtgtgtccgccactgcatggtatagtggagaaacttctagagtatgaccaaataggatatggaccctaccaaatatttggtatcaatccaaactaacatacatactatttaatttgccaacaaaatggcccttattttttttatgggacggaggaagtaatatgccagtgcaat

SEQ ID NO: 104382 - DNA, 529 bp, Oryza sativa
acagaagcatgtccatcaagcattcgagagaacatatttctaagcaaaaagagcactcctcaagcttgcaggagtgagcgcacctaaccgagtagcctgttagctcatcccacgagcgcagcaaaatcgaaggagagtgaactgatctctccttcagattgtgggactgtttgctttattctatatagtaatgtaagttctggtattactgtatcagggaagtaagcctactcaacaaaacttgaagtgctcaatcatgcagccacaagtggtgcagcccttgagtaatgttactgaagccaggaagcatcctcgacatgcgatgctgtgcatacagggggaacatctgacaatcgcctcagctccacggcagaccaccatcagctggcacctttgatctgatgcacgctccatgactccctgcatatcagatgatcgatcagacatcagacacattcaatcataaactctggtcaagtaaaacagcagtagcatcctgatccttgctagtctctaacagtctgaaaaa

SEQ ID NO: 104383 - DNA, 822 bp, Oryza sativa
ccatctgtgattgtacaaatcataactaatgttccaactgaaaataccttaactgggagcaattaatgggaggttgagaaataaaacaaccaacaagtaaaattaaaatttccttaatctgaccgtgcaaaaatttaaagctagcagacactctgaaacccttctttttttcttttattgaacgaacagtcaaacccaaatgattccaaactgtacttcggcaataacgagttgtctactagttgtttgaatttaatggctagggggaaaaaacccacacatttagcagcaagcaacagattgcgcaggctaggtcaattgcaggacacgaacacactgctactgctaataacttccaaaaatagacgcatcaaacgagttgaagcctgaaaatcacagcacaagatttcctagcacgaaggagggcacatcgaatcatcgccatagctaagcagaattccgggagcggttaagcacgccgccgactgcgacagcgcagccgattacgttccgccggcaaagtcggcagccggtagctcgaatcgagcaggaaccggcgcacctaaggtgcccgagcgagccggagttactacgagaccgatcgaatctcttaccactggggggagcaggcgagatcgcggcggaattcggcgccggcggcgatggcgacaacggtggcggtcggaaggttcgagaagagggagggaagcgcaaatttgggggaaaacagaaaagcttccgccgcgtgaatacgtaaaccaccaaagtacgctttcagaagggagacacgtaaaaatagagcttggcgcagcggagcacgac

SEQ ID NO: 104384 - DNA, 635 bp, Oryza sativa
gatggttgggtgcaggttaggcatgtttcttgaaaccatttttgtgtttggattgcgttttggttatgaattcattcgttgtgacttgaatgatctatagtttgttattcagaatttacagggttttttttttcgatttggtctgtacgtcaaccgtcaactgctatataaaacttgtaagttaggttttaattaaaatttaaaattttggagattggttattgttccatggaaaagatgtgaagattattgcagtcataaaagtcagttgatatcttcagcaaagagatcatgaagagaccttgtttttattttagttttccaagtggaaatggtcagtaaaccaagcaattaaccaacatagtgtgtttgtaacgccacgtggcacagtagcagcaatatccgtgaattagaatgctcagattgagaatgtgaaatatgatatgcttgattcaaatccgttttgatgaattgacatggaaagcaactgatggttttaagatgaaattgaaagaaacatgcatggattcaatttgtccctgcaaaagtgtatacaggggtagtagtaatcagcatatgcatgcatggatagatgacgattacccccaatctgaaaaaaatgaaattactgtcaa

SEQ ID NO: 104385 - DNA, 584 bp, Oryza sativa
aaatttagcttaatacgagtgaagtttaaactaacagggtatatatggtaaaaatagataaactatagttaatatttttttaaccaggttcctggacacccccagctatacatagctccgcccctgtgctcatgctcacttcacgtgtactcccttcgtaaaaaaaaatgtccaacctagattaagatgatataacctaatacaatgaatctgaacaaccatctgttcacattcattgtatatatcatatcttatttaagttaggttttttttgacagagggagtaagcacgtgccatcatacgtgtgccaatgtaataaatgagagtgatgttcatgtcaactctggtcaagtgtctaaattgttttagaaactagatgatgtcccgcgctttgctgcgggatatatgttatataatggagaaatgatgaaatgatttggattgaaatattatgaaaatgatttgcgaatggtgatttagcatgtgtatgtttagttttacaatgaaataaattgctgatatgattactatatgcttacatgttgagctttatgtatccaatagattgatgtggcatccttgc

SEQ ID NO: 104386 - DNA, 577 bp, Oryza sativa
tgtgtcgtatagggtgtttggacagtaataaaaaaaaactaattacagtatccgtaagtaaaccacgagacaaatttattaagtgatccaattaatccgtcattagtaaatgtttactgtagcaacacattgtcaaatcatggagcaattaggcttaaaagattcgtctcgcaaattagttgtaatctgtgcaattagttattttttagcttatatttaatacttcatacatgtgttcaaacgttcgatgtgacagggtgtaaaattttgagatgggatctaaacagacgggacaagatattaattgtatagtaagcgactattatataaattagctagtattaaattggctatagatattttaaagctagtagttggctatactattaaacttgatacgagagagggagctagtaattagctactccattaaacttgctctgagagtgaggtgtgaggaggggaaaaaataaaaaaaattggagagacaagacaatggatggagatatcacgtcacatcaccgacacgctgcactgtatacgtacgctgtacagtacagtacagtaggagaacgta

SEQ ID NO: 104387 - DNA, 569 bp, Oryza sativa
gtttctctaaatgccacttttatatttatctttagaaatttgacatcagtgggagaaattttcttgatatttttctttacatttctgctgatgtggcatgacaactaggacaatctgtatggccgagtgataagtaattttcattttctccctctccaagtctggcacaaaccatcgccaccgcaataccaccgactttgccacgtcgactcaagcccgacccaacaacacacgcacatgacgcactcgaccttcccttcccactcccaagtggtagaaaaaaaattcattgaggaagcaaagtgaaatcgtgatggatgctaggtaggatgactacgagagacggcgccggtggcatcgatgatgtatcgctgcagaaggtctggtcctagacaaagccaccacgccaccaacctctccagacctagcatgcataggcgacgataatggttgtggagatcgacagggaagaggcatgtccactgaccgttgtaacaatggttgtcaccacctcgagctaccctctccagcagttgaggaaggcaactcgctgttgccgccttctcgat

SEQ ID NO: 104388 - DNA, 1211 bp, Oryza sativa
gcatggagaaatttgtggaactacagttgaaagtatatgtagtaatgaatttgttatgttaatattagattttttttttatatatatatgagaaggtattatagaaaatgtaatatctatgtcacctttttcaatatggtaaacataaattaaattagtctcttatcgcatttgttttagataatgcatatgtaacagttaccaaatctactgtatgtagcatccaaaaaaatattgtgtttttaataaaataaaaataaaaaatgaaaccttttgtatcagtattaaaaaaaataaaatttatcatgaataatacctcacatatcaaactcatgaatgaatgtaatagtctagaaacatacttctacaattccaacaatatactccacaaattaactgtcagcaggtacaaaagaaatcaaaaccaaaattcagtgttatacaaagaattaattgagcaaaactcggaagtatagaaggaatgggctgaaatttcaggaccatataagaaattctctcattgtagggtacagagagaaatatgctgtataggctctatctttcgatctatctataatcgctggaagctgcaggtagcctggcctgctggataattccatccatcaccttccttcacatactgcatgtcggcatgtactccaaactatatcaaatttatctactggaaattacactagactagctaggccctataacaacgagatcgaaagagaaattaaaaatgttattactcatatactcccatgtcgtataatataagggattatacattttcttaaaaaataatcaataaaagaacaaatcatatacaaaaggtggtagttgaaaaataaactaacaaaataatttgttcatatataaggaataaattggtaaggtacgaaatacattattgtctcggatcacaaaccccttacattttaatacaaaatataaggacaaaatttattatattatggaacggaggaagctagcgttctttggatgacccaagaggccgccgtcgatgcataatgatatgatgagcctacatgcatgcttgcagactccgatgggccaccaccctctcaaacctagccgaatagcatagtagtactagtattactctcaccgtcgtaaaataacttcatatgtattatatttataccctttgttcaaaaataagttcacatttatcttcttcctaccca

SEQ ID NO: 104389 - DNA, 713 bp, Oryza sativa
gaatattccaaggcgaggcgaccgaatggaggaggggaaaggaaaggaaagggaagacgaagcacctatcccatcggcaccgcacgcgcgtacctactgacaggtggggtcactacaatgtgggccacacatgtcagtaggtatcgagggaggtgggcggtggaaccgccgtgtgattcttatctcatcgtggggctcgtctggtcaacgaggaccacgacccgatccgctacgccctggtttgttgttgggctcgttacaaccaatgggccgttgattacacgacaaattggcccactccaacaaaagaattattgtttctcttgataagtttactataggtctctcatctttacatcgagtttgaatcatatcttgaatcacagtcacagaaatcttgaccgccaacttgcaaaactaggttaaattaattagatcctccaacaatatagatttttcgtgaacatacaaagtgattacacgtcgatatattagaagaaaaagattttctaaattttttatcaataaatagttcattataaattaaattttatttaatgaaaataatatcactagattgtcatttaaattgctatcatatgattatgattaacattacagtatattacaattttaaagttaaacattagttttaaagaccgtgtcaaatttgacgcaccttatgagtgggatggagggagtgcatggcagaa

SEQ ID NO: 104390 - DNA, 2816 bp, Oryza sativa
gcccatcacgatggctttgtggacgggacagatctgcatgtcgctgatgccgtgcgaaatgatctcttcccccgtatagtagtcctccctcgtcggcgatgcgccgccggccgggaaggcgttaacgtggttcaggaggccctgcattttcgcctggtccaccttcagctcctccacgaagcacgccatgcctttacggatcctcgccaacactactgaatttgcctccatgtacgatgtagcgtaccttacgactacgactttttccttcaatccgatcgatccgatatatgtagccctccgtagtatgcacgtgtatatttatatacgaacaacacaagactatcctgctgcatgaatcctgatcgattttggctaccgatcgcccgaggactctcgatccgactcggatgcatgcccccccccccccccccctcacacatggccctcacctaccgacatcgatagatgccggcgacaccacgagattgctagtaggagtacgtatttcgcaaagctatcaagattgatggcatcatatcattatatttgcatataactcaaatagttatagaaaaaaaataaaaatattaataacatcaattgacataagtctacaaataaacgtgtaagaccaaatttgatctacactgtctagagaaaatatatatatatatacatacatatatatacatatatatatatatatatatatctacttagcttccatcgttcgtaaaaaaccgggcgaaaaaaccgggggaaaaaaccaaaattgtccgataaaaaaaccagccgaacaaaaacgtgcgaaaaaaagaaaagaaaaaacaaaatagcgataaaaaaagtccaactatgtcccgtaaaacaaatagagataaaaaataaaagagtaaaatacatcagcggtccttaaacttgtcaggaggtttcacttaggtccacgaacttgcaaggtgcacatcgatgcccctaaacttggtttattgtatcatcccggtccaaaaccgcgtttgactgtggttttgcctatgtgtcacgccacgtggacaatgacatggatttttttaatttttttctccctttttccttcttttttctctttcttccttcttttttctcggtggtgagagacggcacgaggagaggggctatcgcagtggtgaaaagaagaaggaagaagggtgaaaaaaaaattccaagtcatcattcacgtggcgtgccacgtaagcaagaccacggtcaaacgcggctttggaccgaaatgaaacaataaaccaagtttaggtaccttgatgtacgatttgcaagttcgtggatctaagtgaaaactcccgacaagtttaagaaccgctggtgcattttactcaaaataaaaaaagtccgactcgttgcgattccttcttagaaaaaaaaaagtccgactctagatcgagtctcactcctctcggtttgagtccgagattctaggcaccacttctctcggtttcaatctataccgtgatattccatacatcttggtgaaaacaaattgatgtgtcggattaaagatctgtttgcaaaaacggaacctacatgtcgagagcattccatttttatatgattttaatttttgggtttgtacattagcatttgagccctgtaatttttatatttatatttgagtccctataatcttgcaataaggtgcttttggtattttttaaaaaaacaataaataaaagggatagaacaaaggcagaaaggtgcataaaaagaaaaagaaaagccacacaaaaaagaaaataaacaaaaaacaacaacaacaaaagtctatttcccctaagtggcgaaaaaaaactgtagatgcaaacggaaaaaaaaaatccgattcctataaaaggcaaaaaatagtggtgaaaaaaaaacgcttgatccgattccttaaaaaacggaaaaaagtctgattcctgtaaaggaaaaaaatccaaaaaaatctaaaaaagttcgtccaattccctaagaaagtggcaaaaaaaatggttcgtaaaaaataaaaagctggttcgtataaaataaaaaattcacgcgagaaaaaaatggaaagggcgaaacaaagtccaatttctaatcagtataaatctcttctctatctctaatctaatctaactatttaaaaataaaaaatgcacgagaaaataaaaacaatcaaaaaaacgtgtgagaaaaaagtcagaaaaaagcacaaaaacacgttgaaaaggtttttccatcttcttaaaaaaaaataaaaaaatgcgtgagaaaaattatttccattgttggcaaaaaaaattaaaaatacatgcgaggaaaagactgtcaaaaaaatgcgccatttctaaaaaataatggtttgaaaaaaccacgcaagaaaaaaacactatatatataaaaaaatcgctctaaaaaaactgtcagaaaaaagctaaattgatggacgcttgagtcggataggatccatcgattttttaccatctactacacggcttttatttcgtcatatattctcatgtattgggaaaaaaagcaaaaaataacattaagaaaaaacatgaaaaaaaaccacgcgagaaagtaattgtcagaaaaataggcaaaaaacacgcgagaaaagcaaaacaaaaaaggggagaaaaatatggttttcgtcatcagtaaaaaaaaaaggaaaaataacatgctagaaaaactgttagaaagaaatgcgctatttctgaaaaatgtttataggtacaacacaagactatcctgctgcatgaatcctgatcgatcttggctcgcatcataccgat

SEQ ID NO: 104391 - DNA, 1980 bp, Oryza sativa
aaataaaatttagactcgcatgtgtgtatagttgtgtctcatattaacataatctatcttattatattaacaagatctatcttgtcaaattttatgaatttttcatttaataataactatttaaaccacatgcatacacctagatactatggttatggtttattaaaaaacctagtacatataaaattaacattggcgccgttgtttttaaaaccggaacatattgagaaaatcatcgagccgagcggggatgctaaatcccctcatcttgtcctctctcacgccactcatctctccatccttccatctcccctcctcctcatcctcttcttcttcgctcttcctctcccgggcatggcgtggcatggcggtcgccacccatttggccttcctctcccgggcatggcagtgacggcctcttcctctcttgggcccctttgatttggaggaaaaacataggaattttagaggatttcaatcctatagaaaaatttcctatgaagccctttgaaataaaggattgaatcctatccaatcctttgaaattcctatggaatggacaatcctatagagattttggaggaaatttagcaagagcttcaacctcttgctaactttcctttgagtctatctctctcatccaatttctgtgtttttcctatggttcaatcaaacggtcattcctgtgtgttttcttgcgttttacaatcctctgttttcttacattcctatcaaaatcctacgtttttcctattcctacgttttctcaatcctgcgattcaaaggggtccttatgtgtggcgccgcaatggtggctacctcttcctctcccccagaccggggtgtgaactaccggatccggttgccacaagtttggggtggccatatcctggctcgattgtggcctcttcctctcctctacccgatggctatggcgggtgcctctcttccactcccctccctggtgcgacggctaccggatctggccaccgcgagctcaggtgatccacgtgaggtcgcctcttcctctccccggctctacaatggcctcttcctctcctctatgtggcggcggcagtggcggctgcctattccattccctagcccggtgcagtggccaccagatccgaccagtagcgtgtctaattcgagtgatttgtgaatatttttttgtgatttgtggagggggttgatgaatcgacggtggtatgtgcatgttgatgaataaggaaggtgttcttggatgtgagatgctctggagggtgatagggagttgttcgaatcgagcatatgcatcgagccaagtttttatttttattcctggaaccaacacctttgaaatttgaattctcctcatcagtatcgcctgcacgggatgtcggttgtcaaatttggcacctttcaaccagcactaatccctgtttttgtgtatgtatatcgacacaagacatatctagaacaattaagtaaagcaataaaaataaggaagtccctcataattcacatagaaaaggttagaaaagatatagcagaagacaaggtggaaatatgaccaatatcacacattcacacttagtaggtactagctactagctggctagctcgatccccttcctatagctttataccccctgtcagctatatatgcgaagatcgaatcgtaatttgatactaagtgggatgtgatctcaaaaggttaatttgaagcgagagattgcatatgcgcatgcatggcactgagggaagagacggatcgaagtgaaagaagaaactaaaggcaactgctagtagtaagagagcaatatgtcacgcgacaggcagacatactattgtactagagatgaaaattcacttcaaagatcgatctcaatgaagaatcgacccaaagtcatacacatccccaacttgaagtcttgagcaatactaatatactccctccttccctaaatgtttgacgccgttgacttttttaaatatgtt

SEQ ID NO: 104392 - DNA, 922 bp, Oryza sativa
aggaggaagaaaaggggcgagaatgacatgtggggcccacgtgggccccaccatttttttttattaatttatgtgtgaaactgacatgtgggtcccacaggttttattattttttcggatcaaattgccacgtaagcgccacgtcaatgccacgttagacgaagaccgagtcaaattagccacgtaggcgccacgtcagccaaaaccaccctcaaaactgccgagggacctaatctgcgccggttttgatagttgagggactcgttgtgtctggttttctgttggagggacgaaaatcggattcattaacaagttaagggacctcagatgaacttattccttttctaagcactgctacacatacttattttttcttataaatttttactaataattacggttgatttaggtagatagacgttataaatattcaagatgcaattacagcattacatattagtgttagtgttcgtaagaatttataagaaaaaaattactactagtacatgtactttttcttttacacagcttttagaagttcagggacggactacacccgattttacggaaggacgcaggtaaaactcagacctacacttgagagacgtaaagtgaacttttttccttagggtgatccaagtgtcactgcgttttgctctagattgcgtagcggcccattttccgctaaactgaaaggtttcgggcccgtttgcgtttgaaggccactgcagcagaagcttttgctccttctgtttccgaatacaaagcttaggccccgtttggtacggctccaaactccaactctcagctctaaactcctactccagttgaagctagctcctattggagttacagaccaatcaaaagtgtttggcaaacttttagctccagatctgaaaaaaaaaagaaaaaaaattttaaa

SEQ ID NO: 104393 - DNA, 593 bp, Oryza sativa
agttctggggatgaatctgtgctagtgcttctctagattcatccctagaaatttgggacggaggcgtagtgaataagcctgattatcttcgttatccagacaaggtcttgttggggttgagcagttgggaaattgcatcaaccaaacaacaaagctattggagcctctcaagtttcatggcttctttgattgaatgaattttggagggttttttttttcagaatttgaaaattcctgcgatgtttcaaaggaatccataatgatttttatacggaatgggaaattgtcgttcatcttgagcattacaatctgctagcgaaattcttagcaatgtctagtactttacccgtcccaaaaaaaaaaaggcaacctaggataggcaacctaggatgggatgtctagattcgttgtactatgttgcctgtccaaaaaaaaggcaacctagaagatgggatgtctagattcattgtgttgtgctgttactatctagattttttttcttcttttttttggggggggggggggggggcggagggagaattgctgccactatctaaattttttttcttcttttttttggggggggggggggg

SEQ ID NO: 104394 - DNA, 679 bp, Oryza sativa
acagcgcgtaatgaagggacaccatgtaccactttcaaaaccaagcaatgcacaactttcaaatcttcaagactttcgagatttaagatcctcttcagttttttgttcctgtgaacttcaagttctctaagtgaaggcagattctcaattgttttgaggctgtcagcatgatctatgcgcaagcttctcagtgcagtacaatgctcaagccagcgaggaagtgaatccagcttggggcatctttcaagcctgaaatccactagtgaaggcatatctccttcttcgatacctgaccatgacttcaagttgctcatctcgctgatgagcaactgttccagcttgggaaatgccactccattatctggttttccgcgaagttcagggccaatggtagctgacaaattagaatcgattattgcaaggtattttagattactcatctggcccagagatggcagctgcgagcaatgtgaacaaccatcaatggttagcctctgcaactctgatagaccgggaaaggatagccaagatggaaattcatgtccataataatttgccatcttgatagacacaacagaaggtgctggcgccagttcttcaaaaacatctttaatattctcggctctacctatctgtgttgtttgctcatcaatgctgcagcataactcaagctctttga

SEQ ID NO: 104395 - DNA, 667 bp, Oryza sativa
taagagagattagttagaaaatatgagatgggagggaagagtcggtggacattcatattgggaggagggggcacatacgtaacttaactgagggggaggttaaaacttatttaatcataatagattcaatgaatttaaatagtgggcccgctggttttttaagtaccacgtggctttgtaggagtgtttttagaagtcccatgtaacggcttgagagtgtttatagtaagtttaatggacttttatgatggtaggcatgcatgtatgttataagtatgtatttgaaaaacttataaggactgaaaatcaaccatatagccaagcttcagaagtacgttttcttcataaatttatttgtcatctttgcttaaataacttttattaggtatttgttgtctttatactatgtaatatttaattcatatgtataagtaattattattttcttcttcaccatttaaaaaggaggtagacttaggctgagttatttccccaactttcccaactcactttccctttgttttccacatgcacgctttcaaactgctaaacgttatgttgttttgcaaaacttttctatacaaaagttgctttaaaaaatcatattaatctatttttcaaaaaaataatagtaaacacttaattaatcataagaaaatgcgtcact

SEQ ID NO: 104396 - DNA, 694 bp, Oryza sativa
gatctaaagaggctagacataaatcatttttcaaaagtacataaattagcaaatcatatttaggttgaactaaaagtaaagtaatatattaacactttggtggtataaacgtaaaaacataacatgccttgttgttcctgcctcatacagaaactatacagtgggcaaaagtatgtaagatgcataatatagaggtctcatatatgcagatcacttcatgttagaacacaatccaaacaaacaaaaataatcaaatcaagtttatgtaaaaagaacatatatgcagtcaaatcaagagatacaaaatcatcctcttgatatcaattgcaagaacagtaaacaaaatcaataacatgcattgataaaaggataaaaaaagcatgagagatatcattgcataccaactgtttgtgaaatgtttactctgtctgcaagggatagatgttcgaagtgtctatcaaaggagaacgaccaccaatatataattgggtaaatgtgtttataagtatgaaataataatgagtactaatgaacacattaattataacaatatcttttctattttgtctttggaaaaactttaatttcctagataaaaactgtcttgttcattataaacaaattaattactaccattcaaaagaaaagagacataattggcagctatatccatactatatgggctgcaggaatt

SEQ ID NO: 104397 - DNA, 771 bp, Oryza sativa
atgcctcaagcataacttgtgtgtggctaaatccaaaaaggaaatgagacacaggttcttgctgttatattcttagtcagatcaaatatgtctatgtgttatggttaattggttattgaataaaaaaaagttgaacattcataggtaaaatcacagtagtgaagcacaaagcaattaactaattttacatgagaacaaagaatagctgtgacattatagatttctagttaggtagagtagtagatgcactgctgcaagcaaataggacacatctaacaagaagatataaaaaagtatgcactcatgctagtagatgaattgaatttctaactatgttcaataacaggtctacaaggtcacacacatggaattggtgattctacctgtttccatgcagatgtgtaattaccagttcgactacaaaatcaggatgtttatgtcgatgcaaacacttggctaatcctcaattatcatgcactcttatcagtatcaatgaacataaacagtcagatagtatttcatcgcaaattattggattgtcagtatcactagattccgcaataagcaaagcaaaagaccgaaattcccaccatggagagctaatccccccccaccccccctccccctctttgcacgagtcaattgcactgccatttcgcgtacctggcattggagcgctccccgaggacgcgcttccgctcggcctcctcgcgcgcgacctccgcgatgcgggcgcgcagctccttccgctgcctccgcacgaccccccgg

SEQ ID NO: 104398 - DNA, 2219 bp, Oryza sativa
gagtgggagtggattttgaatttctttttttgtttttcttggttgttccgtttgcgtctctttggagtttggagtttggacaggacaacgtaagagtcacgccgtcgggcaggccagctgtttggtacgggtatttgccatttggtaatcctttttttctcgctgaacgatctagtaaaacgatgtaactacggttacagattaataaagcgcgtcaaatggcttctctcaaaaaaaaaaatgatagggcgcggatgctgatgcaaatcagattatttcggatattaaaaatggcacatacacgatgtgataacggattaaaactgtgaggtgttatgtgcatacgaaatcaacacggttcataggtacgactggtgtgtagggatagtgtttttttatggaagttggggaaactacagcagttgtcaatagagtcatgtgggctacgactgattaacatcacctcgctgtcgtcggtttttttccttttcaaaactcatgtatttatttacattactaaggttacgtaatactaatacataagcaattataatgcatagagcacgcatatggactagggcacatcctagttttacaaaggactttgaaagatttgaaaatagaaacaatcgagtccttttaacttagtcaataaattcaataagcttgattcaacatagcttaaaataaaatgagttgcacatgattgaaccaccgtactgtcccaaaagggatctcacacaaatggattattaggcgatggcatacaacgtgatatttcaaccacatcatagaagacttttgccaaagcattagccaaagaagacgcaacaaaagttgttccaaaggtctagccccaatccatgacaccagcgaagcaaacataataagcacagcaagatgcaaatgaacccgaaaaccgtacccaaaaggggcctccatgcataggaggtcagggtcaacttgggttggctcaacaccattagtcgcctcatgaagaacttccaccgaagatgaaaaaggccttcatccttggaatgagctcattagagatataggtgtagaccggtgcaacctattctcatgcaaatctggaggcatcctaaccagtagaaaggacccgtcgacgtagtgactcgccggtgggatcaaatcccacagtgaactccatgatggcagcaccaatgaccagctccagaacaacaagagcaagatcaactagagtaattagacaagcgggagaacccgactaaaacaacaactactagtaggatggtgcctgaccccctctttcacccttcattggtgacgagttgccagagagaaggatgaagaggggtcggaatgatgagagtgctactgttggggaaatttaggagagaccttgcatgtttccctcgtgggtttaccatccggggactaaattgcccgatggaagatctacatgttttggcattgaaaaccgttgttattgagtgatagaagctaaaaggatgttgcctcgctatatggcgtcattgggaaatacgttgacatgggagtgtgggacattgtgttccattttgtgttggggtgcatcatcgtttgccgctcggcttgatggagagcatagtgttttccttgggcgcacgtgtgagtgggcgcgctaacatgagaagctatgtagaggtgggattggagatcatggggaggagacatggaggaaagatgagagctagctagcttgcaggagggcacgcggaggtggatcgacttctccccaggcatcgatagtgacactcgcaagagagcaagccgtctcgcgtgacgaatccaacggcgctcgaggctcttctctagtggcagcagcgactcttggcaccggaggtcataggggatggtgcccctaatgacagtggtggcggccatagagggcaactcatgatttgttcctgggtacatagggccacacataagcgttacatagggcaactcctcaatgactcaagtcagaagtcatacgcggagcatcaagcatctgaaattggcccatttggcttttcgcggacagcccatgtggtggcccgacgcaggataagacgggaccgtccaatctaatggatggtctcaattgatcccaacctagacaaatatccggcagccaaaaccctaaccctaaattcatttctcccgatccccttgctctctcactcccgtcatcgctgccggcaaaggggggg

SEQ ID NO: 104399 - DNA, 2110 bp, Oryza sativa
agaggacattgaatactttgatttcccccctaatagttctagtcacatagaatttaggacaatctcatcaaaattgcatttacttactacaaaattagatcatgaaacgatttgctcgagataaagtcttcaatagcaggccatttaccttaatgtataagagctcgtcattattttccttttctttttgagatgagagaattcatgaaggatgaaaacagtcatggaaatttccgtataagtggtaccatttttcaccctttttatttctagcagttgatactgaatattgataaatatgatcaatttccgaccgatcaagaattatttctgaatacatactaccgattccgacagttttcatcccatctagaattgtgaagtgactgtcttgaacaagtaaaatcccttggcctttttaaaaaactaggaaggtgtattattaaaacgtaagattatagtttgttcagaaattatatctcataagaacaaactctaggtcagtgatatctcaagaaccattcatcgacttagaagatagattaaggtcatatgacttttgaatcgacttttggattgagtgagtaattatcgtcatgcataccatctgaacatatatataccatgcaatattgctacaagcaaaaattaggacatgaaggaactcatggttattgtgactgaattgcctcatgaagacgcatgctttagtgacaatcaaattaaggatagattaacagttcaatttttccccttcgtagaagttcaaatttttctcacaattttaaagaattttaaagcctttttatgttacaacacaaatcagccacacgattgtttggtttggtagtgcaaaatatcaccaatagttttaagctaatttctttcttttcgtatgtttaattctctttttcaaaacaatatttgtttgaaagaagagtataattatataaatttaatttgtacatatagtgtgcctataaattttgatgtgttttatagtaaaatttatcggcagttatgattaccttggcaaataaccttagctacctcaggtatggtgctacgtcatgcgtgtagaaggcaaagacgcacatgtgcagagggtaggcgagagaggtcttcagagttttttttttaatctcttagaactgatggtccattggtttaagaagaaatcgatggcaaaatatcttttattagaaagtattggatccactaatttaagtatagattagttattatagatcataaattactaattttatggtacaaaatataattgtgtaaactttagtataaatcatgctttttttaaaataatggttcaaaataatgataggtccactggtttatctattttttttgggtatgttacgtttgtatatgtattttctttttctcaaagccgtactggagattaggacagaggtttttattataatttttagaatgtatcatttgatggtttaagagtgtttttaaaacgtcacgtgacaggttgcgagcgttaaaaaagtttaatgaatctttggtgtatataatagccaatagatatgcttttgtaaaggcaagtgctatgatagatgcgattaccacctttaaatttatctattttatttactcatgaactaagaggtaacatatacaatgtatcatctctagtacacaaataccgtatctttaacactcccacacatttcttgaaatttgtatggaggttgtctcttgatttaggggtggctcatcatctctctcctcacttctctcctccactcatcactcaatccaatgtggcactcttagagggggtctaatgcgcgaaagtgcaccagacgcgaacggattcaaaatttctagttttggctaccgcatggcgagatgaatccgatgtttcctgttttggttaccaatcgtgaaactgtcaaaaccgcgagtgtttcacatgccgtgcatccgcgtctcgtcagctgctagccatatgagcctgcatgggcctatagcatatatggattgatttcatgtctgtctatggtgtgattcgttaatgggccattttattaggttattttttattcgaatattttttaatatattttagatttcaatt

SEQ ID NO: 104400 - DNA, 886 bp, Oryza sativa
caaacccctaacacgtcggcaatcctcaaaacacctttgagcctcttgaactgcgtttctcagttctggcaaccacctttctgataccatcttttcttgttcaccagctaatttaagacagtagttggccaccctatataaaggaaacatcagtagccattcttgaaacgtagtaagctggaatatagattcattccaccaaatataagatattcaagaccaataaaaaaacacaggactacttgtgataaacaagggcatcccaaattgcaattcctggattgttttagatagacatcagctgcacaataattttatttcactgcgtatcagcatactaaataacattttgtggacttgtcatcaattcaaaattaagaacaagtcttcagttcatgaatcccaatggtacactgctcaattggtaaatgttacagctgccacatgcattacacagtgaacaaaatgtatttgaaacgcatgttagaattcttttcaataacaaaacccctacttccaagagaaaatatgtactgataaaaaatacccgaaatgaaatactattttctgaggaacaaaattgcaggaaccgaacaagtcgacagaggatggaagggaatacaaacaaacattggcaccagtcctacaaactataccgacaatcactgatacacaagacatctcctttatgttacagttctagctggattcagtaaatatctattgtgaagaaagacaaagattaagtaaaatttcagcgtacctttcatattcctgttgagcacgatgtgctcggttcagcaaaacacgatcattctcaaccagatttctccgcgtgtgcaccaaattaatagcctttgataaatcctctagtatactagcttca

SEQ ID NO: 104401 - DNA, 649 bp, Oryza sativa
atgccgggcggccctagccgtccctacctattctttgctcgcctcagcacctccacactagcgctcctctccgcccgcgctgctcttcctccccttccgtcggtgcccctctaccccggtgcatctccctctcctctctctctcttgcgctcctctctccgatggcggcggagaagaggaggacgatggtgcctcttcggcggcagcggagaggaggaggatgatgtccagcttagatctgggagatgggccgacgagcccagcaccgcggagaggaggaggaggacgagcttgaggaggcccttgccggcaaggcggggtcgagggcagtaggatgagccggtgagcttatccggcccggtggccctccttcccctagccgactagctcggcggcatggatcttcctccctctctcttccttgacggtgcggagcacgagcatgggtcccacctgcaacgcccacgacgaggaatctgtgtctaaagtttgctccgcgttcctaaggaggccgcgaggatagacgacgtggcagcgaatatttcacttttggtgttgaggcccaactccacctaggcgcattgtgaatggcctgacgaacggagaatgcggagaacaaactgaagcaacatacatggacgaatgccat

SEQ ID NO: 104402 - DNA, 648 bp, Oryza sativa
atttggaactaaactcggcctaccttctggtggtaggggctgcagctgcaccatcttggttgctagcatctctcttattaactcctatcaactgatccaccctcactgatcactcttgtagagtcttggtgtacatttactcctactgcactgcactaccaaactctccttcggccctcacctcacaccttctgttactgttagtgggccccacatttgcaaccttctctctctaccactctcttgcgcaactcctcctctatcgatctccttcctatatatacatgctcacttggacacaacacattccatctcccaaagcagcagcagcagcagcagcagcaggccagcagctagcattatcagagagagagagcaaagtgtgctctcttcttcctcttctctgctactaatcaaagctagccagctagagacatctatagcttgggagaaagaagaaagctgagagctctttcttgctagctagctagcaatggcggcttctgctgctgctccggccaccgtggcggggctgctggtggcggtggcggcgataatggcggcgtcgccggccggcgcgcagccttcgccggggtactacccgagctcggtgcacagggcaatggccttctctcgtgactacaccaa

SEQ ID NO: 104403 - DNA, 691 bp, Oryza sativa
aacctctcttttttctccatttgctctatcttcttatctaccatcaattgagctttatactaaccctgtacgtttcacttacctattgtctcctcaaccactactgattctttcctcgatgatggcaagcaccaaagaagttagggcattggggtgttgcagctaaagtacatatacatggaggccttgagcagtcggtaaactagtggcggtcagcgatgaagacgatacaatgtggagaggtgaggtggtgccaccggagctatgagtaaagaggaccggatgtaggcggtgttggcggcatatgaaattcaaagcaacttaaggagtatatattaggccatgttcttttctccaacaaaaactggataaaattttggatactcgtgacacgcttttcaaactgctaaacagtatgtttcgtgcagaagctttctatatgaaagttgctctcaaaaatcacattaatctattttttaagtatgtaataatttaaactcaatcaatcatacattaataccacatcgttttgcgtaaaacatttaatcttcatcttcagaaaaaaaaagaccaccttagtacgagatgggtaattgagcacgtgagagtagctctagtgcgaatctaaaaccaatttcaacgctaaaaatccgaacagtacaatctattttaataccgggctgcaggaatt

SEQ ID NO: 104404 - DNA, 2240 bp, Oryza sativa
gggggcgaccattgcttgggcaggagagagagcggagcgagaggaggagagcaggcagaggaatggtcgcggctagggtttggggaaggggggttagggttgtttctgttttacaaaaacgcccctcatcttatagttttcagagcgcggtacgatttttcgatttttctcttcttcgtatagaatatttttgtttacaaaggtcctctaagtaagaacgcagaaccttaaaactaagggatggggacatataacaaattatcaagtaaatcaagggtgtttttgcaaaatgaccagcgacgacgtggaggcaggagtgctcgcgaaatcccaccgttttccagcgcgcgctgacgtgtcgcgacgcggcagcgtccacgccagcgcaaaatgccgtgggagcagcatttccgggcgggtttgaagactttagatttagattagatgtctgcatgtccaatttttctgcaggaaggtcgtggttttttcatggaccaagtttataggttctatatccgatatctcttccacaggctttattttcttttttctacgcatactactacctcagcggcgtttatgagctctgattttctttttgaactggattgatggaaattctgaactttacacttctgtgtttagttcgtgtgccaaattttttttaagtatacgaacatacatttgaagtattaaacgtagactaataacaaaacaaatgacagattccatatgtaaactgcgagacgaatctattaagcctaattaatctgtcgttagcaaatgtttactgtagcaccacattgtcaaatcatgacgtaattaggctcaaaagattcgtctcgtgatttacatgtaaattgtgtaattggttttttttccatatttaatgatccatgcaaatattcagatatttaatgtgacggaaaagttggaagtttgaagaaaatattctgaatctaaacaaggccttttctactgttttgtactatgttttgtgttttgttttctgggctcccgatgcattgatgttagttggaacttggaacttagaacttatgtcagcatttaattggtgtggtaattggttatttcctaattcacgagttggcgatcctttgacatcgtttaaattgtagatttaccggtagagcataagcaaaataggatatgatttacgcttctgcgcttggcatgggaaggcaaatcggatgtgctgcgtttggagcctattagattctgacgtgtgggatgcttgatcgtcgacgtggaagcggtgaattttggtttggaagcaatcagacttgcacgtgctgctagggcgccaatgcagaaacacgaaaaccgtcgatgtacgctagacagtgacgaataatagaaacactacaaatattttaaatatgtaaagataaagataagaaaaatgagatcacgaggaaagaaagcatgaacgggatgtggcgagacatattttcgttcttttattatagatcactgtctttttgtgattaggaatttaaattgtttgtttatttttgaaaacaaaaaggaaaaaaagagatcggaatggggagaagcgaagcaagcgcaaggtgtggtgggacgtatttttgtttttttattagatcttttgtccttttgtgattaggaataggtgtgattattttcgctcttcttttcttcaggtccgatttttttttgccatgatggaaatcgctcttttttctattaaatggacgataaaatcatttaaattttttttatgtagtagagatttgtaacattagctttttaagtcgctaaaaacatataaatataaaagttttaaatacaatttatttttatcgttgattagtgtgacaggttataatcaacacatatccatgtgaaatgtctagcttgcacataaacgctacccatataaaaatacaaggaaaatcactggccttttcgttttaggaaaaaaaatccgatccctttctaaggaaaatcaccgttccaaattgccgaccgtacgtgcagcagagctataccgtgccggccagcggcacacgtatgtacgtacgtttacgtgtaggtttgtttccccggacaactcgtatcgcattgcaactcccagatgtaaaccgattggtattttcgctccactacgccctacgtacatataagctcccgcgcgcgcggcacaccacgatataataataactagagcctggggagcaccgcctctacgcaactat

SEQ ID NO: 104405 - DNA, 3929 bp, Oryza sativa
agaaactctattgggatcaagctattaaatccatttgtactacttgttttacagtgtgagaacatttttttcttccctatatcccactttcactttgtcatatataccgcagtgtttatataaagttataagcatgcatatgaaaataacatcaaatgtcaatcgatgatattactttctaaaacaaatttaatttatattagactatcctcgcaaaaaaaatatattagactaactatttgttatatattttaaaagttgaatctaaaatagtgtgcatgttttattggactgaggtagtaattaagaggggcatttgcaaatttgccaccggtttttttaattttgaaaggatgccactcgaatgacagttctagtggcattttttgcaattttctagtggcagttttaacgatttaaagtagtggtaaaattcacaattgcccctaattaagattgtcggtcattacctcgctttcagattgtgggaactccatttggattaaaaaattaataaactaattgcctctcatatgataaataaacaattaattaagtcgtgtctagtataggaaaattaattcaccataagaaaacatatttacctgcgcaaattatgacatgtacgcatcaagagattgctcttgcttgatttggtgagaggtgatgttttcctttgctaacatgtgctggcattggaaacttttgcgcttgtctaaatagttggggaattgaattttcagatgatatcgctgaattgcttgcttcatcaatacatcaacttatgtcaacggaggacttaggcagtctgcctgcacagaacatcgagcggaattagacacaggagactcagaatcgaaggcaaccaagcaatgctataggattgttgaagatagcataatagtccaacagaaaatcacatgataatgagtaatgactattaagatcattagtttaactctgccttttgcgatttgccataatagatcaatcattaatctgattaatgaatcaatcttaccaggttatatcgacattggtggttggcctggaatccaatcaactcatcgggagtgatagggaggttatcgagaaggcaagtttggctcatagttagcgacgacggcgaccgcctggaccagcctctcgtcgtccttcggcagagcacagagtagggttttgttttttattatgtctacgctgttatgattcggtaccacactggtgtttctttttttcttgagtacacgtgcttttaattacatgtttcaatgggcttttagttgcacgtttattaatgggccttttagctgcacgttaattgtatggttaagatagagcgatcaatctaatcaatggttagatctttctgattaacgtggaagctcatagaaagtgtccaattagtataggtatagatagatagattttgataggcagtggtatgcaacgataagtatatatatatagatggcattccacatatgcaaggcagggcagcacttacaataagaacttaggtcgcattactaattaaaacaatagtagtgacagagcgggtaagtgtgtcatctataaagtgatgaacctgtttgttgctagcaaaaggatggctttactataattgtgagcataagtataaatcgcctacgaaatatacatcacgaaacaaaatcagggaaaaaaggaactcgctgctacagacctcgacgacctataaaatcgaaaaaatctagcttcttccatgccaggagacccatgaatccagtatcccaccgaatggctgcacagcaaatcacaagaaagcatgaatatccgcaaagggaaaggcataaacaggtcatatataacgaaaacatatcgactgatagcattgcaacatgaacagaaccaaaataaaagcgaaaaagattagaaccattaaaacaacacgaaacgaaatttaacgaggccaacaattgtgtgattcattgaaggggcgtctaaaacaagcggcaagaaagcaatcccaatgtagcccttaattaaaaggtccatgcacaatgtttttccgtccatctagattaaataaaacatgctattatatccgtttaattcgcagtaggatggagccctcaacagccaaataaatcctgtacacctcataacaaaaatcattcagccgatgcttcagccaagggaaattttcatatctctaagatctatatgcacataccctgatcaaccatggccacctaaataccaatcaaccggtagataattcccgctatatgggaaataactatatccctataccctataatgtattgctagatcaacatgtgcagtggaagtaaagcatggaaaaatgtaacctcctcacaagcaccaaatactgagcaccaagcagcgatgagaacaaagaagtacggacttgatcaatcacccgaacagccatctatggtgacgatggtacaacgaacgcagttatctctggcaacaataacaataatagaacagatctgcaaccgcatatcatatccatgacctaccatgtaaaggtgacctaacaaacacaaccatactgatcttaattcaacaatctccatctcaggccagaacctgtctgaaccagtacatgatcagcacgcaaggaagatgagcaacctaaaatcccaggcttaactacatgcatccccaagaaaaaaaaaaacctattggactatacccctgtatatgtttttggagggcaaccaacgttgcaaccactaacaaaaacagatctctaaaacgtaatcgatatttcaccaaaggcgatatatcactttctaagcttcaccttgccttgtataccatgcttagaacagggcaatatcatgtaacgaatgaagaacctgcacaatatggtataacaaaaagatcagtaacgtaccatgagtcgaagaacatactaatcaggtcacacaaaccatgcagcaacaatgatattcttatctgaagaaacaagatctacagacagcacaaaagaagaatcaataactgatgaatggaggaaaaagagcatgagagtaagccatgataaacacggaagacataattgaactaaaagaatagcccataatccataacaatagcgtgtaacaaatccagttttcatcataccaaggcaattttttttcaccgctaggcaaaataaaaaaaataactctaaaacattaacagcgaaaatcattcgtcgcctagacaggaccaaaagcgaacgaaggacaatgtaaacatggaccaattattctcaaggcaaattgaagggaaatggtaaacacctatgagcatgataggtctaatgggacaaataaaagagagcaacaagaggcagcaccctaaccactagggtatcctgcaatcgcaatcgtattaaacagcagctataagcaggcacatacatttctctggctgcgtacataagcaaagcagaagctgatcatttctagatacccatgataataccacacctgcatgggcatggtaatagctttaactgagatacttgggcataaaaacgaacaaatcataaggcctgcatgcatagccttttccttgaatcaaaaagtgtaaaaaaaaaaatatcagggcaccgcctcctgcattaacaggatccaccacgtcacccacaccagggaaaaagaccgcagaggcatgtgtctcgacagataacaacaaatgctcctgctcttgcaggaacagccagtactctttgacccggatcatggacagaatttgcacaagggtgtgcttcaatagataacaacagctggccttgtttcatagcctgggtactaaaaagcgatataaccaacaaaaaaatagcacaccatgtatgaaacgtgtggaagcacctgaaccttctcatagacaagatgattctgcgggataaactgaaaaagccatgg

SEQ ID NO: 104406 - DNA, 915 bp, Oryza sativa
cctatatatctattctatttattgggaagacttctggtcgtggtggcgcgctgcgaatcagattagaactcgagtaagcaatatgatatttccttctccgatgccaattagattagaactcaagtaagcaatctgatatttccttcttgaactacatttacgttataacggacagcctagacggaatacgataggaaataatgtgaaagatctgttatagattttgagccgtgtgcgatcttaacaaagatggattagattacacccgtatgaaatacgtacaagaacatataagtcatggcataagtatatatcttgttgaaatacacaaaacaaaattaaattctgtaaaaaaaactagaaaaagaatttacattcaaacatactatgtaagtcacacggtaattacaattacaatgtaattaccatataataactatgtaacttctgtatttgccgccattgttttatgcttctctatcttctcatggaacctaagagcatggccaagagaggcccaaaactctatcccaaaattctggttttgggatttgtaatcgggctttgaggtgttgagtatattgctcgcttcaaaagatgccttaaatttctcaaatgaaaaggtgggggccaccggttaatccatccacataaatctcggttgtttctccccttcccatctgatcgctcctctccacgatcgttcacgccccgcgatgagcgcgcaggaggccaattgggagtgagacttcttccatacctatatatggagagcgataaacccagtgaagggaatcctgattttcggtttcatgtttagggccaccgttcgatctatttttttcaacaaaattcctaaatattttgtgtgtctgtgtgtgaaacaaagacgagagtacttcctccgtttcacaa

SEQ ID NO: 104407 - DNA, 1169 bp, Oryza sativa
atttacatgttgggtgtatggaatggatactgcactgagcaattcctaaatatctctcttaagaccttacacttttggacgcacctggacctgctgcaaacaattgttaatgggctatttctgctgatttattttagaaccccatgcattttattaagtatacataactagatacatatcacatgagttattcccaagggagagtcaactgcacgtgcaggcagttttgcaaagaggccccttgaacagccagtacaactgccgctgttagattttgctgttagaatttgtgtttctttgcagttcaaatctagtttcagctgctgtgtactggttagaatgttagattcaggctggtttcagcttctgtgtactggctggtttctgatggtttatgtaaattatatcaccatatatctctttaaaaacacatatgcagctaaaagacctaaaatatcaagagaaataaataacagtcccaataattacagagtatatgtagtttttgtgcttttaacttttgatagattataaaataatattatgaaacaccatttggatattaaagttgactatattctttagaaaaaaaaagacaattaatttgtagattccaatcaactaggtgccaaaacgagaataaactatgtaatcaaacctgtctcatgcatcctatatgcatgcacatattagttctatgtatatatccatgtattaaacaggtgaatctattattttcatttattagattagatctattaaagtaattaatctctctctcctaatttcccacgtatttgcaggagaaaaataaatatgtactgttcttccgaaaaacgcatacgtatgtatatatgcatgtacaagagactactacttgccaaaaaaacacatagacgtatttggatctagaaaaaaaaactattaacaatttcctcctaacccttaaattagaactaaaacgttgtcatgtttgtatatatgtacatatgatcagtctacccctctaatgtgactcatttcatcgcatttatttcttagggtagttcactaggatatatctatattttaagagttcaaaggcggactgactatacttcatacgacataaaactaatgttaaaacattcagatttcatatattacaattaaaaacagatcgctaaggc

SEQ ID NO: 104408 - DNA, 1096 bp, Oryza sativa
agtgcatatagatgaagtaatgttttctgaagtttatcgatgaagtattgtaatcctaaaacataaaatgcaaagtacatatattacaattcttgaaaggaagtgaaaaacaagaagagaagcacaaatccaatagtaacgatagcaaggatattgttttcctgcaaaggttgtgataaacaacaataggagcaataaagtgcatcttaagggagaacctgtctttccagtagctggtcatatgttccgcgggttgacagctctgatccagtctttccattgccatatacttgatatggcaagggtgagcttgcatcagttgaagcagcatcaatgacctgctcattttcatatttatacctagaaaaaaattgtataactggttaacaacaacacaaagataattaagaaacttaaatttgagtccatttggtgaagtagatcagaacacattttgactagaaaatgaacaaagcatttctcattagaaatgtaatatagcaatatttccattgcagcaaacacctactaatttttttacaaatctaaagcaagtcctgaacaaaaactaaattcactataatgtacttgtgtatgcaaaattccaatcataggattacattcaatagaatgcagctagtacatgcgagaatgatccagaagttactaaagaatattttacacgtaaccatcatcatgatggtggaaagtcaaattatttttcatgtgtattcatgaaacagaatgcaacaactgaaaatagatatagaatggtagtacctcaaaagttctgcatcagcacgtatgtcaatcttgtctgtttctttatgtatgagtattttcatgcgtgatgtgtatgtaatgattgattgcagcagtaatgaaggattttttagggaatccaatgccacagctttaacatcctgtggtatttcaccatccagatcaatgcccaactttgctgcatctaactgggaacttgaattgatgccacttccttcaaatgctgggaaagagcttcgaatcatttcgatcatatctccagcaagagtttcacatgccttccgaatactcctttcacgtgaggtctctacaa

SEQ ID NO: 104409 - DNA, 665 bp, Oryza sativa
tagtttctgccatacttatagaaaatatttatttattattagatggatcgtatatgccattggcacgtaaaggtgtaataagggttgtcttcttctagctcaagtgtggttttaattttagtcggcatgtaccgcccatactaagacatactttgcattactttaggtgaatagccagattggttctccaagtttcactcatgtctcagtttggtccttaaaattccgatatgtctatcctactactcttttaagtttttatattttagttcaaactctttcttttgaacttacttagtccttgtttggtttgaaaaagattagttcacacctattttatagtgtgaaattacttccctcaattccctctaatccatctctcttagatattaactgaacatgttcttagaaaagctacatagctgggtaaacctaaccaactactgctgtataatcgctttccctctaacccctctctcttagatattaactgaacatgttcttacaaagctacatggatggttgatcaacgacccttataccccttatatatatatatatatacacacacacacacacattgcaattcatgtggtgaaaatgtatgatgagacacccatataactaagttcatgtcagcggtacatccaagtatccaacaataa

SEQ ID NO: 104410 - DNA, 2823 bp, Oryza sativa
ccttcctgcagaaaaatcggacatgcagacatacagtaagccaacaaaaaatccaggacaacacgtagaaccaatcggagcatcaaaaagtcagagattcgctgccgttcgaagaaggaaaatttagtccaatcaaattaagaatccacaagcgctgacgcactaacagggggtgtttaaatccagggtgaaaagttttggcgtgtcatattgaatttacggatacacatttaaagtattaaatgtagtctaataattccgtatgtaaagtgcaagacgaatttattaagcctaattaatccgtcattagcaaatgtttactatagtaccacattgtcaaatcataaagcaattaggcttaaaaaattcgcctcgcaaattagttgtaatatgtgcaattagttattttttagcctatatttaatacttcatgtatgtgttcaaacattcgacgtgacaaggtgaaaaattttagggagggatctaaacagggctaggtgaaaaaaaataaaagtggattctctgaactcaagaaagattcctgtagagtactccctccatttctaagtgcttgtttaagccgtgtttagttccaaagtttttcttcaaacctttaacttttccatcacattaaaacttttctacacacacaaaactctaattttttcgtcacatcgttccaatttcaaccaaacttccaatttcggtgttaactaaacatagccttagttcccaactttttcttcaaacttccaacttttccatcacatcaaaacttttctatacacataaacttctaacttttttattcaaactttcaattttagcgtggaactaaacacagcctaaatatttgacaccgttgactttttatcacatgtttgatcgttcgttttatttaaaaaattttgtgaaatatacaaaactatatgtatacatataagtatatttaataatgaatcaaatgataggaaaagaattaataatttcttaaatttttttaacaagacgaacgataaaatatatttaaaaaaatcaacggcattaaaaatattaaatttttagaaacggtgggagtattggtgttggtggctgtatggatgaaaacggatcggatacggacggaaactagctttatcatattcgttttcatatttttttcggaatcggaatcggaatcgaaaactcggatacggaaatgaaatcgaatattatcgaatacagatacggagcgaatacgagacggaacgaatacggtagcggatatttatcggtatataaaaaacccctcaaattgagtttcttgatcaaggaagagatatcgcttattattttagttcaacatctccaacatttatatcgtcaattttgtagacggtcccataaccctatgtgaaaatcgattttcatggctattcctcttacagatacatatgcaaatatgattatcattttctattttcaagaccttttactagatgtataacttacttaccattgtataaattggagaagttatttattttacttcacatcttcaaaacttgtaatgtttgttttatactttaaatgctttcaaatacaaatgttataaactacaaagtggtagatcccgttgagctctacaactttgatatggaacacatctccatcagatgtcgtttgaattgtagatctgagattttgtaaaaattaatatggtatattataatgaatatttagactccttaaatgacctcaaataataaaatagtcaataagaaagttgtagatctcatcgagctctacaatgttgatataaagtttgtcgccatctgattccatatgaaaaagttatgtatatatacatgttttttctaaactttgctcaatgtctgcggatatctgaaaaaaaatccggatagtttttccgaccgttttctgattccgacggatagtacccttactgtattcgttttcgtttccgagaaaaaaaaatccgaattcgtttccgaatccgagaatttccggatagttccgacggaaactatccgaatccgaaaaatggtccggacggacggaaactatccgaaccactttcacccctagctggctgtgcttgctccagatctgcaccatgcgacacagctcccagccgcttgatgccctccttcctgcccacgacagcaaactttgcaactgcgctcatcacatgctccgctcatctacagataaaaaactattcagagatcatcagcacaagatggtttcgtggtgtagttggttatcacgtcagtctaacacactgaaggtctccggttcgaacccgggcgaagccaagttaactttttttttccttctttttatcttcagattcaaatcaaccactgaattcaaactttcgttggaattcaaactttcgttgtttttcctccgaactcactgaattcaaagtaactcactatttttattattttttttatcttcagattcaaatcaaccactgaattcaaactttcgttttttcccccgaactcactgaattcaaagtaactcactatttttcttcttttttctcttcttttttttaatcttcggattcaaatcaaccagtgaattcaaattttctttttttccctccgaactcactgaattcaaagtaactcactaattttcttctttggattcagactagctaactgctgaattcaatcttctgttttttccctccgaattcactgaattcaatgtaactcattattttcttcttcgttctttttatcttcagattcaaatcaaccactgaattcaaactttcgttgtttttcctcgggctgcaggaat

SEQ ID NO: 104411 - DNA, 699 bp, Oryza sativa
tgcttgggactatgcaatctctactttcaagccgtatacgtccccttcctttttcttttcaacaaaacgataagaagtcaggcaggccgttgtcgcctttgacaatggtcaccgtttcgtgctcacacaagtcttgtaaatgcagtctctttcttttccctagctagtattttctccgtttcacaatttaagtcattctagtatttctcacatttatattaatattaataaatctaaatagatatatatgtctatatttattaacatcaatataaatgtggaaaataatagaatgacttacattatgaaacgggggagtattgaataagcgatcatcttctcacatgcagctaccctcaccctctcacaagcaagaagacaggactgcttttgccgttttcccctttggcggcagcccagctcgcctacgcaatttccctcgacctggccgcttcgccaccatacacttgcctcgtgttcgtggcactgtacgtagcagcattgcgacttgttgtacttgtacacgaccgagagaggtcggttcagtttaaccggtgcccctccgcgtcttcgggcacacaacgatcccaacaccaaccgtcgatggaagcatgccgggacagaaacacgttggtcacatcaggtgtgaggatgcaaccgtacaagctgcaaaaaaaagaaataacaaatgctgcgccc

SEQ ID NO: 104412 - DNA, 754 bp, Oryza sativa
ccgatggtcgattatatgagtgttttttaattaatagaatgccacatagcgacttagaagtgtttataggagtgctaggagcaatcatatgtatgatttagatgctatgatcattttaagatcgtttatttatcttttaaatttaaaatatcatttatttacaaaagcatcaagatcaattcgtatatgtaaatagcccccacgtgtatgttgtgagaaattaataaagtttttttatgaagaaattaattaagttggtagaaagtcattagatgtctaacaatgtacttttaatgggttagtttcattaaaaaataagctagcatattttgattttcaatgacaaattttaatattttcttttatttagtggagcactcaagatggatgtaggtctagaatgcaataaatccaatatagatgttaaaattatatatttatttgaaaaataaaaatagatatataatttatggtacaaataattgtaaagactcgtaaaattaatccggcctttattaaaaagtctaaaatagcacgtttaagtataaattagttaatatatttctttgttagtttaatgcgtacagaatgtaacggtataaactttataaactttatttaaatagtgtatgatttgaaaataatgctccacataaaggtttcacgtatacctttatttaatgggtaaaaatatagtggtgtaaactttattttggaaagaaatatatcataatataatcatataagttatgat

SEQ ID NO: 104413 - DNA, 3077 bp, Oryza sativa
  unsure (1)..(3077): unsure at all n locations
tgcattaaacatatgtgttttgatgtgagcttaacacgcaacagaaatatctgtcctgcgtgtgacctttttcacctgtggttgggtcggcaggaggaaccaagaagaggcaagggccggcgccggcagcagataaaacagaggcttgcaagcatgtgttattgatggattgttgtggttttttctgactttgtttaccgtacataaggttaaggttgggaacttcacctttccgttcacaaaagaagcgatccagtaacgcgtgattaattactccctccgtcccacattgaacgcatttttaagtttctatgtcaatcatttgaccatccgtcttatttatttaaaaaatttatgaaaaaatttaaaaaatagtcacgcataaaatactattcatattttatcatctaataacaataaaaatactaatcatattttttttaaaataagacgtatagtcaaacgttatataaaaagctgaaaaatgtattctttatgggatggagggagtaagcattagctaaaataaagttaaataatagataactatgattttctttaaagcaactttcctatacgtgaggttgatagggcatgtactgtctgtgaagtgactatacgttgagataacggaaagagagttgtcatgccacttgggaaaatcgctagggattggccaaaatgactttgtggcgtggagacagggttctgaatactaccactgtccggttattagatttggatagaagttcaagtctaaaatgttgaatttgtaccaattggtaaccatctagttgttgcacaaaagtgttgtagattaaagtttgaatttatatcctctcgccggtaatagggatgtaaactatactcctccggtttcatatttcttcacgttttggacagtgacacggttttcaaaatatgtctttacccttatttttctgttataatatatacaatatataaatatatgtttatttttattatagaaatttgaaagacaaattcatatatggttttcttgttcttttaaactaaatacttttaaagttattgatagttaaagttacacaagtttaactttaacctccaaaacatcgaattatagaaccggagggagtatcatttttacggagacaattcttggaccatcgtgaattttcatatttatcaatgttaagtatatagttccgagttccgactgcaacatgatggcaaaattagaaaaaaaaaatcaaattttatatatgactaggaaattcaaatattagatatgagtaaaacataaatggtcaaaaatggtgtcacctttacggaaacgacctaattgatccactggacaatggtttgttattggtcactcctctgggtagattattttttttaaccactgtaatttcttcatttcctttctgtgtgtgcgtttgaatgatgaccaattttgacccaaaaaactcaaatcaactcgaaattgaagaaaacaagaaattatagaaagataataacccacatatatactgtatctgccgagagccgacgagtatctgaatcttccactacaacgctacacctgttacaacttgtgttgagcagcgagctaggtattgtccttttctgattaacatacaaattttaacttgatttataatagaattgttaaacgatgcattttgtttaaaaaatataatagaactgtcaaacaatgcattttgtttacaaaaattatatatattaagttactttaaaataacaaataaatctattctctaaattcatatagtaatcgaaatttaatttattttgtgtggagtaatagctagtatcttttttttaattaactacatcttcatttccatcttcctttaaaccaaggccacttgagtgcgctgacaaaagtgacaagcagatgaaattaaaacagcccattaattcgtccatcaatttgttaggaagaaaacaaacataaacaacagcncaggatgggatgcgatctccgtgatcgctcagtgtcgctagcgtacacaactcgataactcattagaaacaaaacgcttcccccctcttgcagcatggcactacaagtcgtatgtgtattttaggtttgacactccatggagatccatcgacagacagattctctattaattcttccctggtttcaagttttcaaccccccggacctatgggccgaagtctcattggttacccatataatccctaagaaatcaaagcgatttattaggaaataaaaattaatttatagttaaaactcttatacagttattcgtgacgatttagaagccaacgctaaaaagaatgacgtcaaaagtttcttaaaataaactttaaaatttaaattttagacttttgctttgacttactccctctgaccgtaaatatttgacaccatttgacttttttaaacatgtttgaccattcgccttattaaaaaaattaagtaattattaattcttttcctatcatttgattcattgttaaatatacttttatgtatacatatagttttacatatttcactgaataagactaacggtcaaacgtattaaaaaaaaaaatcaacggcgtcaaatatttagtgacggagagagtattaggtaaaccgatggtgcggcgcgggaggtgacactgcatactcctggtacgcaacgcaactcgatcggatatgggaaggacgagacggactggggaggggaccccggcctcaatgggggcacatattctcgtacggtcgaacgcaacaaacgcgacgcgacaaaaagaaaaaaaaaaaaccccaacgtgccgtgccgtccccgcgcacgcacgcagtagctaggcacaacagctgcttccgtccgtcgtcgggaggctggagacggggacggcgactaccgctgcgactgcgtacgtgagagtgtagcaaacatccacccatccatccatcgatgcatggagacacggccccctcccgttgcgttgcgtgccgacgtcgtaggttcgtggagggtacgatgatcatctgattggtcaatgcatgtgtgtgatcatgcatatcatggttggttaattcggtttgg

SEQ ID NO: 104414 - DNA, 1694 bp, Oryza sativa
attcctgcagcccaaaggacattttactagctagtcaagtaaattaagggtgtgtttggttgggtggatgggactggatgggagatggccgcctgattttttggggtgtttggttggaggacggggtggatatggcggcccagaataaggaatattctctcaatatgctggatgaagggatccggttcttttggccggatgaagccatccaccttctataggacgctgattagtgcttgattagtgagtttattagagtatgattaacggtattagcatgttttgctattaattagtagttagcatggcaagattagtgtcaacaagtgttaattccaacctgtaagtgtataactaagtaatattatgccaattaagatattataattagttaattaatctcatccgatgcatcctcatcctgtcaaccaaacaaaaagttggctcatcccatccatacaaccaaacacaaaacttgtatatcctcatccttaaaaacatggatggacatatcccatccaaccttgcccttcaaccaaacataccctaaaacgaacagaggtagtcaagcggcctttgcgaaacagaaatagttctgaagtgttttcagcatcagagttaaacaaacgcatgggccaaatcgcaaatggggacgaccgtctagatgaaatccagatagaattaagcttgattccatttcgaaactcggccggtcgtaccacggagaatcaatcttgcaagctagctagtttgaaaacaaatacagattaattaaattagacctataatcatctgtagctagctagatgctcgatcgattgagtgtcgcaaaacgcaatatcagaaaaaggggcaccttttacacacacgcaccctgggcttcctttttctttgagcattttaatgatatgaatttcaactttgctcgtcaacgttccaccaaaacgacacgttgctgtcagccttttcgcgacctttctcccttctcgcggtaacgtgcgccgcggtgctttgacaaaaacaccatatatttttatataagtatatatatatatatgcatatctatctctgtatacatattatatatattcacttccattacacacatagaacctatatatttattcatatataccgagacaaacaaaataaacatataaattgctatgtaccgataccaaaaagattttgtctctaactatgcacttggacaaatggtggagccaccgcttcgggaccccagcatgggtctgggcccaatgaatatgaagtggaatttttcatattattatttaaattgaaaataaatagaattttcatgataattagatttgttctggccttgctccggcactacacctgcatgcatagtactaaggtgctgcctagaaaaatatatttttccagacggaaccttaagcggtccgtctgagaagatagatattcctaagtggatggccacagagctcgacattctatgttgcaggaccggtggtggcgaagtttttgtctgcctggaaaaaaggtagtaagtttttcgtctagaaaaatgattttcccagcagtgtgcttgtgcagctgcataagctagaaatgaaatctttcgtggagtaatatatagattgtgagacagagagaccttttcgctattgggatgacggcaaaagcttcgggaggagtggaagccacactg

SEQ ID NO: 104415 - DNA, 2245 bp, Oryza sativa
tcctgcagccccaagctgctaattattgccaacttatcagtaccactagtactatactgtccttttgcgttgctttcttttagtttaatttcagaccatattaattggttcatgtgattaatgggcttgccatgttagcaaaataattataggctgtattctttcatgagtgatctgggtgattgtgagtgagtttgtttcgttttctgcgcacacgcttcctaaactattaaacggtgtgttttttttcaaaaaatttctataggaaagttgctttaaaaaattatattaatccatttttaaaatttaaaatagttaatagtcaattaatcatgtgctaatgactcacctcgttttacgtatcttttcaatctcccctatctcctctcctcaaacacagccatagtcaagttgcctgcctttttgtgattagtttttcaaactggttgctgtgcgcctctgtttgtgatatgggggccacaggtggtgtgtgtacgtgagatcactttgagtctttgacagggaaattaattaattaattataattgcatgcaatgttgcaaatgtgccctagcctgtgatgtgatgcaaccctttgcttttgctaattgcttgtcatgcacggcaggctaacctgaaattaactgccatgccatgcaacatgacaatatgccctgtgtcatgtgcttcttcactatttgtatttcgtacagtggttggggtcgggagatttcgtgagcttaattccaacctccgatttgttcttccataactgctacatgtacgctgcataaaatagacggaatcccaaacatactgtagaagtgttcatgtaaagtgttctcctagttaatattgattttttattgttacaattttaaccactaattaattatttggcaccgggatgatatcctcgacatgattgtagaagtgttcaggtgtgtaaagtacttcggctgtgtttagtttggttgtgtttagttcagcgcaaagtttagattttggttgaaattggagatgatatgactgaaaagttgtgtgtgtatgaaaggttgatgtgatggaaaaagttggaagtttggatccaatgtttagatctaaacacagccttccttggttttcaaataattaatattattaaattttatttgtttcaactttggctaatatttgttgttaaataattagactataattattaaaagtttcatgcttatataaggatgatataccctttaacaatatgttgtattttttttgtatttgcaaatatatattttgcaaaaaaaaaaagacaagtggtcaaagcgtgaaaatgaatagtacttgtccgttattaaagaaagcgagggaattaatagtaaatatatatttaaattttctactttgtggaaatacagttaataataataataataataataataataataataataataataataataataataataataataataataataataataataataataataataataataataataaggtctgtgcttccgtgtaaaatcgtgtaaaaggagtgcccacgaacgcaacacaatgtcgcactggtctgtcagaaattaagcatcttcaaagaatcacatttgggatggcattgtacctcccaaggactgtaggacgtacttgctatgactaatgtgattctttcctcgcaaaagaatgtgtggttcttgtccccatgtacacctatgcgcacaagaatcacaagtcatagtgaagttattcatatctcattttaagcgcagccataaagtttcgcgtacaactttaatcgtccgcctaatttaatttttttaaaaaaaaataaaaaaacataagtcacacatgaattatcattcatattttatcatctaataataaaaaaatactaataaaaaaaattcaaataagacagatcattaaagctgaacatgaacatgtaaactcattgttgcgtttaagggcccctttgaatcaaatgatttatataggaattttataggattcaaatactataggaaatttttctatttggccctttgattcaaaggattgaagctttccaaatcctatgaaattcctatagaatggcacattacatgtggattttagagtaaatttagcaagagctccaacctcttagaaaatttcctttgagtctatatctctcatccgaatcctgtgtttttcctacgctccaatcaaacgatcattcctgtgtttttcctgtgttttg

SEQ ID NO: 104416 - DNA, 1705 bp, Oryza sativa
taagatgtggtgaacttttttgcatttttgaagaaattaaaccatctcttgtaaattccatgtatttataagttgcttgatggatccataaacttatttgctctgcgacgcaaggaagcgcccaccacaccatgacagatgattaattgaggcaatgcctctaaggacattagagagattagggagtgatttcttttggcatggtgaggaagaaacaaaaagaaaagaaagaaaatgggtgggttgaacataggggaatatgtgtagttgcaagttgtgtttccatggatcacctctttggcataagttaaaagtaatgagttatgcaaatcttaaaacgtgtggaattgtgtaaggttataatgggttatattgggttgttgtgtgttgtagatatggtggctagagtatttatttctttatttgatggaaaatatggtgccgaaacttgagactgagattcggctttagttttgtgaatgtgcagatttaaaatggtcttccaggtttggttgtttgagagaaaattgttgtacaaacttggtcataaaaaacgatctggcactattgttgagaaatagtgattcatctatttgtgtgaggaatatcaagatatttaaggtctggtgattttttgtaattttaaataaactaggaaggtagcccgcgcgaatgcgcgggcatgaccgtaagtttgagacacttataatagcgaaatattaaccggagaacatctaccacgatttctccgtaaattgtttttgtcagcattaacttcttctataattttctaacctcctgctttatattatatcatatttaagtaatatctataagcaattatttgtaatcttcttcgtcatttgaaaagaaggtaaacttattttctttagaaaatatgtcaatgaaaagtaagtactaaggtattattctttttttaattgaatatatattatcatggttcattcgagaatgaattgggtgggacataaagctccacttaaagtatggatgtatatagcttaatatgactaatgtagtttgagacactaaaacaaaacatcaaatagatgccggcactatataggtgccgaaaatgttaaaaccggcacctatatagattttcccacctctgcggggtgaaaaaaaaagaaaaccagcaccttttataactataggtgccggttctaaataaaaccgacacttatactacaagtgtcgggtttttttaaatgtgatgtaccatgaatacacacttgttttttcttatataagatagatctaacggttagaaataatgtttccaccaatttaaaaggcataggattattccgaaaatgtagcttaaaaattatggttgttttaattccaacattacgaagtgaacatagctcaactggttaggttccttgtggtggaacttgtccactcgggttcatgtcccagatttgacaaattctttcagtggtaggcgatgtggccgttgatagcgaggcgtagtggtaatttcgtcaatctcaaaatatgtcagactagtctcttggaagtactcataggggtagtgtgcacacattgtgagcgcctgcatttgtactttgtttctaaaaaaaatatcaaacaatatttattgtttctcttttaattaaatagataaaacaatagagaaccacagtgttgtgtacatcttagtgtgaggagaaggtgg

SEQ ID NO: 104417 - DNA, 838 bp, Oryza sativa
cttaatggacttttagtctctaacgttacctattgtatgtcgatccgatttgtcgtgatgtatttaagactataacataacttgtatacaccgttagtttatataattaaatgaatacaatggatcatatattgggtgtataattaaaaataatttaaaagatgatgtttacagaccattgatttatttgatatttgatatttatattatagatctagcttacatgcatatacttcagtgtattatgtagtattatattttatttttattttatattatacaaaatcctattctaaaccgtcgttttttccacctgtacaaagtatgcattttttgggggtatatcattttttatcatatatagatgtctattttttttcttccggccaacagtaccagttgcatagtttatttggaggaaaaattatcacatttttaataatccaccaatctaaacacaaatcgacagtgagattagatcgtgccatgtggtggccttggagtgtttgtaagagagccacgtggctgtttgagagcatttgtagaaagtttagtagacttttaatctatatatgggctctgaactaataggattaagcgtaattaactcactaaggatgaaattccgctttttaaataacgtttatgatgttaggccattcatcttctttaaaatcgatacggtttttttcttaggagggtatcgaagcacatctcacattagagaaatgttttaattcggtgaatagtatgagtacgtatgtacacaggatttgttttagctatttcccaggtgaacagtactactatgtatttatacgtacacacgataatttat

SEQ ID NO: 104418 - DNA, 647 bp, Oryza sativa
  unsure (1)..(647): unsure at all n locations
tcaaatttaaaactaagttttaaattaagttttgtcagtgatggtcgagtgtggatttatgtttacttcgttggaagcgcaggtcgcatggctaattttcctccgttgattcgtccctcatccaaatatacttctctttctaagtaaaattatttgtcatcttaaggccatgcacaaagttagagacgggtatgagctctacgctatctagagagactaacgtcatacaacagttgaagacaatatggtctctaccattaataaatgctaagagtcgactctgaaccgtagacctgcataacaaccatatttctctttcctcctttctctttcttctatactatcaaatttactttacttgcatgataatagagagaccactaataaacactgttgtacatgccctaagcagaaaaaatatgctatatggtcataaatatttgacagttacaacgagattcaattaaactttcaaaattcagtccaaaaattatggatagccggaattttaaaagttcaattgaatcatatcctgaacgtaaaatatgtatgaccgaaggaagtaatttttttgggtcgtaaaatggcccanaatcacaaattttagcatgaatctttctttaaagtccccaaaaagattaatctct

SEQ ID NO: 104419 - DNA, 3176 bp, Oryza sativa
attcctgcagccctaggtgagggttggatgaggatgctaggtcccgatcttccaatagttattgataactctcgatttagtggaaacttgacacacacaatgcggcttccgatcaacacaatctgaactctgcaatcgtagcaccacgtctcctctagttatcaaccgtccactgctcggttgacctcgccgagaaggctaatccctgcatgtgaatcaaataacacaagtaagaacaagatagattgcaacacaattgtgtatgaatgattaagcactcgaatttgaggttccacaaaccaatctagcaacgaaattgcaatggcataaataatctaagcaaaacctgactctaaactatgacggctgctgaataaatatgatttgagacgtccttgggttgccctagagcgcgcatccccttgggctaagccacgacataattacaaagcccacaacccaaatcatatttggactggatgaggtacgtgacttgttttgcagattcccgatatcttggtgggaattttgacgtgggaccaaaaccatatgaaagtagactccaataaactttccaacaagtgctcatgggccctaaaattccttttagattagcggctaggtccgtttgaaattgatgctgtcatgaggcctgaatccgaatccaaaacgtgtagaactttatctcttgtcttctatggaccaaaagtggcgtggtgaggtagaagtagacttggagaatgtcttagtttggtccccaatcaacttctttgatcatccttgcattccttatgctcggtttcttttccttcacccaagcaagtacctctgcaaacgaaaagatacaaaactcatggtgtagtaacatttgttcaaatatataataagtaaatctaagatagaacatatgcacctttagttgatgaatacataagttagacatggtcatatccgagctagttgtgtcctcatcagggggattcggcaggctgcaggcggagcaaaggggcgagcgagatccgcgagatccctcccctcctcctccggctgctaccgcgagatccacgagatccggctgcatgccgtacatcaccgtcccatgccactgatctgttcttggggcggtggggagtggtgagtttgtggtcgtttcttgcggcgtggtgaggtgtggggagaaagagagattgcacatatccatggcgcggtcccgcttctcggaggcgagggaggatgacaaagatgagttctttgactcgagggaggtcatgtcgccaacgtccatctcttctccggcgagctccgggcgccatgacaacgacgggttgcgctatgacggacccatgtttgaggtgtgggccaccacccagcgctactgccgctgacgccctccccttctcttgtgtcgtcggccgctggacctccccgtggcgcatggagagagaagaggggagagagatgaagagagggcagatgggaagagaggaggaagaagaggagggtgtgagaatgacatgtgtggcccatgtgggccccactattttttaataattcttttggtgtaactgacatgtggagtcattgtttttattactccctccgtattttcatgtatgacgccattgacttttcgaccagtgtttgaccatttgttttattcaaaatttttgtgcaaatatgaaagtatttatatcatgcttaaagaacatttgatgatgagttgagtcacaataaaataaatgataattgtataaattttttgaataagacgaatggtcaaacgttggataaaaagtcaacggcgtcatacattaaaatatggaggtagtaattttcaagtcaaattgccacgtcaataccacatcaataccaagcagatgaaaaccgggtcaatttagccacgtaggctaaaaccctcgtccaaaccgtcatgggacctatattgctccggttttgacattagagggacccgttgtatatggttttttggttaaaggacgaaaattagattcgttgacaagttaagggacctcacatgaacttattcttattttaaatgccaatttgcattgaatataaataagagagaattaatatggggcctccattgtaaaattcgctcacgaaataaaatagatggcccattcaattcattagctctagagtctagacaggccgagctgccaagaaggacagttggatcaaggatcacgcaaccaagcccatttaatatgttcccattttctttcactttacatggttaagatgaaaaacatttacggtgagtttgttgagaaaatataaattgtgtacactctcccaaaaagaatgccaatcctattattcaaattttgtaaagggaaacaactatagagtattactttttcccccaaccagcacctattcaaatttctcctcatgttcctccgaccaatctcctactctcagcaatctctcattgtattctttttgtaatagagggagtaaggttttcatacataaattttgctagttttttcacacgtaattttgaaagctgattaaagaaaaaaatctcagattattcaccagattattgaaataaattatttcatccatgcttaaaaaatacgttgtctaaaaaaaggttcttctgctgcagtgcttagactacttgttttaaactatttattaattttatttctcaaaatatttaacttatctttataactaaatcaaatagataatttgcgaaaataatccagacagtaatctaaatcaaacttggcccaaacctatgtgaatcacaaatatactcgcactagtttgcacaaattgttttcttaagttctttctagagggatttggctatttagcatctgagtgaaacttggagaatagcatattgcttgacatgtttgcaaccttaaagccctatatgtaggagcatcaattcagatgttaagggaagtatcttctggctctacatttgttactgcatatataatgcaaggagtttcttcgtcataagttctcttccaacaatctattgttctaataggctgaactgccattgacaggtaggcccaggaaaattttccggcccagtagggcccatatgttatttgtctctctttgtaagcaaaacacagatctttgtagcaagcaaagctgtattcctctcctgggagattctg

SEQ ID NO: 104420 - DNA, 662 bp, Oryza sativa
tgatataatataaatctaataggttaaaatattattaaagaataaattaatgctgacaaaaataatttatggagaaatcgtggcagatgttctcctgttaatacgtcgcttttataaatacctcaaacttggcgtacgactcatgcacgcgggggctaccttcctagttatactaatagttttacacatctaataaaatcattgcgtacgccctccctccacccaccgtactccaccatctccattggtggtttggcgccttatgctcgggtcacgtgaatagtggaatgtaccatcatatcaattaatcgtctcattggactatatcatctctacttcgtttatcaaccaatcaacaaaaaccatagcgttgtcatctccggagcaaaggggaattagagaattaagcaagcattctgtagaagagagtttgacgagaaaaaaaaagttttagtaattaactccgcagcagcgcggtgcatttggccatcctttaatttcagactcttatctactcgacttgtcgaaccatcgatatgttggagcaatctctgataactgaccaatatttttagagtcatatgctcttgctaatagaatgctctaaagctatctatctaaaatttttcaccccaaacgacaaaaaaatacacctgcagaga

SEQ ID NO: 104421 - DNA, 2912 bp, Oryza sativa
ttcctgcagcccgctaagttagtatcggccggtagccaaatccatactactccttccgtcccaaaatatagcagcaacctaggatatggtgctgctatattttgggacggagggagtattaattagtcagtggtgaacctagaaaaaaatatcgggggtccaatgtgtactaattatctaattttttacttatatactaattaacatcatataatttaattagaatttgaataatttacccaggctcaaaagaccccgggaaaatgtacatatactagctaggcgtcctgaagttaagtacacctagagttttgttttggtactttattcaacttaatttgcaaagcatgcatgcatgaaatttgagctgcattcagcagagttggaaaaaaaatgcctgacataatgtttcttggttttagctggcatccaatacgaattattcgattcgtttgaccaggaagcactgagagctactagtagagtatgaaattatagtgcccaccagagaataagtacgatttgagcagcttgagagaattaaatttcccatattcgggccatctgttccgacatactaaagccctaaaatccacgtgcttcaatatatatttgcaccacgcatatgcaacagatgttcattattaatagtgacacgcatattcatcattgaccatgcagtgtcactattaattactccctccgtattttagtgtatgacgccgttgactttttgaccaacgtttgacccttcatttcattcaaattttttgtgtaaatatgaaaatatttatgtcatgcttaaaaaatatttgatgatgaataaagtcacaataaaataaataataattacataaatgttttgaataagacgaatggtcaaacgttgaataaaaagtcaacagcgtcatacattaaaatatggaggtagtactacacaagaggcgatccctgaggtagtactatacaagaggcgatccctttcggtccgtaacttgcatatccctgtccaattctcaaactgacaaccatactactttctccgtcccaaaatgtaagcatttttgaggttggcacgggtattaagaaagtaggtgagaatgattaaagaaggtgcgtgattggttgaaaagagaaagtaggtgaaaaagaatggttgtgattggttgagaggagaaggtaggtagaaaaatagcttcattttaggacaaagtactgtgctagaaatagctacattttaggacagaggtagtagttggtttctaaactggcagctgtacggacaaccattgctctttgacgtgaaccaatgacatataggccggccatgtcagtcatttaaagttaagagggcattaagatggtgtttggatccacggaataaattttagtcctgttacatcacatcggatgtttgacactaattaaaagtattaaacgtatactaaatgacaaaacccattttataaccttggactaattcgcgagatgaatctattgagcctaattaatccatgattaccctatgtgatgctacagtaaatatgtgctaattatggattaattatgcttaaaatttttttctcgcgaattagctcttatttatgcaactagttttattattagtctacgtttaatacttctaattagcgtcaaacattcgatgtgacaggaattaaaatttagtccctgaatccatatatgtaagggtaggattgtctttcgatattagtgataggtaccgtattggttgttcttcggtatgggttaagtcatcctcacatctattacattatttgcatgattttttccacacatttacgttttgtgcctaaaaacttgatcgattaaagcatatactctctccatcccaaatataataacctaaaatcgaatggaacatttcctagtactacgtctgtctagattcgtactacttggaaatgtcaatgtcacatccggtactagattcttatattttataggacgaagggagtaagtgattgcatcggttaaaatatgactgaatcttgctttggctgggtcgccttgctgctagtgccgccggctgccctgttagttgccgaagcccttgccgctgcccatgtacctgccacgaaaggggaattggggagttagggtttttagccacaaacaagtcaacattttaacccacgtaaacacaattaaatgcacgcgatctttgttctttcttttccctactgtgatctaaatattgattgagtcagtcgttgttttcctactaccgattagatcgagccggcaatcctcttaaaaaaaatactcccattcgttcctaaatacttgacaccattgacttatttaaacatgtttgatcatttgtcttattcaaaaaaatttaagtaattattaattcttttcctatcatttattcatggaaaaagtacgaattaccccccgaactatcgcggtcgaccgaattacccactgaaccacaaaaccagacattcttcacccgtaactacgcaaaccggacaaataacccgccccctcccccccccgccctcaaaccatggtggttttgtcctacgtggcagtccagtcaataattcatttataaaaaaataggtggaccccacctttaagtttcttaccctctctctctactctctcagaggacaacagcgcaggtaactgagcgacggaggggagtcaaggactccggcggcaggggcagaggagcatggcggcggaggaggcgaggtggcagcggaggagcgcggcgaggcgaggtggcggcagcaaggtgaggcgaggcgaggcaaggcgagcacaacggtgaaggaggcgagtgctgcggcggaggagcgcgacagcggaggaggcgtggcgaggcgaggagagcgcccagcggaggaggcgagcacagc

SEQ ID NO: 104422 - DNA, 1809 bp, Oryza sativa
tgttaccaaatttcggtagaacaggataatatgttgttgtcagaattcactatgcattatcaatgtttgataacaaactaaatgcatccatatatttgttaattttaccacatggtatggtttaaaatggtactaatctgaataagccttagtgtataaatctttaataactctatttttgtatcctcttcaacttaaagaattgtctttttaagtaatatatttatgagatttctttaatattactttattttctctcgttttaaccatttaacaagcaatattttcttctctttctcatttttttctccatattgatgaagggcatattagtttttttttgttttcttacttaatttaccttttagggacggagggagcaaagaataattacctgggtagaaatggaaaatccatggaaattgaacaaaaacaacaaaagaaaatataggtaaaacttttttcttttgttgtttgcaatgctaaaaaatagacaatgatgaaaatagtccaaaatcaactctaaaattttaaaattcaaaatttggttgtaggtgataagttaacaagtagataatgagattgaaaaatgtttcaatttcaccctccacaactcatttcaatttcccctagtaatgtttttgtaaaaaaaaataatggatgagatccggccttcacttcaacggaacctacaaccaattatacagttttttagcttaaaggcaaataaaaaatagctaccgtaggatgaaaaggaagacaaataaccactccgtcaataaaagaagatatacaactcttgtctggacaataatcatatttaaaaatttccatccaaagttaacgataatctatattaccgtgttctctaaatttgtgcatgcaagatgaatggattccttctccttatcacacctttatagattgcttagaacccaagtcggtatgttgctccgaaaaatacttgtacataatatgtagttggagctttgtcaaaaccatattattcatactaagtcacaaagcttaatttgaagccaatactcctagctattaatataagtttttacacatatataactacggacacaattgctcatgtaatacggtcgttaaaagttaactctagtatcaccctcgaataacagttattatcacaaattaaatttataatagttaatttatcatacgtatcacaaataatgaccacagtttattcgcaggctattcaaccattcgactatggcataagtactgcctccgatccataatataaatatttttagagttgggtataattattaaaaaaataggtagaagtgaataatggagtgttgtgattggttaagtagtgaaggcagataggaaaagtgaatggcgggggttgtgattggttcaaaagaaagtgttggtggagaagttgttatattttagaataaatattaagagttaaaagttgttatattttaaaacggagagagtatctcaaattaactttacataagtaaatgagaatggatcgcgataaacgagaactgagacgaaggcaggcaggcaggtggtggtggtgacattgaatgtactgtatactaccactgactactcggggtcgggggtagctggaggtatccggcatggcggcatcttgacgttgttggaactcgagcaaagccggtcaaacttgtgattctagaaacgacacagcctcctccttgtgtaatggtggagctgagtgtgtactgttactgtggctgtctgcctacctgcaggctgcagctgctccagagaagcagggcccgttagtccatg

SEQ ID NO: 104423 - DNA, 1258 bp, Oryza sativa
cccctgtgatctaaaaattggtccctaaggaaccccggaagggctgccatccaatgggtacacgaaagtgacgaagttgctttgactactgaaccatgcctagatcgttggagcaaattggatgatcgggccgagggctgccccctaggtccttagttgtcaactttatggacatagaagatgttctgcttcaatttttttttacatttccaaacttaattatatttttgcaatgtcacattcattatgttgattcaatgagatttttgatgtgtacaaatcattacaatatatttctagagtcaactattataccaaatacgaaatgttctgtattccgggtattgaaacttcaggttttgttgctcagtattgaaaattactggttttgatatagtagaaggaaaatctaactacggaatttcaatcataaatttagcccatgtttgtttgaaatagctgggggcgtacacatactcaccgttatttctcgcttaatgttgctgtgaacttgtgaagcttgatggctatattcaaacagaagtaccagatttccagtctacctgatacttgagatcaatggtagattgcttctatccactttactgccataacatggtgctaattctcatcaggaacaccaagatatacattatacagtactgaaactatcatgtcaacaaaaaaagagaaaaacatgtagtatttaaatatcgatctgctgcatctgcactaacagatcaagtaatgcaacaagcaaaagttacttgtaccttgtagaatctggtttggtgcttttgaactcttggtgaagggacaaggaagtctgcggtagtctgaaaatgcaagtgcttaatgtttgctgaaactgtcatttgtagttcagtcttagctcttagggcagcttctttgggccctattaatactccctgaagcttgctctttcattaacaaaagcatgtcagtcttcctaattcctcccctttcttcagataatatacctttgagaatgtaagtagaacatcatcttctttgacaaaaaataataatggaaaatagaacctcataggagaggaatacagctttgcttgctacaaggatcagacttttcattccaaagaataagacacatgtttgagaacatatgggccctgctgggctaaaaaattttcctgggcctacttgtcagttgtcaatgcctgttcataacactcttagaagttagaacattcttagtttattatcggaagagaatttg

SEQ ID NO: 104424 - DNA, 689 bp, Oryza sativa
agtttcttcaaaataaattcatctaatcatctgtgatctctctccctttagggcttgtcaaatcaaccaaaattttatacaccgtcacatcgaatatttgaacacctgcatgaagtattaaatataggcaaaaaaaaaataattgcacatattgcgactaatttgcgagatgaatcttttaagcccaattgctctatgattcgacaatatggtgctacagtaaacatttgctaatgacagattaattaagcttaataaatttatctcgcggtttattgacggattctgtaattagtttttttattagtgcctgaacaccccataagacaccctatataatattcgatgtgacacgctaaaactttacacccctgaatctaaacatcccattatccacctattcccttttttcattattggtttatgtgtaaaactaatcctccggactgataatacctgccattttggataagggtgatgtcgaactttaaaatctttaactatgaataattttcaaaatatttatcttagaaatatgggtaactggatgtgtatatatagattagtcttaaaaacacttcaataaaatcattttttatatttttatatatattataatataaaataatggctaaagttactttttgaagattgtgtccttatccaaaaggataagtaaccagaggcag

SEQ ID NO: 104425 - DNA, 686 bp, Oryza sativa
attgaacacatacgtatactacacacgtcctacaaacgtactcctctcgttgtaaaattaagtttatgtgttagatttttttttattttaaacagaagtaatactcggtactcgcactggttaatgcgtcttgctgtacgtgtaaggggttgtttagatcaggggtgtaaaattttgacgtgtcatatcgggtattatatagagtgttgtatggggtgtttgggcactaataaaaaaactaattacagaattcatcaagtaaaccgcgaaacgaatttattaaacctaattaatccgttattaccaaatatttactgtagtaccacattgtcaaattatgcagaaattaagcttaaaagattcgtctcgcaaattagtcgtaatctgtgcaattagttgtttttatcctatatttaatacttcatgcaggtgttcaaacgttcgatgtgacagggcgtaaaattttagggtgtaatctaaatatggcctaaatgattaacttgtaaacttatttatagatcaaagtagtgggttcgtgatttattttagtctatataaatagattttgtgagtttgccacttactccctctgtttaaaaaataacttaaatcctatagataatttttagatacacgtgtgtctatgtgtgtatagatttgtccctaagattttacttttacttttt

SEQ ID NO: 104426 - DNA, 579 bp, Oryza sativa
atgaactgaatttgaacctccttgacaaataggagagcggaaaaatccttcaatggagtgtggagcatgcattatacattcttcaatccatggtggaactttattaaaaagattgaggtaggaagaatgcatacattgaccttgatggtcgtgctttatagtagttgtacatgccattttgctactctcatatactatactgtagtaagccagagtccttcaatgctccattgatgttcccaactcacatctctcgttctccaagtgcatgcttaccaaactgctatatggtgtgtttttttcttttttaaagaaaagttttatatgaaaattgttttaaaatcatgttaattaattttttttaaaaaagagttaatacttaattaatcatgctttaatgaatcattccattctacgtgcgtgagaaattagcacccaacatcaacctctgaacacagcctaaaggcagtggtggtgtgaaagtgaagcatgcaaagtgggctgtgggcgggctctgcgtttgaaagggggaaggaaggttttgcatggaatttgcaatggcagccggtgagacctttt

SEQ ID NO: 104427 - DNA, 678 bp, Oryza sativa
aactaattttatcagttcgtcgaacgaacggcgacaaatcctgttccagatatgttttggattattaactgtgactcatcagcacaccatgatgtcccatctaattgtcaagctcttatcgccttatacggattaacaaattgagcagcatcttttctgcaatagatagaaaagtgaagctctccccttcacgggactgatcatgatatatacttgttcatgcatttgtcatcgatgttgacatggcaaagacctttcttatggaatgtacacatcattgacctcattttggttgaaactttccgacaaattattgctctgtttaatttcctgcaggagagaaatcagattgtccaacctctccataaagtttccttccatgctgcaactttgaagaaaatttcttgttttctttaattaattagttactccctgccaagaaccgtcagtttcttatcaacaagaggctgttcgttgaatgtgatccgttctaatccatggacgctccgacaaatctcatagaatcaggaaacagattattttatatgtacttctgatggagacagacagggtttactgcagttggtgaagctgaaaattgatcaagttactaccaatctttgtcaactaatatgaaccatagagtgaaaacacatgtgctaatttacatcaactaac

SEQ ID NO: 104428 - DNA, 681 bp, Oryza sativa
ctagtttttttttttttgtttaggatggaatattgtttcatggaggaggaggagaaatcaggggagcggcggttacgggtcacgggattgggttgttcgactcgaggttacgggttgctactgcgggattgggttgttcgagtggaggtgtggggtctcgcttcgattcgcttctccgtccatttgatcgggggagagaaaaatttttcaaaatcggtcgaatcacgagtccctgtctccaattgcggtgttacggggtgatgatagggatcgatttttggtcgtttcctccttgggttcttcctaacactacagattcgattggtctggagtaggtttcaactttcgtcagccacaaactgtttgtccgcgagcacggcgtcattgaattggcgaaataaatcgatcaatcaatcaatcagcgttggtccctgaccagtccgtcctcgtgtccaatgaaaagcttccgatggatggatggattggttggaaaatctcattacgatagctctggagtgcttcattagtttcattatattgtccttttggatttgtggacatacactctaatgtaggttatcgtaaacatgaatgaatgccgattagcttgctcccttggtggtgttcccctcttgtgctttcgctgtaaccagcgattgccggttgccttcggtaggtaga

SEQ ID NO: 104429 - DNA, 654 bp, Oryza sativa
  unsure (1)..(654): unsure at all n locations
taggtcatagttagtggtgccacatggaaccatgtatatataataagattaaaatgtcagatatcacgtgtatcacgatggtgtagtgctgtgctgtgctggcatggcgcttgattagggggccactgcccctatcgttaaccccactgccctggatagttgtgtccataagacgacgtgattttttgtccaaacactgtacaagcatactggtgtgctactccgttccaaaaaaaaaaaaataaaccctagctacgaatctggacacgtatatgtctaggtttgtagcttggattgggtttttttggacggagggggtaggtgtttatataaactggcaagatcgatggaggcggcgcgttgggcggtccaccggcctaaaccggatctggccgcctccgccctggtgcggaaggggggaaggctagtggaaggagctggatgaggcgccgaaggaggagttggccagcagtgttgggggagcccgacaggatgacggagttaattggagggggtggtcaagccggtcctaagccgaatttagccgcctccatcttggttctggaagaagaaggccgacgaaagtggagttggggagttgaggagttggaggtgcangtggccgggaggttggccggaggggcacaacaggtg

SEQ ID NO: 104430 - DNA, 648 bp, Oryza sativa
tgctgtttttcttcctactactttaaaaacgtagtcgtcttcctttcaactctttattgtacgtaggatggctttttactactttaaaaacatagtcatcctccttttgactccttatcgtgcataggatggtggtttttactactttatgatgtcgcctagaggggtgaatagacgatttttaaaataaatgtggaagctaaaacaaaacagggtcggattgtctgatatcaggtcggatagtcctatgtgatcggattgtctgaaatgagatcagactatctgacctgcacaacaacaaaaacaaacaagaaacaacctaaaagctctagatccaatccacacgtaaggaggtgagctcaaccaacaacaatattagcatggcacaaagcaatgcaacaagaaggtaaagagagataggatatcactgaggtttacgcgacgatgtatttcccggagttcaaatccttgaggggattctagtctccgttgaggggctcgcaaagagccgggtctttttcaaccctatcctcgtgaggttgcacaaatgcactcctccttccactaagggtatctctttccttgcggaggcgagatccggccttcacaaacttctcttggccaaccacacgtagatcggtggcccaa

SEQ ID NO: 104431 - DNA, 738 bp, Oryza sativa
attcctgcagcccaggccgccttcgggcgcgccccgcggctgccaggtggggcccggccgtcagccgcccgcgccctcggtgcggctgacgcgtgggacccacggcgccggccagcgcaagccgcgtgcgcccggtccaccgtggaccgtgaggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttatgaagtcaagaacccatttttgtgctttgtttctgcttgttatatggagtttagtagagtaaaagccttttcttttccgttggtcgtgtagacgctgcagcttcggaagatccgctcttcgtggaagttgaagccggtgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttacgaccttattattgttattggtattattaccttgttcaccctagaaccaacaaaaccccaactagtggacactctactcatggtaccactagtatg

SEQ ID NO: 104432 - DNA, 696 bp, Oryza sativa
tcgttgattgcgagatgtttgtaatgacttcgtcaatctcaagatgtaccgacccaatctttgaagaatgtccatagagataggatgtacttatgtttacaatggtgagtgtatacttgtattgtgttttaaaaaaaatctatacgcacagtactacgggaggatagcatacggtgtttcaattcacctactcctaagcagagtgtaacttaactcgttaggtttcttgttgtggaaacaatccacccggtttcaagtcctaggcttggtacgggtgctcgcatttacagctaattattctttcaataataggcaacgtatccatcgatagcaagacacccatggtgatttcgttaatctcaagatatgccggcctagtctgccggagatctatacgcacaggacaatgggaggatagcatacggtgtttcaattcacctactcctaagtaaagtgagtgtaacttagctcgttaggttccctgttgtagaaacaacccacctgggttcaagtcctagacttggtacgggtgctcgcatttacagctaattattctttcaatgataaacaacatattcatcgatagcaagacatccatggtgatttcgttaatctcaatatatgccggcctagtctgtcggagatgctcataggggtaggataacacccttcaactactaaaaccataccaaacaa

SEQ ID NO: 104433 - DNA, 634 bp, Oryza sativa
cagcgtctgcaggcgtcatcgccacggacgccttccgccgcgaccaccagcgccactgcttcccgccaccccatgtcctcttcttgtaccgcctcgaccactgggcctaccccgaccgcgtctgcgtccacctccgcggcgtcgacatcgccgctcgcgagacccacccgcccacccggctatccgcctcgcccacaccgacgccaacctccgccgtccgccgcacgcccgttcccgccttgttgctgcctccccgggcccatctttggccgccacggagccccgccgggctgccgcggtgcttccccactgcgaccgtcgccgccggccgcagtcgcggggccaccctccttctctcccgcctcgccccggcggcctccaccccagccgctggccggcttgcccagaaaagagaagagaagagaagagaagagtgagagagagaggaggaggaagggagagagatgacgtggcatcctgacatatgggacccacgtaggtcccacgctgcctcagccgttacataggataaaaccggtgttaaaatcaccgaagaacctattctgaccggttttgattagttaagggacgtcgaatatctgattttgcggttgggggtgattttgtaactcga

SEQ ID NO: 104434 - DNA, 651 bp, Oryza sativa
aaactaaggcacttccaacaatgacctggttagcccaagcccaacccaggttctacctagcccaagacacagcaaggcctagtttgcccagttaaagatgagaatttggatgtttcatagcccattggaacacaataaatttacacccactttcatataagatacaatcatacagttatattttgttcatacaaaacattgtctttcctgacattatcttgctgcttcttcgaaggccaaggaataatttgttattttcattggtaatatatatacatgtcttgtaatattatctgatgccatataagcttaaagttagttaacacaatgtattgattagctctgtaatcctaaaattagagtcttaacccttaagcataagttaatcacgtatttcatcctgtacttgcttgattttgctatcaagtattgcaggtaccagtatatactttacttagtactccctccgtttcatattataaatcgttcgaatttttattttatcaaacttttttaagtttgactaagtttagagaaaaatatagtaacattttcaatacaaaacaaacatattatcaaaatatattcaatgctaaatctaatgaaactaatttggtgttataaatgtttgctaattttttctgtaaattt

SEQ ID NO: 104435 - DNA, 761 bp, Oryza sativa
gaaagaagaaccagaaacaaggtcaccaggttttgccgagttcagtggagtcatcattcagaagaggaagcaacctgggaaagggaggatgagttgaaagccgcccatccgcacctcttcgccagctcctccgaatctcggggccaagattccgtttaaggggggtaggtttgtcacaccctgaagttctcctcccaagcctaaatttaatttataaatgaccctaagaaaataccggtgcaaagcaagagtaaaccccttttaaatcaatgcaaataataatcggaattggcatgtggaatttttcttgagttctacaggtcgaaattcactaacaggatttttagtggaattttcagagccctaaaaataattttaaccaattaaaattgagcaagcaatattttaattccagggaaaattcttttctccttttttctttttctttttcccttccttttccgaatgggccgccggcccattctctcctttcctccccctcctccctgctgggccggccgcaggccgaggcccagccaggccgccccgccgccctcctctcccggggtcgccgacaggtggggcccacctgtcgggtccttccccaacctcccgccgcgccgccgcgcccgcaaccgccgccgcgcccacgtctccgcctccttcgggccacgtcgaccacgcccgcgcgtgcgccgcgttccccgcgcccactcccctctctcacccgctcgcgcccgcgctcgagatggccgggattc

SEQ ID NO: 104436 - DNA, 549 bp, Oryza sativa
cataatgggcatgaaagccttggacaaaaaatagtaaaatggaaggagtattacacaagataagcatgcaattctaagtttttttaaaaagccaaaattgggagtttactttttcaatatttttacaaaccagataaacatgatatctgcatggttattatcatcacctctttgtcccttaatccattacttctaaatgtgcttcatacaggtactgaagatgatttctttcctagcactagggatactgtaagtactgttatatatttataaaagactagccaaactaatcaagtgtatttgtacaaaagaaatgaaacaagtacagatttcagaagcctcaaaataaatatgcataccacacaacttaaaattacgaaaaaaactcctttccattgtgaaatatctgtaaactaaaccgattctcttttagtattgaccatgtcagaccttgataaagatttctcaaaattaattatcataaccctaaaaattatagtcctagtttctgaattattttcgaacatcgcacatttttcaataactcag

SEQ ID NO: 104437 - DNA, 686 bp, Oryza sativa
tagatattgtccttcttttcatacttatagctgcatcacttgagtttgatcttatgagtcatgattagaatctcaatctctagcctgcttcttggttgccgattagggtagtatcgggatttcagccgatcttacttgatttaactatatttgttttatatgctttattgacatgttaaatccgtcctttatgttaagatcttgccgtatctaagtatattaggctctttgtttggtatatcctatttgctttgatatcttaatatagagtggtatcggaatattagccgatacatgctagatctatctgatcggctatgctatgaatatatataattttattcttagtatatacttcgatctaagtgatttatattgtctcggcatggcgaccgatctatcccaatcacttgacttaagtatatatcgacataaagattatatatcgttaatatctatagccgatcgagtagatttagttctttcttatctatttatgactgtcgattgatgcatatatgacatcggctcaaagacaaatgatacgtcatcggcacctagccgatcggctatcgtttatggatttaaccacggtttctttgtctctgtttcttgttgattgcaggatcaaatcaactggcacgctagcatacccgaggcgagttttggacctgcactggagttaa

SEQ ID NO: 104438 - DNA, 930 bp, Oryza sativa
actcaagtgcatttcgttattaggtggagtatatacttaactcactgcggtgatttcagtgaatttagtgcatgcgatccggatctcccgcagctcgcgtgtatacatacagatccagatcctgcactaccgcaccacacaacacaacccccaagcaatataatcaccataataacactgaagaatctaggggggggggggaaagaaagtaaggggcaaatgagagaggagtgaatgatgaatgcggcggaaaagcagaactcacggggacgggataggagattcgcatccggggaggaaaaattggaagaggaggcaggcagacgcaggcatggtttactgcggtactggctctacaggaagagaggcggcgacgatggcggagggaggaaggtggacgcgtggtgttgccactgctacgactaaaaaacaacaaggcaagtcaatcttgatcttagagcatcacaacaatatccttaaatgaaacccaattttaaaattaaaatttattttataaaagaattgctccaacagttccatagagatgtatccaaaaattagaatctcattctcctccttactcgctctccacaagtcaggagacactctcactttcaatttccttcgctctctacaagtcggtcaggagacactctcacttccaatttccttatagcaaaaggagatggcgacaagtggagagatcgcgcgcgtgggaggggatggacaaagcgattttctttattatatgttggtagttcagtgtgggttcactttttattattggaagttaatttaagatatttgttagaaataaaaatctatttacaccttaaaatcaaattaggaatttcaaaaacagaattttaaagataaaagatttttgggtatcgtgctctttacccccatcaacttttacaatcgatctat

SEQ ID NO: 104439 - DNA, 1265 bp, Oryza sativa
gtggggatttagggatgttgggagcaactggcatggctcaaaatcaatacacaagtagtaaaaaataatgaaaataaaaagaaaaaacatttgccacatggcgctacaatctttagtctcgattggtgttaaaggggttgtaaatcgggactaataacgatggattccctagtagtggaagcatgagatgcaaaaggatcacgcttgtgaagctagcaattctcataaaattctagtcaaatttcctataattttcctcgttacgacaacaaaaatgatgatggagaagctgttttgcaggccagcaaccggttgatgccccatcattttcctctcccttttgtttctttcaacatatacatattgctgccttcttattttcttccattttcttatttagtatactcagtatatattagctttactagcctgattagactaagacatactaccttcgtccaaaatatcaaattttaattatatatctgagcatgtgctaaaaaaagtatattatgggacaaaaaaaatagtttttgccccaaaaaatgcccctttttaacaggtctttgctttttatcaggtcttactagataatttattaattaatatattcagtcaagaccacgtcaatataacgatggtatatcagatagggaaaaggggagaaattctagtccatttgcgactagtagcatatcgctagctacggcacctgcatggttcgttttcagtgaaacaaccaaagtgttattgttaaaaaaaaagtgttgaagtggaaaaaaagagcgagatatcgatgcatgtcatgtgtgtgctgtagctaagtaggagtcgtggctacacaaattaagtagtacgtcacaggaaaaagatcattttttttccggtgggctgcatgcttcagaaaaccacaatcgatcagaggaaaaattaggtgtgtccaactgtccaaaataagttaaggaccgtgaaagcaacaccctgcccaactctcttcctgctttatatgatctttttcttccatttcctctctatgcataacttcattatatattgacaacattttagttcgttttacgcaacgttcttttcctattgatttttatcctcatttctggccatacatacaggatacaggttagtacttagacatcacggtctttttaaatgtatggttggtcgcttctaatattttgttgtgatattattagaaacaccgataacactgaaatattaggaattgccaatgcgatatactgataaaa

SEQ ID NO: 104440 - DNA, 968 bp, Oryza sativa
atcaatcagtcggttccaaaatttgcacacaaccgttatgaaagggacagttagttctataatacagtagatgtgtaaattactggagtttagttggtggttaacagatgacagctgagaaggccggtgttcgttgaaaatcttgagggccagattagctgcagtcagatttcacttagccgaggcagaaaggcagctgagctgagctggtctagtcttgctgcgagaccatttatgaaatgctgacttggccttctaattgccatcaattatcttatttttaaactgccgttaattaatcaactgatagctacttgcacgcgtgatgcgcatatttatatgcgtgtgcttgaaggccatctccatccgaccatgggtctgatggctgcattgaatccagggcacacaatttctcatacatgtatagcttaattagtagcagtaattagctttattgtacaacagtagttattttcagattaatttttctgtacttcaaaaaaatacattttctaaaaaaatactttacttatattacttagactatttgttatgagttacttcctccgtactcgtaaagtaagtcgtttaggacaatgtttaagtcaaaccttgggaatataaataatgaataactctcaagttgttgagtttgaaaatataaaaattatatgaatagatttgtcttgaaaaatactttaataaaagtatacataagtaacaagaagtcaaatttgtgttttggagaccgcgtcgttgttctaaacgacttcctttacgagtacggagggagtattagttatgtttatttattaaagtatctaatttatccatataatataattgagtagataatcgacaataacaatccgctgaataatctattcgaaaataaacataattgttcagggaaggaatccgaataagaaaagtcatgccactatagtgctaaccgaacataatattct

SEQ ID NO: 104441 - DNA, 1228 bp, Oryza sativa
gatttcaatgaataaacacgatatggtgtactacaattaaataatgtatagaattgagaaaattactaccttacaaagatgatgttgtttttctctctcaaaatttttagagaatcgcaccacgtataagtttaaagcacaccaccattggcactaggggtaagagtttgtaggctagtgaatgtccgcgtattagttttggaaagtttatcatgtcatagggctaaaatataaatagttcatagcgcttagattaacactttatggtatggataccaaagtctttccatgcattattgctttctcgattggtttctaattatactatctaataagtaaattattcgagtttagagaataaaagatacatggtacaaggattaaatgttgtatagattagggtaaatcaccttacaaagattatattgttttttttactctcacaattttttcagagaattgtaccacatatgagcttgaggtgtgaatcgcaccacccttactctaggatttggagctttgtaggctaaagaatgtccatgtgttagttttgaaatgttgatcatttcataggactgaaatagggatagttcttaagagcttacactaacaccttatgatgatggataccaaagactttccactatgctagtgggtaacatgtttttggtccccttattcgatgtacaatgaattgaacaatgttgtttcttatccaaccatgtaagtgatgacctttttcttataaaggggcaatgactttaaagctagctatttattctaaactttatattcttagagagttttagtccgctacaacactagctctctatataaactgtaacatttatctgatttttcttcctgtagatcaatgtgattgggattatagttattatcgtgtgattaaatgcaagttgtacatctttatatataacaacataagttaactagagaaacaaaaggtataattgcaataatgtttgaaccttctaccctgcttcaacaccacagaccgaggactgtgatggtgaaccttcgttatctattaacgagttaggagttgcaacgccacgactccttatcacctgaatgcttataaaggtggctgagggttagtccaatgttagtcttagcttgagtggacttatagtccattatccattaaagttatattccataatgagcatagcaaagtttacctctcgattcagcttcattatggtgg

SEQ ID NO: 104442 - DNA, 1216 bp, Oryza sativa
agggcagagcagcgacggcaaggcgaaaatcggcgcggcggtgtggttgaggagcggcgccgtggtggaccggtgggggtggggatcgcttcaggtggactgggctggatatgggctcgaaaatctttggacgaaattacccctcgctaatgataattaagtgctaatctcccttttaatcacagccgctgattagctttaactttcgtgcaagtttttttttgtggagcatagaagcacatcccttagatttttcttttaactacctagttgatagaaaatttattcaaaaactcacaaatatataatagtgtaatttggtaatttgtatgtaactatgttattttttaaaacaattaacgttgtacggtagtggagacatgcgcgagcgcctggcgtgtgccaaataatctttttcgctaaccggttgaaaaatcacaattttatgtcgcaagaatttcgcaattctatttttttcttaagatgttcatatcaatcctcacgtcgtttttctaggctaataagccatagaaaaatgaacaaagcaatgaaaaataatttataagtaaaacttttgtacctgtgttcttaataatttaaaagccaatgctagaatataaattatgattaaaaaaatccttgaattaagtttgaaatttaaattttagctgcagccggataacccaacaagcaaacgatggattctaatgtttaattcttgatgcaatgtcaatgtgtgcaacatagtactacatgattatatggcaaaattcggcttcgactgcacttggttggcgtttggattggagccgtctttcggcaaatcaatctggcgcctaccgaattggtactttggtaggatattgaaccaaacttgatctccattctgatctcggagcatatattctgcttgagatattacgcaaatttcaactcgttcgaacttcttgcaaatttttcccgtaacctaaatgaagagagtttgttcttgtggtcctaagataagaaaaggaaaaagtacaccaatggtcccttaacttgtcgtcgagttacaaaatcacccccaaccgcaaaatcagatattcgacgtcccttaactaatcaaaaccggtcagaataggttcttcggtgattttaacaccggttttatcctatgtaacggctgaggcagcgtgggacctacgtgggtcccatatgtcaggatgccacgtcatct

SEQ ID NO: 104443 - DNA, 1473 bp, Oryza sativa
cgacatggcgatcgatctatcccaatcacttagtttaaatatacatcgaaggaacaattatatgtcgttaatatctatagcctatcgagtagatttagttctatcttatttattcacaactgccgattgattccaatatgacatcggctcgaagataaatgatatgtcatcggcaactagccgatcggctgtcgtttatggatttaaccatggttttcttgtctttctttcttgttgattccaggatcaaatcaactagcacgctcacgaacctagaagcaagattttggacctgcactgaagttaagcagatcttccaggccagtgtgtgtttttcacatcaacaacggtttaaccttggcatttgaaccgtagctagttgcctagttcctagaatatataaataatataaagcccagtttttttttacgatcagcaccagacaacgcaatgattcattaaaaaaaatacaagactattgacctgaaaaacaatagccaggaatgaaaaacaattccaccaccaccaccacgcactgacaacgtctacacacagccgccgttaagtgtgagcggtcgccactagactaacaaggaatctacaaccaagaccgccgaaacataagccctaataaccagccaccaactcaattctatccacgattttgggattgaggggtagagggtaagagagaagatggaaccactcccctactaaggcccgccgatgtggccaacttgcaaaagcttgtgtgccgccgcaagaggatgaatgagcctgcaccaactgcttgagagaagatttggcaagggggcttccaatatgacgactccagtgagaacggcgacgatgagcaccgccgccatccgccaagatcttagggagaaccaagacagggttttgacccggcagccccaccagaggaagaggacgactcaacaacactctcaggagggaaagcgacgcccaaagtggccgtcgttgccggcccgaccaatcccaagctaggtttacacccgttgtccgccccctaccgatcgacagccaaagctccaaagctctaccacctgccaacctctgtcggcacgtgcacactgctgcatcaacgccccccgccggctgtactccgcgtcaatgccgccaacagctctacgcaccacaatggcctcccgctaccgccggctatgccactacgagctttgtcgtcgaccacgcctctaaattgggctcgcctccacgcgccgcgatagcctactgccgttgccagccgcctccacacgttgtgccggtcttcacaccgccagccgtgacttgcacgttggtcaccccgcgctactgtaggatcgagatgtcgactagagggagggtgaataggcgatttaaaaactaagaaaaaattggttatatagcatcgaaagttcacgtttttggttttatagcaccgaaagttaccggttcactttaatagcatcc

SEQ ID NO: 104444 - DNA, 753 bp, Oryza sativa
acaactattgtattgaagtttgtaaaaatgtgaaatagatgtattgcaactagataaagtgggggtaattataataggatttgattaagtggaagacattttagtctttttgattttagtgttgagaaggcatcccaattaatcgtcaattgaattcactcctattttattatgttcttgatcatgcgatatacgactgatagttgatttcctggtacaactagatcgatccatcggctgtgtttcttttgtaattaattgcagttagtggagataacgcgagatgatcgcgagcaccagtagagcaggtacagtggcaggctataagccagctataaacatattttaaaaagataaaggaagagagagataagcagcgggctatctgtagccagctgtagcacagacttcaagacgtaatgtgtgtatgacaggtggaccagttattaataatatagtaagcaactattgtagtatgaattaactattatattgactacagatgatttggagctagcaatggactatgctattaaacttgctcgtacagtacacaaatgatgtccttgtctgtctcacaatgtcgtcacctatcgagatcagagacgactcctgatcgatcccaaggttgacgaatgctgctagctactccaagctagcctgtgatggctagctacctatcttgacctagtagctagctagtacctacctagtacctagttgtacgagcaacggactatccggccggtcagc

SEQ ID NO: 104445 - DNA, 680 bp, Oryza sativa
atatgtgactgccggagctacttctgtgtaatggtccttacttcttcggtaatttcagaaattttttggccaaaattatttgaagttttgactgattttgaattaatttgaacaaaatttgaccaaattcacaaaaattgcaaaaaacagaaaatttcgggtgatattgagcttgccggtggggagcgaaattaccaaaattttagaaatttcgaaccgaaatttcaaaccctagtcataagcgtatagtccagtctatccgacgagcgcggttatttacatatagcacgctacttatagttttgtttttgtttcgtgtaaaaaagttaatccaggagtaggatagttagatggacaaagtcttataggtcggttcttctcttgttacagtagtaaggtggtcataactataaacttttgtttttatttcatgtaaaaagttaacccaagacttatatgattggatggataagatcttataagttggttctcctcttgtttaccagtaaggtgatcttaaccaagtacacatagtattttgtagactacataagtcatattctaatggaaaaaatccaaatcaccccatactattgcgatcgtcaaaataacccccatactattgcgatcgtccgaattacccctaaactccaataccggacatttttaaccttgaaatt

SEQ ID NO: 104446 - DNA, 3097 bp, Oryza sativa
cggattgtcgggcccaccgaccagacaaatgaccgtggaacccccacgcggcccccatccgctttccttctcgtcttttctttggcacggacatgaaggcatattaaaaaataaaaaggagaatagctaatatggtccttaaaattttgttcctgggtcattttagtcattaattttttatattgtccaaataagtcctttaaatttgtcatatgggctaatatagtccttggtcccacgaaaatcgcatccaaacaagtcctttaaatttgtcatgtgggctaatatagtccttggtcccaccaaaatcgccacatggacatgccatgtcacatttctatgcaaaatctatatgatttgtccaatttacccttacgcataggaaaataaaaaacaaaagaaaaaagttaaaaaatatatggtacatgtaagagcaaaaatatacctcaaaagggtgaaaaaagaagtatttttttcctatggttatgtctaattcacccttatatttatttttctatgatatacgtaagggtatattagacaattcatcatagatttgcatgaatgatgacatggcatatccatatgatgattttggtagacccaaggactattctaggccttatgacaaaggttaaggatttctttggaccatttaaaaggttagggactaaactgatcctacagagaaattttagggactaaagtagctattctctcttaaaaaaacaatttctaactacgtacagtaagtatatacaaatatacttcctccattccataatactcctataagacatgatcaaacttggtatagtcttcaaaactaatacttgatctaaaatttctcacttaaaatttttcatatactataagatttattgtaacaaatttataaccatcttaaagtaaatttgaatgtcaatccaatgatattaattttaacaaataaaatttaatttatattataataattgttgatcaaatgtttttaaagttaaatcttggaatgtgtgcacgtcttttattataggatagagggagtagtttatgtctaggctatataggtctcgttcttttctccaataagagttggatgaagattaagatttttgtggcacgcttttcaaactgctaaacggagtgttttgtgcaaaaactttctatatgaaagttgctctaaaatattgtattaatctatttttcaagtttgtaataattaaaactcaatcaatcatacattaataccatctcgttttgcgtaaaaaacttaatgaaacatctttaggagaaaaggacaccaccatagccaaaaattgattactttttaaaaataggttttacttacaataaaacacttctttttttcgtaagtttttgggattagaattttaaactgttttcttaataagtcaatgactttcaagtaagtttggtggacttcttactctaattcacgtaaacatataaagtagtattaaaactagcttttggtttaatagtgtggacggtttgtggctttataagagaagaatgatataaaagttgtctctttttttctctttttcagttttggcctttattttgcttagaagctcaaacaaatactagaacctagtatatagttaaatgagtggcagatgagaaatggtagtttccttttagaacattagtagtaatatatagcaccatacgcgaaaaacttacatggaattatgtcgtcaggcacagcgaaatacttacgtggaataattatagacatggatgataaatcttgtaaggtatgagagcatcatatataataaatattgtcgataatcagttaaccaacaatagcttttgtcttgattatattgggacatgtcgtgttagccctcgataattgactattttaaacaggttcagatccctcgaagcaataataaacatatgtcatgatgattgtatttgtatactaggagtatgtaaaaacactataaactagggaacttggcctgacttcacgtgtgtgttttttttttctcaaaatgatcagctaaactaaatagcagttttctctttactatgaaaattatgattatatactatagcttaaatttaaaataacatgtttttgtaatacagcctcccatggtccaactgtctcctctggagacagaactacagaagcaaggatagatcgaattcaaagtttatggcaaatggccaaatggtttgatcacgaactctcccttcaccttacattaatttaagacaggggaaggatttgaaaacacaagttgtgctttaactattactacgacggttgaagtttatacatatagtacgtgtgttacgagtattacacgattacttgggattagcagggagtacagtaggtcatagttagtggtgccacatggaaccatgtatatataataagattaaaatgtcagatatcacgtgtatcacgatggtgtagtgctgtgctgtgctggcatggcgcttgattagggggccactgcccctatcgttaaccccactgccctggatagttgtgtccataagacgacgtgattttttgtccaaacactgtacaagcatactggtgtgctactccgttccaaaaaaaaaaaaataaaccctagctacgaatctggacacgtatatgtctaggtttgtagcttggattgggtttttttggacggagggggtaggtgtttatataaactggcaagatcgatggaggcggcgcgttgggcggtccaccggcctaaaccggatctggccgcctccgccctggtgcggaaggggggaaggctagtggaaggagctggatgaggcgccgaaggaggagttggccgcagtgttgggggagcccgacaggatgacggagttaattggagggggtggtcaagccggtcctaagccgaatttagccgcctccatcttggttctggaagaagaaggccgacgaaagtggagttggggagttgaggagttggaggtgcaggtggccgggaggttggccggaggggcacaacaggtgtcaattggtgaaattgccgcattgaggggtcgttcgttgttgcagatatgcttgttggatagccgcggg

SEQ ID NO: 104447 - DNA, 506 bp, Oryza sativa
gcaattcgaagcaactgaacaatctcaagctctcaacaacatgaggagaagattggagaattgtagcagagacaacaggttcagaaaatctcgagcccgaatatgcaatgaaattaattctctcctttcaaggctgtaaccatatgctagtaatatgcagtgaaattgtacatgtttactttaactccatgtacaagcataaacctaacaacatgtatattagttagttgatgtaaattagcacatgtgttttcactctatggttcatattagttgacaaagattggtagtaacttgatcaattttcagcttcaccaactgcagtaaaccctgtctgtctccatcagaagtacatataaaataatctgtttcctgattctatgagatttgtcggagcgtccatggattagaacggatcacattcaacgaacagcctcttgttgataagaaactgacggttcttggcagggagtaactaattaattaaagaaaacaagaaattttct

SEQ ID NO: 104448 - DNA, 634 bp, Oryza sativa
ttgtccacaatatcaacaagagttgagggacgtaatgcaaaagaattccatcgttcatgtatacttactacaagtacaagcatgcattaattggagtatgctgaatggaataatttggttcatgctatcatctaaccagctactcggattcgaattttaggtagaatcactggtatacaggaattattgggatgacttgtattaaggtatttatgactggatcaatgattccagtattactcaaaatctcaaacagtgtacttccatgtgtcatgtgttcatgacataatctattaacaaacatcaaggtttgactttttttttaaaaaatgcaattcatccattcaagtttctatgaatcaaaatgacacaacattacgagatgaccaatataccatggcataccttcattttaatgtcatcatagccacatccacatgttgcaaaacagataaacttattataatctcaccaatttgaaaagttacttgttcaatgtatttgagatgctcttatcttacaataatataatggtgcgacggtatagtaatctatttcaacctatacaaaaataccagactaagctaaggtgatgaaaagttactttcttgcttgtcaaaggacttttggacca

SEQ ID NO: 104449 - DNA, 767 bp, Oryza sativa
aaatcaaaagctccccctaaacatgtgcatatcaatcatagacaataaatatggagccaatgcacatttcaatatcacattccaacaagcacaaaacacattagcaatatatcaatgtgaacttcaatccataggcataagatggtcacatatattaatatcacatacaccatccatcatcgcacaagttcacatcacttaaccatccaaaacacataagtcacaaatcatcctaaaagggctcacaaataaacataggctattacaagaccacgaggggtccaaatgacatagagtttaacaaaacgacaaagaacacacaatatagagtaatagcccatacccatacaaaatatagcccaaacctccttaacttattaaatatgaggtgactaacctcactaccactagtcccaacccacaagacataaaacacacttttctcccccttttggcatcaagcaccaaaaaggtcttcactcttgtagaggaggaggacgcgccgaagtggaaggatgaggagcatcacgacgacgatgatacacaaatgcttgggagctctccaacatttggactcgagaatccaatgtacccactctagtgtgcaatctccccacagaagcattcaagtctccaacatctgtgcgcaatccacgaacattctcatgcaaagcttcatgcccggtggacaagcgttgaatgctttcacttagggtattaatagccccaagtaccgggtaaagtattcgtttggttgcattccaaag

SEQ ID NO: 104450 - DNA, 586 bp, Oryza sativa
tactcctaagtcaatgacatgtggggccagaatgatgtggggacaggatgtcagtgagaggggctcgggtgtgcggtggtagcggggggtttgtgcgtcggggggtgtgggtggtggggcccacgcggtgggtttccgagtcagtgttccactctggttgagttgacggcgtgagctgctttacggttagccgcacgggatttgccagcgagacgaccaggtccacgccttcaccttcacttcactgccagtttttttttaaaatttttttaaaatatttctctgactttccgctgctgctgctgttcatcttatctgaatctgaattttctgaagatttctgaagatgagggcagtgcagggcagcaaatctgaccggaattgctccatggtttcctcgacaccttaaacaactgcactgcactgcacacatatgcagacttgattattctgctcatatggatctgtaaaattattgacctcgtttgtgctctgacggctaccgcagctccagccagcacaaacgatcaaatccattgccttaggcctaatttagtttaaattattttaagaagtaaacttaaca

SEQ ID NO: 104451 - DNA, 999 bp, Oryza sativa
ggggcgctgcgcgtattaaaggaagtttagcctaggcccccctcctcgcttgctccccccgccaaacggcggctgggcgagggcctcagggcaaagtagtgcaagggcccgaggggcatgacgtggcaccccgaggccctgaccccccggccgctcctgcggttcgcggaatacggggataggaccaggctgtagggcacgtggcatgatgggaaggtagattcccctcactttacatacccccaggcccatatctccgacaggaacgatgtgactaaaaagttgtgtgtgtatgaaaggtttgatgggatggacagttggaagtttggaaaaaaaaactttggaactaaacaaagccattttgtgtagaaaagtttcgatgtgataaaaaagttggaagtttgaagaaaaagttgataactgaaccaggccactgttcatgcatgctcggtggaacctctacatctttgatttcgagtttttgactgtgtttagttcacatcaaaattggaagtttggttgaaattagaacgatgtgataaaaaagttgaaagtttacgtatgtggaaaagttttgatgtgatggaaaagttgaaagtttgaagaattattttggaactaaacacggcctttactccagtttccattgcattaaatgatctatatgaacggatggaatggcatatgtggtgttttcaattcacctactacatgctgcaaacgcaaacgccgacctcgacggcattagcaatccgatccacacaacacaaatcgctgcactcatcagaatccaacgatcgcattgccggcccaaacttttttcttgccatcgtgaggttaggtttttttgtggtcgaactgctatagatttaacacggatactcgtatttatggttaatttatttaagttgtaggtaacatactcgttgattgcgagatgtttgtaatgacttcgtcaatctcgtaccgacccaatctttgaagaatgtccatagagat

SEQ ID NO: 104452 - DNA, 534 bp, Oryza sativa
cctatgtacttcactctattgtaaatatggctataaaatttataacgaatatttgaacatctaaatgatataaaatgaaaaaaattatcaactacaaagttatagatttcgtcgagatctataattttcatataaagtttggctttatctgacttatatgaaatatttaaaaactttataactatcatatgataaactatatggcaattttgcatttagacccatcacgtcaaaaaattgccctctgaaaggatgttttctaaaaaagctctcccagagtgtgttaggggtgtagatatgtaattatttgaaacaaaaaattatttatgtaaatattttaataaataataaaaattaataatacaaaaacgaattcttctgtctattcataagaaaaggcccaatttatccaggctatacattgggcttttgtactgtgcaaaaactatcccatgcatgggccacagcccactcttgctttcatattggcccacttgagaattctcactctttttcttatggaaaaagtacacc

SEQ ID NO: 104453 - DNA, 1367 bp, Oryza sativa
accagccaactgaaatactaccattagtaaagaattttttaaagaaccgtctatcaaaatcattatttttaaaaacagtttactaaaaggattgtacgtaaaaattctgtcttcacagatggtttgcttaaataactatgcttaaaaattggagcaatattaatattaacgatgaaatttggcaactgttattagttaagaccgagtcaagggaggatttaacgctatgattatagtagattcggttggaaaatgtattggaataagttgataagtgtcatggttatggataatgcataccctctatcctacgagtcatggaatgtagggatatcttcgtatgtacggtaaagctctgtatgcgataaggaaatcgacaaaagattatggaaataaattatggatgcttactgatgttagttttctgttgaatttctaatattgcagttatggagcatcttggaagctcaagcattgcgcgtgggagaggcaagaacaagaggatttggacgaactttgattgttcaagttcgctttagatccaagctggaaatcagaaggagatttcaaaaatggatactgcaagttctagagaatgtacttgctaagaagttgtcaagttctagccttactactgttccgcacattgagtcgagagtaagacactttaggactaagtttggcgtaattgaagtgatgctaactaaaaagtggcttttctcgggatgacaacagaaagatagatgatacaataatgtgagaaacaacaatatgatgatcattgcagggtaagtcatcaaacaaagtatataattatatggagtacaaaatttatttattgattcataagtcgctattggcggactgcggccgcctgccgctaccaattagccgctattgcagcagtggggcgaggtgatatcaatctatttacattggccaccgaacaagtccaaaggtccggtcacacgcgtggggagaccaaagtggctgtactaccaaatagcatgtggctgctatactaacttgcgcatgtttctgtgtttctccgctgtgcaacgaccatgcaaccagccaactgagatatacctctcactagtacaaaaatcatctatataggttctaggttttcctttcgatgagaacataatattacacgtggattcatgataaatcttatttgaaaatagcggtggttttttaaagaaccatctatcaaaatcattacttttaaagaggttactaaaagaattgtatgtaaaaattgatcttcacagatggtttgcttaaataactatgctaaaaaattggagtaatattaatattaacattgaaatttcgcaattgttgttagttaagatcgagtc

SEQ ID NO: 104454 - DNA, 755 bp, Oryza sativa
tttttttattgtttagtcccggttggtatgaacaacaaggattaaagtgttgattttagtactggttagtgttatcaatcaggactaaggatagttggggccagacacagcctgataactgtttgaagctggattaaaaatgatctttagtcctggttggtaacgggattaaagataaaaaaagattcgtctggcttttgaacctggactaaacatattcttttggtttatttgaaccgggactaatgtgatttttgccatttgggtaaagatcacttctccaatagtgtttgtactatacgataaaacaatctttggccaaaaattgaggaatttggtttcacgattaattttacatgtctcttcatcgcctttggtcacccagctagctcttttttcacgactgctaacaacatatgtcaaaaggtctacctaacatatattttcaaatttaaaaatgagaaatactactatatgcatttactcgttctataacatgatatctatggatatcactgttgcaatatgctatccagtggtagcgttttatctgaaccctcgtaccattcgcaacaacgtaatgttagcatcaatagtttcatggactatggccttgtttgataacaaaagtcttctattagtttagttttattgttttttggttattaagttagttttttggtttatatgatttataagctggtggatttaaagctttaagtaaagatagagtcccatagctatctcacgtaagg

SEQ ID NO: 104455 - DNA, 952 bp, Oryza sativa
  unsure (1)..(952): unsure at all n locations
gggaggaccccacccgttcgggtggttcggccctctccccgctgtcacgcctaaanattcccgagtagaattccaagcagaatgtgcattaaaatccccgtccaggaccggccggggtacacaaacgacaatgttgacattcagatccacgtcttacaaacatcataaaagtcttacacaaatgcagcggaagaaaagaaagacaacaggagctaagccttgactagaactgcagcgggaacaccactccacaggcatcctcgacggcacggacgaagcctactcctcggagaaaccttcatctgacacatacttgagctctggggttgggaaaaaatagagcaagactgagtactacccactgtactcagcaagtcataccggaataggggtatgatgcagggaattatcaaagaagagctggagtggttcatttgcataaagcgagcatttataaacagaagttgaaagatttaaacagttgtaataattaattaatattaactatccactgtccaacgctatcccacgttgcaacaggcccaaccatccacctaaactatccaatttcaaaagattacactagggtaagactaatcacggtgaatctggttgaccgcccataaccgcgggcacggctattcgaatagttttattctgatcagaggtgtacaactgtacccacaagacacagccccacgacacgtttccgtgcgccgacatgccaccacgacataccggaaagaggccgtgacaggacccttcgtataaccccctctaaccaagcacaccacacctcaggtttcacccccactcctcgcaaggcagcgggcagtcccctctcgtgcctaggtgaatccggaagcgacagaggccgtcgcagggcccgccccgctccatcacgcccacccttgcctggatgcgtcgactagaggagagctacactacaagc

SEQ ID NO: 104456 - DNA, 3365 bp, Oryza sativa
gaatcgtctgcaccacctctatgggctgtatcggctgtcttctgtccgatccatctcagccgatgcagactccagccgatgccttcacagccgatgcatactctgttcttcgaatccatctcttttctgaatccgcttcgtttccaatgtcgaacttggttcatattttaccaaatttggtcgtgaacacatgccccccaagtccgctatatttgtaatgttgcggatttgctcaatttccctttccgagctgaactagggtttctaaaaccgattccgttttggccgttaccgtgctccccttttaaatagtaaccaccgctcttctcgtttcacggcgtcacttccgtttaaaccgctcttagccaaaactttccccaatcctccgcctcgagctctccggcgacaccttcaagatttccggcaatccaagggcgaccctccgcgacaccaatcctctccgtcggcaatgttgaactccgccagtccaccgagcgcatcatccgccgaatatgttgaggtaagtgcccatcggctaaactcccttcttattgcgcaagattggttcttttcccgctcaatcctcgatttttcttcttctgtagcatctcactcaccaagttgcgatccctagcataactgatgagttccagtttttccttggcccaatcggcaatctagaccccacaaagtttatcaatggagaaaccaaccgaattccttttagatttgccaatccagatctaagctcctggaaaaataccttcaaatcttggccatcggctgaaaagagttggcctgcctggtataagaggatgtccgctagcaaatcaactcactgggaagaaatcggcatatcccaagccttggccttaactgtagcagacatggcgagagatgaatctatgatagcagctgctacttacttctggtccacggccatgaacaccttcctcttctcccaaggagcgatgaccccaactctcttagatgtcatcatgatcactgacctagatgtcacctcatcggctaacctgcctagcttggatacccaactcacccatgagttcaaaaccaggagcataggtggttggttaggctatgttgtgaagaacatgggaaccgggccaatttctccaagggaacatgcagcctttccttatgatgtggcttgaaaaattcctgttctgcggtccaagctgtggtcctactgcaaactggcaacgtgtagctgagaatttggtagaaaagaagcatttccctcttggaaagtatctgctaggctacctatatcaaactctcaatgctgcaataaacaagatagtctctggaaaatcaattggcacagggggtccatggtggttacttcaaatctggttgaacctgcacaccaggatggttgccgatcgaccagcgctagccgatgcaaattttccaaggtttgagccgatcatcagagatgatggagaaaggagtactacacgccgatgtatgtccttcgaagaagcagcatcggtcagtaccgcatccaagttatcggctgagctcttcaaagaatggttcaacaacttttatgatgggttcgtgttgacagaaaacacgaggcctgggagatctgcttaactccagtgcaggtccaaaactcgccttcggatgtatgagcgtgccagttgatttgatcttgtaatcaacaagaaataaagacaaaagaaccgtagttaaacctataaatgatagccgatcggccaggtgccgatgacatatcatttatctttgagccgatgtcatttgtgcatcgatcggcaatcgtgaataaataaggaagaaaaactaaatctactcgatcggctgtagatgttaacgatatatactccttataccgatatatacttaaatcaagtgattgggatatatcggtcgccatgccgagacagtataaatcacatagaccgaaatatatattaataataggactatataagtttacagcataaccgatcagatagatctagcatgtatcggctaatactccgatactactctatatcaggacattaaaacaggtatagaatatcaagcaaaagcctaacacattcaaatacaccaatatcttggcataaagggcatatttaacatatcagtgaagcaaatagagataattatagttaaatcagatacgaccggctgaaactccgatgctattctaatcggcaactaggtggcaggctagagatcaatattctaagcacgacttaataggtcaaactcaattgatgcagcattaagtatgaaaagaagaacaatatctagataatcaagccgctagaagattcatagaatggtagatatcttatataatctggatcaacgtaaagatctaacctaatcggctgtcttctgcacacagatgttggccgatggtgtattagataacaatattgctgaagattatataagatatatgataacttgatgaattatacaataagattagagtgtcatgaagatgtaagcactaatcctaagagcacgatccgtcataacgaattttacctgttgttgaagatcgaaaccgatgcagctcaacccgaaagtaagaattcgtcgaaataaaagcaaaaggtggcgatgcgcctgaattgtattgaatgtgtcttctttcttttacatagggctcggggtctatttatacccgagaaatacaagatatgtccatattggacacgactcttatctctaacaaactctaaaatatcacaagtctttgcggcagacttttgcctaaacatatctctaaggaagttacataaaatatcctaattaatagatacaattaccttctcaggactctatccatgcgtggcaatcatcttgaagcacatcaactcgaacccaatgttgcacacgggtcgtattgtcggaaccggctatatcagcttatctagttcaactcaatctcagccgatcctagccgtagccgatcaggactccagccgattcctgctctgttccaaaactcgatctccgcctccaactcttccttgattaaatcccctttcctgatacacatgctaccaaatttggttgttaacagttccccaagaacactagaatctggtttgcatatgaaggacatagcactttcgagcttcctggtgatttttggtttgacgagatcaattccaaaaaatatgacaaatccaaagaggtattctcaacagccatcaacccttgcatcatccctgtcggcatccaccaaggcaagaacatccagatgacctacgagttttgtcatccgacagcgccacaaggcaatttggcatgggtcaactgccaattagcttattcttcaccgacaagatcca

SEQ ID NO: 104457 - DNA, 1160 bp, Oryza sativa
caatcctcatagatatcagtatgatcacaggtttggatgtcacctcatcggccaaccctatgagtttgaacacaaagaaccaatatgacttcaaaaccaaaagcatacgaggttggtcaggctatgtagcagcatacatgggccatggttcggtcacccctcgagaacatgtggcttttctattaatgtggctagaaaaatttcttttctgtggatcaagttgcggccccacaaccaactggcaatttctggctgaagctttagaaacaaagagacaattccccttgggcaaaattctcctcggctatctataccagatgtggctaagatagtagtcggttcagtagttggagcaggtggaccctggtggctgctacaaacctggttaaacctgatagtcatgaaggttgtcaatcggccatccgtatcagaagctgagttcccaagactagagccgattgtaggggatgatgaagaagagcgtactcatcggagatgcacatcatacggcaaatacgcttctacaccaactgatgccggagcaaaactatcggctgaactgctcaaggactggttttgtagcttctatgaaggctttcaaaaagatgctagagtctggttcctttatgaagactctgcacaacttgaacacccagtggacttcaaattcgaagacatcaatcatgaagtataccaatcatccagggaaatcttctcggctgcaatcagcccatgcatccttcctgttggcattcatcaaggaagaaacatccaaacttcttatgaattctatcatccaatgagctcagctagacaactcggaatgggccaactcccgatcagcttattctttgctgacaagatccaatgccgaggagggattttgtcaaccctgatgatggatcggctgcttagccttcaaggaccccctctgggcagtattgacaacatagaactggcaacattcaggagcaaaagcttcgacaggtggtggggtgaatggaaactgcatttattccaccaaccagcttcaatgtacatgacagacctctttcccgatattgtccctcaagtaagtcttcaactttgctcaattttagttaaataactgtttggccaattgatcttaactaatcatccttttgatttgcaaacaacag

SEQ ID NO: 104458 - DNA, 696 bp, Oryza sativa
taattgtggtaagaaaaagcttggtctcgcgtcgccctccaccacgggcggctcgggaggcgacaagcgcctccaccaccgcccgagcggccgccgacaaagccgcatggccgcaagaatggtgacggcggggcttcgtccacctcatgcttgggccaagcgagctgttcggggtggcgcgttggtggtggtgccggcagtggcggagcctaggccatggcaggcagccaggacatgcttgctagggagcgaggctggccgaattaacgttggtgtcgaggctggcacacgggaagagatggtgcaggcgtggcaggccggcgcgtggatggcgacggtaaccggaggtggaggcagggagggaggagaccgactatggagtacgggctagatctagagccaggcaatggtggaggcaggagaggaggggccgacatgtggtggggtcgctgtagcgacgatggcagtggtagggcggcagttccggcggccttttggtaggaggttctcatggccggcgggggtggaggcttgcatggcgcgagaaggcatggccagtgacacggaggccaacgcagctgaagcatctaggcccccgttattaattttggtaattaatgacaagcactaattgtagactaaccgttgctattgagataatattttaagattaggtccatgtcatgtgtgcgcatg

SEQ ID NO: 104459 - DNA, 637 bp, Oryza sativa
aaccagccaataacaagttatatagcacaactaataaagattacaacatatatatgataactcgacggattacataaacaagattagagtgtcataaagatggaagcactaatcccgagaacacaagccgccatgacaagtttacctctagtttaagaccgaatcgatgcagctcaacccgaaagcaagaactcgtcgaaatagaacaaaagtaaaaagggtggcgatgcgccgagagtgtattgaactgttgttgttttttacattgggttcgggtcatatttatacatgagatacaaaatatgtccttaccaaacacgactcttatctctaacaaactctaagataccataagtctttgcggcagacttttgcctaaacatatctctaaggaaatcatacaaaatatcctaattaatagatacaattgcctttccgcgagctttatctctattgttgcaatccttgtgaagcacgttgatcgactctagaaacaaccttgaagccattaccgtcagaatcggctgcaccacctctatcggctgtataggctgtcttctgtccgatccatctcagccgatgcatactctgttcttcgaatctatctctttgccgaatccgcttcgattccaatgtc

SEQ ID NO: 104460 - DNA, 846 bp, Oryza sativa
cgccatcggcactcttcaccagcgctacccggacgagttgcagcactcgccctaccgctaccaccctcgtcgcggaggagcccgcgaccacgccaccttccgggatgctagctcggaggatgacgctaccatcgtgcacttggcgcgcatggtggaggcgtacgacgcggctcgtatcgacttccatcagatggtgcgccgtgggatggtcgagaacaacttgaagatcctggagctgcgtcaggagaacctgcagctcaagaaggacctagacgcggtggaggcgcagctgcatcagctcaagatcgcccagggagagatctgccgccccaagcgtcgccgcgtctgccgcagccagaagatcaccgcccgcaagagcacctccaggcctgagcttgttcgttagtccctggcgtggacttgcttcgtcgagacccctcgtgccgagcccgcgcccgtggttccccaggagggggaagcctccggcgttggtagcacggaggatgcgctgttgctcaccttccgtcctggcccgtcgcagcggtagacgagcagttagtaggcttgcgcgtgtgttctttctcgtttgtcttcttgggttgtgtggggcacggttatgccggtgtgtggtgtaactgtgtcggagcctgtctttatttattcgcctaagcaacttgaactttaatgaacccatttaatagcagtaataaatttaagaattatggtagtcgtgggtggttagctttaattgtcagctctctctgtttgctggttctgtgtggggttttcagatggtgatgaccaggagaaatgctaacaccggtgatggcaaccaacctgaaggca

SEQ ID NO: 104461 - DNA, 674 bp, Oryza sativa
atgaatgacaggaacactacttggtggttgttgacagatagaccactagccaccttagctcaattattgacataaaaattataggtttcctgacaaattttgatcccatactaggatacaaatttatactaattaaaatggcaaataagtatttaattgtttttatggtattttgatggttcatgtgaatatgtttccaagaagaacaaattaattgttcacataaaattcatataagatcattaggctagcttcatccatggaaaatattatctctgcaagtagagggaaaagaaaagattaaaaacaatattttgccacaacatgaactggtatggtgcggttcatcgtcatatctgaaatcctaaaatctccatggagctcctgatcagagatttttcagcaggctgcccaccaaaagatcagcaattacctcagtccaatgtcttatctgatctaaaggatgaaatggaccggcctgaaaagagaaaactactaaccttttggtttgtggaatcctgagttggtatcctagatgcttttgtcatgctttcaaaattagtacaaaaataggcctaaaaagaattacataaaaaccaaaaaaaatgtgcatctggtgttgtgctgtcactctttcgatttctcggacaattttattcaatatgaaagtgtgc

SEQ ID NO: 104462 - DNA, 705 bp, Oryza sativa
attcctgcagccctttagttcacgctaaaattaaaagtttggttaaaattggaacgatgtgacggaaaagttatgaagtttatgtgtgtggaaagttttgatgtgatggaaaagttgaaagtttgaagaaatattttggaactataaacacggtggtagctactagtgcaggacgtgacagctacattactagataacgtcacatcctgtactaggtagctacattttgggacggaggaagcagtagtttctagcggctataatttctcgtagaattaaaacttcatttaaacagtctagtttttcacccaaattctaaaaaactgtaataaaaaccagaagcttggaaaacctaacttatctagcatattcgttgcagtagaagctccccaacttatccagattttataatatcttaaactcccaacttatctacattttaagaagttggcttcaaaccaattgcattaagctccccccaacaggcttgtcattttttgttctctctaacaatctagattttcaactaaattattttcaactaaattctattaccaaaatctcaaaatataaaggattttgaccatgtgtagtttaaaaatataagaaaatttgaactatatagttacaatatttttggacttgggtcaataatggcaagtttatggaacttccgacagctgtacttctaccaacaacaaaagc

SEQ ID NO: 104463 - DNA, 2620 bp, Oryza sativa
tgaggcatgaccgcagccctctaggaggaagaggcagcccaaggaccggtgagacccgatcgtccaggttgggcgaaggatcaacaccaaagtgaagcaagaatgatgcactgctcatatgagctatgcaactacctgaaatcagctatactaatgatttctgtataactatggcgtacggttatatgatgtcttatgatcaagtatcaagtatgagtctatgagaatgtttatgtatatctctagcctagtatatcaccccttcctctttttttggtgtatttcctgatttggagcaccatatgtgtaatctctgaactaccagaatattagagtgactacttggtaaccttttgagtttcatttgctaaattcctgtcagaacttgtggatgattcatactgaaaactatttgtattcattaattctttaaaagaaacaggattatagttggcatcctttatgcttgtgtgttgagctgaaatatcaaatacgagtgctgtatactcgtattcttctatcagagatgaagtttcttaagttattactagttaacatatgaaactcagttggcccaatttccctctagaatttggacacattttgttagctatatgcattagtgagcagcaacaagcataaatcttgatatttaaagaacatttcaatagctttattcattttctgaactgaagaaaacctcaagcttgattggtgattgagacttgtgtataaccgatgtataaagttgtgctataaaatctcaagctattgcgatgtaactagtttccagatgacttttcttccttgatttgtggcaacgatgtgatttgtagcttctctttaagcgtcatgaccatgatatgtttcctttttctttaagataatgaaagttttttttattgatctcagtcaattacatcaagatgatacaattgtcctaagaactgacatgcttcaaagacctataccgaatgttatgatctactccctccatctacttttgatagtcaaattttcaaatctgaaaaatttatttttgataggcatatttcaatccaacaacttatcatcttaatgactttcttggatttaatgcatgactctttatttttccacacatgattggctacatgggcattgagaaatgtagatattaatgaatcgcttatttacgaggaatgactagtagcatatttaaatggatgataagtagaattacttatccttggtctgtgtgccaagatgaaatatgactatcaaaagtagatggagggagtatttcagaatataagtttctttcaaaatagtcggcgctggcgtgaatcacgttaaatccaatgagaaactaaagtcggcacaataatgcaatatagagttggtcttgatccaacaaattctagactcaagaacttcatcaccaatgcgcatgcgaaaaaacaagataagatgacacatgactgattttgacagaaagatgattgcatatttgcatagggacatgccaattgtctgagtctacttacaggacatccactgctgatttttcagtcagtaatttgctggtaaaggacatcaggtatgatacacattagagagctgcaagctggaaaaccaagtgcagctacacattatgtctgtacttctgtactcagttgcagggtacttgagagctgcaagctggaaaaccaagtgcagctactgtctctgactgtacttgttcatgttactacttactatagaggggaagatgccaatatcaagatgcagctctttctagtgaagttctatctgatgaaagaaacaaagagaagaacctccaacacatgcctgcagtaggtagaaagggaagagagggtgccttacagccacattccttcttcaactgcagccattatttcagctttagaaagcacactgcattggccctgaagcattgacctccagagaattcattcatcagcatgctagctgagggaggttgagatcatagataggatcataggagctgctaccctgtcatgccgctgggcgaaacgacaccccgtttgtcgacaatcatggtcgcctttttcgtgaccgatggatgatttccccgacaacccgtgagccgggactagtaacccaggattgcttccacaggtgatgaaactgtgctggaaagatggacaaggggtgatcccaaccacaagaaccctctgaatgatgagagtggggggtcaagagagtagtggctggaattcatcggcgcagcggagaaaagttcaggcagaatgatccatctcttgaggtccatagctgatggctggatgagaattgtgtgcacaaggaggcattgttctttgtgttctttcaccatcatttgatctgcagacagtaagtagtgtgtcacacccagcagggaattccctgagaaatggtcccattttgacaggccaaagctccttttctctccaggcgtctctgaattcatcatccctgatcagttcctttcctacatgcctcttccatctactttgatgcattgccattggttttatctcaccttttttttttcagattgttgatagcaatgtgacaattcctatagagggtgtagatggatcaatcaaaaagttca

SEQ ID NO: 104464 - DNA, 665 bp, Oryza sativa
tgaacatacgatgaagggaaaatcatagagatcaaacgctccgtccatcatatcttgcaatatattttataaatggaactaattttccgaataatcacatgttattttgagtacacagcccagcgctctggcatattaaaaaaatgtgaggatttgccattttagcgtttttcactttgtcagtataggatcatagctagagagagcgatgcaaagctaaattccattaaccgttcaatggatcattagatcatatatggttggatcgagggtttccaaggcctgatggttacgttcgctagcagaggcacccagtgccggcgatgatggctggtgggtagcacaagaattcagatgccatctcaactgctcaaagaccacaattcatttgcaattccactattacaggcctcgtccttggcatgtaatagtgggcaggtagagggtgttgtcggtggggcgaagtggtagccttgctggtggcaggactagaagttggctggtcctgtgtggcggaggccacgtgcttccgatgttgggctggtgacagaccacggcgactcggtgcagagggtcctaggcgaaagcctagcagtgggtactccttcaggcgtggttcctattgggcactgtataggtacccttctccctcggcgacgatctct

SEQ ID NO: 104465 - DNA, 3222 bp, Oryza sativa
aattcctgcagcccaaaagttgtccaatcttgtaatcaacatttacacaatcacacagggttgccccccactaacatggtaagctctccattctgcattttcatagcacaaatggaacacatgtggatcttaatgagggaatcaaaataaaagcaaactgaaccatctatcaatcatgaagcttaggtttgcatcagagaagtttggagtctagcacttcattcagatgaggagcattcattccatatggaatgccaacacagactgataaaaccatttgccaaataaatagagtaggtggcacaagaatggaatagtttatccttccaactatgcaagattgcaagccctgatatttctggcacaggcaagaacccctttttcactgaatggcactgatacaagcctataataaatgctagtctttgacaattatacagataataatgaacagtaggaaatatggggcaatatttggagaatagtcgagcaataaggcatttattctccttttggctatgagatatcttcatatctcttagcattgtacaatcatgctttcttgatgaaagaaaattttgcagttcattgcatcacactttagacatctagctttgcacgaaacaaatgccgtaccaatgctatataacttcaggcttgttttctcttaatatataaataaaaagtcaaaaattgactgccatttgattgtttttttttcagggaaaaagggacttcattaattatgaacctcagattaatcctgaaggatcctctgtctgacaaatttttaattatcttttttttctcgaatatgcaggagagttgtgtatctttgcatttaagaataataaatttacaagatggccaaaccaaaaattagacatcttctgagttcaagccatatttgctaattcatgactaactttattttgatctctatgaatcttctgaaatgtaaaacccctctttctggacagtagctcattcgtctccctgatcacaaaagcatgatcagatctgtccattttcttggtctgattgttagcctttcttttcccctaaaaaagaggtttgtgattgctaagtttgattgtgattgcttagttagatcgtgtcatcataggcagcaatgatatgaaaaatttaaccaaagcgcattattaacaacaaataactaattagccttgctgttgtcatgcttaaccatgtctgtttaacctagctaacaaaatattttgtctgttagtgcagtttgtttttttatgtcagtggaagctgcattttcagtctcaagagttaggctagcattttacaaattttagatgagctttttctgaatgatcctcaaaagactagtttaactagagagctttgtcagaaaagaaaactcaattaaagcacctgcacgtgtgcaggatgaagccaactaaatcctgttaaaagtgagcctcttaaaactaaatgctggtaaagtgagctcttagctttctttttctctctctatatcaaaccatgggctcaaattgagttctatttgttttttcttaagtaacaattttgtgaacaagggtgaggtgtgcatatcttaggacggatctacttaacttatttacccttaatttggtactatttattatgtagattatagcgcatgcatcaggccataccatttgcacttggttcttttgattattgtaaggaattagttcttcagataactaccgatagtcacttacaagttggttagctcacactaaaataatgcatgtgtatggtcaaaaagtaccataatcatgacctcataaaccatcagacaaattacttcaagcaacttcctctgtcaaaaaaaaataatctaagagcggatggaacacttcctgatacaataaatttggatagctatctgtctagattaattgtattaggaattgtctcatctactactagattggttttttctgagacggaggaagtacactttgaccttgtactccatgttaatcacgtcactcttggacttaaccaaagtgatatgatccactagattagagccccactagctaattgtacttggcacaagatttatttcaaagtaaaagttggaatacatactttgaataaattcataaatacttccttctgtaataggtttaaggttattttgaagtaaaaatattttcaatttatttatccatagttattttctttggtaatagattgataccgttgccagaaattatacttgattttaaaaaaaaaacatcccttattaataagacgaagctcttctattctttttatctttcagagtcgatcaggtgacactttgaccaccaaaatttagcattatatattttttaacaaaagttaaaagtacaagaatgatctgaaagtatttccatggcaagttggccagtacaatttttcagcattctagagtggaactttcatgttactggacagggtggtgattagttcctcatcaggcaacagtaatgacctacttttcatttactttgggcaaaaattaacagcacaataatgtcattggaaatacatgctccgtgactgcacacgaaagcaacagtaattaataatataattgtacatttatatgcagggacaaagttaaggtcaagtcattgtgatccacaaactgaaccaagcttcagtttttgtttcccctgaaaaaaaactttgatttaatttcttaattgagtgaggcacatacatccatgaacaggatgctggtttcaaggagatcctatgtcacactatcatgctaagcacattattttctatgagctgttaagtactagtagattagaaaaagtaatgcatgtgacatagtgaggccaactctgaacttgtgactgatcaatatgtagcagttgtaggttcagaatcatgctacagtacaatcaccccctttgtctatattttctatgagctgtaagtactagtagattagaaaaactaatgcatgtggattactgaaagccaactatataacttgtgactgatcaggtagcagttggtaggttcagaatcatgctactatactagtagtactaatatactagcaacccttttctaaagtttttttttttgaatagtacgatgatgtggtcataaactcgatcataatgtcaggtaattttagtaaaagcatgttgtttatacttgacattcagagaagtacagcaaaaatatactact

SEQ ID NO: 104466 - DNA, 611 bp, Oryza sativa
tcaaattcaaatttgaatcaggtatgtaaacttttgacttataaactttggatctataaactttaggtgtataaactttagatgtatagaaatactatatgtagaaaatatttgaattcaaattcaaatttgaatcagatataatttaaattcaaatttgaaacgggtatataaacttttgacttgtaaactttaggtctataaactttaggtatataaattttagatgtatagaaatactatatataaaaaatatttgaattcaaattcaaaatttgaatcggatatataaacttttggtctctaaactttagatgtgtaaacttgaggtgtataaactttaggtgtataaatttactaaaataggaaagtaatgcggtaccaaaaaaggaaaccaggtggagggagggaggggggaggggatcgatcgctacccatctccaggcgatcgatcgccattaggatccccgcactttagtgcatatcctttctcgacatacaggcccggctctaggggtcgagctgggccaccgcacagggccccacgaagtgaaagggcccaatcccatatatgttgtacataatagcccatagaaattagaaagcccact

SEQ ID NO: 104467 - DNA, 662 bp, Oryza sativa
ctaaaatttaaattttggaacttaattttgtaattgattttagcgacctttttcagcgtagcctatttcttaaccttagttatttatattgataaagcaacatttttttgtgagtgaattacatgttgggccagtttttattaccatggttgcatatggattaggattgaactataattttcactttagactagttatctttgcataacttttcagtttaggcccgttctactccagatctcatgtctttcgtctccaagagccagcatatgatctgagcagggtgaccgtgacacagagcaaatcgagctcattactagctggaaacaaaaatgaaaaatgagatgtctgtctttgcttgttcactgtaggctggaagcaaaaattggaaaatgagagatctttgtgctttgctcattaacccgggggcttttgctcattcacccagggaatttgaaagatctcaccaacgccaggaaaatataagctgggccaatggagaggctgcaggagcagccttgaatcaggtacaaggactagaggaggatgaactaatgtaaggaccatgttattggggtgtggactcactagtccaaggtgcaaagcgtggtaacaaatatggtctaaaatgaaaagatttgatatcacctagtccaatatac

SEQ ID NO: 104468 - DNA, 702 bp, Oryza sativa
tacttctctttccacaccattgtttggatgatacttcttatcgtttggtactttatattgtttgtacatatcttctaattgattcttgctgtgcagtgcggcaaggggccttatcaatcacattttgtatgaatctgagaagatgacaggacgcaaattttcaagttaagaaatttggaactagacaatcagtgtgctgtatgaataatagtaaacagtgatgtgatcttgtggttgctgaattactttgttttttttttggcacaaggatcaactaatcctttgatgggtcattgagttattaaggtggttgttttctttggtttcatctactgtggctcttgactcttgaggtgtttcacccaagcttgcaatatgctacttgggcaggtcatcttgaaacctggaaatatgaatcttcagtgattgataatgctttctttcagaaatcagatccataataatttatagtcctttctcctgtgatccatcgaatattgaaactttgcacagctactgtgtatgctgatcgatcaacttgagtatgatgtgttttgctcgtgtttcctggttccatctccatggaacagaactacacccacaacttgcaatagtgcaaactgtaagcattcatggcgatggttttttggaacgtagttttatggatcaaaattctgggagcatctggagctttctgaggat

SEQ ID NO: 104469 - DNA, 670 bp, Oryza sativa
tacgcatcacttttcatcaaaattacatgaaaaccccttttcccaccatgaatttgctcagtggccgctggcatcgattgacagcacaggcgtctctccgatggaggtggtgacataaagatttggaggtggtgacataaagaaaagaaatcacagcttagtgacaaaagttatgggcggagggggtaaaaagtgtcaacaggtgacggtagaaaaataaagagcgattcgcactttggacctacatttattacctaagttgtatattggactaggtgatatcaaatcttttcattttagaccatatttgttaccacgctttgcaccttggactagtgagtccacaccccaataacatggtccttacattagttcatcctcctctagtccttgtacctgattcaaggctgctcctgcagcctctccattggcccagcttatattttcctggcgttggtgagatctttcaaattccctgggtgaatgagcaaaagcccccgggttaatgagcaaagcacaaagatctctcattttccaatttttgcttccagcctacagtgaacaagcaaagacagacatctcatttttcatttttgtttccagctagtaatgagctcgatttgctctgtgtcacggtcaccctgctcagatcatatgctggctcttggag

SEQ ID NO: 104470 - DNA, 749 bp, Oryza sativa
attcctgcagcccctttgctgtctgaattgcaatatcgcattgcatgtgctctccaaagtccaaagattaaagaagcattactgtggccgacatacactttggttgtactggtatggtactgtctttgctttgccctgccaaaggaaacaaagcaaataaatggataaacaaaacctgattctctgtttgattggcagacactgctgtatataatggcttggttgttggtactcgtaaggtgctaaccatgaccaaatttcagttgaattaatgcatttgtacaagcttacattaatctgacagtggcagctgtgtttcttgttttttttttttcatgctctgaagaaacagggcaaatattctggtttgttcaacaactctgttctgcagtgtggcaatggcaacttctctcggcagattgccctgttttttcagaagcagagttatgcaggagccaggagacgtttctccaggtgtcataccatcctaaatactgaaagttttcctagaagaagcatctaaacagtcacacccactattcagatctatggaagttattgaggaacaatttttgttggttcattttctaatagtaaggcctctcctttggaacaaaagaaaagtgaaataaattatgaggttttgtattcgtatgggaaaatttctattagagccctttggagtaaaggaccggtctctacaaatttctatagaatggggcaatctgtgggcattttagagggaaata

SEQ ID NO: 104471 - DNA, 640 bp, Oryza sativa
cgtgcgcgcggaagacgagactcaatctccccaaacaccctggaacgaacagagccaagtatcaaaagaaaatccacagccaatttgccttcactaaataatacaggttcaatttgccttcactaaataatactacattactacttcatttcataacatgtgactatgtgtattgtcagtatgcatacctaggaagtaggaaatacaaaactatagtgatgtttgatagaaattggatcaaattcaacgccattttgataggttacaattacatccgtctgataaaaaacagccataatccaattcgaaagaattgctacgcgaacctgacagaggaagagtcttcttatttagcatgagactgattcgttggggatgcattcacacatcctcttcaacggaatgaaaagcaatcaaaccttgaaacggaaggatcacacatgtggtggtagaatagacccaaaaggcccacgcaaattaggcttgaaacacaaggagaaaatctcaaaaatcatgtgttccaagaaaccgaaacgtccatcgctgcagagctaggcatgcaaaagttttgagagtgtattattggcacaagtaattaacaaattattagacttgacttgcacatatgatgattattagg

SEQ ID NO: 104472 - DNA, 845 bp, Oryza sativa
attcctgcagcccaaataatttatattatattaattattgattaatgttttaaatttgaatcttaaaatatatgcatgccttatattacggggtgtagaaaagatggcaaacatcaatttgatcaataacaatgacgtgtggatattcgttctccatttttattgcccatgcccatacataagagtcttaagcagatgtttacatgcacttgtaaaacacacatgtacacaactgcgccactcgccatctgatcatcatggcattttgttttcatgcataatgttggtgtgctcatcaatcgtggcaatacatctaccgcaggatcagaagggaaataataccgccacaggcctccagcagtagcatgaacccactgccctacctgatcctactaccacatgctccaccattaactgccgggactgcatagttgaagacttgaagctgtcctggactctaggaggtttaaattaaacagttgtgacaatatccaaaataaccctcattgccgtaacccttatctccgtagggagcgtatcctatgcacacaggccctcgcgtgtacacactgtgtacaccaactaaaaattatcacaaaaaattctaggaaaattcatacatgtacttttaatagtattacatctacgtgcaaagtcgcatcttcaaattcattctacatagagaataacaaaaaagataaaattctgacaaaattgcaaccttaaaactgtcagatttttttttgttacggctaaaatataatgaatttgacgttaagattttaaccctaggtgtaatacaattgaaagtatgtgtatgattttttctagagggctgcaggaat

SEQ ID NO: 104473 - DNA, 655 bp, Oryza sativa
  unsure (1)..(655): unsure at all n locations
cggtcccagccaagtgcggcgtgcccggtggctcggcgtccccgtacaacgcgcgaggttggcgtggcgttgcgttgcgttgcttcgctgcgaaggttggcacgctgcatgtgcgcctgggcaccgcggcgaccgagccggggacacacgcacgactgagcaatatggccctaggacggccaaggaaaagacgaagaaatgctcttgcttttaccgcgagtggggcgtcgctgcagcgtgtttgattgctggtgctgctccaactcgaagcgcacacattttttttcttctttttttaaaaaaaaaagggtcagtaaaatgggagtgataagatgtgtttttttaaannnctttatgactattccggatttctgatcagttatctggcataaccgtcactggctatcagtctgaaatttcaaattttgggcttgaatttatcctttttactacctccgttctaaattattagtcgctttgacttttttcttgtaacgtttgaccattcgtattatttgaaaaactagagcaaatataaaaacaaagaagtcatacttaaagtacttttgataataaagcaaatcacaaacaaaataaataataattccataatttttttgaataagacgaaaaatcaaaggttacaaacaaaaag

SEQ ID NO: 104474 - DNA, 706 bp, Oryza sativa
ccaccccctactgtcttttaatagtagtatagatatagatatttcaagagtcaatgattttcatgtcttgacacatacaagggatggcaataggcatctacaccaaactagcttgtgcatttctgacgcactatctgtctagctctccttcgtatctatgtttctttggacattgaaccactgctgcactttttagctaacagttgacagtttatcaattttctttgaatctggagctattctttttctgatcggtgttgctatatatgaaagcaaaattgagggatgaagggaaaaaccgaagtcagctacaaccatgaagaaatacatcagtagtttagtgccaatttaccatttgagcgtatgaacactacaacagtactgcatagatgcttacattggaattacagtactgtgttacctttcatgacaataaccagtcaaccacctttgtcctgtgtcatttaaatcattaactatatgagatagcagtttttgtgttgcagctgtaatgtcaaatcgtctggtgattcattcatgctcttttcaatgctgaactatttgcaggttgtttttactgggtttgcctatggtggtctgtctgaattgtctgaagatgaatatacctcatgttcaatgggttcaacaatagcaggagagattggcatttttggctacagaccatctgtcctgggctgcaggaatt

SEQ ID NO: 104475 - DNA, 787 bp, Oryza sativa
tccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgttgccgccgtccacgtcaagcccgcgacgacaacgacgatggccggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcagtttttttttaatataatggatatttccctgagaaaatcaagaagataattgtctccatttgagagttgaaagaatcatgggttttgtggttatttcacacgtaaagggttgaactgaacgtctagctttgagttactgaaactctattttctgaaagaaaagacaaatactcgattctatcctcagcgctttcgcaatactctattattgagtgctatatgccttcaagaagctattaagaacaagataggagtgattcaattggaggacgtatatacgatcgagctctcttgcgtgctttgttcactgacctgcttagcatgatggaatcacaacagtgttgcataatcaagcacgtcctagtagtgtaataataataccaattgcttaatttcgtgactaattggatgttgctgtcacaggaaaaagaagaatttccaagctgagattctccccaggagta

SEQ ID NO: 104476 - DNA, 1225 bp, Oryza sativa
cgttcagcttagcagcatgaaaagaatatctcacattgaaagggacgtgtgaattagcagatactctggtccagtatttcatctgacaaaaaaaaaatcagctattattttacatcgctgcctgccaattcttgccttagacgcatctacgaaaatgatgtcttaatgtatgaattggccaaaactgagttttttcaagcaaaagaacaaattgacatccaagtttacctcgacaatgatacccaatgatccacacccatgaagtaattttagtttaaaactctccataatacattttacagtactattagaagttataaggtcacacacaataaaaggatcatttcacatggcaatcccctacaatagcagtgcttttaactagaaggtgttccaaaatttaatttgcatagctaatctaattgtaactagaatcctctggttctaaataggttcagtatcacatgcattgctggactccagatgaagcttagggttctttcagcaaagcaaggagaaaacagcatgttatgaacataattttctaaagaaaaggatatcagcttattgatcaattgactcattcctgatcataaaatgaaaataggaaaaaatagcagtaactggacttattctgctccaaactcaagatttctcaccgtacaccctttccataccttagtctgcctgtatggattgttgaaccttcaaagcaacaccttgcattctaagtaaaactgctagctagacaatggccacactcattatctaattgttgggtgtagcatcccatgacatgctattatagatgagttagtttttaattaaggcaatgccaaaaggacgtgtaataatgtaaatatgtttactgttaatcatatatgttggttttacaacagaatgtgattctccctgaccctttatggattttatgtggcatgcattgcatattgttaaaaaatgcttcaacacttgaagtgtatacttttcatagcaggttatacaaacatttgaaaacatttttattaaatagtagaaggtttgcatgggccatataccaaaacagtatttgtgaacccatggtccttgttctgaaccaagacttggtttcatgatgacaccaaaccgaagaaaacaaactgcgaccatatttgtccaaactgaagttctacctctgactctgagttccattgaatatttgccaatccatcttattcagcgcctt

SEQ ID NO: 104477 - DNA, 1488 bp, Oryza sativa
aaatggagaaaatctcacttcctataaccagtgatggagtttgagtgaactatcaatgggggaccaaaaagttaacggtattcattaacacactattaaaataccaaatttagtactaaaaatacactacgaatctattacacactaatatcaggcctaactgccacatgcttaatggacattgctttcacagatccagttacttctttccacggtgtgtagctctctcgtcagtcaccacacaagaaacaaagataagcagcagtgagcaattaatatggcaagtccatcaaaattcaggaactaagcctaactgttgctgctatgctgcatactactagctaccacacatgggcttgtgtgccaattgctgctgcatagtagctaaaggaaaattttctgggggaccacaaccctgttaagtccacactatcctccgaccctgcctataaccacagctctgcatactacagataacataatcaagtttaaacaatcatgaacctttaatacttacatgctatgtaaatccttgccaagtttctgctctatcactattttgatatcttgaaagttacatggagttgcctgaattattacaaaaatgttaaataaacaaaaactaatgaggctatgcagtgtacactaacattaagatagaaattaactagtaaacctgatcttgcagacaagagagtgttgatgagtattcttttggtacttgtcttattgtacttgcgtttaggcattattgtacttgcatggttatgcactcccgttaatcttagtgctacttttgaagtttggatatttgatctgcttgtatgctatcaaggaaaaacaaatcttgtattgagcccttatttgtttctttctttatgccaaatctgttgttcagatatgctccagccacacaactttggagaggcagcatatcatgtgatgggtagcatatctgaacaagcccagatatctgaactttggagataggcataaactttggagaggtagcatacaaagttgtgatgggtggcagcaaagaggataggcatgaacctgagcttgaacattggagcattgcagtaaaggatgggaaagccctggaaaacgagtggatgagtgagataccaatcccacgtcgcggccctcatagatctataacttcccctccccatgatttctattgttgccatttttgttggaaagtaatgttgctatacacctaaatgtcttgatgtttagcatctgttatattcagacttttatggtgctccccacaatatgtatgcttctaggctatttctttgatcaagtatctagattaaaattagttctgggccagaaatctgtttgcatgccatacaaagttcttgtggcatataagtatataacctgttcccgagaatggtcctgtcattaacaagcagcttaatcatgatttttctcttttgctaccagggcttttgttgttgctaatgataagctact

SEQ ID NO: 104478 - DNA, 654 bp, Oryza sativa
ttttataagctaggtgcaaaataagcactagatgatggccaaaatagtattagcttgtaatctctcccaaataagcactagatcatgtgaagggctttagatataactgttttcataagctaagtacaactggttggagatgctctaagaataaaggttggacaggctccatacccaaaacacgcaaggtactttgacaacattatttttcctgaagcagctagctgttctctcagaattcttagcctcttgggtaaaatctgcaatataacacactgtaagttctataaaatagaaacaacaaattgagtgcatagtgcagctataggggtcctcactttttaagtgtctaaaatcagctacaggggcccggaaatattttcagtgtccaaaatccacatacacagattaaccaaagtttgatgctagtaaaatgcacagaaaagtgcacaaaggggtgagatacacctgatgttttaacacatcgtgaattatttaaagaaattgaaaataaaatgtataatgaatttaactgatataactatgtccatcgtgttatatagagtacattgaacttttcttttaaaaaaaaagcatgtattgattgatttgaacaaacacatgatctgtactattgatctttgattccttgaa

SEQ ID NO: 104479 - DNA, 884 bp, Oryza sativa
cccatctattgagcttagctcttatcctaatgataatatttacaattgcaaacttatttgatttctcttattttgctgttttctcacagtttttgattgggaggatatcaatgggagctacaataacatgcatgaagtattgatcagcttagcaacagagttggacattagtcatatctacagaggtctgcattcaggatgcatgtatactctggtttctgcggtatgtgctgggagaaatctctgttatctttgaaaatgtgaattcacttgtcctgatattgacatgtgttttcctcttcttctaagttttagtgtgctctcaactgaggctgtcggctgtccattacttctactaggggacatagggaggaagtaaatgtagttagccatttgattgtattagttagcttgaagctgttcaactgtcacaataattgtacgtgtgaatcctttgtggctgctctggtatcaaatgttaaagactagttactcttccctgagatacacatacgagcatttctattttggatgctactcattagctattacagatcctaagtattctgctcccggagtgattttaagatatgttgtaatttgtgccggaaatatatattgtcatttatgttatacttgtcagatcagttaacttgaaatatttctgtgctatcatattgagaaagttacgcttattggaacatcactgtaaatttttattttcctttttgtgggctgcttagttgctagccgatagatgttacattggttctttattgtcagattatcacaagtaataatacttgtcttaccagtgtgaagttttacttctattgttctctcaattgcatctgtgtgctactccagtcagaactatttgacgc

SEQ ID NO: 104480 - DNA, 683 bp, Oryza sativa
gtcatctgtgtcattaacttattatactgagtgatcctacaaaatttgcgacttagcacaagatgctgagtcatgaatttgcttcgaccaagctccaaccttgcttccaagtcatgaactttttactctcaagactatgtatcctgttgatctaagagcaaaacctacccaaaatccgtaactaacaaaggtgtatataaagcatcaggtgtcagcaacaacttaaactgttcttgatttccaggctttggatatcttcttccccagatatctagcagcaacagcgccacctgaggccagcagtccagacatcgcttgacgtgcacttgagaccattacccggcgcctcaaagccttgcggacacaggttgctgctacatcttttgaagaaactgaggcacgagttggcatttctggaaattaaacaatttatcagaatgtgttatagattcgacggtactaatctcgaatgacgttagtaccttcgcaattcgatgcaaatcttccttgcaatcgcctttggattgtccatgggagataagagaacagttcgtttgttgcagatgcaccacaatcctgcaaatatagaactcttatcagttttagtttatgaagttccaaaagaaaaagattttcgtagagtaccaataaaatatcttataagtttcaaaggagataaatat

SEQ ID NO: 104481 - DNA, 670 bp, Oryza sativa
tttccctttttatgtatttggttcaattagttagtaaactaacatcttttcacttattcaggtggaatctttcagtgaactcttgaaagctcggaagtccaggattgaaagttgtgggcatatggtttcccagtactctcttgaatgtccaccacgtttgttcatgaccggtagggttgtcttttcgactaatattcagaatgtaattatgtatatatctttcctctatttaggagaaaaatgtaggtcaattaaaggaatcatgtgatcagtatgccatatgattttttattgctgaaaaccaaatcaactattgaatataaacataccatatgtgctagtgtaatgataatacaaagtaattaatgccatgacatactcctgagttaatttgaaatcagccttccgtacccagagacaattttattcatttcctacaatttagggagcacctaggatgaaataagtattgtttttattaatagaagaaaggaactatggaggactcttaagctaagtaatggtgattttccatgtaccgatcagtacagcatctgcagctttcatgaactagtagaacagaaaatatctaggaggaactagatatattgtttcattgaggagaacacctcgatgaacttgatatctgggtttggatctcacatgtact

SEQ ID NO: 104482 - DNA, 547 bp, Oryza sativa
tctataaacttagtcaaacttaattagaaaaaaaagtcaaacgacttaaaatatgaaacggaggaagcaatatattatgccattcgttttgattatttgtcttagtaaaaagatttatataaatgctatttcttccgtttcatattattagactttctagcattgcccacgtgtttgtgtgtatatatatatatatatatatatatatatatatatatatatatatatatatatatatatatatatatatatatatatgcaatgctagatagtcttataactagaaacggaggtagtttattttttttatatgactagttatatatacactctcacataaaattatacgtatacatatgtatgaaaaaaaattaaataagatatatagtcgcgctgtataaaaaaaaaaagaggtattacagttataaaaagaaaatccctttttctttgtatgaaaaaaaaatagcgcttactaacaacaaggaatttctctatccactttcacatacatgtcaccaaccactgtatatatttaaactttgataag

SEQ ID NO: 104483 - DNA, 529 bp, Oryza sativa
tttttcgtctggtttttttgacggacgatggaaacatctcttattttttaagtagtagagataaagataaagatatatatatatatatatatatatatacatacatatatatacatatatacatatatatacatatatacataaatatatatacatatatatatatatatatatatatatatatatacatatatatatatatacataaatatatatatatatacataaatatatatatatatacataaatatatatatatatatatatatatatatatatatatatatatatatatatatatatatatatacatacatacatacatatatatatatgtgtgtatatatacacatatgtgtatatatatatatatgtgtatatatatatatatatgtgtgtagatatatatatatatatatatatatatatatatatatatatatatatatatatatatatatatatatatatatatatatatatatatatatatatatatatatatagatatatatatatatatatata

SEQ ID NO: 104484 - DNA, 710 bp, Oryza sativa
ggctcaaaccaaaaagagatggatggatagatggatggatggatggatgtatggagaaatccaaggtacatgacccctccagatttgtgtcccctatagtgcttgtcctcttctctctccccatctctcaatgaacttattggtgaaaacaaattaaaatatagtgtgttaattaattaatttaaccatgcatgggccggccctcctctaccaactagattacctgtttgcttttgttagtttgatttgtccatttactaggtccaatattttagtaagttgttgcgtatagcccccatctcgagctatatgctagtcagccgtcctacatatgtggcttggtatgcttgtgtttttccttgcatggtgtaccggtataggctagtacatcttctacctcaaccttaattataaaagtttcaagtttatacaatccattaaattacaattgtatattagccgttaggcatgcctcacatgtgtcgatctttaatttttgcctgctcattgattaattgtgtgtatagatcaattttgcatttcaaactcaaacaattactattgctgtttgagatggtacattataacatggacccacatgtacataaatgcatgcacatcctttataaacccttaaatattatcaaagacatcaataatgcacatatatatactcaaatgtgcacgtatgtccagttatgtgtaatatg

SEQ ID NO: 104485 - DNA, 584 bp, Oryza sativa
ttgccggccggtttctgaatatgcatgactactaaacacgcagtaatttgactagcttgctgtcaattgtcattggcaaggcatcagagaagcagtaataattcatcatccagcatgcaagcatgatgatttgttttttttgaaacaatcaagcgtgatgaattgaactgcacacatctgtatgaatgttaatccacgacgtccctaccaccagcagatcaatttggcacacgccacctctgcacgaacatgaacgaatcatgctactagtagcagaagaggaatatacctgcgtgatactccagtaattaattaagttcagttaatgttatcgtcatgttgacaccggcctccgtgttttttttttcttcggtaatcgccacagcctccgacccaacgttgactaacttaaaagtgctgcaaaagtggacactgtttaagaaacgtcattcatattgtcagcaaaaagatatgaaagttcagtacatgtttcgttagagtttgtggcgaatatatgtacgtagtcggttaccgtttaggacttggagttgtactaggtataggactagagtaagagtcggact

SEQ ID NO: 104486 - DNA, 1985 bp, Oryza sativa
tgttaggacgtactccctccatttttattctttgcttagatcaaaattaaactaatcagcatcaaatatttagggaaggagtaatatataaacatggcaagtaaccatcaaattcatatcacagataccatgaaagaccaataggaaatatgagtatgtaattttaccttccaggataataactattggttgcaataattagccatgaaagaccaataagaaagaaatatgaagtctttcaagatagaaaaaaattacacaaaatatggtacctcccgatatatcctcaataactgtaaaatcactttcaagataatcatcaagattagttgctagcgacgttagaatatattaatcaacaagaattagctataagtatgcaaatttttccttctggcggcaatgctgttgttgccacagatgttttttagcaaatagctagtcatgtaactgacttgtaatccccctcttcttaatataagctaggcaaaatttgctgcatgccactcaaaatttataatctttgtaggacaccacaaaacacatggtaattaactattggacaatgaacatgttattttattatatttggtctaaatagagagagaaatttttagaaaagacaagtttgcccgtaggatatgtttctttttaataaccctattaggtttatttcgaattaccatgactaggggagtgagaatggactacatcgacggagtgagaatcgattgggtctagttcgacctagaccaagtcgtcttacaagccaatggataaaagggcaaatttatactttccgcgttgtttctctctctatttgcaccggatataataaaaataatgtgttaagtgtccagcagataattaccatgttttcacgatatcctgcaaccaatacatattttgtgggtgtcctacagtaaagacaatgaactttaagtgtactgtagtaaatttgccttaatataatggcagagttcctgccaaatgttaatttcaaagaaagtgtctagtttacgtatgtcaactgtgcacttttcaaaagtttttccaataatggcctaggaaaaaaatgttttttccaatatgtatgtaaaaagagtaggtacatgaaaaacatattagatatgttgttaattgaaaatagtttcaaaatattgcactacaaattcactatgcctgtgcacaacttatatttcaaaatacttgaaataaagtacataataaaatggtaaagtgtagaacctatatttcaaaagtcaaatacaaagctaacttcaagtcttgatcaacacaaaatactttgatttaactcagctttgcatggatatctcttattatctctatgtatatgatgcatgcaagctagaatgtgggctgcatgcttgccctgatccttttttttttgtcaatcatcaatagagaacaagttctctcattctttttttcctttagaaaagaagcaaggatattcttaagaattgcaacatgcgagttaataagtaacatagttgcagttgctagctagctattgatcgtctagaaggcgtcaagaatcatgcaagacatgtaaggggatctccatctcatatgtgttgacttgtctaagaccatattagagtgtcatctctccactgatttgaaggtagggaggccggggcgttagaacaattgcaacaacactcgctagagagccactgattatttttttttaaaaaaaaagatgctcaaaactatgcagctaattgcatctctacatcaagagcaaataaaactcaaggctaacccacttaccagacacgattgcatcggccaacggagtctaacatatgctctagatgcaccatcacctaatcaactaatatgtaacatctccaatttttcaatatataacgttgtttacttcttgataaatgtttgatcattgggattattctttttttttgcaaatataaaaaaatgaagtcatgcttaaagaacat

SEQ ID NO: 104487 - DNA, 2427 bp, Oryza sativa
ctccacccctttttatatggcacagggtgacgggggcccaccagccattgggctgggcgcccccgattagggcgcgggtcaaggcccccttgagccgttggactcaaggggagggagatccatctaacagaaccattactgagacctgacataagttattgttgccaagcttatcataaaactcacaagcaacttcaacttctggatgaattaatttttgttgaaatttgaagggacaccaatgaaatttagcagcaacagtgtcgtcttgcatataagtcatggccatgtggaaaattcagagattggcagcactgaaaggagaactctctttttttgctgcaactactcctgggtttatgatcgcttattttcccgcattttttacaaaactactggtggtatagtctaatagagaaagttacacctcttcaaaacagtaacaattttatatttttctgaatattttatcattattcatgaacgtaataatgtggattgcaccgaccctgaactccacctgggccagatgtgtaatgaaacgagtggctacatagcaatgaaggaataagttcattttaggtccctcatctttacgtcggatatgaattacatccttcaaccgcaataccagatataacttttgcaaaaccggtgtactcgagatcccagtacatacaatacaataccatgttttagctgcgtgacgagtaggacccacgtgtcagcgaccaacgtaactcttcttcctcccctcttccctttcttccccatccctcttcaggcgcgattcaaggatgatcaagtttgtttctgatcgtgggatggcgcgattcaaagatctagtagatgtttaatcggtctcacttatatatgtatatacatatatatatatatatatataactgacactctctagcggaggagaatgaaaggggaagaaaaaaaacgccttctttggttgttcctgatctgttcttcagtcttgtgaagattgtttcttcagtttactgttcactgtagagagagtttcaggtttcagagttaagcgagagtgcgagttgcgagcgattgccgctctaccggtgaagctgcagaggcaaatcgatctcctcgctcgctgcaagtgcagtacaacgagatgatggagaggagcctccgctagatgattattccatcaatactctctctccattttttgtgatttgttccattgattcagattcatacgcagcagctaaaacacacagaaaatacttgcagaggagacaaatcaataccttttttcctttttgcctccctttctttcaattgagttggattttggtttggttcaatggttgacacttgatatctgtaaataagttatttttaggagaagtatcttaaataagtaaatttttgcatttgaggcatcttcgacgcgaatgagaacattcagttgccgcaagcgccatcgcatcaccgagccgcccccatcgatgcgtctaggggagtactatcagatgacctaatttaacctggttttgtaagtttgggtttttggtaaatatgagagaccaaaagtgaacttattgcaagcctgaatgatatattacttgggccggattaagttgctgttatcaagtctgtcaaaattgtatgatttaggcctttataaaaattaagacccaaattgtaagaagcattagttcctcttgctaaggcccaaaccaactacagatcatgcaatccacatccagatgagaaaacatacacactcgaatttaggcccaacttgaattttgttatttctttcttttttcatgtaatggagtttttcttctttctttgaagagagagagagaggtggaaaggtctaaaaatgggccatgagagagagagacagagagagagagagagagagagagagagagaggtggaaaggtctaaaaatgggccatggtggtaggtgtgtgtgaaggaagtatttttccccagctacagtttggtcgatatgtactttttaacgaacttttgcaaaagtgagatggcttttaggagtgacgagttgagtcgagagtactagtacaaagatgcttgacgcatatgctatattatgcatgattggaaatagaaaagcatgatcttttttttctcagaatatcgaaaaatctgatcatatgatcgggagtttatcagattttataaaactagcaaaatatccgtgtgtgtgttgtagctaactctagttatattactagttatattagatgagtttactaaaacaaaattatcgctcaaattctgattatctaatgataattaataagataaatataatgttgtaccgtatacatgaagcaaattaatagagcttctcactccaagatactctctcttctaaattataaggcctatattttttacacagttttcaatagtata

SEQ ID NO: 104488 - DNA, 607 bp, Oryza sativa
tgacatggaaacccctcttctctgtatagaaaacactgaaaaaatgtcactgcagcaggtttagagtcattagttcatgacaagagcatgaagaaactgtgtgatcatttagcaattttgtttcctcctaaccataattaaacaacctgtacaaatgtagctgtcacacacaggtcacaaatggatgaagcaaacctgcttttgagaaagagttaagtcgctgtcagaggaaagaacacgaacgggttgctgcgttccgtgatggaactcaccagtagtgcagttgggatctccggagttaatcagcttgcttctgcaactagctttgctctgcagttgtgtatttgttcacgaacctctgaaaatttttagggttttggtcgccttctccacgtaggtcgccaccactgtgacgcagccagctctggtgactgatgaatctttaatgaattcagcatctggatggctctcagaatcagtagcagataaaaatgaatccaaagtgcagtagcagcagtgatgcaggatgtcagcacacaaacagctagtgctgatcgaatcagactgggagtgagttgggcacaagatgttactacagtatcttact

SEQ ID NO: 104489 - DNA, 649 bp, Oryza sativa
tctgtcaatgggtacagtcgtacaggggaaagagatatacacatgcctgcgtgcctacttgccttttgaccatctctgtttatgatcagtttcttaatccatgcagatttcaagctcccattcctgattggcagatgtgcactactgccacagtccatttcacatatatttttgttgttctccctttgcttctcttctcctctcttcttgatcaggtagcctaacttattagtcttcaagttccagctgagcaagctgctagtttagtcgatcttaccactacttcccctgcattcaatagattgattactgatgatataacaaccaaacactttataacatgagtactatactttacaactaaagaacgatcattggggagatctacacttttatttatatatgcatgtctctgcacttttttttttattcagacacatgagagcttctctttatatgtctcgtgtcatgtttggcagggagagagcaagctaaggtggtgaagcatgaggaaaggcaatgcaagattcccaaaggttggagctttgatctcaattgcatcaacatcatttcttgaaatttctctcctgtgctttgtttaatttaccggggtgtgttttttttttcatattttgcgcagtcatcgtca

SEQ ID NO: 104490 - DNA, 801 bp, Oryza sativa
caactcatggcacaccaaggcaccacaactaatgagccctttttctgttttctcagtggtgttgatgagttcttctaatcatcatttgaaatgacagcctatgtgggaggaacttttcagagaaagctgagaatcgaatgctccatcagttagtagtcaagtatatatttttaaatatgtggaacatgaaaactacccaacaagctccatgaaaatgatgcttgtagatgactgtgaccacattattcagtggaaaatatacatagctaccaccactctcatttagtggagtgtaatgggaaactgatgggaaattaactactgcttgaccaatgattagtgcaaataattaattagtgagctcaatacatactgcctaattttggttctcatattcatttattttaagagaaaatctcttatatgcctctgaaattttaactaatcccttctatgcccctgaattttgcttacttccttatatacacctgtcggagggtgatcctctctagcgggaggctgtgaggcccccctttgtgagtccggccaggggaccgggtgcaatactgaggaatgtgttctcgcgcgagcgaggtgaatctgcgagaatcaagctcacaaggtggaaggcgagagagtgagagagagggtttatacaggttcgggccgctatcaagcgtaataccctactcctgtctgtgtgatgaccttcgtgtggttacgaagattttagatcctgggattacaagctagggcttggccagcctcttccaagaatccagttttctcaggggctgcagg

SEQ ID NO: 104491 - DNA, 694 bp, Oryza sativa
ctaacggaaagagcaaagttttaaatcaacttttaacaattcataaggataaaatggacttttacagaacttaatagagagatgctaatggaaacctaaccgcgatggtatttctgagacaaattaagacgcttgtacgatagcatttctagcaagttggatttatcgatggtatttaatttcttggaatggtgtgcttgtagatgacatttcctagatttcctcaattaattaaacaatatgcagtatatatggcactcagtaattaagagctaatggtcggattagtaaggaagagctcgctagccaattaattaattagcagcagctagcgaaggaaaaacggagttcgtcgggatagcaggcgaccgtgtggtatgcattgcatatggtccaatttgccgcagttttactccacttagtctgtgtataattcagcgcaaagtttagattttggttaaaattagaaatgatgtgactgaaaagttgtatgtatatgacaggttgatgtaatgaaaaaggactgaagtttggatccaaaatctagatctaaacacagccttagcaacggctttacccgtcaaaacctaattatgcatgtgagctcaacagtagttcagcacaaaaccccacggcctttaatatcctctcgatccaccaataatatccatctaatttttattttttcctccct

SEQ ID NO: 104492 - DNA, 892 bp, Oryza sativa
agtgctcctgattggaggtgaatgacacagaatcgctgctttgataaatagatcaagtttaatttgctacatcatgaaattaactaattaaggatgctagctagctttgcgtatgtcatgagatgtgctcatcttacctcaatcatcaatcatcacatatatccgatttatatgtaaacacccttttacaacacaggcagctattatacatatacgcagatgaaaaaaaaaagtgtttttatataccatattttatagtgtaaaatttagtatatctcagtatctcaagtattatgaggtattgaattttatcctaaaaattttggtacttcttagacactttcaagtaccgtaaaatttcaacaagaacaataactacaaggtggggaattaagtaaatctccgatcctacctaatttccctaattgacaggtcaggattttttttctgaagaaagacagttcaggttttagacaaactgaatgaataaattatatatatataggacactcatattgggcaccatggtatcaaatacacaaaatcactcaaaattttcaaaattttcaaattgtgagtatataccgagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatacccatttgaattaggtatatactcaatttcaacaatggtgcccgggcaccatggagcaccaaacaaatttatatatatatata

SEQ ID NO: 104493 - DNA, 605 bp, Oryza sativa
ttcatgcttttcttaaagaaaaactctattgcattattttagactatttgttttaaactatttatccagtttataatatatataatatttaatttatcgttataatctagtagatcatccatcatatttcatctgccaataatctaaaatgaacactacctaagcacaagaacaatatgtagtatttactttaaaagatgttataaaagttatacttagtaaatggttgtatgcatgcctagttggtgtagaagccgtaatctatatatcttcatttctttaaaatttttttggaacctctctgtatatgtttggaaatccaaactgagtcgtcgattttgttccatagaatttctatgaaaactattatgtgtatgaaaaattaactattacgtgtatgaaattttttatgcgtatgccctgattgtcttttggagcataattttatgttaactaaccaaattacccattggggcacgctagacttttttttttgaagtagaattatatttaacatacaacactaactctgatttcttacaataatccttttggcagcagtgaatctacaatattataatgtggattagactccctgatgaaca

SEQ ID NO: 104494 - DNA, 1262 bp, Oryza sativa
tgaattttccacaagaaagaagaaagaagaaagaagaagaagcaaaactagtgatggaaaaggagaagaattccagcacgtcagccatggcgtcgcgagtccccaagcttgcctaacccgtcttgaccacgacaaacacgcagagagagagagagagagagagagagagaaaggatgagagggacaagacaacacatcgatgattcgcccccatccgctacgactccaagaacagcaaactcatacacgcatttcgccgccggccggccgggcggcggcggccatggccggccaagaaatgcggtgctcagaaatctttcttccgtttgggttcaccggagagaaacaagacggctggagatcaaagacgatgtttgccaaatcaattaattacctcttgcggctgcagatcatcctggaaggcccagagggaggagagcagcgtggcgtccaggccgtctccgaatccgagtggcagcggctccattgccatctcctcttctcctcttcctcttcctcttcctctttctctttctcctggccacacgctgatcgatctgatgatctcttcctcctccccttttcttgctctctctctctcgtacgtgtgtgcttcttgatttgggagaaacaaggacaagtgaagaagaaggaggcttttgggtgcagagagattcagagaaaatgtatatataggagttctaagctagcagatgatggtctctcttggtttgttttgtttactaatcacaggaggaggtttttgtgaagaagaagaagaagaagattagtagcaagaggttgtgggagagaggagaaaaatcaggggattaaagtatatggaatgtgcattcctcctatcatctcttgccatctgtgcacacatttcctatacaaagatactactactactttccaagggaagagagataaaaaaaaaggggaaaaggaaaaagaaaagttaggagaagaggagagaaaaaaaaaatgcaatgggggtggtgggtcccaaccacttttgtgtctctttgtgtaggtttggagacttggaggatggcgtggacaaagtctttgcttctttccttatttacaagtctcatggggctacccctctacagactacctgaaattgatgattcttcctcttctctctctttcaagtctccacagtatttttctctgtttttttcttggtattttctgccagtatatagtatgtgctctagtgtttctcgtattatacagtgtacatgtcggtttga

SEQ ID NO: 104495 - DNA, 1463 bp, Oryza sativa
agtactacttgattttttaccgtgcagactgtgcagtgcacgtactattaattatagtattaattactgcaccacattagattatggccttatatgtgggtcgttgctcatcttagcatggaaggaatattcttctgtctgtaattcaggttccatgcatgcatgcacagtaaatactttcattaaccctcataattttggcaacttattactgtctctctacttatatagtaggttaattatttggggaagatattgaaattacttttgattgttgttgtggagttgtattactatatatggcgcatatttatgtttcccttttcaaagctaggttggctgttctatttatttatttttcccagtatttaaaatttaaatttgttaagcataaagtagtgtgaacattgactagcacacaagtacgagaaaaactgcgtgtcagttccctggtgtgtacactttaaatactcttatgtggcatatctgtttttttgtttaagacaaatctgtgtagagatcgatgtggagcataatatgttaattgtgcgtacatatgatcgacactgtccatttcccaattaaaaaaaccaacaaacccgaaaggtatctgaagccaaatgattaacaacctgggttacaagtccaggtacacttaacgttcaggggtcatgaaagagcacagaattaaactagctaattaatgcaggataattaaattatatcgatcgtagagaggcatgtcaggacaatgacttgctgcctcgtgtcctcacaatcgcgaaagttgtctcgacatgcatgtttgttttttcttaattttttcaggaaaaaaaaatctagtaacatactccattcgtatataatatatgtgtgttttggttaataattagttaacaccatagataatgtagagccagctaaaccatagttatcacataatctttaaaaatgcaccgattaatcgcataatctatatactttacgcgtacaagctaaggtacaacggctatcgttttagtgaattatctccatgcatgttatgctaaagatcgacttccaaagacaatacatcgtatgtataaatgatagtcccagtgtaagcaatatccaccggagtcgtagcaaaaacgagttttcatacacaattaactatcactgcttatacgtatatatacttcgttggattataaatatatttgacataactacgaggagattgtgttaaaaaaatatgtcctgagaagaaattaagacggggaaaaggatcaaagaataatcgacagaaagtttatataacgtgggaaatgaagcaaatatagacaaattaaagaggacatgatcaaggtacacacacagtcatcgacaggcatatgcaacaaaggcatagagttgaccttggacaaaactggacatgtacattatctggcaaatagccacctcatcagctagctcgcctgtgg

SEQ ID NO: 104496 - DNA, 1065 bp, Oryza sativa
cctcctctcccctctcccgcttcttccccgtgcgccgctgcgcccgcatctgcccgcctgctggggagaagcaatgagagccgacctcctccccctacttctttccggcgcgccgccatgcccactctgccctagccgccacacccgcatctgcctgcctgctccacgccgcccgcctgccgcgctcgcttgccgcctgccgccagcctccactcaccgaagaagataagagagaagagagaaaaaagaggagaagaaaataggagagggcaactgatatttgggtcccacgtcagcaaaaccacccatatatactgccataggactctgagtgtacgttttgtgtgggtttaggtgtgcaaatttctgattttgtatttaagggactcaaaaaaatctcgctattaagttgagggatctctggtgaacttattccttttgtttttgggttcccttggcccatcttgttcttttctgcaaagcccatggcccatctctttgcgcagcccagccagcacaggcctgcgctgcgtgtcattccagcagccatacacgcgcctatgcacagtttcgaaaaagaaactgaaaattagcatggtgattggcgcgccgccctgtgtgtattaccatgtgtattgcataagttattgatttctaccaagcaattgctttcagtttattaaaaatatcaacatggtaatggtacttaactgtatttgtctttatatttttcaacatcgtatgaaaatttcagtcaaaaaaaaaacatcgtatgaaaattgtcggtcttacttgtgtaatttcgcttattttatcttaattttcaattaaacctatagtagattacatctatttgaagatttttaataatgagattcttgctactactaatttggtgcttttaattttgctattttagacatataggatgttactatcattgtgttacttgcctcgattttgatttaacatgaagtaactgcatctccgaaaaaacttaccatgggctacaaattctaatatcgctcccttccttttatatttaccagtaatctatccgtgcta

SEQ ID NO: 104497 - DNA, 759 bp, Oryza sativa
caattaattgcatcttatgtatatgcacaacggtaaattacttgaatatttgcacaagaggtatggaccaatattataaccttataacatgaactgtctcatttcttctccaaaagggaatacatgacaattctttatccacaatttgcatataaatacatatggacaatctcaaatttattagtatcagaactttgcgtctaacgatctacaaatctgtccacatatctccatgtacgaggaccccgtataacccatcaacacattttcctggaggttatggacaattccaacagctcatcacccaagtgtatctccgttttttaatagatcaagccgttgattttttatcacacgtttgaccattcgtcttattaaaaaaatttacgtaattataatttattttgttgtgagttgttttatcactcaaagtactttaagcatgatttatatatatacatttacataatttttttaataagacgaatggtcaaacatatgttcaaaaatcaacggcatcatctattataaaaaacggagggagtattagaattatcgcagcaacagatttcatcgtagcacgataaatttcaatgcatctttgaaatctcatttaacacgctgaacttttaaaataaaaattaatcaatacttaaaagtacattactactgacgtgttcatacactccatttgtaaaataatttttttgcggggcatttgtaaaataaatttaaaagcatcgtaaaatacaaacatgg

SEQ ID NO: 104498 - DNA, 652 bp, Oryza sativa
atccctactagataccagaagttgggcatcaaggtgttgaggcatcgtcgccggcggccgcgtcctcccccgtcgacgctccacactgaacccgaacctcgtcaccggcagctgcatccgctcccgtccacggtccacatcggagctcgtcgccaacgaccgcgtcctttgtcgggagctcgtcaccggcggccgtgtccatcgtccacgcctcagccggtgtctgcgtcctccacaccggagctcgtcgccggtgccgccgccaccaccacgcaggatcctccgccgtccactccccacgccggagctcgtcgatggcgccgtctctgtcaccacgcaggattatctgccgtccatgtgaccatgctccacgccggagcttgccggcggccgcgtccttcacgctggagctcgtcgccggcagctgcgtcctctacgccagagctcggcggcggcggctgcgtccgcgccaccggcgtcagcctcgtctgcgctgctcccatggtggcctacgctctcgtgtctgagggaggtggactgggagcgataccgttgggacagtatcccaacgggataccagtatatagtagccccctattttaatgggaatttggtcccaagcctaagcctcaagccctaatttccccatcct

SEQ ID NO: 104499 - DNA, 1026 bp, Oryza sativa
ttgcaacgggatattttaactgactctcccttttcgtttcctctgtccacgtgtgctcccctagtacctggtacctgatacctggtaccttaggtaccggtcggtatctggtaactagtacctttggtatcgactaggtatcgaccgatacctgatgcccggtacccaaggtaccaggtggtacctaggtatcagaccttggtaccaaggtatcaagcctgatacttgtggggtatcaaagggtaccatcaaaaaagaggaggagacgtgggggagggagcgccgcaacggcggaggatggcgtcgaggaggcacggcaaggtgagggacgtgtgctcccctagtacctggtaccttaggtaccggttcgtacctggtacctggtacctttggtaccgactaggtatcgaccgatacctgatgcccagtacctaaggtaccaggtgatacctaggtatcaaaccttggtaccaaggtataaagcctggtacttatggggtatcagagggtactgtcaaaaagaggaggagacgtcagggagggagggccgcaactgcggaggatgacgtcgaggaggcacgacgaggtgagggtcgaggcccgagccagagagtttgagaagtcttgaggaggagccgaggaggaggttgacggccatacctgttgcaggtcgacgcaagctgccggcgtccatcctggaggtgcaaaagcggggacgacggtgacgccgaggccgagggcgaggacaaggggagctcccgcttctgccctccccgaggcgactactccccggcacacacccgaccgacgagggcagcgagccatagcggcgcagcgaggggaggcgagctcgagggtgaccccgccgagggttggccgacctcgctgacgcagtgccgtcgttgtcctcctcggccgccggagacgacgacgacgatcccttcctcccggccggcttcttctccgctcggccttcttcagagagagagagaaagagagagagaggggagagggagagggagggct

SEQ ID NO: 104500 - DNA, 751 bp, Oryza sativa
aattgttaaccttggcgagggattttgaagcagattctgcataacagatcgatgctcaatgaaaacatcaatagaaattgcttctatcaattcaatttcgagcatgaatataaatcagaagtagagatagagaagcgaacaaaatatgaacaggattctttaaatggaaatggcaaatgtgatttcagttgtagagttgagcggccttaacttttaggaggctgagataggaattcatcatgttttcttgcatttccatttcgtgaaaaaaaaagtcctagtgtaggtaccatgcaactaaacttcataaatatatgacactacacatccaataattttgaggactattgaattagttactggttactgctgacgtgcatgatttcttattgcaaaaataatgttacctaactagctgcaacgaaaaaatgaagacacttgttcatcgctactgaacgctgctaaaaaagttttgcaaaagaaatattccagctacatgaaaattcctcagaattaactccacgctactaatgtgttgtgattagaaatggttgtcacaattacgatatgatcaattgcccatcacagttcaaatttttctcacaatttatctgtttttatgacatacattaattttgttcagatgtgcatcagtacatggccttgtcctctttatggaaacgctatgaagtccgtgacatttatgaacatttggacatattttaatgtcagcatattagccaagttatca

SEQ ID NO: 104501 - DNA, 850 bp, Oryza sativa
gagtggccgccggcaaagccgtgcggccgcaaggacagcggcggcggggcttctcgcttctcgctgacctcgtgctcagacagctggggagccgctcagggcggtggcgacggtgattgctagatccgcgctgctcctgcctgatctggcgaggagtcagctggcgacggggacggcgatggtggtggggatggcgacggcgacggtaagggcgagctgcgccgggctgcggaggccgatgacggcggggatggcgaccgcagagaggcggcggtggtggagaccgtggatcgggcgacggcggccggtgggaggagccgtggcgcatgggcgacgccagcagtgggaggccggtgtcacgcccagaaatttagcccaagtttccagactatttcgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggtttcagctccactccacaggcaaaactcaactggggtctgagccttggtcttctaacttcgtcttcagctcagaagcactacacttctgaaaaggggtaataatagcaagactgagtacaaccaccgtacccaacaagccacaccaacgatgcagacgtgcaaggggatacaaggaggggtttgtggctatttgcataaaggcggttgtaaaacattttattgagcaaaacagtaaaacggttgagtaattaaagtaatattaaatctccactgatcaacgctacaccacgttgaa

SEQ ID NO: 104502 - DNA, 687 bp, Oryza sativa
tatgaggcacttagtcctcatcatgaagaaaactgcagcggaaaataaaatctagcgaagctccggctccactcccacaggcagctcaactggggtataagccaaacgtcttctccttctggatcctttttcttaactgaggttgattgattattgcaaggtgagcatatgacatactcagcaagccacacagcaaatatgcaagtgcacaaggataccaaaggatggcataatattggctcatttgtaaaagcagcatttagcaaaacatttaagagaagtaaaacattggagtaattaatcagaaattttaatcaacactgaacagcacacccgtgctgcccaggcccaaccattctgaacaaccatacccggctgaacagatctaatctccaaaccaggagctaagctaattattaccaggtataacatctataattattatgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgcataacacaactcaccacagtgcaccattcctggatcataatcacccccttata

SEQ ID NO: 104503 - DNA, 980 bp, Oryza sativa
aggagaaaaaggatattagttattaacaactggtttgtcaaaccatatctcaagaaaaataaatttaatagatcatgtagcagattgtagatgaaatattaaattgttgcgtaagatttgcatcgtaagaagcaagaggtaggaaaattgatgaaaagtttgtgtttaattattagtactaatcacgaaacaaaataaatgatatacctcactttgatgggagatatatggatggaaatatgttaagtattataaaaataatagatatctatgttaaaatattgtggaaatgatacgagggggtgttgattggatttgcttgcatattgattcgtagaatttgatacaatatagatgatgtgcatgcttgcattagctttgatatgtaattattactaatagatgatgaggtggtatgtttgtatgttaagttttaggcttagtgggttgtaactatataaaatgtacagattagaggccgaaagtcagacaacgacaccttgctcatgtagcgcctattttatgataatgatttcattttaaatgcattgtttcacaaattatcatttctatcagacaaaataaacaacagaaatagacattaatatccattccatttatcatttctcgaaaagaaaacaaagattacaacgacacgatgcagttgctgtcttaagcctagttaaaacacccccttgtctccacctagccgatccaccgagtcctaagagagcagtgaagactgtctgctcggcgccatagaacacagtagacgaggacgcgttgcggcacgagaacagaccggcgagcgaccgaccatggcgtttgctgctctggcctcgctcgctatggttgccagctgctctgccacgggtagagctgctgcggcagttgacgtaatgcagggaatcacttctgccaagcgtgctgttcctccttccttgacccttctgtcttgctgctccgtccataatgcaggg

SEQ ID NO: 104504 - DNA, 696 bp, Oryza sativa
ccgcattaaaatcgataaattatttacactaaaaaaatcaataaattctcaacgactcctaatacatgcttgcacagtcaggttgatgatgtggcagatgcatctatgatggataacataacctccaatgtagctttacaaatttgtctccaaaatcgtcatggccgttgtatttgtgatgcattgtcaagagtaatagaaaccaccctagattctaaattgaattcttgtagtacatcaagtacaacactaagataagaggttctttggtgcttggatatccaaatgtcatatgtcacagaaaaaggaaagctaacagtactgaatgagcatttcaactcatccaacctagaacgatataacacaacaatattgttcttggtagttttccttgaaacttgggtgtactgtggacaaaaagcatttcggatcatcctctgaaattttttgcttttgcccatcctaatcggtagctcctcagaaactatgtaacaagcaatttcatctcgagctactcgtggctcataggtccatgtacttacagaaccattgggtccggagctcagttatgtctgccaggctcctgccgatgctttatccttgaggtgcgtcaaataatgtcggttttgatgtcctgttcctaaactagaagatgggggataaagttttccacagtgtttacaggtagcacgtgtt

SEQ ID NO: 104505 - DNA, 620 bp, Oryza sativa
atgtggctatgtgctatgtgctcatacatgtgaatggggaaatgtgggttttgtttgtgatatataagggtgaattttgtatgcaggatgaatgtgttgaatgtaggaaatgtcggtttcgtttcgttcaattttaattaaataacatgttgggaagatattttcaatttttttatatgactttcagtaaatgcttgtatatgacattttcgttatatgctttcatatgacattgtccgagtagatagtgcttttatatgacattttcgggccatttcggttgatatgacatttagatagtgcttttatatgacattttcgttaatgctaaacgatggtgctttgatatgacatttagatagtgcttttatatgacatttctgttaatgctaaatgatggtgctttgatatgagatttcggttatatgacattgtccgagtggtagatatttttaatttttttatatgactttgagttagtaataaattcaaattcttttatatgtacgcacattaaataatttttattgtcattcctataatatagaacgatggcagatagtgcgaaacgagatgaggataatgcctctcctccggcatcacacgctattgtggttgct

SEQ ID NO: 104506 - DNA, 532 bp, Oryza sativa
tgctcgtctgttattttgcgtggaaaccgattttgtgaatagggacgtgccacttggtttatctctccagcgattaatatgcatagaatttgttttaaaagattctgtactaaatatccaagtagataattaccattctggtgttctatttagttttacggacgacagattagtctgaagatatacatttacatgactcgctcactcactcgagcagttacatttacatgaccatccgcggcagtagtaaggccctgtttgtttcaacttataattattatattctagattattaagccagattgctataagctggattataataaactgatatagaataagctgtgagttgtttgtttgtctgaattattggaggcatggattattgggtttgaaaggctaaagtctataatgcccttagatatttgttcggttcatggcataggtgggtaatttttcttaactatgtaggggtagtgagtctttagccacttgataatctgaaaaaaaaagctcctttagagcagcttat

SEQ ID NO: 104507 - DNA, 755 bp, Oryza sativa
cccattagtgtgctaatgtttctaagcaggactgcatcctaatagctttagctaaaccacatagagttctagctaatcaatttgttaacccatttgcaaaggaaaggtaaggaatgtcaacagggtcataacaaaggatataggtcaaccctcccaaaggggagctttaggatctgtgtgacttaccttgcaggcctgcgaagactttcgaaccttcagcataaacagcctctttgggaacgtcgaaagccaaagcaaatgaatacaatcaacaaaacagtacaaaaacgagcataaacatgacatgtggatacttttgttggatatatctcgattttagatgaatttcgagacttgaaccacctaaatccgagttacggttaattagttatggatttcctaagttcaataggatttaaaccactgtcagataatatttatcatttatgacgcaataatgaattatttatgaattggaaaacggattactgcatccacatggatcggctccacagtagaccgggtgcgcagagccagtctatggatctgacggctcagattaaaagggaccgatctatcctagatctaacggctgaactaaatcgggttcaccacatgtgcggctgacgtggcagacagaggctgaagcagcgcggatgtggcggtgttgggttcatggctggttgcgagtggcacgggaccagatggtggccggcgatctagggcatggtgggttcggattggcgcaggggact

SEQ ID NO: 104508 - DNA, 1164 bp, Oryza sativa
atcaacgtaaaagtgaaactggattaagaaaatggatagtggatttaagttgatatattagagagatgatgatgctagtctagaggtttcaaaatgttacagaagactaattcaatcaaaggacacatttctacttcagaagagagcatttgcttttcattactcaatgttcaatttatattttgaactcatgaaacagtaaaagctgaagtactcctacaacatatttagcctgtcatgaccaaagtagcacactgagaaaattcagaaatcatggtttgcagagcaacagaacatcaattcaccaaatttattgaacatttcaacattggcacagtaacaactaacttcaaggcatcaaggaatattcactctaattaacatgcctgggtgctgatgtgcgaaggtgttccagatgcttggtctctgccaccctcagctgcaccacccttgtactgcatgtcaagaatggctaactcatcagatttcagatcaaaagataaaacatgtcacgatgtgatggttaatttttggcaaccaatccattccttggtgccaatcttagcattattcagtagcatcgtgtatcacgcaaaaaccaccatcaagtgcaaaagaaaatccctttttttctgaattatcggtggaaattaatcacatgtggagtgaacacgtaggggaacaatggagggagctcctacatcacggcgtccaacggcggcggcggccgtagcgcggtcctcagcaccacgccctttgctgcacggccagcggtctccatccgaggcggccggcgaatcaaaaggcggttaggtagacgggcgctggtcgatggacgtgattttttcctaccccatccccgtgcacaccaaccgagctcgtcgccctatctggcgaggatctgcgccgccgctgagcttgagaggagaggcagcgtcgtcgtcggagctcgtcgctgacgctgagctcctctccccatatagcgacgaggaagaggggaggacagcagactgaacggcgtgccagcgcgtggtaggctcggcctcgggcgccggaggaagaggcggcggcggcgacttcggcgcaggtgggacttgggaggggagatcggcggataagagggggtcgactgtcgagatggtgttgatggcggcctgacttttt

SEQ ID NO: 104509 - DNA, 1548 bp, Oryza sativa
cctcaaacggagggagtattattaattaattaccgcctcattctctccaactagcttaattctatgatatccgtactaaaagaagagattatgtttcttgttgcaggtacttgttttgggtctgttcatcggtatatccatctttgtctcgctctaatttagaccaaagacagactactaacaggcaaaaaaaaaccgacaattcaatacttcacagaaaacagcacaaaatactgccaggattcttctcaatcttcaggattagctcagaccctccaagtataacttttccttcaaggactggatgagattcttccaatgttgtatcaaagtgattattttttaagattagttgtattggatatttcagcaaaatgttatcaatcaaaaacaaaattatttcttcttgttcgcaatgcccagcagatagctgctagaataaccacacttatgttcagcattttcggctctattatttgctgccatgggcgtggggagtatgaccttaattatgagcaatccgtgttagtgtcggagtaaatttcttttagaaaaaacacatattgtaggctagggttgagacttgagcgttataccttgcttttgttgtaataggcaaatctctttcgctagaagaagaaaagttaactactatgtttcgttcaagggagtagctatactaatttatggcatcatattttttttttaaaaaaatcaacatgtatttacattgtaagtctctaaattacatacgtaattttcgtgtatttacaatataagttccaaaattatatacgtaagtctctaaagtatatatgtagtaagtccaatgtaatataatgcaagtgcataatgcaacctttatattttgcattgtaaattacatatatttatataacatctactgcattagaaacctacaagtaaaaccatcaaaagccatgcttgaggtggtggtgtggcggagcgatagcattgtcgagagagagagagaggcagagtacatggattgaggtggcaactatgtatagggtgcaacagagtggattgggcagcggtgacagagacgcaacgatgactaagggtgcaagtggctaacccgctaactcacttattacaagtggctaacctacgaacgcacctccgttacccatttatttgatctataggttggtttgcatggtcgctacttgcacccttaacagtgtcgctaggagtggatcatcatatttgatagttactactttcattctagaatataaatattattagtgttggacgcaggtattaaaaagtagataaaattaaatgggagaatgttgtgattagttgagaagcggagatagatggggaaattattatattttggataaattttgaataatagaagctgttatattttagaacatagaaaataagttttatagccgttcccaaaaaatatatttatttatggtggaatttattcatatgagttctgagtgttagatttgatatggattatagggtagatgactaattatttttttaagtagagacactcgtggg

SEQ ID NO: 104510 - DNA, 1985 bp, Oryza sativa
actaaatgtagccatttttttttgataactttgcaaaaaaaaatgataaggttgaaaatagtagcaaagtgaacgagctctaaatctggcaagttaaccaggagaagaggacggtgagaagaaaacctctgcgtttggtggttgtggaggtgcagctgccaaggctggagcagattgtgaaagagccgacgctgcagcaggtgaaacagatggctgaggagatgctgccgcagaagtcgatggcacaactgctggagacgagggaggtgacagatgaacggcaatggacggcgaagtgcttgcacgtccatggtggggaaccggcggaagatctccatctgggacgactggggaggaggcgatctccatgtttgcgagaggtcgccggcgaccggcagcggaactggaagagagtagagacttagagaggggcggcgggcggaattggcagagacagttgtgcgtgcgccgggatcgcgggttggtgggcatgttatagaacggattcgcaatagttgtggcgacagtttggccttaggattgtcacggagattcgtgctcacgtggcattagccacacatgctttactgattttcttcatctttactcgggtgcgccatctttactctgttgcgctttgtccttatcatcctctagcactataacactaggcaggcgtattgatttgacagatagatcaaagtaatgattgatacttcatattaatttagttacaccataattacatcctgctaattacatatgtaattttgagacttacacatgtaattgtaaatacacatttaattttaaggacttgcagtgtactccctccgtcccaaaaaaaggcaaaccctggtttccgtgtccaacgtttgaccgtccgtcttatttgaaaaaattatgaaaacaattaaaaagataagtcacacataaagtattaatcatgttttatcatctaacaacaacgaaaatactaattataaaaaaaattcatataagacggacagtcaaacattagcacgagaacccatggtttatctttttttgggatggagggagtaaatatgtattgactatttttttatgaaaaatacgacggttgtccctgagagagctgcagctgctggtgctgcgcaggtacagccatcacatccgaagacagccatggctagtactgttttagaaaaaaaaaatcaagtcttcaccagtgccaaagctctctccctataagaccaactccagtgtgaacctaaaatcgattttaaccaaaaacaaaaaaagaaccgtgcacattgtgaggagctaatggtttgggtcagatgaaaaagcgacttcaaacgagaggtcgaacacaaatcataaaaataaaaaatatatttgttgctgccggatgtgagagcgagaggaaaggtgagattgagttttattttcatgtgaggaaagctttgttcaactggtatgaacagaactctcagaacacacactacagctgtcctaagtgctcgttcaccggtcgccatatttttttaatgaaaaagcaaagtgtaaaacaacgggccggaggtcaacccggtcaagcatctggttcaccggtctaaccgctagatcatcgatcgaactaccggttcaaactttattaataatttattcatttaccattatttctaatgcagaaaagtgtaattatgctacatatacgacaggaattcttatccagtactcctgccgtccaaaaaaaaaatctacttctgggtttcccaactgtaaataaataaatcaaagagcatgcccaacgataaagggaaaaaaaagggagaaagcaagtggatatactccagtgcaagtcacacagaataacgaaaatcctgataattaatggcttgtcttgactcgatgccgaaagaatcaagaatgcataatatgtccacgatggtgccggcatcacatacatcaaagaaaaattacacacatacaaagacatg

SEQ ID NO: 104511 - DNA, 2549 bp, Oryza sativa
gtggtggagcatcggtgcgccagccatgcctttgttggtctagtggcggtcggccacgcttagcggtagccgatccggtactagtcttctcctgggcgtgtgtgttggcgatgtcgtcgtgtgggtggtggtattttttttcttttcctggttacgactctccatggttgtaatcttgtacttttttcctgctctatcaatagaacttcgcaccgtctcgtgcgagtcgttcaaaaaaaaaaaatgtttgccatgttcgcctcgcctgcattggtgtttgtatggttccatgtcctggtcaaggtaaaaggtaggccactacagggttgtgtgttcagtcaaagaagtgctagaattgctccaggcttccaggtctgatatctagagaatggggggagaatttcagatgctccatgaaatactgaagagcggagattgaggttggctgtttggatccctcctgtcctacctaccatcaagtcattataagttgatgatggtaatagctggaaaagatagtagcagtcttagtaaccaccaaaacaagctgcaggtgctcacatagggcttgtaggctatggccagcaggtggatacttattagtcaatgacaccactaaatgtactgaaaaacagcatttagaaggctttttgttattcaccagactcccttatattctaagccaagatccacaaaacgaaaacaaatatgtcagcataggatgaatgcgatgcccaagcacatattagtaaggcttccaatggacaaaaccattctttgtaaaagaacacctttttcacatcagtatcaacaaaaaacagcaggcaactaggaaaacaacattttagcaactctgcgcaattaatttcttatttcttggacactaagcataaaacaatctcctgataagttttcttcataaataatcaagaccatattggaaagaggtaaaatggctcttaccttcaaatgaacgcaagccgcttcaaaagaagcaaacatagagttaattagcagtaaaataaattggctttaacataattcttttgcaatctaggtccttcaaaccatcacactatttgctgggcttgtccttgaacagtcatttaggcccggtttaaatgccgaaaattttcgggtctgaaaacttgagagacaactaggcgcattttctatttcctaaaaggtttagcaaattaaattataccattcttatggaataaattaaaataagtttggtgacattggacttttgaaacaaaatgacatatgcatttacatactaatgctcatcgcttttccaaaaggagctatacaaaaatactatcccaaccaattattcaccctatttgaattcctgttccagttcttcaagattttagccatgccggtgtctcttaaaagcatttctttcgatgcaagtctttactaccttacctttacgccgctaccgtgtggagaatccatagcaatatatcaataattactgtattggagtgtcacatcgttctagattttattttttcccaacaacagggatcatatgatcactcattggtcatactcatcatcactcatgaatcaaggcattaggtagaatgcatacatacaaggagagaaaatgtcaacattctacacaagcattagacgtagatgggctagaaaccccatagcacatttaagcaaacataagacaaaaaaataaaaataaagtgaaaattcttagtgttcttaccatgggatgtttaaacgaataatcaatcggaaatacaatatcaaggaagaatatccctcctccatacgtagaacctacaagacgagtactaccgcattagatcaacaaagtgaaggtgcatataagactcgtttactctagaaaaaaaattaacgcaatttatgaacaggtgaaattcgcacagtgcagtagtaatattcacacacgctaggtttaccggctgctgctagctggagccccaagggcgcacgccgctccatcccccgcaggatcttcctcctccgcctccgccgcccctggcgccgccgccggcggggaaaggggagcgaccgagcgagagttgggggaaggagtaggaggagggcatgtttgcgtgggccgtgggccgggctctttgtgttggtgaggctttaagcccaatttttttaccaggccccaatcttgtcagaaataatgggccaaagttaaactggcgatgtttcagtatagggaaaagtacaccgaaggtccctcaacttatcatcgagttacaaaatcgtctccaaaccgcaaaacgggtatatgacatccctcatcttacaaaaccgttcacttcaggtcattcggcggttttgatcccggttttgtctgacatggcggctgagtcagaggtgggacccacgtgggctccacatgtcaggctgccacgtcacacccccctctctctttcccctctcctctcccttcctcttcctcctctctctctcaattttctcctcaatggaaagccagccggcgggtgaggagagggtcgtcggggcaaggcgggatagga

SEQ ID NO: 104512 - DNA, 1740 bp, Oryza sativa
aattttagagctagagaagatctacaactctgtaattaacaaccttttcatttaagatcgtttagatgtccgaatatttgttacaaaatctaaaacttatttaaaaaatctcaaaccaacatttcaaacaatattggataaagataaactttatataaaagacgtagatctagatgagttctataactttgtagtttattacttttccatttaaaatcatttggagtcaggggcaaatccagcatgggtgtggggggactcgagccccctaccccgctggatcagccttgatagaaggagagataaaaggggaagaagagggaaaaaataaagagtatggggaccgaagaagaaggaaagagataagttcctccttcaatctggtcttggattcgctccggtttagagtgtcaaataagcattattagcttttaagcaattgaaacccgtgaaaagggttcgaatacaaataaaatttttgcatttaggtcccttaacacccttaatttttaaacgtctagatttgtaaattttcaaaacaaaaatacttttctaaaatttgtaataaaaaatttaaaaaatcttaacctattataaaaattgaatatgattccttaatcacacaccttttcttccgccgtaacatcagctgcccgatgtatactttctatatagttgatacccactaacaattattagaagctaaagcttaacatgcaagcatatcacatcatcacccattagcaattattattcaaacccatttaaaatcccatgtaagcatgccacattctcactcactagcacttactattctaacttattttaaatcccatgcaaatatgacacatattcactaactagcaattactatcccatgcaagcatgatacatcatctacaaatcatcttccttattattttattaacatttcaactttcatcgtttcaacaatatttaagatatactcatccatgaaccccagcgaagcgcggggtatcactttaccgaagagttagcacgttatctgcgtgcatctggttgctgcgtcggctcgattctgatttcgtccgtagtcctgcttgcgcgcccgcccgtccgtagtccgcccaattcagggtgcttcgagcggatgacctcgagtagtagacatggttggagaaatgggggggaataattaattatttgccactcttacggatggtgataaatgatttgccgatccacatgtcatagacacataagagctcacatgttattttgagggttttcattgaagtttatttttcaacatttacttttagatagctaaaaacacgtatataaaagttttattcacaaattatttttcggttgtaaatataccatttggcttattccccaaataagagaaacaatggggtcaaatgtttcttggcttatcatctaatgtttattgtaattttattttttttttccgttgcaacacacgggtcgactggtcggcttgtgaggctttttttttctaaagaaaaatagaaaagatcgactggtcggcttgtgaggccgtgacgttacaagggttagtggcaatgccgcagtggggctctgttgatgttcgtccgtcttggttcgttcatcgtcgcgaatcccaatacccacaagccgcttatcgaaccgatactgtttctgccacaaccagtccgcaaaaagccaaaaactacgatctgcccgttttgttactgcctgtctccctccgta

SEQ ID NO: 104513 - DNA, 733 bp, Oryza sativa
gatcgagcagcaggtcgcttcgacaactcctcgatgcggcggcggcggcggttcctcggcgcggcgaccactccggcggcggcggaagcctctcgacgcgagcagcaggcggggcggggtggctcctcgatagggcacaacagaaggtttgccaaggtggattcctccttcgcttgccctgttgactagtgcggaccagcacggcgtgagaggaagattagtgttgattgtctcttcattgctgtcatgtaatttgcattcataactgctgatcgaggcgattagagaaaaagattaatctttgactaaccaccaagtgagtgctagtgctagttgtgtcaaattctgccaaaactatattcaaattataccaaaactatcatatttgtcaaagtttgtcaaaaatatgataagatttaaattatttcaaaaaatttaagctcaaaacagtttgcagctttatgtgcaaaatatgggtgaaaacaccagtgatatctacaggtaggggtaaatatgcaataagtaaaggcatatatgtattttcgtgctcgacttaacaccatcatccatccaaaacaaagggcaaatctctgctccgtttcagaaaagcagaggccaaaatgcaaatcgaaatgctaacccctaaaagataagagcaaaattataattgaactttaaaataggagtaaaagtataatagccccgaaggagaaaggtttttttttctttccag

SEQ ID NO: 104514 - DNA, 694 bp, Oryza sativa
gaaaaacaacaacaacaaaagttttttttccttactggcgaaaaaaactgtagatccgacggaaaaaagatttgattcatataaaaggcaaaaaaaaaaagtggtgacaaaaaaaacgctagatccgaatcctttaaaaacagaaaaaaagtttgattcctataaaggcaaaaaaatctaaaaaattcgttcgattccctaagaaaatggtgaaaaaatggttcgcaaaaaataaaaagctggttcatataaaataaaaaatgcaagagagaaaaaaatagaaacggcgaaacaaaatctgatttctaaccagtatatatctcttctctatctctaatttaactatttaaaaagagaaaatgcatgagaaaataaaaacggttaaaataacgtgtgaggcaaaagtcaaaaaaaagcgcaaaagcacgctaaaaatgttctctatcatcaataaaaaaataaaaagaagcgcgagaaaaattatttccattgtcgataaaaataaaaagacgcgcgaggaaaaaactatcgaaaaaacacgccatttctaaaaaaatggtttttaaaaaccgtgcaagaaaaaaacaccgtctattaaaaaaatcgccctgaaaaaactgtcagaaaaaagctaaagtgatggacgcttcagtcggataggatccatcgattttctgccatctactacatggct

SEQ ID NO: 104515 - DNA, 660 bp, Oryza sativa
tttttttttgttcgtttcttctattttcgcaggcgggccgttgccccgactgcaaagatggatgattttcgcagtcattgtggtgcaggcggacctctctcccgcctgcgaaaattagttttgccgcctgcaaaaatgctttttctagtagtgttgtatagctcattcaaacacgcatgtcgcaatgaagggggtaaaactagcttagcttagctatgcttgtcttctccaacattcccaaggcttctagttttcaaaaccctagcttagcttggcttagctcctggatcctactagctagctagcccctttcatggccaatcatcatcaacttctcagtcaattcatcaacttcatccatcccagagacctctgcaagattattgtcatcccaatcctagttgtaaaaacactttcccaatttcccaattactacttagttacttctccgccccaaaataagctaacttctcagcacacgaacgaccaaaagttaatttattttgggatgtagagaaaattttatatacttttttttcctttttgctcttcattcttactaaggtttgcctaaattcattttttctcatggagtatatgactccacacaatgaagaacacaatacgcatacgatcaacaaatcatgattcaatctttcg

SEQ ID NO: 104516 - DNA, 707 bp, Oryza sativa
atatatatattatatatatatgtctagattcattaacatatatatgaatgtgagatatgtctagattcattaacatatatatgaatgtaggtaatcttagaaagtcttataatataaaacgaatagagtaataatttgataagttatctattatcagaattttaagagtttgatcaaatatgtatatgatgttatgatagacaaatttacgtatacattttttctaaactaaaagttatttgagattgttcattaaaatttttaaagtttaaccaaatcttatcctaaattttaagaccatatcatagtcctgatggagatacttagttacacgtacacgtatgtacaccaacaacctagctagatgttcatgtttctaatcgatctccaccacatttgttttcagactaaacacatccaacatcttgcctatcattctctcgaaaatattaatttactgtaaatatatggggaggtgtactatctattttagcgtgtgcatcctgtataaaaaaaactaacttttgaccagagttcacaaaatcgacaggtttttatgaaactgctaagtcttggtttttgtgataaccgatcgacattaatcagctgtttccccatcgatagacacggtttttatcgatttttaagtcggttttcgataaaccggtgagaataggcttttttactttgaaagggctgcaggaatt

SEQ ID NO: 104517 - DNA, 1592 bp, Oryza sativa
cacattatctacgaaaaagaagtctagaacaacaagaaagttgcgactagtttaggacttcgttagacaaattgtgatagttgacatattggtggtaaagctaggagagttctatagacgcatgtataggtaatgaaccatgtcgaatccatattgtatatctgatcgaacctatatcatttttttaataatagaaaataacttttgacctccgcaatggttatatttcaagtaaatcatattattctcaatgaaccataattaccacatatatgtagtacgagaaaacaagtttcatgagaaagtgttgttctgctcttggttataatcagcacacctaagggctaaggcctttggagatggatgtgtaaaccaatataaatttgttaaagtgaacccactagaatatggcataaatactcccacaaaaatatagtactcctacatagtattagagatgattgacatgagtgaacattttcatttgcaaaatgagtcttttcagattgtggtttgttcccttgaagagcaagttctgtggcagagagaaatgtagcccccaaatcaacaaccaatcaggagtgagcatcaaggccgacatatcacagcagaggcaaggccatggagcatcaatccatgcatgctacaccaactaattataaactcccaagatcccagacaaaatgaggattgatccactaaaccctcatgacaaagataatgattaatcccctctttccttctctctctccctcttttgagtggacattagcacctgaacctgcaactaaacaccatttgtcgtgtgctgatgtgtcaatgtggcactggcttgttgcacttcatgtccgacgtgtcatgccacgtttgcagagggtggcacacggtccagtaggctacgcctagagaatgataggatcaaactctattatcagaaaaaaggtgtacagtaagaaaaaggatcgaactccattattgaaaaaaaaaaggcatagagccgtagaaaaccaaaaggcagttggaaaatttttaaggtaggaatgagctgcagctaactgcttatctgtggggtgactatttttttttgaaagagcacttagggcatagagtcccccctattccgctggattactattgatagaaggggagatgaaaggggaagaatagagagaaaacgaagagtaggggggactgaagaaggaagaaggaaatgagtccccccttaaatcttattctggatctgcccatgtgtacaaccgtgtgtaatagtggtctctctttgttgccatgtaagtaaatttgatgatgtggaagaaagaggagaggaaagataaagcatggttgctatgtatgacaacagctcagagtcgactcttaacatttattaaaggaaattttgttgcatgagggtggagaaaaggaaagaacagtagtaaaaaaaatattttggtgcattaataattaagagttcttgttgtctcaactattgtagcagtatagtctctaaataatatgtactaactaagagaccatatcggaccctacctttgtacatgcccttatacacgtactaaaattttcttacaaaactc

SEQ ID NO: 104518 - DNA, 599 bp, Oryza sativa
ctaatatttctctgtctgaaataatattgagaaacttttgtctaatcgagcacagtttggaacacatattgttcaattcctgttgggatatcagaaaattcagatgtttgtgatgctgtaacactaaccgatacgggacagatttgaacaaaattcttgcagaaatcctacaatgcaaacacggttttacctaaattgggctagtctttctccaagaataaaatagccccaaatgcctttcgtttaataaaaagcagagaacaattttaacaaacaacatgatgcacatataataaagtgcatacagttaatagttttaaatcagccacctgacaataacatgaatgatagaatctacgtatacccttacaagaaaataaaagatgattagataaggtcaagcaaaagaaaggaagccatggtaccagttgtcattatgtcttataatatgatggctacaagctatatagttctaatatgcatgctatttttaagggaaatatgagtgctgattggtgcagatgatatgcggcaatttttttttggatcaaatatgactacagagagcatgtgaatgtgatgtagatcaccaatcaatt

SEQ ID NO: 104519 - DNA, 1211 bp, Oryza sativa
cagttctgacacatgctctagataaacataatataagttaaattacaactaaagtacataataataatattattggatcttagttatactatagttacgtttgaaagtttttcattaagctactcctatttcctgatcacattctaccgattacttttttttaaaaaaagaagaagtttataagaaatattatgtgcataatttcctaaaggtatattttgaaaagaaattcgtgaggcgattgggtccttatcttccatttctcttccccagattagaattatacaaatgcagcggcgccggcgtcagcattcagcagaaggcaggcatatatggtgtctgctgatgcatgtgggtcccacccgcccaaactgaccaagtgggccctccctatctacttggtactccttctctggatcttctgcgcgtaaaggtatattctcaggatcattctctccgattccggccggtcagcggctgtgtttgcatcctgttcccaacacatctctctcgttttccgcgtggactcttttcaaattaataaacgatgcgtttttttaaaaaagtttctatacgaaagttactttaaaaaatcaaattaatctatttttaaaaaaaatagctaatacttaattaatcacgtgctaatggaccgctccgttttccatgcgggagggattagttcccattactggaatccgaacacagcctcaagattttttttgcaacttgacaataagcacttcaacttgacaataagcccttaattaactagtaccccactaatcttgtgcttatttcagtgtaatgtttacagctgtaatgtatttgtcggtttggtttttttaaaaaaatgtactaattgttctacgtactggaaaaatacttcacaggtggagtatctcttttggacgacccgtcctcctttttcctcagcggttacttcctcaagctataataaatatttaagttttagaacgagatttatacagatttttagaattcaaaccaccttttttttagttttagaacaagcttgtaaaacataactagtttatgatggtacgatgataatttctttttggaaaatttaactataattttttttattttaaactaatactttctctgtttcatattataagactttctagcattactcatattcatatagatgttaagagatctagacatatctcacattcttattt

SEQ ID NO: 104520 - DNA, 921 bp, Oryza sativa
atgaagtgccctttcctcgtaggttttgccacacatgccacgaagctggtcataattcgcggacttgcggccggacatctacgtacaagagaaaactttagaatatggttccctgtagtttagttgggactcctctgattgttagaagttgttttgttttaagtacgtgaacaaatttttgagaggcgtgtgttttttcatcctatgagcaatttattaagattatgtaacctgtggattggtcagtatatacgaccttaagtaaagtatgcttctagtagtaaattgtgtcttttttgggtagtgtatttgcaccggttaaaaatggatgtctgctgtaattagtttcatttggatgatggtgctttctctataaagagagaaagagatatagtatactggtatttatgatgatcattgtttgcaaaaggagtgtgatttggtgtggatatgagttgtttttttaggtatggagatagaaattagctgtgcaatgtattgaatcctcccgttcactgaaatggacataatgatcgatagcaattgactcgttatcacgcagagtcaatgacataatttacgcagagtcaccgcatatattgaatcctcccgttgaaaatgataaatggaagtaaatgacatactgttattgtttggcatagtgaataatttccatagcacagttcgtgcaactgtcattgcaacccagacgatactttgtccatgcatagcaatgttttcatgattctgtcaagataggacataagtgtatttcgaagattacatgaaaatgttctggtaaagctagaagtagaaaattgctaaactaattgtctttaatttgtcgaagacggtccaccacatattctggtagtattgcctcgttatcacgcagagtcaaaaggtggatcaaaaattgcc

SEQ ID NO: 104521 - DNA, 1920 bp, Oryza sativa
tacatggcaacagttcgcattatagaaatctaccaactaccatcattggatccgtcctacggctcatgatatgtccaattatacaggtttgaccggctctttactagagtatacgtatgcatgtacatgcagagaatccattatggagtatatgacattgtgtttatatacgtacagaagaacttttgtcttatatactgcctccagtcatgaaaatatatatgcatgccaaccgttttgtgcacatgtttcagataatcttttaaaaaaatagtatagtgaatttttaaatatttagtttaaaaattagtactgtatgtatagtgtttccttaaaactattttcgtaaccctgtaattttatcaaaattttcaaatatctgtcaataaaaatcagcaaccaaatttgtatttagaacaatgtgtcgatatttaatataacatatttttcaagtcaaaatttactccatcatactcaaaaattgtagcattacttcaggactctttcattttatgtttttgtcatagggcactctagtttcgtgattatttaccaaagataattcggttattattttaatatatcctctatcaatggaaatataaaactctgcaaatgaccatttacctttgggccaccttgtaagatttaaatttgaaaatatttgcaaaatttaaacattccaaaattcaaaacttgtctaaatttagtctgcatttgtttattttttttaatatatatatatatatatatatatatatatatatataattataagtttgatatcagcaattttggaaacgatttgaatcttacaaaattcagctaaatttgttcaaattcaaaacttgcaaggcggcaaagggtataattataattatctttcgcaaagttatatctgtgctctatcatggaagaaattgtattgaaataattgttaaagtgtctaaattatcgcaaaaccacaaaaccaaagtgtctcaaaacaaatgccacagtttcaaaattattggggctaataatgtagtatgtatcttcgtgatctcaaagtacggccgaagggtctaacacattgtgttcagtgcacccaacagcaccttatgggtggtgtcgaacttttcatggatttatggtgaatcaaaatcatactacaacacaatagtgacaaaaggcacatgaatcttggtcaaggcgaagctggctgctaggtgatgtgtggctatcgatcagtgtagcgaagttgtcttgctagtagttaataactagaagcaactgctgtgtttccttttctcccttcagctatctatcttggctgcacctgtctgaaggagtggaggtgtgaactgtacccagcatgacatttttcacgtcagtcaggggggagaggagacgctgcaaggtgatcagtgatcactgtcccactccacattggcacttagcccatgctgccagcaggtacggcagagcccaccccctgacgaccgatgctaactgtttgttcagagaggaaatttcgttgtgcagatcatgattaacgagatacgcttggggcttgacccggccaatcatgttggttaagacgatcaggttttggaactatacacattagaacgacacaacgaatacgtacatgatcatcaccaatcatgccgcttgtccgtgcctgcatttgcatgcatatgcatgcgagagttcggttcacacgtcctggaacgaacatgccgcaaaagacattttgtccccagctttgtgctctgttgatcgaccgattggtcaagacgaacggatgccgagacagacaaggcgggatacatcactctctctccaaaaggtgggagaagaacggggaggagaggacgccggccctggaccacgctcaagctctctctgcaaatccatctcctcgatccggtaggacac

SEQ ID NO: 104522 - DNA, 1147 bp, Oryza sativa
attcctgcagcccatttgatacacgaggcttctttggattgaattattttcggaggaaaattggatgatttcaatgcgtataggatttttattcattgggaattaaggaacgggtaacggaaaaatatggtaaatctttcacttgtaattgattatccataggaaatccatagaaattaatatccattagaacctcgcttgtttctttggaaaattcagtaaagaatcagtgtatatacatgatacaacttcaaatgaacattgttctgacacaacttaagattaaaaaaaatatttatattatacgtagtttttttttctatggatagaacacacaaccaaaggttacacgagtaacattaggtcttataactaatatacaaatgaaaaaaaaaacctagactactaatttccaatcttctcctaccttgcttcaccattccccttttgttacgcagcagcaaccagaacatcattgatgttaagattttcctaacagatagcgatctttgctgcttgatgaaacctggcacgaaaatcgctctgaggcaatctatagaagcctggatttctataaaccctcgtcgctatcccatccacttgaacacccccatcaacaggcacttgccggtcctcacagagctccctgtgtttgagatgcatagttaaaaaaaaaaagggggagaacattcgatccatagtacagaaaaaaaggcggtaccaaaaatagcacaaaatctctcctctttcaattagaagcaaatggcactaatttttgttcgatttgtagcacttctatcacatatgtcattcattaggctattccatattttccatgcttcttttcctcttgtcgatctcgccaatgcgtcggtggacggccacagtgcggcacggctgtcggagctacggctgatgcggcggcgtggggaggttgcgcgcggcgcagctaccatgactaaggccggcactacaaccagcatgtgtagcgcaacaacggcgagacgcacaacacaacaatggtgaggcgtgcggcagccaacatggcttctgggcgcaacattcgatatggctgctcgtcgagataggtgcgttatttcctggcagtttgtggcgtgtagcctcattgactacgggctgcaggaat

SEQ ID NO: 104523 - DNA, 1809 bp, Oryza sativa
ccatgcgtgacaatcatcatgaagcacattaacctaaatcgacaacatatgttgtatcatattgtcggattcggcttcatcggctaaccttgtccgactcgaactctgccgatcttagtcgtagccgattcggacttcagccgatctttactctgtttccgggataatctctatctcgattcctcctttacatctgattcttggattaccaaatttggtcgttaacaataatataagggattttaattttttgcttgtattgtttgaccactcgtcttattaaaaaaaattgtgcaaatataaaaaatgaaaagttatgcttaaagtactttggataataaagtaagtcgcaaataaaataaataataattctaaattatttttagtaagacgaatggtcaaacagtgcaagcaaaaagtcgaaattccttatacttactcgtaaagtaagtcgttttggacagcgacacggtctccaaatacaactttgacttcttgtttctataaaaatatttattgaaaagtgatatatgtatacttttatgaaagtatttttttcaagacaaatctattcatataatttttatatttttaaactcaatgacttgagagttattcatgatttatattacgagtacgaagggagtattatgggacggagggagtaagtcatatttgtaatcactatgtgctatattaaatttttaatcggaactcaaaaagtcattttagtacttattgtttacatgttcattagttttgtcacatgataaataaattaactgcatattggttttggtgtaaaaagaaataggaatttgacttttgcaaggagggagtatattgtaacagtgtcggtctctcctgcgccgttagatttgcatagtgcggtagagacgaaggaaggtaaagtgctaaactggaaaaaatagagtgtcggcccgcccaagtttagcccaagagtaattggttttgtcgacagatcgcttgacccatgatggatttggatacaaattttgctgcaagaccaagacacataaaaatatttcccagttggtcagtgttttaccatggactagtctatcttaaagcgtgcatcgcatctgcgacctagcaagctaattagatagataagttttgcccacatggacaatttccaaatctgaagtttgttttagtcacctccaactagcttaactccattgtgtgactagccgtgttcgatgatcaatgctcaaaactaacgctgtttagttttgcataattggagcagcaatacaaattaatcttcacacttgagcaattaagattgtggcctctctcttggttcttcgcccgcatcatccttagatccatgactgatttgatgacattttcctgcattgaaaaagaaagtttttgaatatacaagtagacagtgatatgagcagatcgataaacacagatcaatagttcccatgggagagcactagttttgtatgatagtgcaatggtatcatggatattgattaattcctatcattctatggttaaacctacataactttgcttctgctactgaatttttaaactgccatgctacaactatgggtggagattaagattcagacagatataacccggggccaaaacaaccacttgtgcttaaaatagacagtgcatgaccatgatatccagaaatagcatccgttttagtgttacggtggtgatccagtgcaaataaattgggtagtaattgttgcaaaaacagacagttttgcacctgtttgatatattactataagatgtatttaagggtaatagtttctg

SEQ ID NO: 104524 - DNA, 1176 bp, Oryza sativa
gtggcgccggcacaccgaggccgtcgccgccgtccgcgacatggtgatgtacatggagcggacgttcattgtgacgtaccggaaggtgtcggtccaggagctcggcgtgaagctctggcgcgacggcgtggtctgctccggcgacgtcatgccgaggctggtcgaggcggtgcggcgcgagcgggcggccgccgccgagcctggcgagctgatggccggtgtggccgagatgctgacgaagcttcgcgacaaagtgttaagccaggtcatggacgcgtcgtctgtcgacgactatagtagcgccagtttggagaagtctgtatcagagtatcagtagaggacactttaacctttagtttcatcacgtcagattaatttctttttttgttaggtacgatatattctgtgttggttaagtacttcagttgaatctctttttggttataggaacatcggtttaatctttttggttaagtatatacacttcagtttaagctctactttcaactactaccaccatagaagagtttcggtagttgtaaacatatatgctctgtttgttgattcagagttgtttgttgtggttctgaaagtccgaacgcaccacaaaattggcattattgtgatgcataattctcgttcgatcactccaaatttttttcccattccattgcatagcacaaagtggcgctaagattgaactataatacagtactatacacaacttctcgcaccccgctatatttaatgaaatagcacagtcttgtgctgattccattaaaaaaaaattctcccacactctcatctagtaaaaagttattatatcggctgggcaagcataatcaacaagttaaaaaagtggacgcttcaggactgaaaaaaaaagcatccatgattccaccatgtgggatgtttttttttttggttgtctatatatcttgtgacagaaaatcccacctcctatcattcgaattttggaccactggatacgctttaagattcgtgcagaccccctaaccctaactcctctcatcccccgtttagaacgccgccaccactcctatcctcgcgccgtcgcgcgattccaccgccaccaccactgccccaccgcgccgccgcctgcctcgccgactggccggaaagagtcaacggcgccggcaagccccctccccctct

SEQ ID NO: 104525 - DNA, 655 bp, Oryza sativa
tttcgctagtgtcaccctaccgtcaacctttgtctcatcgtcgacctcccaccccgtgattccggcgcctcctcattgcccacagttcattcgattgctatccatggttgtccacttgtcctgaataatagttcgctcaataacctgtttcaaattgagcggttggcaccgctccactcaagaaggactgggccaatgtccctccctcaagggagctatggccaatcgttatcttgccggcaaggaacatcaaggcatccgctagctaggttttggcgttgatggacatgggattgacagagtattcgttcccgcttggagtaagggtggaggagtagtagacgagttcttagataggaggcgatcaactgtcacgccccgaactagtaccgaccggaactagcctgtgacgctccaaattaacctgttaatcgataccagtcccaggaaacaatgctggtatcacaggaagacggattatcacagcaacagaagtctctttattatagagtagaggtagagtcatgttgggctgcggacagatcccgagctcacaactgcattacaaaagggaaacggaagccaggacttggaccaaacaacacaggcgcgacttgtgaactaggccgaaaccttaaaactcatcgtaaccggc

SEQ ID NO: 104526 - DNA, 683 bp, Oryza sativa
cataccaccaagccacaacaaataataatcgactacaagtatagtgtcagtataagcaatagaatttctacacttctaaaagaactcttaatatatcacgtaatagatctcataaattagaaaaaaaaaatctaagaaaaaatataaaaaagaaaatatctggtcattaatttacgcttcaactggtagatccattattttcaaccattagattggatatattccagctaaaaaccaactaatctctccctacgtacgtacgtacgcacacacacaagagatgtcaaaaaggacaaaaaaagaagaatgtatatatgatctactccgtctgtttttttttctttctttgcagcactaaagttttcctcaaattatgcatatatatagggaaactctttacgatgttatcgaaaaagtcatgccaccgtggcatcacttcatgccatcccaccaaacttttttaaagtattttttaactaatgatctaaaacgaaatcgtagacactcatataaatatgtgcacaaccatcctacgaatatacgcagtactattcacaaaaaaaatacatacgtacaataaaaaatgttgcatggaaacctattatatccttatataattatgtcattctcatccaaatagtgttcacaaaattagcacaaataattttgacaatatgaattat

SEQ ID NO: 104527 - DNA, 540 bp, Oryza sativa
atcggggatcctgctaggcgtacgcgcatgacgcagatgcagtaacgcgagagtgctggtaggctcgtgggctcttggcgtacctcttggcgtgccatggcctgatggccgtgctatacttttgcaccatgcagagctgtgctatacgtttgcacggagcggaaagattggtccctgggtgggggggctctgcggggtaagtgtttaatttgggtacctgtgtctagcttccgggcaggcagcaatacaaccagctgattaatctcatctctgcttttgagttggtcctgtgtactcccgtgctagttactgttgcgtttatgacactgtgacactgtcgtcgtgcacgtacaggacgggacgaaccgaaactgccgcttgaaacaaaccaaagacggtcacatacagcgctaccgtactagtttccttctatttgtctcctgaattccaaagtttttttttttcatatgacacacacaaaaataaaaacgatcacgagtactcttccactattcctcgcctaaaattaattaggtaact

SEQ ID NO: 104528 - DNA, 1556 bp, Oryza sativa
catcagcagttcagtagtacaatgagtcaatgacaacttttagactaataaaaaacattgcaaaggtaacctgcagctgattagtgcagagaatatcccctgcaaaaaaaaagattagtgcagagaatataccaccagcattagttgacatactgatgtgcagcaaacactgccaatcagcaatgtatagtgtaggctagtattattgaggaatttgcattgcaatccttcgaagttatcagtgttagccataaggtacagccaggttgagatattgagatgtaccaaagatgaacactataactcccagtaatcgaagtaaaactcatctcgaaacaggggaaaccgaaaaacagtagatttgttggttgactgatcaaataaagtaacactcaataaagttagaaccagagaaattgctggtatctaccatgagcaacaatttgtcagttaaatgttcatccagcttccagaataatatcaactaaaactaatccatcctaagtaatacgaggatttaactaccacaatcatttgcctaagtaataagtcaggcaactctgaatcgtcacatggtatatgctaactgaaatgtaatgctactgattctgaacacacaggtaaaacaccccagaccagcgcaataatcataggaaacataataatccgctaatggcaaacgaaaagtaagcaaagcaagaggaaaccttgcggaaaatcaaaacagaacacaaacgatctccccacaagcaaccaaaaattggggcataaatcgaattagaaaacagagagatcgaggaaacatcacccccttccttgaattcttctcggttttcccccgacttccccttcctgctccgctgcaaccacacgggggctaggtttgaaggccacccacccgcaccagcgcacagtgggagcgcgccagtccaagccgtagcggtggaatttagtgcgtagggcaagactccgatctcctacctaacaacaacccgctatactttcccctttatctctttctgagtttcttcccttcccttcacagtggcttggcttggcttctctctccggttgctccaaggtcgtcttcctcctctcgactcaaccaatcagtccttgggagtggtggtgggactggtggttcgttcacatgcgccatggctcggattccagagcttgggccagatgtcggtaagccagtgggtggggtggatacagaagagcacgtgccaaaccttccaaactcctagtgggctctagttaaataggcctttctgttgggccccggtttgtgacggctttgggcctggttcggtgctggtcaaacgggctacttgcgccatatttctgctatttttcgacttgggcgtggccatgaacgatcgacgatcttctctcccatgttcagagctaatcactggcggcggccgacgatacgatgacgtgaggtgtacgcatgtcaggacgtacgtacgttccccgtgattcacgatgagaggattagacgaaggacgaccggataacgccgcccgaattcgatcgagggctgcaggaat

SEQ ID NO: 104529 - DNA, 1108 bp, Oryza sativa
ttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcggtttggtagagctcatcacccagctcctgaatccttactgaatatggaatttgttggctacaatagtaaaagtagtttaattaatcctatatatatttttatataaatgtgattaagatggctcacccaaacaacattattctacccctagctctatcttaaacaattccggatccctttgacacaggcccatgcatatatagcttcatgcttactaaacgggaaaataaaaaggaaaattggtattaccatgatcccgaaaaagttaagcttgtatccttctggaagggttgggggcggtggattaggacgtaattaaataagtgttagctaaaaagcttgaaaaaaatcaatatgatttttaaaatatttttttttataaaaaagtaccatttagcaatttgaaaagtgtacgcactagaaacaatagaaacaattgagtagaagttaggaaaggggaaaaacacaccctacgactgggttcgtttgtatggttggagagagctaatcttttgtttattgtgagcacattttctaaactattaaacaatacgttttttaaaaaattcaatatcaaaattgttttaaaaataaataaataaaattttaaatttataatatttaatacttaattaatcatatgggaatcatcggcaatgttttctatgatggtgaatagctaagccaaacagctacatacctcctccgttcaaaaaagaatccaatcttaactatgaacctggacatatgcgtgtgtttatagctaggatttatttttttcaggacggagcagtagaacgtagcctaaaaaagaatgcatacatgatccat

SEQ ID NO: 104530 - DNA, 696 bp, Oryza sativa
tctagaataaaacataaaataaattctaaattgggatttgagtacaattagaaaagaattgaagaatgccactaaaatttctatcaaattataataaaccaacaagaaaagactacataccaagaagggtatatagcaaaatacattatgaaaaaaggcaccacgttcgctgtgggggctagaacttcccacattaattggagaaaaagaaaaggagagtccaactagaaatacaatttaaaaacaattgaaattcgaaattaaaaataagcaatattgaaaaaagagtccttataagaacccaatacgagattaattaatattcaaaataaaaataaaataaaattcaaaattagcaaaaataaaaggaaaagaagagttccggtagaaatacaatttaaaaataacttcggaattcccacattaattggagaaaaagaaaaggagagtccaactagaaatacaatttagaaataagtgaaatttagaattaaaaataagcaatagtgaaagaagagtcctcataagaacccaatacgagattaattaatattcataataaaaaataacatatgaaattagtaaaaaggaaaagaagagttcgagtagaaatacaatttaaaaataactaaaattcaaaattcccacattaatcggagaaaaagaaaaggagagtccaactagaaatacaattta

SEQ ID NO: 104531 - DNA, 2098 bp, Oryza sativa
atttgacttccgtattatccgtaggttgtcctgcgaccttctttggaaatacatgcagcaaccttcttatgctttgtcgaaattgttgaagaaaggcactcttgcttgcattagttttgcttgctgtttactgtgatctgcttttcatctcactataaacaactaacaatgtcggaaaatattgtatcatgtcattattactgcgatatctttggtgagaaatcctaaattcacatggcttgagaattcactgttagtgaattgtgttataccagttttgcattggacccactttctgtttaatgtgatctacttttcatatcactgtaaacaactaacattgtaggaaaatattgtatcgtgtcattattactgcaatatcttggtaagaaatcctaaattcacgtgacgtgagcattcactgttagtgaattgttttataccagttttgttcactgttagcatattgttagcatttgctgttaggacatgaatggcaagcgtagagcaattctggaaataccagttctgttcccctgctatattggtgtttacaagttccacgcattccctgtttccttggtacttagcctaaaatgattgttcttgatataaatactctgtaatcccctaatttgtgctgcgtctggcattctatatgaattttgacccctttttttcccttgtgggatagcttttatgtagaaaaggaagtctaacgtgtttctccgatgtgaataacagaacagacctgccaactcttgtgaatcaccaggtttgactccttttaatctttgataatgttgaaaatgaatgtatatgaatataaatgtgatcaaagcccttaaatatcatactgttctatcgagctatcttttcttctctatatactatcatactagtgtttcacatgcaattgacattactggattgtggcagaacctgaatcagcctagtgctgttcaattttttgacaggatagcatctttttactaaacaacaactgatctatgtcaattatactggatactgattttaagaacctgtcggatattgcagaaactagaaaattgccatgcaaaacgaagttatatttctttctagttgtactatttcctacatcagatggccatgagctgaattcccttatctgtgtctgtggtgcagaaattttccatggaatttgctcctgaccattattgtctaccgggtttgcggggaattatttcttcaaattttctgatccttgttagcaagtattcagaatttagggcagtgcatggagatggggaatgtttctacaggagcttcataatttcctatctggtagctgacatgttggcctcctccctgtttctaagcatagaatgtatgcttggtgatttattccgctttgtttggcaggagcaagtccttgacagggaggacacagatgaggaacaacgcctccttgctgcccttgaaattgaagttaaaccaatggctatgcaaattgattatcctgaatgggcaactgcattttcctggggccacgaagtaatcagtcaccttctatgtatttatttgtttatctttcttatagaaacaagcttgtaagagatgattctctacaataaatgccttccttcttactactctcttatcaattatttgcttcctaaggtttttgttatatctaatgtttacctatcagagattctcatatgagttatcctattatatttattcatgtcttaatatcaacgatatgcattttgcaagcttcattgtaatatacctgctaaactcttgaattcctcttagagtgcaaaatgccatccgtttgtaaggtataccatgcgtgatttactgcatcatcgattctcaggtatttaagaagctgatagagaacataattggatggaagaatccagcatcaacatacaggtatttatatgtttggttcctatagtttcaacaaattgttgtttatccatcccactgaccacatatgggcgctttttttcagccgtaagcaggaacttctggggttcttcagcagtaaaaggatgtcgaatggcagtaagaacaacatccttcagtttatcttccttctatt

SEQ ID NO: 104532 - DNA, 715 bp, Oryza sativa
gtgtttcataaaattatcaaaaataattgctactaccctccatcaatgcttgcatgcatgcattttatcggtctttaaaatgatttttcttctaaactacttatccaatctatgattcgattacaccgttgtattcgttgtaattaaatctttataataaaatatcacacgattaaattttgatgaaagaaaaatatatgtttcaatctattaactcttattgtttcataagtgatagcaatatgtttcaacgtgtatcttcactgtgtttcataaattttttaaatgttttagttgctgtttttttgtttcaccatatataaattaatgtttcacttgttggtcagctgcaacattttgaccgaccgatgttttttttgatatatcggacgttcgattggtagtattctccccaaagttccaaacacaccctagttgtttttttgtttcaaccgggctggggttgggaggagatggaacagatggagaccgagccaccaaaaagcccaaacctgtaacaacaccccactgacccagcagcgtaataggcctcttgcctccttgcgttgcgacccagccccctgtcccctggcctcccctcctccagcacccgttccgtctccttcgcccgccgcctacgccgtcgcgccgatctccatcaccgcgagtagcggcgccggcgtcgtgctgcttcgggcttccgccgcatattctc

SEQ ID NO: 104533 - DNA, 657 bp, Oryza sativa
tacaatgataaggatactctcatttctccctcgttttttctaaccacatttctcaaactattaaacaatatatttctttctaaaacattttataaaaaaaacttctttaaaattttatattaattaaattttaaaattatttaagttaatacttaactaatcatgcgctaaagaatcactctatttcacgtgcgcgggagagaagtccccccccccccccccaaaaaaaaaaagttagctagcagaacaaagttcatatcacccataacaagtgttttactctctctgtttcacgaaataaatctaggattgggtgtgagatatattaatactatgaatctggataggctcttgtatagattcattatacgaaaggttacatccaaatttattgtactataatatgttacatctaattaaagattttttttacagagcgagtagttcatagaacaagtgtttgttagggcagtcccaaccctccacttagtatggtgtctatggcattaactacattgctatgtagtacttttaatttatgtggcactgtattaattaagagagagagtaaagagaggaagaaactgggtctcatgcaagacacagcttcaacacgagaacctatgcactagacactatcaagctttgcattggggg

SEQ ID NO: 104534 - DNA, 665 bp, Oryza sativa
agggatatgaatgccacagtagaatcccatgatgccttcgtcttaggataccgaccgatgcaacagtggatgcactagggtggcgatcacggccttgatgatgagcgagaggagtcggccaagctcgcgatgatcatggcggagcagcagcgagctaacagcgggaagcaccagaaggatgggtgtaaaaaaaaaaaccagtggtcgttgctatagctctggcccgtgtgcgtgcagtgggcgcagcgcggcatgcagctccaaattcctcccttttgtcccccgatgcaccgccactgatgatgcctcccagccccacccccataaattccatccacgccgcccggcgccccgccgctgttgccatcggatccccgcggaaatccagtatgcagcggacacccgatgcttgcgaaccgatcgaggctgcgtgcctcgattgaaaatctgcattgaattgctccggatccgtctcaccaactcatcatcaactccacgcggccgggtgcctggccaccgctgcatctctgtgcctgtccaaccccgtctggacttctgatgatgacgatgatgcgagcgcgagaccagtgtttgacacgtacaaacgcccttgctgcatcggtctatcacagtggaggcactaacgtacacggggctgcaggaat

SEQ ID NO: 104535 - DNA, 665 bp, Oryza sativa
tgaatatattattacattttaagacgaataaagtatataactaagcttgtattaggggtaccataatggtaacagtacagtaatcacaattcaagcatatttttttaaaaaataatttttaattattttttttaaaaaaggctatttttgagttgccacgcgcattaaccaaaattattgtcgatgtaagagcaagaataatagtgatagccccatcgtttggcctaaacaaccaaagaataagccaaaatttgaatttttgaagttgattttaaaatgcttttaacgtaatttttgttaatgttggcttttaagtcgctacgaacaaatctacaaaagttttacttataaattaattttaattttctaataagccaaataagccaatttggaccaaatgggcaactgatgagagcctaagtatgtatgaaggagagagaaatatattaaatgcttcaagataaataatgctctctacccttcatgataaatacatgaaatacataagtatgagaaagatataggagaaaaaaaaaaccaagtttatagctactaatattggtgtactaactttcacatgaactaatacaatgagctctatccaacagcaaacaacggacttcaacaaaggcggcaataaaccaatcggtgaagcagtgaccctg

SEQ ID NO: 104536 - DNA, 656 bp, Oryza sativa
ttgacttggacattttttttaaaaaaagggggagaaataaataattggctggtttgataaacatccatgttattttactttgtcacaaataataatccaagcagaaagaacctccgagataaataagtgatgaattcgctcatatcacatctcatttggggcaaaattttcgatttgagatgtgttactagtaggggcggatctacagtacaagcgtcggtgtcaggcgacaccgacgactttcggcaaaacctataacaaaactgcttttccatatgctataacactatgttttaagtataattagtatactatgacaccgataaacacgttatgacactaaataaccgattttctagatccatcactggttactagtacagtgtagtactgtatttagcaacagaaagtggcacacaaacactgacacgcatggttgagataaacagtggcaggagcccaggaaaggtaacctggctcagagaaacaggagaataaatgattgaaccaagaaaaccacaaaaaccatggacttgcagtgaaacccatagccccagcagacagtagttgatggaattaaagacaaaggcagaagtcacaggcaggccccatgcacattgagcaaaaggaagcccaagcaagtgccggaaaagata

SEQ ID NO: 104537 - DNA, 695 bp, Oryza sativa
gtactctctctataaaaaaaacgttaacctaaaataaaatgagatatagtctagtgcaataataaatttagataaaaatgatgatattagattatgtcttattttagattggatttttttatgaacggagtacgccgctagccgcgaaccctgttcaccgcccgacgagcgacgattaccggtttccaacggacagccggccctcgctgtcttagtgtcgtcaaccctcaggcaacccactccgtcctccgtgttttggcgcctgcctgtgccgcactgcagcctacagcggcgcatgcagcgtgcgtctcgcactagaggagaggcttgctgtcgtctgatcggtttgatccgctgacgaggccggtcaagcccgtaccatccagcggtaagacggaccatcaagacgggcgggaggccgtcaatgccaccaccaaaccgaaccacaccccctgtgcaccgcaaccgcaaaccccctgctcctctgcatcgccaggcgccaccccattccgctcccttccaaaaggaaacggacagaccagtaaaaccacccgagtgtgtgcagcgtgagaggctacactagagctatagtgtgtgcgagaagggggagaaaaaagaacatggcctcgtgttgcctcctcgcctgtcccctccattccccgtcacattccccacactcgcgggggctgcaggaa

SEQ ID NO: 104538 - DNA, 647 bp, Oryza sativa
tggtaagaagcagggtggcaaggaacggacaccacggatctgcaagatttgcaaacaaatggtgtttcaagatttgcacaggatatgctgcctttgtttgcaaatcatgaaactcgtcctagtgccatatatatccaaacgggttttactcgttctatatgctgatgtgacatgtcatggagatgcctacgtatcggtgagatcccaatttcagtgacatattgatagttttttttagaaaattcttttatccccctctttttaattttttaaaaaacaacttcccccatcacttttctttaattttattttttctatatggctaacatgtagtcactaccatggtatgtcacgtcagcacacggattgagtcagaactcgtttggacctatgagaccccaggataagtttggggggctgaaaaatatattttgtgattctaaaatgataaatatggttgtatgcaaaataactctggacaaaattgcacttctttttttttcataacacttggtttatggggaatttcggaagtacaaattgtgtttgtgccttcaagtaaagtattatctatttgatcacagtggattgatggttgcgcatcctatatacttatatagttcatccccactaagtgcacttaatgc

SEQ ID NO: 104539 - DNA, 660 bp, Oryza sativa
ttcctctttaaatccaggtagggagagaagccacctcgaattcaaattatccccaaattttttcctcattctttacgcttcttacatttgctcttgaatccttagagttgtcgatgaggaagtgaagccgatctcgccgccgccgaggaaggaagaggaggaggaggagccgatctcgccgccgcaaccactgaagcgggagatctggcaggagaaggcgagtgcgttctcgtcggtgggctcctcctcctcggggaagagcggcggcgccgagagcagaggtcggcgtcgcggaggccacaggagacggcgatggcagcgtccggctggagatcgaggagatcgcggcgggggatcgccgtcacgagaccaggaagcggaagaaccacctcggtgcgcgcgcgcccctcgcctctcgaattccatctccccctttcaccactgctcatcctcgacgcgatgtccatgccccctgcaggtggtggtggtgctcggcgacgacaacggcgccaacgcccctcccttgctcctgcgtcgtcgccgccttgttcccccgccgccgccttgctctccttcccacctgttggctggcgacgctggcctgcccagaaccccagagagaagagtgagagagatagagagagagaggagaaagggaga

SEQ ID NO: 104540 - DNA, 688 bp, Oryza sativa
agaaaatatggcactcataaaggtaagttggatgacttttgagttttttcggatgagtgacttatgtattgtgctttatgtccactaccatgaaacagcaaacttttctgcttaactccctatgaaactgttggtagaacaatagctcagaattcactcagaagaatgctcaagggaactgggggcaggctccttgatagcgcatagacaattggaacctagaaaatgtcaacctgaatagaattttgcgcatatgaatataattatctaattatggaggatgtttctttctggagaatcaatcaatgcctacatgtatttttgtaatggttgatctgcctttatcatgactaaggaccaattagatcttagggatgggcatggattactccttgagtacacaccaagtgacccgcgttcatccttactagaattgtaaatatgcttgaggaactttcatggccattccagattggtgttgtctaagcattgtgtttgcactagtttgatagtttgaggacagtattttgatatcttgatgctgttaaattacatatatataatgcgttgacgatgctttgatcttcagatagcatgtgagaaaatattttcatttggctgttcccttccccagaatctattggaagaggacaaggacctagcaaagcagcaacagggctgcaggaat

SEQ ID NO: 104541 - DNA, 710 bp, Oryza sativa
atgagtccagtggtcgaggtaatcttgctagcttcatttcagagtcgaattgaaacttcgaaatagagcacttatcctctttccgtgaacaaggaatggaggatatcgacgccgttatatatggcagatcgttcagtgcctgtgagaggggaagttaacttgccatgaacacaccatcaaaaattcagtcattggatcaggaatagactgtaaattgcctttgctgctctagtgctatgacgagagggaggggaagtgagtcagtcatagagagtaagaattaagaatgatctaaatttagcgtgcgagtgacaaaagcgtaaggcacacgatcaggattcaggaacgatggatggttcagatagctatgttacaccgatgtcaaattaatctcgagttgcttagttagttactaaccatattgtgtgtacactaccaaagtatgttgacagttcacgtacggtcttcgttattaaccaccactagtcagtgtagggataactacattatatcacttatcaaagcataggtagtccgggccgtgggtacgtcagagggttttacacagggaagtggtacgtgttaattccttgaatcctcacagctagtagtatcgatcgaaatggatcatggatgatcatgaatgctagctttcacgtaccatctcatcaccgtgccgctccaaggaaactatggagggctgcaggaat

SEQ ID NO: 104542 - DNA, 667 bp, Oryza sativa
ttataattattaatcagttgtatagctttagcttaattttcagtggtgacaatttatagtttgacaagcaataccaaccataacatccagcatgatgcaaaagttttaaaaagttcaaaattttagtgatttttattgtcggggattttcaggatgttacacgggccaagtgccctagactcatccaacttacttctattataagaaaggaattagagataaggcaatggatcttatctcatgtaaataggaggcatgtaccggattataagagatatcacgcatgtcttagctggctccctgatgactatataagggggtcggctaaccctaattcgggtgatcgctacaagctactctcaacgtcgtattgcgaaattctgcacagatccaatctcatacgactgaactagggtattacctctcttcgagtgcctgaactagcataatcactgtgtcaccatctttcctacgtctagtgcacccgataaatattattgccgatctagaaaatcgacatatctcttgttacatgttgtaatggtcttttaggcttctttggcaaatgggatcgggaaatgatatcccatccatcgaagggtaatatcgtatcctagccatctattcttctcatctatatcttcacatctcatttagtcctagccat

SEQ ID NO: 104543 - DNA, 628 bp, Oryza sativa
agaaagcatatacttttgtgaggtcgagagaagcaggctcgccacaaaagtcctggccacaacaaactccctcctaaatcaattggctcctaaatcaattggtaaaaaagaatcaaaatcaactatactacttaaatgcgccatgtttgcaggcgcaagcgggaacgggccaaatcagctcctcccttttgattcggagaatttcttggtagagatcgaccaactggtcatataaatcaatcacggtcacttaacacacaccgttccttttcagcttgcaaatctgaagtatggttgcccacctaaaaattcagtcagtattttgagacctagccttccacgatcgatctgcacgagtgtctgtttgtctctctactaaaatccacagtggaattaatatttctacacctcgcttgtctggttgagctaggtagctagctagtccaatatgattccaaaatgaagttgtactggttggctaccattgaatatttgactagatttatacagtagagtagtgtactactgatcaaattgggggctcccttggatgtcgatagcaacattagaactttagcccgcgtggcatcatatcaacaaagttggtacaccgtgccgtgcctactta

SEQ ID NO: 104544 - DNA, 1537 bp, Oryza sativa
ttggctcggcttctgaaagatgattttctgatctttgggcagtaactgaggtggtatcactcttgtatgagtttctcctatcacctaaaacacattatatacatcaaatatgcatcagaaaggaatctcctggaaaaaaaattagaatagccaaaattgatttgcaaaaataacgcaatgttattgcaaaaattaatgaaaaaaaacgtgggaataatacacactcacaacaataagttactgggattatttgtacttccaatgttagaggctactttatacgaagagagaagaaaagagaaatagggcatctttcaacacatgatggccatggattaaaaagtgccacaatagtaagtataaaagaagtattatgtcatgacaatggtgcaaagacaaataagttgcctgcagtcttcatcatttgtacattacattctaaaaataagagctatcttctaaaagttttttgtttggtagaatataagtttgtaggacagtattacataactacctgcttcaatgtccaatttgtcgaatatgaggcagcagagtcatctgaaacaccaccaagcaatgataaaataattataggcttcatttcctccatgaccttatcaaccttcttcgttgaactggaccaacacaacaaatcccatgaattaatctaaccactcatcaattattagcatgtacatcatctatatatctgcatcatgtcatttctggtagaaacatttgcaatcttgataaaaagtatatcattccaatggatatcctgttggcagaatgttttcatataagctttctattcatagccttgtagtgatccctagcatgattttttttttggccatctatgtcattctatcaagctaggtaaagtggcatcactatattgtacaatatataatgtaccagtagaaccaataattaacatggaattttttgacaactgaattcatatgaaataatctgaagtaaagaaaaattcccttaatagaagtgaggcataattacatatgatcattagaatataattaagcttttgttaaccgaaccatggtaaagaagatgaatggtgtcctgcaagatgaatctccccgctgaaactgtaagtacctctctttcagaatagaggtagtaacaacatgaagcagttaaagtgtttcctaaaattaaacaatgatgtacacgaaaaatatggaaataaataagaaatgatgcacctgcatattgtttgtgttcttcaaacttgaatccataaaaccgggcatgaaccatgcatctgatcctgccataagccaaaagaagcaaacattaatttaaggaatatgataccccttttaatcttagttaatcctaaacagcgaacaacctagtcgagagagaatgaaccaaccccgcatactacaaaatcataagagcattatattaacttatgacagaattattccttaccttactgcatgaaagaatattcttccccatactaaatggaagcaattaaaataaaaaaggaatcattgggttgtag

SEQ ID NO: 104545 - DNA, 2478 bp, Oryza sativa
cataactgcatcccaggtctttgtaaatatgcagaggaagtgaagagttgcctagagaacttcaaacggatgctagcactaacaaaagtacatcaaatccatcttggctgtgatctgaagcctttgtgctgcagagattgagcacggccaagcccaagcgccattcttcatttggatcatcctggagtgaagtccagggttgaaaaatagccttcacctcatttgactttagttgattccagcaacattagccgataatgtttttgtggctctgccatgatatacaagttctgaaatcccgctgtcgtttccatggtaatatgtaaatgattttttgatggactaacctggtcatttgactggatttttttagttcggaggcttaaagactcccttagcatcatgctagccatctcaaaatatagctaagctaaaaagacatacttcaagaaagtagccaaatctcctctagctggccaaatttagtcgtcctccctcgctagccagtagccactctttccaacagaaagaggggagaggttgagtggttgacatgcaggtcccacttagggcatccatgtggatttcatctggattatttgcaaactgagggagcgaggttatgatgctcatgttttcaagctatgggtcccaacttaattcccataaactcgtatatctcaaacattgtgaaaggtatcaccagtgaaactttaccgaaacaagtatgcctcaccttaataccttatgatcccattggactatataaatcggtaatgccctaagggcatgcgcaatgcttattgccgaacgtgaatacgatagacaccataattctcttaaaaatttaagtagatctattttttttaaaaaaagttttaatttcgtagtaatatgtaattaatcatgcgctacttatcaccacgtttttccgagccatacagtctctagccaaactgcgcagtcgagtcagtcgagctagccctatacttaccgtgagcacggatgcccatgctcgagagaacattttctgcccattacccacgacgcagacacgcagtgacgctcgggtgcgactgctgtggctagccagccaaggttgtcaggacactagatagtttcgctcaaagcaatatatcgtatagtaggatcgtatcgtaatatcgagatactatgagatttttatttttaagtttaattaatatttatattaattatatatagccattctatataaaataaatatagtaatgatatatgtcatgcaaatagagatatttattaagggaaaccacattggttttgatatattttactgatttttatataaatttgagcgtatttatttacattattttcaaaacacgttatttaaaataatattttatagtatcgtagggattgtagaatcgggataccacctaagatttcgtaggataatgtagtaatgaatagtaatatcgagatactatgaaaattagtatactatgtgggatcggtattgtttcgactcgtagaatcgtagtatcgtaagatactatgatataaattgggatactaacgaccttgcggctagcgacaacgattgcagcatatccaacctattctacgtccaaattcgttgtactagaatttgattggttttttttgacatgacacaccccagtgcaataaatctgaacatagatttattataggatatattacattctattactagattagctccgtaatacaataaatctgggcatactctatactagaatatgtcacattctactggattgactattttttttttgggacatatcacatcctaatactaaattgactttttttttttggaacagggagcatgtcaaacaggtggagatctaaccgacggcgctaggcagcggctagcggcaattccgacttacgttagacaaggagtggtacctggtacatgaaaaaaaaaatcacatcttccatgacaaattttaaaaggcgcgtgaattgggtgacaatttctgaaagactgatggcaaatactgaaatccctctgcccaatttgcttcagccatctcttgctcctacaaagcaaaatgagctcagcaggaattttctcatcctgtgaaccgagatttctcccaattagagtgaatctcatgcttctccgcccagcgcctgcaaatgaactacacactaaccatgcatcgcccaaacaaggccaacggccacaatttgcacgtcccggcagggagggcgtcttacagtgtaattttagacaatagacaaagtcataaactgaaccaaacatacatttaacagatactcaggggttcaaaatagatctaaaatatggtgactagagggtagcatccaaatccagccaatccgtatttccacttccacagcaaccagttgaaatttcggttgcaatttacctgccgatctagagcgctgagcctaactatatgaaagtccacatctttacag

SEQ ID NO: 104546 - DNA, 687 bp, Oryza sativa
atttaaatttcagactcggcaacatattgaaagacctaaagtgaaattattctttcaataattagccattgatgcttgctcccccgggccgcgtgcagcccacaggtacacgtatagcccatttatgtatctacattcgcccgtttaaaaccgaggccattgccttttagccaaataaataatatgatggacaaaaaaatatagaaaaactttagacataaacactttatatgtaaaaaatacatttcatatagaaaaaatattgtacaaactttctgtgcacaatttttctacttacatataaaagttttgtatacgtgcaaaaatattctgtatattatttgaatttgtgtacaaactttacactggtggagaagtgctttttactaccggtttataaccctttgtagtcccggttttagtcctgggtgaaataaccggtagtaaaaatccatttttagtcccggttggtgttatcaaccgggactaaagatagagctaagctagctagatccggttactccattattctattctcttcttcattgtttttaatatattgatttcactccatccccatcccaaaatcccaaatcaatcatccccaaatccttgaatcctcaaatcgatcatatccaaatacatcacaaaatcttaaaaaaaaattacatcacaacttcgacaaaa

SEQ ID NO: 104547 - DNA, 721 bp, Oryza sativa
tgaggagcttgatcgcagtgacgtagtcagcaacctcgagtgtcatctgctatattctcatcgcccaacttaagatccaaggagaaggattgctctaaataatgtacttacaatattatctaaaagaatatatctagttattagggccgtatgcattgcttgatgcatatgctggagaattttttactctactatcttaaaaggtatgtatggatacttttgattagtttaggttggttatatgcatttagtgaggaatttactttttgtgatatgatggcttttgttttgtgacaaaccaattatcttttctcttgatcatctggcaaaccatgaaatcgtttgtcttgaacccaatctttatttttgaccaatggtcctttcctgagatctgctgggaaagtataagctttttctgcctttcacagaagctatttctccctgcgcattttactctctttatgatagctcgatttttttttcatcttacaaataaaatgatgtaatgtgcattccagggtcgaacagtactctctttatgatagctcgatttttttttctcttacaaataaaatgatgtaatgtgcattccagggtcgaacagggttgaaatgttgttgaggaaaatgacaaagcaaaatagcacgtgaaggcgtgaagcgataaatcagggagatggcagccccactgcacgtttttctagtggaggggctgcaggaat

SEQ ID NO: 104548 - DNA, 671 bp, Oryza sativa
atgtccttggctcatccgctccaggctcaaattatcccgacttgggaacacaaacaccgcaaataccaacaagggcaacaataataacggagatgacattttggtatgtgtatccaaactacaccaccgcctaaagcacaagccactgatgaacacagcccagcatatcctacgcaccaatatcaccagacaaacagacacatagtcggcgacgtacaacaattagtagtactacgttacacggtgacactgccacgctctagctagtgctggtcatccaccagctgcctgaaatttatcggcgcagcgaagcggaccgagccgttgtatatggccgcggcggcgatcttggacgtggcgtgcgtcgggtgcagcaggtcccagaagaggtagtcgtgccggttgtcgcacagcgtggcgttcggcgtgcacccggactcgccgttgaacttgccggagccgcagcaagccgtcgtgacctccttgaatcctgcacaccaatgccgtgtcacgaaactctgaaccttgcgttggtcagaaatccgaaactgaagcgtagaatgttcagataccgagtcgttggggatgcttcatgatgctttgcaccacggcatgggagctcccgatggagtacttgaagccgctgaagctcacgctgaggccgtgcatgg

SEQ ID NO: 104549 - DNA, 702 bp, Oryza sativa
aatatgatcatgccatgcaaactgtcccgtaaccctggaaattcaggagaaaaggttgcatgatgtacaattctgtgagacctaccggtggggcatgggggttcagctgaacccccaaacgttttgggggagaaatatgctacctctccctccctctcctttaatttttgaccacacacagcgcctccctgttaagacacaccattaaaaaaagtagaagctcttggatcaaaggaaaagggataatgaccattagatatatgaattgcaactgcctttgttgaggaagtttgctacgtgattaactgtcaaggcaaagcagccaaaccaacactgttgtccgtaaaaaggtaaagaagccaaaacaacagtgttgtccggaaaaaaattgaagcaaaatatgttgcgactcttgccaattgtcagtaattaaccacaacagtttgacaagccgtttgcagtgcatataaagaacacgttaatttcctctaaaaccctcctcataatctccttttctttctgtacagcaaaagcacttccaaggtacacataaaaaccttccaaggcttagtcatactaccaaaaacgttcaagaaaaaaacatcagaaccatgagttaacgttgagatcaatttcaggggcggagacagcttgaagccacaccagggcttagttctattaccttgtcctagctctctataa

SEQ ID NO: 104550 - DNA, 675 bp, Oryza sativa
atcttcgtttgcttctctaatcgatcacacgaccacctaacctgtgtgccagtgtcaggcaggtagaggactactggttttatctccttggcttcgaaatgcaatcgggacgtatagagctgcttgatctgacatccacaattattgacgcctgttcactttgatatcattttcaaccttatcaaattttggtaaagttacaaaaaaaagtggctacatttagtttcttgccaaattttggtaactatataagaaatcctgccaaatgctaaaatttagtaaggtttttttggcatcaaagtaaacatgtccttggtttgttggttgcaacgaaaaaggatccgaaaaatcatatatcgttgaattgatcagcgttagacggtgagaagcctgactaaggcccagtttagttacaaagtttttttttctaaactttcaacttttcatcacatcgaacctttaatacacacaacttttctatcacatcgtatcaatttcaaccaaactttcaaacttcagtgtgaactcaacacaacctaagaaaaaaaccccagcattgcatgtagcatgcgtatgtactacaactactaccctactactatgtcatcccctctatccttagaatcatgacttcagcttagaggtgccgtcaattatggtcgaaatgggcggtgc

SEQ ID NO: 104551 - DNA, 721 bp, Oryza sativa
attcctgcagcccttcatgcatagtatatccagtcagtgacagttgacttactagcttgcttctttcttctaggacagtactatttttttcacaagagtttgtacattttggtttaatttaaattggatgtagcctggactggtatctaatctatttcaccaccatgtgtagtacgtatgtttttccgtggccaagaatattgcgttctttttctgagttaaatgctatccctggagaggttgaatctactgaaaagaggaagacctgctgatccctacactagctgtgtttcataatattcagatagttattttacttgatggctcagtgtctgataggcttagtatgttggaaatggctaccggtccccttatttatactgccagagcattcttcaagaaccatctcacttcatggaacatttacgctggtaggaattctgctaagttgcaggatatatcttgtatcagtgctagtactattgataaaggattgcaatctgccacatattttcacgatctgatgcacatttctcattggcaaatttattttctctcctgttgtttttttacagttccattcaaattctcatattagacttaaacacatttttccctttcagggatcacatgtcaagtcaggatgtggttgatttcgtacatgagaaattaaactcggtgagtcctcattttctctacatgttatgacagctatgcattt

SEQ ID NO: 104552 - DNA, 643 bp, Oryza sativa
gcaaggcccaagaagattgtgaggagaggacatgggagatggaggtggtgagttggttgtcctataggacgaggcttgggaagtgttgatgtgcagccccatcgtttcgcttattcatggaataagccaaacgacatatttgcaaataaaaactaatttatgaatataacttttatatacgtattgttaacaatataaaagcaaatactgaaaaataaacttcgatgaaaaaccccaaaatcaattcaaaatttaaggttgaaattcaatttttggctaataagtataaccatatgcgaaaagataaggcacgtggtcttttttcgtggttgttttttgaacatgatgatgtggtcatatgtgtttacttaaaagccgcgggaatggttgagaggtagccatgccacgtcattgttttttctagaaaagaccttcttttgtgcttaatcacacttcagtttaggttaatatgatccactcgatcgtgggataagatcaatctggccattaatgtggctgctcttcctgagccataggatcggcgaaaccatattggacgggtcagatcgtttttcgcgcagatgaatagaagaaaaaaccctagccgcactcagcccagccccgcctcgcgctcctcgccttt

SEQ ID NO: 104553 - DNA, 2618 bp, Oryza sativa
catgtgtccagagcgattggtatactattaatcttatttctttctggttgtttgtacatcatatattgcatcaatagtaatcggcgttcttcttacttacatttcaggttattttgaattaaagaagaaccaaaatattcctccttcacagcagatggtgacatgtgatcctgagtttaccattgtaagtatatctaagttcttttagaggactaaaaattttgctgggtctgatctgatagcttttcttttctgttaggtggacataactgctaatactgaatttcttgtcatagcaactgacggcatctggtaggctatcaactatacaaataatagatgtgatttcttttcattatgcttgctcccgatttaaaaaaaaatatcatgcagagtatgcccacttcagttttttagatatatgcatagcagtatagcatatgtatgtaggcttatttagtgttgacacaggaggttcatatacccatgtatgcacattggttcagctaaagttaacttgattgcttcttctaagacttggattaatttaaattagatgcgtagttctctatgttttctcatggtgaaggatttgaattatttttctgaaaagaggaacatctgccaatccctgtgggcctgcactaggtattttttcatagaattcagatgattatttaacttgttggcttggtatctgatatgcttactaagctggaaatggccagcgtgccccttatatatctgacttctactgtaaggacatgcttcgagaaccatggcactacactggtaggaattatgctaaattacaggatataacttgtcactgctaatattgataaaggattgcaatctgccatatattttcagtctgatatgcagtccccatctttgacaatttcattcatattctcatagtaaagttaaactcatttttttccctttcaggggtcacatgtcaagtcaggacgtggttgatttcatacgcaaggaattacgctcggtgagtccatcttcctcatttttctctgattgtcatgacagtaatgcatagaagagtatcctttcgaatgaataaatttcaagaacctaccttcatagttcatacatgcgctcttgaatcaagtagtaattttttactccatttctaaacacatatgtgggtctgcttggctggctggttggtatttaggcaattgaaatctaaagtctacatgcctgtaaccgttcatccatttgttgcttgcaaccaacacagggggaggaaaatctgcgcgccatttgtgagaagcttcttgatcattgcttgacctcgagggacaacgtgacggtcatactggttcggttcaagcccggcgccgcggttatccctatcctgtccgacatcgatgaggagcctgtcctctccgacgttgaggaggagccccatgaacctcaacaaaatcccggggatggcggcggcggcggcggcggccagcaagacatcggtggcgaatcagaggagctcccattggcccattttcctcaggaatagttcgtgctaggatcttagctagctgcagagagttttgatgttacagtgctatctccctctttgtccaaacaaagttgatggggatgcaactaggagtagttcattaccataggagtagttccaactcgtcagcacgtactacacttacgttttgcctgagatttacctgaattcgcttcacgcacttttattactattgttctgctctggaaccctgaagattttgatcgaacgttaacagtgtttaattcgtaaatgctcactgccttttgtaacttctctagcaatgtgcatgattttgaagaattttagtgctagactgctagtgaactaaatatttgcgtgacggtgtttatcagatcagtgtatgactgtatgtaatatcctatgaccgctgaattaagctagacaataatttcaccatgacacagatcgagtcggagatgcaaagaaaggaaagaaacacagatgggagaagcccagttacggttttagcgcaagctttcaaacacgcgctttacttctaatcaacatcattaattcgatcctgattcggacatttgggatggattccttcacacgtgcgcagcctgatcagaatcggacacacccacgaggataagaggcgaggacgcgacacggcgacaccatccttcctcgcgccaccaccacgagcgtcctactatctttcatcccgccaccgcctcttgcctcctcttgctctccctcacttccggcgaccatgggggatttgatcttggatccctacatggaggacgcgatcttggatcatccctgcctcgccgaacttcttgctgattaaacagcgctcccaatgttcgactctttctccggcggcggcactccgccgattgataccgacaccttcctccgcgccatcggcgcgctgcctccgcttgcaccgccacaggaagctccgctcgcaccggcgccaccggactccccccgtacccctcacacctacggcagcctcctccccgtctacggtgatcatccactgctcaccggcgccgtcgtccaggagcccttgccgctgccagaaggcggcgatcaccctgtg

SEQ ID NO: 104554 - DNA, 622 bp, Oryza sativa
attcctgcagccctgcaaaacttaacccgtatattattatccccttgtattcccttgcattaattatgcatctccggtgtggcttgctgagtactgtggttgtactcattcttgctcaatctttcccctcgtcagtaagagaagctttggagaagatgtcttaggtggagtcctggcttataccccagttgagcgcctgtgaagatggagccgtaggcccgctagtccgctgctgtttatttttgtttgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttctcggtcgcgacagcaatcaagataaatattataaaaaatatgatataacatctgtagcccccgactcactactcaatggaagaccaattggtgtagtgaggcagaggaaaaggaaaaatatcatatagagaataaaataaatgatgacttacctttgtaatattccccttggtgatggcagaagtggccaatgtgggaacaaagtcgtccatcaataacaatgaagacacca

SEQ ID NO: 104555 - DNA, 647 bp, Oryza sativa
caaatcgagacgccgccgccacctcccatcacgtacgatccccacccgccgtcgacgacctcgaaatcccaatcgctgcgccgcgaattagtcgaagctgcagtactgcatcgccaagctcatggcggctgagggcggcagcgcgttcgctgggcagaaggtgccgctcatcgacgccagcatggctctcaagatggaggagacgtgccccaccccggaggaggtgaagcatctctcgccggccgacgagcgcctcgcggcgaaggagtactccgacggcgagctcaacaagtcccacgccgaggtctgccgtgaagctgacaagaatagcgccgcctacctgctcgccaagcgggccaagctccaggctctgatcaaggaagaatgggctaagattgacttcagccgcgtccatgtcggtgactgggacgaagaagcaggctgctacaagtagctagcccacccagctctgctgctggaacattggacactggccttattctggatggatggatgattcgcctggcccttttttctctaattagctctactagtattagttagtatcagttatgtctagctgttcgatccatcgttcgatttgtgatgtttggtactagttactaatcaatgggtatctatgttat

SEQ ID NO: 104556 - DNA, 690 bp, Oryza sativa
attcctgcagcccttcagatccaacatgtccagtctaaagataaatcctggtaaaaccttgcaagttggaatgctatatgagatttgaagaggtgaccaattgtggatgcataaatgtgaagtgttagctagaatgctagattgctgaaattggcagacagacaagtttttcttgattataaatgtcacagaattgtttggatgtgacccatattttcttagcatgcaaaccatctgcaataattgtcctgtgagtagatgaccaagttatatacacttttgggataattttattagtgggatgcaattctctttttttctcccctaatatttcacactctaaactgcaccaacttgtaggctggttagtgaatggtaaagaaaaaatgttgcacagtgtgcaatttatgtacacataccattctcatttattttccagttgtattttgataagatggttatctaaatcatattctttggtgaaagtgtaaacctccttgtaaaacaatatagatcttaatgttgcaatgctccactataggcatcactgtcataatcatgttccagtgaagatgcactgtcataatcatgttccagggaagatgtatgaattttcttagcctattatttagttcctacagaaaactagttttccacaaatggtaagagttctgctctggttattgatgt

SEQ ID NO: 104557 - DNA, 739 bp, Oryza sativa
attttcaagtcaagatttgaatactttcaacttaaatttaaaaattttcaactcatattttgaagcttccaaatcttgattttgataattttcaagtccgatttgaaaaaattcaagtcaagatttaaaaactttcaactcaaatttaaaaactttcaactaaagatttgaaaactgtcaactaaagatttgaaaactttcaacttagatttaaaatctttcgtattagatacaaaaacattcaactcaaatttgaaaaactttcatctcaaatcttaaaaactttcaactaaagagttgaaaaatctcaactcagaattaaaaactttcatctcagattcaaaaacgttcaactcaaatttgaaaactttcatctcaaaacttaaaaactttcgactcaaatcttaaaaactttcaactcaaattcaaaactttcagcagaaattagagatgaaagattcaacttctaaataaaaaatcgctgaaaaaggggaaaaagaaacgggaaaaacgcgtacgttagcttttccgtgaaaaaaaatatggacgtggacgccatccgcacgcactagcgctgtgggccttatgggcctaaaacgcacgccgcaacacacacgcgaattagctatcgccgttgcaataccgtgttgattttctatgggtttaggactgcttatccatgatggattcatgacttttgggtaaccacctttagaagaggcagtgagacctattagta

SEQ ID NO: 104558 - DNA, 654 bp, Oryza sativa
aattcctgcagcccatcttattccttctttctcccgtcttctttcctcctccgatgccggccaagcccttctcgcttcttcttccttctttccgtcctcgccgccccgcgtagctgggcgaccctgtcaagcagccatcgaccaattgcagcacctgggagcccgccgtcttctgctccaaggagtctggcagcatcactgagctagcccttttctacctccccgacgacgccgcacgcgtgccgtcggtgctcagcgagctgacggagccacgcctcccgccagcccgctcctggccaccgcctcgatggcggcagcaccgagacaaccgttgcccgccaccgcgccttccaccgtcacccgcgctagatctgatgcgacattgtcggatctgcccgcgtggggcggagcggcggctagatccgcgcagaaggaaggcagtggaggaggaggtggagccgccgcacctccctctcacccgccgcgcctcccaccatcgcccgtgccagatccgcagcaccgccgccggatccgcacatgtagggcggagtggcagctagatctgcgcaggaggaaagcggtggaagaagaggtggagccatcgcgcctcccgcccggccactcccgggcacctcctcgtcggtggcggcaggg

SEQ ID NO: 104559 - DNA, 629 bp, Oryza sativa
aggttgtgacgtggcatatctctctgccgttcatcaactttgatccaacggctgtaaatggatatgactgcttaacttgcagtcactaactaactgcacttgatattgattccagttcatgggttcatgggaagaatctactgtctccgtcaaaaaaaaataatgaacctaaaatttgatctaacatatcatagtacaacgaatctagacagtactataatgtgtcacatccagtactccctcagtctatgaaaactaactagtatcagatatgacatatcctagtattatgaatctgaacgtatatatctctagacttatagaactagaatatatcaaatatgtcacgtatggtcatagattcgtttattatgaaacgtagggagtatagtagagtgtcgtttttcttgatctgacactaattaatacggagcaagtaccggtgtcagcttttggaacgacaatatatctttctccctgatatatctttctccatttactgtagattgtacagtgcaccgatactaataactattattactccgagcatgtctaaattcgtagttcttgaataagtcatatgttactatattttagaacgggggagtacccgttatgaacaggctctg

SEQ ID NO: 104560 - DNA, 1266 bp, Oryza sativa
ttgctcttgggtgggtttgtcgattgatatcctttgaaggtgaatttatgttagttgcgaaatgcaatcattttcttattgtaagtccgaaaagaaggcaaaatttagatactaattttgtactacaactataatattgttatcgccaacaaactccttgatcgcttaaagcaatcaatgagattggtaacgacaacaatattacaatccaccaaccctgaccatttcaaactacctaattaagttccttaattatcaaagaatgacagatttcgaagtgcatggaaaattttggcgtctaggtcggttccgtccatggactaccctgaccaatccaacaaaatttcccatgcagttcgtattctgtgatggcttgataacataggaactacattaaaagtacggccaatctatcaattcatccatttcagctaaatttcaaaccctaaacctaattaagttccttaattatcaaagaatgacagatttcgaagtgcatggaaaatttcggtgtctaggtcggttccgtccatggactaccctgaccaatccaacaaaattccccatgcacttcgtattctgtgatggtttgatatcacatataacatctcacatctcaataacccctaagtcccaaagtttacatatctcaaagtgcacatatgaaatatgaactacatctcacatatgaactacttatggacaaagttcatggcaatgtaaatcagatttcatttagaacatatcagatttcagaatttcagagtatatgaaaatttcacccccaattcctgcattcagaatttcacccaaaattgcattctctcatatttcaaacactcattctctcagatactacaacatttcattgcaaaaccatatatatagccatacatcactggatttcagaatttaaatcacacttgcaacaatctgaatttatatggaaaaaagagcacgatgatatatatgcagtttcagtgcatcagtcaaacaaaacagcaaataaaatctatccaaattcatccatccatcaaccaattcatattgcacaatctgaacttatatgaaaaaaaaatagcaacaatccacaagtttcaaactagctacaatctgaacttatatgacaaaaaatagcaaaatttcatatgcagtttcagttcataattccatccaaaagttcatccaaaattttgaattgggctagctatagatatgacatctcaataatccctaagtcccaactacatctcaacagcacaactg

SEQ ID NO: 104561 - DNA, 676 bp, Oryza sativa
attcctgcagcctgctgccaccgctctccttcttcccttgcatcagccacggaggagccgtggacatgccctcgaggtgtcgttgctggaggtgctcaaggaggacttcgtggtaggaaggagccggcgtgggcttgggcatgggcacaatgacgacggtgggggaagcggatgcacccgcacgtggtggttgtgagtacagtgagaaggagacaaaggcaaaggagagaggacgggcgggatagtaggaggcaccgcccatcgatataggaggaggatggagctagcatgggcttggacatgagtgcggtgatggtggcagtggaagcagatacccctaccactgtggttgtgtggagcagacggaggtggaggcgaaggtgaggggacacgcgggactgcaggaggcaccgtctagcagtgccagcattgccataggaggaggatggagacagtgtggacttgggcgcggcatgatgacaacgacaaagatttggccgtagaagaggagagagaggagaagatgagaggaagagtgagaggaggaggtggtgaggaataaggtgatggagccaatgatatatgggatctatcgttagattggagagtgtaatgaagagtctatgcagtgaaaggcaaatttgactatcttttttttggcaatccggccaaatgg

SEQ ID NO: 104562 - DNA, 655 bp, Oryza sativa
attttagagcttttgaaatgcaagtatgttaaatcatcatcccacataattacgtaatcttatgttatctatatattttacactttgtttttacctattgatattatactaaactcccgcagcaacgcgcggggttttacctacttctttcaatggtagatcatatatctattgataataagacatctatgatgactttatcaatttgaagatatatcaagaatgactggtcggaagcaattctacttgtaataaagattttaattactatgagtattgcataataaaaagggtatatgaagagatattttaaggacgatctaatttgcagtaaacattttattatgtaagtaacgtgttttagttattacaaatttgggtgtgttttagcacatccgtgttttcacatgcaaaatctggtcatatatttgtaccttttctactggctgggagtctaggactgctgattgatgatctaatgcatttgaaacctactaatgtgactcctgtattaacaaacagtactaatgacgaaagagctccgtgactggagcagttgcagctagagctagctttcgaaagcctagcaaacctagctagcatgcgtgcgttattctctttattctctttagtactgatctctgctatagctttg

SEQ ID NO: 104563 - DNA, 1112 bp, Oryza sativa
tgaaaagaatagaggtaccagagccgggtcgtggcccgcacagaaaaatcaattttcgtgtgcaggtcatttaacaggccgctcgaccgtctcccctcctgacgctcgcgcgaggcggccgggagcggcagcgccctccccatgcccggatccggcggcggctgctgccccttgcccggatctggcggcggcggcagtcccccgtccggatttggcggcggtggcggtggggtgcccggatcttgggttagggtttccaattatttgaaattttatttttttttcggattttgattttcctgtgcgagcggcataagcggattttcgcgtgcgggtgcgccacccgcacgagaaaaacgtgattttttcagacggggcgttccagacaggcgtaaaaactgcacgcaaaaatcaaaataaccacacgcaaaaatagctattgtagtggtgagaggatggttatgattaatttgttggtccgacgggaaatggtccctggctgccgtgtgatactgcatatgtggcaagtggtgaaggaaatatttttaggcccgagcaaatttaaatatacctactatttgatacaagatttttaactttaaattaaattcaattgtgtatttgacggtgagccggacagctccttgtggtagccggacggtagctccgcccctatgtgtggcatattccaccaatagacactacaagaaactttaataccacaagatttatttctatggtataacaattttaaaattgttgtaatacataactattgccaagatgctgatgcaatgatttttttttctggcaaaaggctagttccgtggtggagttaactactcctacgcaacacttcctctgaattttttatatacacggttgacttttggacatattcatcttactatatgtaattgttatttattttatacttctatactactttaaggctgtgttcgggactccccgacacccaaaacaaagcacatattattgtatgattaattaaatatttgctaatttttttaaaaaataaattaatatgattttttaagtaactttcatatagaatttttttttaaaaaaacacaccgtttagcagtttaaaa

SEQ ID NO: 104564 - DNA, 605 bp, Oryza sativa
tgagaatttggtcgtgagctcctgctgttgaccctgggagatacaaaaatgtgctgccttcgttggatgattaggatggttgggaacttggaatccccatttcttgggagtctttggactggataatccattcaatcccaggtcaaacaaagcagaaagaatatgataagtagttaagtactagctgtagaagaaaacctgatgatttcttgattggaaatgctcaattatacaagcctgaagctagcatgtaccagcaacaccggacagtgaggttggttagccgtggtggtggagtggagctcttggcaatggctggatgccaaagctctcacctcagccgcgcctccaatgccctcttcaactcgtcgccaagctcatccgacgaaggcttcgtggcgttctcggctgcggccatgtccttgccactgccccggcgatccggcttcaccggagatgagtagtggtatggctgtgctggttgtggcggcgccggcggcgtcctccaggtgtcgggtgcgccggcggtggacaccgccgccctgcggctcccgacctcggcgcgcaggtcctccacggcgcggcgcagcatcccgctctccgcg

SEQ ID NO: 104565 - DNA, 1686 bp, Oryza sativa
ccaaggattacaaaggtgttgatgctcaagtgatatcattacacctaacaataccaagaatgacaaagtgaagatattgaagatgtgtgatacgaaatggctattatggcaagacggtgaagggcaagcgatgcttggtcacgatggaccatgcggcggtgaagggcaagcaaggggctcggcgccgaagaaccaaatccggtggtgaagggcgagtgacggctttgtcatgatgaaccgtgcgagaccatttgaagctacaagtaaccgcatcaatcatttgaagaatatatggtgaaacggtatcggcattggcgtccctcaagacaatgaaagaaagatgaaaaaaagtcattcctaatggtataattatcttcttgtttacatttgagtttaggaatgccgtactattaagagggatgcaacgtcgaggtgtttgtgtatgtctcggtgttcaaagtgacctatcatagtgctaccttgagagaaacccaagctataacctatcatttgagtggttttagaccttgtttttggttgagttgggtagtcctctgagtgagctttccatagagtccaagatcatcaaaaatggactcccgagcgaaaagttatagtcgtttttactctgtgcttttcggaaagtccaaaaaattatcgaaaactccgaaaagttttcggataaatccgaaatttttcggatattccgaaattggctgcgaatctaagatttgcttctatagattttcggacttgtccgaaaatgcttttcggaaaatccaaaaattacagtcttggcctccaacggctagtttttgagaagctcgggtatataaactcctccaccccacctttgagtggctgctgctcttggggagtattagacacatccaaagctaaatagccatccccatttccctacctctgtggtgcctctttgtgagggggatttgagaaggggagatagttggattgtgagagtgaggagttgagagctagtgagcttcactccatcctttgtagcgcctctttgtgagagggatttgagaaggggaaagagttggattgagtgattgagaaattgagagctagtgagcttcactccatactttgagcactcgagttcatagcaagcaaatcttcgattgtgtttgttactcttggggactaaggtctcctagacggctaggcgtcgccggtgagcacctaaggttgtggtgtgccacggaaagtttgtgaaggcttcgattttgcctccgcaagggaagaaatcaagagtgaaaccgaggagtgcatttgtgcaacctcgtgaggaaagggttgaaataggcctggcccttgtggctcctcaatggagacgtaggattcgtggatccgaacttcgggaaacaaatcacgcgtctcctctcttggtttgcccatttgtgcagtctctcatattgtacttgagctagtttttacccgatctacttgcatgcttaattgatttagttggtgaccttatatcttgtttagatgccttatttgtcaccttttgatttatatacattttgtttatttgagctagaagttcatagctagtgttttcttccattatccgccgaacttttcggttgagaccggaacttccaatctcatattggaagttcctatttgaaccgaaagttctcatcgggctgcaggaat

SEQ ID NO: 104566 - DNA, 1202 bp, Oryza sativa
taagactagatattcactcaacattgtaagtatattgtcccttatgtttggtgattaggggatttgagatagttgactaccatgttagaagtggtgtgagttgaagtcttgaagaatagatttgttaagaaaaaatctagaatcaagtatcaggtcaaattaagtatatggatatatgatatacctatatatactaattttgtttcatagtattttgaatattctcgggaatacccaagaaccccttacatccgccagtagctcttacaagaagtatggttgtatcttgctgggtgaccttgtagaggttgatgaggatgtcctcgacgcactcttataattggggactcggagtaccacagatgtgcggcgactttgatggcctcatggcctccatgcggttctagctctccgctggtactatttcctatgtttcatatgataatactataaggcgttttgggttttgaatagattcatacattgatccacatatatgtttcatatatgtgcataaatttatatggatgttagtgaatctacaagagagatgaagaggccaaaacatcttgtaatgtgagggagtacttatcaagctggattcataagttgggtaggttatttgatagggaggcgtgcgagtgcatcgatggcgcagccgctgctgctggtggctgcttcgggttcacgactccacatgatgcttgagaagggagagatctcgcagtggagtacatgcgagggtgttaagttcggcacggtggcatcaaggagggagccgcctaaacgatgaccccgctagcacggcggatgttactcctcctcgtagaggagagagaggtaagtgtgcaaaaagagaggcacactgaaatgtgggtccaatatattcactaacattcatatgaatttggatacatgtaagaaacatatacatgaatctattcaaatatcaaaacatcttataatgtaaaagagataaagtaatgcttataatgccgaagtctatacggattcgcgtgaaatagcctttccacgtggtgttgtgcaatttcagctttcgtctctctcccctaaccgtcggattgcggatggcgtaactcaactaattaatatgtttcttataatgcaaccagctcatctgggtttaagaactaggtttaatatgaatgcttggattaattgttatcctctcttagtataaa

SEQ ID NO: 104567 - DNA, 1102 bp, Oryza sativa
tttgatatgatttaaatcagctttaatttgcgatggataacaacacgcatgctggtaatggtcaacctctccgtgtgggaggagagccgcaagactgcttgcaatgcaaaacaagaggtttggaaacggacagtttggtggcaaaatttagaaggaatattgtactgctgcccaatatatgatgttaacaagcacgtttgagaaaaggcaagtgcacagtacgtacgtacgtacgtacatacaatcaatcaatatgtgctttaattttgtgccttttgcccttgtttgtcgctgcggagaagtgaagccgcgacgatctttcacaagatggatgtgtagcagctagctagctagctatgtggtatagggcatgtgccacactgtgtttaataattttgatattattacaaaggatacaaccgaaagtacaagtatgctgacgtactgacgttaaccagtgtgatcttctattttgccccaatttgatgttgccattttattttggtagaactgtataggatacgtaaaatgtgacttttaccctattactttttatgatatattcttagtgggtcctatcattccaccaaccctcgagacctgcatcccatccatatactatggccattttaattttttaatctattatcatgattcaaaattaaagaattgattgcacgtagaatggagatagtacgtattccccggcaccatggagatttcaacttgctcatctattactttggctttgagtttccttcacgcacctcgtgttccccatcaccatcattggcatcggctccgatgttgtaagctcatgtccgtgacttcgcgggcatgtcaaggctgagctaatatacgatgacaatgattggctagctcaggtcgtggtcgaggtcccgtctgcaagatccagtgattgagacgatgggagtgtcatctgtctagtggcaaccttcataaccattgtcaatatccttgtcgggtcagctccaatggttgtggcggtggttatcttttgcttcggttcgatgttggttgttggtggtgagtgcacgaaattcgatcagcataacaattagccgctgatttcggagatttt

SEQ ID NO: 104568 - DNA, 830 bp, Oryza sativa
aggtgttgcatttacttcgcaatgttgttgcactttgataaacaaatttgcgatttactccatggggaagaggtgttgttgctaatggtgaagacaccattgtatctgctattaatggtaaggatccaacctccagtctttgttattagtatgaatattgagggaagatgagttaagagctgtaatgaatttatctgttgatggcagtgaatgtgtaatcttttgattgactgccgatgatgatgaagccttcctcttattcatcaaatgttcggtaagaatcctcttattcttcaaatggtcagcaaaagtagacatatctagcaccactttcctcttatctatagtattcaaccgatcaagcatacccctttcctcctgttgccagcgacaaaccaccggagacaaggaggaagagagatatggggagaggagactggaggagttttcacccgagcgtgttaacgagagcttgagaaagatatgtaactagctagcaagcccgtgaacctggttggatcttgtttagagtacttcattaagtacttttcacatatgacatatcaaatcaatattcatgtgagataagcttcttcggtggataagctttggcagttctgcagagttaggtcctgcggcaaacttggaatgatggtgggacaatagcaagctcgtttgctttgtgggggtgatgggtgtcatgatatatggcaatgacaacattgtagcgtccatttttgacgagataagctatggtagctcggcgagtgtggtgctctgtggcgatgatggcatggtgccgacgtacttgttcgtgttgtgatgatgta

SEQ ID NO: 104569 - DNA, 1409 bp, Oryza sativa
ttttgaagctaaagacgaaataaattctattatctaaaaaaaatacatagtaattgatgttgatcgccatggcattccctctatgttttcatgggatttcatttcgtatagttgtgaaaggtatgcaacgtgtaatatatgaacttaatttttttacgaattccctttgacactgacatagtggtgattgataattttttctatagatcaatcacatttgcaactgttagattaacattcaacaactaacaataatatttggtattatatttatgtataccccttcgtggatcctcctaggattagaagtagatgttctaatccacaaaacaggtcagttaggattcctcgtggctttcctttttttttcatagtcctcaatagatcatctcttaataatctattttgccacacctctattacacatgtgacatgccaacttgcaaagcaatgttggtacttttgggtgtcgttcactcgttcccaatattatttatctcgactccttttgtttcctaggtctagctagctagctaggttttcttttttgaaattgaacacactttcagctagtatacatccgttctgttttactccatccattctaatataagtgcagttgtgggtttctgtgtccaatgtttaaccgttcgtcttatttaaaacatttatgaaaaaattaaaaaaattattcacacataaaatgctattcatattttatcatctaataacaataataatatcaatcattcaataagatgaacgatcaaataccagatatgtatggaaactcacaactgcacttatattgggacggaggtagtatgttgtacgaaggcattgacatactagtttcttaataatgtgtttcttaactataagaactagaggttacttaactatgtatttataaaaattattaaaactataaatgtatactctataatcgttggccgtgtgcctatggatagaggccagagatgtaacccatttctattatctaaaaaaaatgaagaatctacccgtgcaaacacaccactattttacgtatcaaatctcaaaattactccccctgaagtggtccaagtaaaaaaaatgtcaacaatatgtttttatatattaacaacaatttgcgatgtacttatatatcataatttaactgtatttatactcattctaggacatcacattttaagtatatatataatctatcactactaatgctagctagcttaaagtaattaagcgtgtggccatgcgcggcaacgtgtgcttaattaattatatgcctatatatagttaaaattaaagtactacacatatggaccacttcctaagagcgcaattagttcattttggttatgcgccctacgcacgcatgtgcttattaattaggccttgcactgttg

SEQ ID NO: 104570 - DNA, 609 bp, Oryza sativa
ttgagtccattcaagtctcagcaaattcataaatatccctagaatccaattaaaatggttttgtttcctgtttcagtagacttatagcatgtttttcttgtgtgcttcgtttgttgcttagattttgaccgtttcgtcgctccgcggtttctcgaagacgttgttgtggtctcatcagtgcaagagcaaggcaagtcatgcattaaattgatcatattgtacccaatttacaaatgtcccgcattttctattaaacgttgcattcttttacaatatcatgtgggatgggtcctattactcagctatatgttgttacccttacgccattgataacttgggttttaaaatgactagatgttggtttaggacatgcttagccatacttagttcaacaagtatacaaaaggtggatcatattaatgcatagactttgattattggcatagatttggattagtgccaccataatggtgttagttaattaaaatactctacatggtgggctgtgggtgcacggttttgctagtcgtgcccagagtgtagccttagcttattactttcctcccctttgtttcgcccttaactgttgtaactatgctcaatcacctt

SEQ ID NO: 104571 - DNA, 659 bp, Oryza sativa
aatctatttattatattattaaaacaaccttcaaaacaggcatcatgttcgctgtggaggctagaaatttcaacattaatcggagaaaaaaaagaagagtccaagtaaaaatacaatctaaaaatagctgaaattcagaattaaaagtaagcaatattgaaagagtagtccatattggaccgtaatatgagattaatcaaaattcggaataaaaataaaataaaatccgaatttagaaaaaaaagagtccatttaggaaaacaatttaaaaataactgaaattcggaattaaaaataaggaatattgaaagatgagtccatacaagaatccaatacgagattaatcaaaatttagaataaaaaataaaaattagaaaaaagaaaataatagaagagttcaagtatgaatacaatttaaaattaactgaaatttgtaattaaatataagcaatattgaaattcgtaattaaatataagcaatattgaaataagagtacatataataacccaatagtacattaattaaaattcagaataaaaaataaaataaaatacgaaattaggcaaattaaaaagagagttaaagtaggaatacaattttgaaacaactgaaattaaaaaaaataaaaaaaatcaaaacaacacaatacgaaaaataa

SEQ ID NO: 104572 - DNA, 655 bp, Oryza sativa
atacaagaatagagggcatttatcaaatatagacaataaaataaaaacataccttcatcatctccatgttctaaatgtaaagagactaaacaagatatggctcaaacaaaacattagtctcatatgcttatgtaatcacatggaaatattatatatgaatatatcaatatgtgcacggatagaaagagtgatacatatagcttgatctccatgcatttcatccttgtgatttaggtataccatcaatgaacgtttttctctcaactcatataaagtccagaaatcacctctcacatattccactttcatatccatatgagactagtagataaagaaatgcttataacaatgttagtctcatgtaattggattcgtcattaatcgtcaaaaccaaattaatggcacttgaactttcaaaaggaaccgtccatggtggcatcgggtgcatttagggatgctaaagtgcccaacattttagcctacaaaatattgatgggtataaaatggggtgggctaaatttctatttattttgaactaaaaatatatgagggatagatagggttgtgaaagaacccatgggcattgacccattatcacccccgtgcatcaaggggtgcaagttgagctgcgccatcaacatcacggcgaggtgac

SEQ ID NO: 104573 - DNA, 646 bp, Oryza sativa
ttcctgcagccctccattactaacgccgattcaagtggccaccgtaccgagcaagcaaccgccgcctgccactctaatatctattataggcttgctccaattcagtgatgaacatatcagaattttgagaagaacattgtaaagttcagtaaagtttcttagcttttttcttagtgaaagcgagtagaaaagacagaaggagatcagggagaagagcggcgaaagggaagtaaaagatcatggccgtgttgatcaggaagcttgttctgtcactgatcgtgatggtgatggtgttcttggtcgtgtctggcaccgcggcggcgcggccattggtgggacaggaatggaccggagaagacaccgccggcgacgactccgtcgtcgtcaggtttctccggcagctgtatctgcacaagcttgctggtccaggtcactcctgcaagacctacagcccaaaccgtggatgctgataggatcgatggtgatttggtgaagatggcttggaagctagctagtagctaatttgtaacacagacatatatacagcaattctttttttctttttgctaatatatacaacagttcaatttgtagatttattttgcttggaaactagagatattatttttccccggtgatttttttt

SEQ ID NO: 104574 - DNA, 4566 bp, Oryza sativa
ggcgctccgcgaacggcgaccgcccgagccgccggagcggctcctgcgcctgcgggtggtggagcagctcggagagcgacaccagcacccgcccgagctgctccgcggcccccgcgacggagcccgccgacgcggccgacgccaggcggcccaccagctccctcatcgtcgccacatcctcgtcaagctggaccaccagaggatggaaccggcacggcaggctcgccgaccggacgcggtaggcctcacccttcgcggccgtcgccgccttgggcgcggggaacgagatcgtgcggcggaagccgaccaccatactccaccacctccgtcactctttgatgggatcgatcaagcgaagggtaacctgtgcaacctgtgcgcggatggcgaaggggaggggggcgcgttttaaatgggaggggggaagtgggattcggggtggaagcgtggaacgctcgaggaaggcgtgggcggcggaagcggtcatggcctcatgggtcgtcacggcgcacggccgcgcgagagtacgtagtagacggtagtagaccgcgaccacaagttgtggggagagaacccaagaatggtgtgggtttctggaccggttctattcgattccaccgtgacgcaagtcgtgcttggcacgcatagcttttgtctgattttaatccttgtgcttttgggggtgctttgggcagctagtgtacttgtgttgggtttggtgctttaaactttttcgcgttccgtgacgggcggagcagatggggcctggagatagatatcataaaccccctgcctttggatgaaatctgatggagaagaatgattcgtcgattcgcatctaccgttgtactggactactggtgccttttcttccagaacagttgtggtgaacggaacacataccatttccatatttcacagaagagggggaaaattgctgttgtaccatcaccaaaacttcaagttcgtcaaaagatgatacttggtcacgatccaaagtaccactactttcggcgttacccaagatgccacaatgagctaatgacagaggtgaatgcactgatgtacggtggagcatgtcagtaatcgaagtgaatacactacttcactggtagtggagcagttgcgttgcaataataaaacaggaagtagtagtagttgcgttacgtatgtggataacacagattaatctatactatcaaacacgggagagatatttcactctaactcatcacgtggttaattacaacttgtaaccgagtaagcgactactcatgactgtgctagtcggagaaaaaacaactgtggggcagaaaagggaaattttattatccttgagaccttgagaatatattatagtagaagatattataattttttatgtatacatgcatcaaaaatttcagtgtaaaatttacatatctcgagatattttcttaagaacgataaatttaggtagaaatacatgccagtgcagtgtgtctagccgacacttgagaccatagcgcagtgtcttcatccttcgactgaattttaggtgcggtcactccaacgacgattcagactggaaccctatcaacaacaagacctctctatcaggggagttagtccagtccagtagtcaaaatcaacctcagccgcctctggctacgttcagtgcatcagcttgccttttcacgtgtcgttagaatggctatgcatggaaccttcacacggatatagctagatgcttcgaacgagagaaactgccatgcatccctcatgctcgatcgatcgtgcattcgtgctgcatggattggggcacatggacagcatgacacatctcacaagctgctagaagttggcaccaagctctcgctcatgcatgcttaatagtgacaaagctgaaggtttcttgtcaaaaagtacatcgagaaagaaaacctggcatgggttcggcatggttcaatggttgctgttcaagacaattaacacgtgatgccattttagataagtaggcacggcacggtgtaccaactttgttgatatgatgccacgcgggctaaagttctaatgttgctatcgacatccaagggagcccccaatttgatcagtagtacactactctactgtataaatctagtcaaatattcaatggtagccaaccagtacaacttcattttggaatcatattggactagctagctacctagctcaaccagacaagcgaggtgtagaaatattaattccactgtggattttagtagagagacaaacagacactcgtgcagatcgatcgtggaaggctaggtctcaaaatactgactgaatttttaggtgggcaaccatacttcagatttgcaagctgaaaaggaacggtgtgtgttaagtgaccgtgattgatttatatgaccagttggtcgatctctaccaagaaattctccgaatcaaaagggaggagctgatttggcccgttcccgcttgcgcctgcaaacatggcgcatttaagtagtatagttgattttgattcttttttaccaattgatttaggagccaattgatttaggagggagtttgttgtggccaggacttttgtggcgagcctgcttctctcgacctcacaaaagtatatgctttctccaagtggtctaattgaaagtcatggaattgatcaggactagtgggtagaactgtagaagcactagcatattagacaaaaataaatatgttgtttatatgcgtgacatgaatgtgtcgcttgttgtcaaaaaagaactaattgatgcttgctaggttgatctgtttgacatgcatgcatgccttcagaattagaatatcagaatatcctcgcagctttcatcatacaactgatatgatgtcatctctgaattatctaactatgaacattgggtggatggaagtagtccaagtaaactaattgataccgtctttttcttttggtgttttagtaaaacggttgaatggatcaggtcagagtttctaatgaccatgctcattgtactaatgtttactgaaaaataatttatgaagcaccgtactgttcattagttaggtatagaccttgagctatgcggtgtgccccattacctggtggagtggaacctgatcatgaccaaaactgcaagtgcaaaagcaaaagaattgcctgcgaaaaagaaaagagaaaaaggagatttgactgctgttgtaccctcacagctttcagcatagaagtgtaaaaaagatacgactggtgtgccctttgatgccaccttcttaaatgtatgtttaatgttttcatctgaaacaaaagtgtccaaaccctacaatgctgcttcatgtcgatgaactccagtaccataccatctcttttgattggttctagaagcagcctgttctgctctgttggcaagttgtattcctcatgttatctgatatgtcatgcttgagtcttttactcgggcaatatgatctaggtgaacgtatgtaatccacacctgagttgttaagcttatcttttgctactaggtgaagagaacggtacatcatggagctgatatcttctccttttatcagaggggacaaaacagaaattggaaccggagggagaaatggcaaaataaatgatcttatgccgacccaaactgtgccgtaagccggcccgtaacttcttttgctggatcataaactgcaacctactccactccaggccggtgtgtcctgtacttgtgtaggtttaacttgcaggtacttgctgtgactaccaagcgacaaccagttaatcaccggtaacatcagaccaaaatttaacgcaggcagacggtgatatataagctcagcaaaagcaaagaacattatggccaatgaggtacctgacaaaaacatctagaacactaatacacagcactagttagaattgcatacgtgcctgacagcaccagacgtcaaataccacgagtaaaattattgccacaactccaagtctccaatgtacattttcgacacaagtagagacggtttcgggtttcccaccaaagcttctatacaaaaccagctcactaggaatcaattatacctaatttgaaaaaaatggtggaactatactaatcagggaagcatcccccacaatccacagcaacttgcctttattagatctctgtaatagcttccccacgctgcacgtcctggtctcacgatgaagaactggaggccttaaaagacctttccatgctttattgtttccaccaaatattgttttctttcctacttaggctgtgtttagttcctgaaattgagaagaagtttggaaaaagttggtagtttaaaaaaaagttgggagtttatgtgtaggaaagttttggatataatgtgatgtgatggaaagttgggagttgggggggggggggggggaaagtttggtgtgatctcatggaaatggcagatctcatgcttctttcagaaaaaccaatccacagccacagatccccttatgtatgacaaaatgctacttcctccgtcccaaaatataacaacttctctatcaacattccattcccaaccaatcacaacccaccaccattcactttt

SEQ ID NO: 104575 - DNA, 980 bp, Oryza sativa
aggaagaccatggaagggtgtcaagccttgagtttttcacagcgcatcaccgagcaccgtctcacctccttctccacacgtgcctacaatcttcgcttccgcctccactttgcttccaagtcttctttgagagaggaggtaaaagagaccgaggaagggatgaagcgtgatatgtgggtctcacatagtcacataagttgttttagttttttttttcaaactggtactgacaggtggctcccattaatattattatcattatttttgcgtctagtgccacataagcgttatccaaaccactttaatttagaggtaaattgacttggttttaagagtttttttaggagcacatagaaataaaagttatttacatgccaactgaaagggaaaaaaagagaaaggagacagggaacggaaaggagtaaaacatctaaagcctatcttgccacaacatttgacgaccacatactcttagctactgaaagggtcaattagccctttactgaaagggtcaattaggcctagagggggggtgaataggctaatttaaaaacttaaatgaagcggaagcaggaattttcggaactaggctggaattttcggaacttccgaaaatgcacagagcagcgaacacaggataaaaactctagatctagaagtctataacagggcaaacaaggcacaaacggcaactagaccaatagcggcacaagcaagcaaagctagaggagagggatgaagaaatatcaccaagatatagctcacaaagttgatcccgatgttcaaatccttgaggggattctactatccgttgaggagctcactaagagctgggtcttagctaaccctttcctcgataggttgcactaagcactcctccttccactaagaggtatctcttcccttgcgaagatgagatctggccttcacaaacttctcccggccaatcacaagtagatcggtggctcaggggctgcagg

SEQ ID NO: 104576 - DNA, 756 bp, Oryza sativa
atgtgttatttccaaatagctctcaactagctcactctttgaatctttttgagctatttgggctattgagggagggctaaaaagtattacttggatccaaatagggcatataagggcctgtttacttcgtgaaatgaaaatttttggatgtcacatcggatgtttgaccggatgtcagaaggggtttttggacacgaatgaaaaaactaattttataacttgcttagaaaccgcgagacgaatcttttgaacctaattaatccaccattagcatatgtgggttactgtagcacttatggctaatcatggactaattagactcaaaagattcgtctcacgatttcccctctaattgtgcaagtagtttttcttttaatctatatttaatgctccatgcatatatccaaagattcgatatgatatttttaggaaaaactttttgggaactaaacggggcctaagttgagtgcatgcgaggagggtactgttcactttgtttcccaaacacataggtgtacattgtacagtgaagaagagtggccttcttcctcctgtcactctctactgtagtgggagccatgctgagctgcttttcacataaccatgcccaaattataatctgtctacagtagtacaaccaaatcatggagtcttggttgtggccccaaatcaccaaagcagaatatacggtcaacttttttgtaactttttttctcccatcttagatggttgccaagtaaagttggggctgcagga

SEQ ID NO: 104577 - DNA, 975 bp, Oryza sativa
gccatgcttcttgccctaccctccccaccagtgaccaaacccctcatgtcaaaatatataatgaacgacatacgctttgagaaagtccttttagcacctaggctagccaccgcaggtttggtgaggaaaacaataccatgagaagaaaatatagtacgcatcgcgaaaacgattatgctacagacgcgctaagcgcaactacatttagatgtagaaaaaccgcatctagacaacataaaaaaaaggaaaaacacctataatattattgtaataggatcttcgagatcgactcggaacaaagcgaaatgtgtgtgtattgtattcatcatacctgaaatcttaagatgctatcacattggaaaatatatatatatatatataatagttacaaatattaattttattatcgatgttgatgtttcgcgtacgattaaatctttattttcttttataaggcatttgccagcaaaaaatgtatttgaatttttcaaatacgtgcgctgctcacattatcgtattttggcattatctcccaatctccatcccaaacagtcccaacgcttaaaaaggcgatcgcatgacctcgatgttggaccgtacgtcagatcgtgtctgctgtagatttgtcatgtgtgccgtagattttggtaccaattcggacatgcaatgagtgcgtggtggcccggatcaaggctagtacatgcaagcgggtcagccatttatgtgcgacaagcgccaagtctcgagtgatcggtccattcagccgcgcccgcctgccaacagccggacactgccactctttgcaagcatcgcttcccaaagcctgtgtgcctgcgccccgtgcggaagtggagcagcagcgaattaaatttgaaaaatactgttcattcaattttatttttaaaaatatttaagatgtaatttatttttatagaaatatacagtcgatctcatacaaccgaaaataaaaataat

SEQ ID NO: 104578 - DNA, 958 bp, Oryza sativa
ccaccacttctcccctcgctccacgacccttttcacaggctcaacactagcagcagccgccatcgccgcttagccgccttgtcgcctcgctgctgcgtcgtttgcgtcatgccgtcttgtatcctcgtcgatcctcgcccaggcgttgccctgcagcgactcgacggcagctgttaccgtcccatccatcgtcgccacaagcaagtgtcggcggcctgcctccgcctccccaagccgacaccatcccagccacaaccgctcccaatcggtgttgcatcgtcgtcgtcctagctggcaccggccgctagccccgccatcgccgcccctagccagcactacattgttgttgtcgtccctagccagcgtcggcggccagccccaaccgtcgctccgtcgtcaccgccaacatctatccctgcccgggtgcttcgagtctccgctcacccggcgggtccccagcggggctggggaagggtggggttttccaccgtctagcaatgcggggctggggcgggggataaatgcagagagcgggggccgatcaatcacctgttgctagctcctgctcaaaatacggagtgcaccaccggcagattggccgcagcaacacgaatgccacgggaagaagtattgacgaggtaggccgaaacaagtggttaggatttcaattccaaaagaaataagtttattttccctccctccctcccaaaaagaaataaaatcgacactagccaccaccctactcacgctgtcgctctccacctaccatgtcttctaggcgtcgactacctgttctccctctttcctcctgccgtcctgcgagcgccggccaagccacggccgccacctacccgtgatcttcaagggaaacgaggaatcctcatcgaggatggagacggggtggcatagagccccaggaagacggataaagaggggccacattcccactctgctgcaa

SEQ ID NO: 104579 - DNA, 688 bp, Oryza sativa
acaattcatcagcggcaagtgttgagggaggtaagacagacttattacttcgagaaatgcccttaggcttgtttagtatggtccaattgctggcccattcaggccttgtgcagacctatgggtaaacaggtcttgatctgggcattatcctcttgtgtcatcccgtacatgttaaaaaaaaggaaagaggggcatctgaacagtgtttcatccaaaattgtcccttacgcatttcctttcaaaaatcacgctccgatctataaaaaaagaaaaccacttttataatcttatcctcggtcctaaaatataagtagcttcaaagaaatatgagagaggagagaggaagatgacagagagaaagaagagtagggggttacatgagaaagaagaccatatgccctccacccctgccaagttcgtccagcattttttttccgttgacacgtggccactctattcgagatatcacaaaataaaaaaaaataaaaataaaaagaggctgtatatatctggttggatgtacaggctgggtaaaaattactcttctctaaaattaaaaaaaagagctatggtcgataagcatgtaaaaaattaaataaagcaataaaaaaattataataaatctttcacatatgtaatattaccgatttaaaagctaatgttagagaataggttatgaaaagtaact

SEQ ID NO: 104580 - DNA, 683 bp, Oryza sativa
cagcgattttctttcactagaatactggtgagtctggtagtactgtgcaaagtgggggcgaagtgcatgtgatcaagtaacaaatactcctactactactagtactacacagaaccagcaaaaaggggacctggaatggaaacgcaataacacccagaggcaagcagtggcgtcattggctatcggtgggcatggtgttcacgtgactcgagtcagggatgccatcgcttgccatttgccgatatgagcagattttttgttcttgtcacggcacaaagaccagccggtaactgatgtaaggactgaccggttgagaacgactactcttcagcctccctctgctatagtttttttagaggaaaaagacaacacttccctgatgactgtcttgccgctgctgcatgcgctaccactggatactccgttgcatagtacaggcaaagagccaatgtgatatgtcaggcctttgttccatcttcaacgtcaacactcaaaaggattgccttttggcaagtactataagcacctttatataagcccttttatgttgcccctaaatttaccacgtagattaggtgatgagtcggaggagaggagttaggagagagagaatgagccacccctcatgcaaggggcaatctccacacaatctccaagaaaaatataagatgatgtgtgagagt

SEQ ID NO: 104581 - DNA, 689 bp, Oryza sativa
aaattcgtgttaaatttaactgacattgaaactgaatacttgtcagattaggtgggggatagacaccagtaatgcagtctgaagcccatgttccccaagactgtaaaagaaggtaacaattgctgcccctgacagggtcaaactacaggcagcagcaatgactcatcagcacattacagtttatagtcaaaattccatcaaacataggtgtcaataaactctaacaaaagaatatgagtatcggcacgaattgcagttaggcaagaaagaacttaacctgccagtgagaagcgaaaccatgtctgacaacgacggcaccccgcccttgtgcggcggaagtctcggtgagatctcctcatcggaggaggacgaagacgaagtcgcggcggagcaggatgagccttgtaggaagggatcacatgcttcgtcaacgaaggagttggctccgccggaatctgggacaacggccctgagatagatggccgtcgccgcggcgacggccgccgccacctggaaggtggttgatgtctggaggaaccgcgcggtgagtgttccggagacgaaccccgctgccgacacgccggagaggagcccgacgccgccgctcgccgcctggcgccgacttggtcggcctgcgtccacaaacttcacctggtcaaggactccctgattgggcggtgggccgccca

SEQ ID NO: 104582 - DNA, 1360 bp, Oryza sativa
ccatactgcctccgctcggctatttactctgctaagtctatacccatacgagaagtacggttgtactggagtcgtttcatgcttagcttcatggctcggtccttaattgaccagggacggcactagcctttaccggacaccacccaaatcctccagccgccctagtcgaaaacatttgtttagtttttaactttctttcacaaatcatctcatcaatgtcatggcaatatggcgctcatgtctccacatgccgtatctcaactacctttcccaaggtagttgcccaagcataaagcatttgataaatatgagaatgcatgaatctaaattagcattactaagcattcgtcataagtgactagggactcatacgtaattatgggtacaagggaataatgagataagcaataatcaaaggcatggcataataacaagtaggatattcatcactgcatgcaattttatttgtaaacaaaacaatttcacaattgggatcaacatgctcaaggaatggggtgatgacttgcctgctcaggatagttcttattcttgatataatcttgatcaatcttcacctcctggaagctgcatacgctgcctcacgactaaccgatatacaaattctataatacgcgagaaaaaccaatattcaaacaacaatcaaatgtgcacaagcaaaatataatgatggtgtcgaacctagggttgctcatactattccggcttgctaatggattctaatcatgctaagggccaagattcttagtcttttatattgtcatgatggctctattggtactaactagcacaatatatgatatacacattttgctaatatgtggtttagtcaagctacaaggttatgggagggttatacgactacgcatacatctataaatggtcttatactaagggttctgttgttggatggatttagggtcaaacaaataattacatcgattaatttatattatcattttttccaatgaggcattattttaattatgatcatattttacttgtcattataaattataaaaggcttaataattatccatgctctatatgttagatctgtgaggttataggtacagattatttgtaattgtggtcccgtaatgatcaattacaggaggtcgaaatttataattagtgtttatctaatatacatatttgtcatatactccccagtttaatgtatggaaaaggtaaatcaatagcatagctataatggaatgtacattatatgtgtgtgcaacaacatatatggttttggtcgcctactgtacatgagccatttagaaaggggtaatttggaaccatgccattataattttgcaaagtttgaggggtgcaggaa

SEQ ID NO: 104583 - DNA, 726 bp, Oryza sativa
ctactcctacagtcctactacacaaaagggttgcagttacgtgttggcccaagggtgtagcagtggcatggcctactgtgaatctgtgattgtgtatgtcacatgagtccagtggtcgaggtaatcttgctagcttcatttcagagtcgaattgaaacttcgaaatagagcacttatcctctttccgtgaacaaggaatggaggatatcgacgccgttatatatggcagatcgttcagtgcctgtgagaggggaagttaacttgccatgaacacaccatcaaaaattcagtcattggatcaggaatagactgtaaattgcctttgctgctctagtgctatgacgagagggaggggaagtgagtcagtcatagagagtaagaattaagaatgatctaaatttagcgtgcgagtgacaaaagcgtaaggcacacgatcaggattcaggaacgatggatggttcagatagctatgttacaccgatgtcaaattaatctcgagttgcttagttagttactaaccatattgtgtgtacactaccaaagtatgttgacagttcacgtacggtcttcgttattaaccaccactagtcagtgtagggataactacattatatcacttatcaaagcataggtagtccgggccgtgggtacgttcagagggttttacacagggaagtggtacgtgttaattccttgaatcctcacagctagtagtatcgatcgaaa

SEQ ID NO: 104584 - DNA, 1266 bp, Oryza sativa
tattccagattctaagctactcgacccaggtaaaacttggcaacggcaaaacaaccctcttttggaaagataagtggctatcccagcgcacatagagttcgctttcccagttttattctcttttgccctacacaaggattgcacggttgaatcgcaatacaggcacaattcctggcacatccagctccatccaaacctatcctaccaagcagagtcagagctgcatgaactgctgcaaatactgcaaaaccaccacccctacccagacaacacaaacgcaagagagttttcatacccggaacccaaagtctcaacagcaaatgcctatcggatgatgtccttccatgggtcactttggactccagcagattatatttggctccacaccatcccgcaaaattgcaaggttttcctctggctggcattcagagacagattaaacaccaaagccaatatggtcaacaaaaactggaacgaagaccccactgctctttgtgccctgcgctagaaacagctgaccacatcatcttaagatgcaagcaggccaatagcctttgggaaaaattgaatttactgcagctagccaacaactcagattctatctcaaccttcctccaggcaattatagcagaaatcaaactttgaaaggaattgagccaatttggtttgctgcttgcgcatatactctatggaaagcacgcaacaaccaggtgttcgaaagacaatttgacagtctacaacacattattcaacagatctcagacaccatgcacctctggagcctaaggaccaatgaaataaacagacaaaaaattcaatcctggtgctcacggctttcatagaagattgctcattgtacatatttatgtaaattctccctttttttctgttttggtctgttctgctttttgctctttttttctctctgataattcccgcacctaatatgtaatctgtaaacctcatttcttttaatgaaatgactataaggtagagcctgttctaccttcttccgtcaaaaaagacctatatcagggtagcatgcgccaaaaactaaaaacatcgcaatttcttcttctcggaaggaaaactcaccctagctcacttggtggaggtgtgggtgtacaccctaccacccaagttctacggttcggatcctcaaggcaaggcaaacttagtacttagagcataccgcaactcccaaatgacgcatacaacaacttccaaagcatgagcttttaacacgacagattaattcaccattat

SEQ ID NO: 104585 - DNA, 721 bp, Oryza sativa
tctgtgtgtgtggccggccattttatgtgtgtgtggccggacattgttgcaaggcatgggtactaagcttttcttctggggtatcctaagctcctaactgaaaattcgaagctgtcctagctagccagctgctgaaatatttactcgcagttgcagactaacagttcagagctgagctagctacggcagccagccacacatccggatccagcaacttttgccacaactttacagtcggaaaaacaaagataggaacgccaagagaggaaaaaagataaaggagtaaatacaagatcagccaggcaaggaaaagcagtaaagttcggtgtaatccgtggtgaaggctggcaatggcataagattcaaggcttcaaaagcacaggggcaaagaggtgcgaaagtatatgcgaatcagtacgtgacctgcacgatcgaggtgaggagcagccagcagcagcaagttttcactcgaggtgagacttgaccaaacgtactactgctgctgctgctgggctttactgtgatgtaaactgttagtaataaactgaacaaggcatggccactggatcagatgatggctactccaggaaggatgcaaaatgtctccccctctttgcagttgaagtttgactgcctcgtcgaatcaacggataagcaggcgatcctggccatggttaagtttcatctgccgaggtggtaaaaagccacgggctgcaggaat

SEQ ID NO: 104586 - DNA, 935 bp, Oryza sativa
cggcctgacggggcgccagtaactgggtgaggggatggaatggtccgaagcctacccattgctacgtgactcgtctgaagctctgaccacgggtcggtgactcggtgtaacttctgattcagattcccgaagcctacccattgctacctccctccaaaaagtataagcatttttaacactaatataggagtagatattaaaaatatatattaaaatgattggataaaagttataataattaagaaaagaaaatatataaatagttaaattcaattcaattggctgtgattggttgagagtaatttggatgtttggttgatgcctaaccttaccgtaactagttgtgtcatgatggcataagtgcaacttaaaaatagttagtcacaagtgtgatatacttagcttcaactttaagagaatgacataaggctaaaaaagtatggcataacatagttgcgataacgaaacaaatacatatataagaagctattgcataactaaaatatgacatggtaaagtacggtaaccaaccaaatacccttagatcagtggaaaaatagtttcattttaacatatgctattttattagaaatatcttcatcttgtcaacataggcgtgttcataaatggagaaacaatatccaaccttcatgcaacaaatcggcggcctatgatgggaacatggttcttggggcctgatccaaaaattgttggaaaggactatgattgcctttgttcgggagctgaagaatgtgtggcccatacccgtgaaatctctacatagtggcatagtgcggcataagtccagttaacatcccctatcttttcatctttactcctcaatttataataccgggttaaattaggtcctccgacaatatcgatggctggttttagtgaggtgggaagttgacccggtccactgggctacgggc

SEQ ID NO: 104587 - DNA, 683 bp, Oryza sativa
tcctgcagccccgatcaaaacatcggctgctcatgagtcgtgacttcatctagggttttctttgttgtacacatccattaaattgggctaccaactgagctagatgtggccttctttataatgggcttggtgtacacggaactaaacaggctagtaacagattatttttttaatgggccacctctatgtattgtatacttcggggcccacaggtaatccgcgggtaatttttagtccccgcccccgcccccgaaaattagcgggggcccgccctgccgcacccgcgggttagaatttccacccgcccccacccctgtaggggcgggtccccgccgggtccccggtcccactggggaaattgctacccctagcccccacgaagtcggcaaaacgtacttctacgaggttagtacaggttcgtgcgccgggggacgagcccgaactgaagctcgtagcgaggcgagtacagatttgcgctgtgcgggcatgtggcctggcatcaagtgatgcgcccctcgcgtgcctcccggctgaatcgattcctggcgcccgtgtcctcttgctggtacaaaagccgaagcccctgccgcccatccaggctccccccgtacgtgggacgcgggcacatcgggcaagatccgatgtcgccgactagtttatccgcaggctcgcccgagtcccca

SEQ ID NO: 104588 - DNA, 691 bp, Oryza sativa
aacacaggcatattttttgtacataatgaaaagcattaagaaattaaattacaccccatcatctgcatatatcagatgcacacagcccaacaaagaaaaaactcacatgaacatatcatgctatccagtagcaactggtcatgaataaccgaataacacaaaattcttagacagtactctaaaacaaaatgatgtaaatgatcctacaaaaaaatacaagtaaatactgcagtcttctccatgtctattttgatcgagaacattgctatgaactttgcataacatcattcggttatcatacagcaagtttgaatcacttgtagatgatactacatatatacatataggaatgccaccaagaacatgactggcctatgtaatgttgcactgtatttggaaagacaaaagtagtagcaacaggcacaagcaatcgatcaatgtcgtcacgatcaaacttcagactccaaattacagtaaaatgctatagtagtatcagtctgctgaaaaaactgcaaccgagattgcacacaataatgatgaaacaggatgtatttgcaattgcacgtacgtttccatgttcttgcgtgaggtagaatggcagatatgtgaccaatatataataagtaatcataggagtatacactatactaacatgtactagtatactgtcatataccagcacatactatat

SEQ ID NO: 104589 - DNA, 1548 bp, Oryza sativa
tacaatgataaggatactctcatttctccctcgttttttctaaccacatttctcaaactattaaacaatatatttctttctaaaacattttataaaaaaaacttctttaaaattttatattaattaaattttaaaattatttaagttaatacttaactaatcatgcgctaaagaatcactctatttcacgtgcgcgggagagaagtccccccccccccccccaaaaaaaaaaagttagctagcagaacaaagttcatatcacccataacaagtgttttactctctctgtttcacgaaataaatctaggattgggtgtgagatatattaatactatgaatctggataggctcttgtatagattcattatacgaaaggttacatccaaatttattgtactataatatgttacatctaattaaagattttttttacagagcgagtagttcatagaacaagtgtttgttagggcagtcccaaccctccacttagtatggtgtctatggcattaactacattgctatgtagtacttttaatttatgtggcactgtattaattaagagagagagtaaagagaggaagaaactgggtctcatgcaagacacagcttcaacacgagaacctatgcactagacactatcaagctttgcattgggggagaatagtgttttcataataggtgaaagaataattatgattggtagagaagagagatgatgtatttattaatggcccactttaagaaaccatgagttgtagagtgtagtttctattgtgatgtcttattgacatagcaccatagacattgcttatggacactatgggttgggactgctcttataattctacctagaccgacagctatctattccctccatccctcaaacactttgttttttgtcattttatttgtctaagaaacttcatctttgcaaaaatgaatgcatttgagtttgaaaaggtaggagataactgcattagagtatctgtgagatagacaaaaattaaaaaaaatggacttaagtagtagtattgttttttaagctaactgatactcatgaatatatagtactcactccatcttaaattatagcaagttttaacttttggtacgtgtattaacaagagagataaaacatttggttgtctcctcggattgttaaggtagaagaacggattagttagggctataataaaatcaagggggtagacagatagtttagtagataaagttttataaatattaggttgttatatttgggataaagtttgaacgatgaaacttattctattttaggacagatgaagtataggttatacttcaactataagttacaactaactatgttacgttctctttgtaactctatacataggattgtatttctatgacctactgattgcctgattcgttcttaagacttggttgacacaacttcgaattcaatatttctttaatctgggtattcataactcctgaaattcatatatctaaatcatcagttttagatggaatatttttttaactattgtaatttaacgtgcaaat

SEQ ID NO: 104590 - DNA, 1996 bp, Oryza sativa
gccgctccattgactagcagtttggtatactacagcacatccacacagggatatgaatgccacagtagaatcccatgatgccttcgtcttaggataccgaccgatgcaacagtggatgcactagggtggcgatcacggccttgatgatgagcgagaggagtcggccaagctcgcgatgatcatggcggagcagcagcgagctaacagcgggaagcaccagaaggatgggtgtaaaaaaaaaaaccagtggtcgttgctatagctctggcccgtgtgcgtgcagtgggcgcagcgcggcatgcagctccaaattcctcccttttgtcccccgatgcaccgccactgatgatgcctcccagccccacccccataaattccatccacgccgcccggcgccccgccgctgttgccatcggatccccgcggaaatccagtatgcagcggacacccgatgcttgcgaaccgatcgaggctgcgtgcctcgattgaaaatctgcattgaattgctccggatccgtctcaccaactcatcatcaactccacgcggccggactgcctggccaccgctgcatctctgtgcctgtccaaccccgtctggacttctgatgatgacgatgatgcgagcgcgagaccagtgtttgacacgtacaaacgcccttgctgcatcggtctatcacagtggaggcactaacgtacacgccggactgaatgcatgccggcctccatgtactccagtatagagaggttaaagtcttaaaccatgaccaactagggttacatgtttcatatatatgctcattggctcccgctaatccaaccccaattcgactgtttatcgattaggaacgttacgttacgttggttatcattatgtacgtacaggactgcagaaaaggccaaaaaggttatcttctcgtggctgaaggctattaactcgctagtttactagcagcagctggcatagtacgtcccggctacaacgccagcaatcccaatcatacacgcatgctcctccccatcaaactttacgtacgtacacgaggtatagtacgtacaagaaaaaggcaagaatattatactaatcgcgtagaactattacaccaatcagccaaaaagaagcacgggaggtggcactccagtagtcgtactcgtactgactggtggtaacgccatgagctgagaaaaggctactccattccagcaatgaatggacgacggaaagtggttttttgatcgtcttctcgcctccatggcaggcatacgcatccatcatttccaaggcagctggatgcggagcgggaagcccatcacgtctcgcattgatcctagccacgccggccggcccgtcgcagcggagcgcgggcgccaacgccactgcaggccactgcgagtctgcgactattcgatccgtagtcgtcggtgcgacgcgagcccccggttaatcatcacggggtggtgcatgccgacgcgccgatgcgcgccaggccgcgctagctgcatctgcatgcactgacgcgcgcgacgcgccgatgccactgcctcccttgcctgccgcggggcgtcagacgaaggcgcgcgatgccagctagtgcgcgcgccggtagcgatcatcgccgatccagtgaaccgtttctattcaagcctttttttttcaaaaaaataaaggtatgaattaccccctcctagcgaactcttacggtcaaccgaattatctcctctgaacctaaaaaatataaaaaaacagacatattcaccttgaacatttaataccggacaaattaccccctcaacttaatatagagcggttttgttttacgtgtcatacgtgtagaatttcagtcaacattttctgattcggggttaatccgtgtggatttgaccataggcgtatctgattttcctttgaattgaatttctctatttttctatccaaaattccatgatccaaaggagtctgaaaaggtttcagggctctggttgcattttaaagaaattt

SEQ ID NO: 104591 - DNA, 864 bp, Oryza sativa
ataacactctctctgttttatattataacttgtttaatttttttaagttaaatttatttaagtttgaccaagtttttaaaaaatataataacatttccactacaaaataaatgttgtatcaaaatatattgaatattaaaatttaatgaaattaatttgatattgtagatgttactaatatcttctataaacttagtcaaacctaaataattttgactaaatataagctaaataacctacttcctccgtcccaaaatatagtaatttttaactatgaatctggacacgaatcccaaaatatagctaaaaattgttatattttaggacggagcagcataatatgaaacgtcggtaatcaacaactaaaaacatgatttaatagaagtagataggacagttctcacttatacattgtcgtgctattttttatagtcctaacatcacgtcaaccacgtcaaatgagtgatgtgcagggtttacagtaccaacggtagccggttgattaccacgaaaactattggctaagtaggatcgagagcataaaataggcagttttctgattaagtttaaataaattcaaattgaattttaattcgactatgagttttcacttctatcattgattttctttttgttgctatgaagttaccgtttcagcttttagccacgcgaatcatcgatattgctttgtcgtaggttttcatgaaaaccgagaattcttgtctcgacatcggtttggtgaacctttggtgatgagatcgttggctcaccatatttgcaagggggaaattgctgcatgccgcacggccaccgtgacatcatttgattaagagatccactttaatttggtgcggtacagtacat

SEQ ID NO: 104592 - DNA, 1677 bp, Oryza sativa
cggggacggccaggaacacggcagcagacaccgacgacggcacccttaatggcggtgagctcgacaatgccacggcatccgtgcctaaaaccatcaagccactaactcggtgatggcggagaatagaggggtggcagctaggtcgcatcctcatatctcccctacacattccttaagatcagtgcacagctcagtcactaccaagtaccagcggtgtcaacaaactcgtcgtaggcggcaacacatgttgaggctctttgtcggcctcgcccaaaggatgtggatgagagcgacacgagggagtgggctgtcgccgccgtcagaaagggaaggagctcgggaggaggcggccacagcttttagcggtcatggaggggtagatgttagtagggcgatgaggccgttaacaccgacgagaacctcgttgttcccacccacctcattgtggccaccgaggggaataacggggaacatatgagagagtggatagaggacgatgttaatgacatgtgggccctatatgctacgtaggtgcaacatcggctaaaagaaactcctatactgctttaggatttcttctacatcggtattgtaaattaggggttaagatttgtcttgtagtttagaactcgatggtaagatgagggatgtaaagtgacttactccgccccatagtgctgataggaattttcccaaaatatgcatttcttctttctcgtgtagaactgaacattactgtatattgatgacccaataaggaaatactccaaatataacgatacaatactcgatcatcttaaaatataacacacaattagacacacacaatcatttgaatatattattacattttaggacgaataaagtatataactaagcttgtattaggggtaccataatggtaacagtacagtaatcacaattcaagcatatttttttaaaaaataatttttaattattttttttaaaaaaggctatttttgagttgccacgcgcattaaccaaaattattgtcgatgtaagagcaagaataatagtgatagccccatcgtttggcctaaacaaccaaagaataagccaaaatttgaatttttgaagttgattttaaaatgcttttaacgtaatttttgttaatgttggcttttaagtcgctacgaacaaatctacaaaagttttacttataaattaattttaattttctaataagccaaataagccaatttggaccaaatgggcaactgatgagagcctaagtatgtatgaaggagagagaaatatattaaatgcttcaagataaataatgctctctacccttcatgataaatacatgaaatacataagtatgagaaagatataggagaaaaaaaaaaccaagtttatagctactaatattggtgtactaactttcacatgaactaatacaatgagctctatccaacagcaaacaacggacttcaacaaaggcggcaataaaccaatcggtgaagcagtgaccctgcccacagaaaggctcccgttttccatccatgggatcggtcacccaaaacccaccggatgacgacgcggccgcctcccctaccccgcgccacgccaatccatcccacccccaccgtgcccatcccaaccgaaaatattcccagcatattcccccgagatcccgcatcccccctcccggcc

SEQ ID NO: 104593 - DNA, 956 bp, Oryza sativa
attcctgcagcccccgcgagtgtggggaatgtgacggggaatggaggggacaggcgaggaggcaacacgaggccatgttcttttttctcccccttctcgcacacactatagctctagtgtagcctctcacgctgcacacactcgggtggttttactggttttgtccgtttccttttggaagggagcggaatggggtggcgcctggcgatgcagaggagcagggggtttgcggttgcggtgcacagggggtgtggttcggtttggtggtggcattgacggcctcccgcccgtcttgatggtccgtcttaccgctggatggtacgggcttgaccggcctcgtcagcggatcaaaccgatcagacgacagcaagcctctcctctagtgcgagacgcacgctgcatgcgccgctgtaggctgcagtgcggcacaggcaggcgccaaaacacggaggacggagtgggttgcctgagggttgacgacactaagacagcgagggccggctgtccgttggaaaccggtaatcgtcgctcgtcgggcggtgaacagggttcgcggctagcggcgtactccgttcataaaaaaatccaatctaaaataagacataatctaatatcatcatttttatctaaatttattattgcactagactatatctcattttattttaggttaacgttttttttatagagagagtacttgtgttttattctagttgtgttcgtgttgcaacttgcaacattccagctaagggatgaacaacgtgcaatggccgtgatcctacccgtgggaacggttgccttcgcacagtttccctcgttcttttttccttttcgcatgagcaggagcgcaagcttcctagttcataaattgagaccggttaattaatggtactctattaatgaaaactcgaattactagtctagaaatattattttaggctttgggctgcaggaat

SEQ ID NO: 104594 - DNA, 706 bp, Oryza sativa
cttcggagggagataacactgtagcgagaatttacttggaggccaatccctatcttttccggcacttgcttgggcttccttttgctcaatgtgcatggggcctgcctgtgacttctgcctttgtctttaattccatcaactactgtctgctggggctatgggtttcactgcaagtccatggtttttgtggttttcttggttcaatcatttattctcctgtttctctgagccaggttacctttcctgggctcctgccactgtttatctcaaccatgcgtgtcagtgtttgtgtgccactttctgttgctaaatacagtactacactgtactagtaaccagtgatggatctagaaaatcggttatttagtgtcataacgtgtttatcggtgtcatagtatactaattatacttaaaacatagtgttatagcatatggaaaagcagttttgttataggttttgccgaaagtcgtcggtgtcgcctgacaccgacgcttgtactgtagatccgcccctactagtaacacatctcaaatcgaaaattttgccccaaatgagatgtgatatgagcgaattcatcacttatttatctctgaggttctttctgcttggattattatttgtgacaaagtaaaataacatggatgtttatcaaaccagccaattatttatttctccccctttttttaaaaaaaatgtccaagtcaa

SEQ ID NO: 104595 - DNA, 748 bp, Oryza sativa
tgctccaagagatgatcaaagttctcaaggacctcgacatagaatacaggatgctgccactcgacgtgaacgtgcgaaacgcgccccctatccagtccacgaggatgccaacgacatggaactattcctgattactgaatcggtgaatgcaccagatcattcagctatgagattacagagaggaggaaatgcctttgatcgagtttgagctgcaagatcctggtggcaactagcaagtgttctgcgctgcaagagcttggtaacaactagcaagtagtggatagcatgtaaaaactagcaatggttgttattgttagtgtgcttgaagccatcatcacttggtagttggtgcagtatgtaattactggtgctgtgtagttgatggataacgtagatacagagataaagagttttcattccaaatggtgaaagcagtaataaaaagttcaatgggtgaactcctatttctgattccgacggctagcccaggcaaccaacgacccttgccgtgaagctgcgaggccaatggcctgctgcgtcgttcgtcgagtctgatactctggtttttgtatctgatactctggtggagatgtagatcggcgccggctctggtggtgcgcatgaagcaccggccaccggctggtttctgtttaaatggttgcgccttccatcgcgtgctagaatagagggggcagccatggctgcatccatgttgggtccgggtgcaagtaattcaggggctgcagga

SEQ ID NO: 104596 - DNA, 1098 bp, Oryza sativa
gatcgatgggcggccactgccgaagccatcgggctggcgtccacggaaacagcagtgatcgcgcccacgagccccatgtgagcctgtgcgacgcgcgcgcatgtacgcccggttctttcatagcctttcggctctgtctcacggttatttcaacaagctttcggccttcactcacatcctgcagctgctactgatttactgaagtgatcggtgacgatggaatgctcatgcatgctacattgctaacgacgcttcgatcgagttaattctttatgtttgcacgtacgtatacgcttggacgaagtttgttatgttcaccgcctcaccggttcacgtggttgatcggttcgtgattacgtacagaccgaaaggagggagaggagtcacgttaatttttttagggtaaagagagagctttattaatgcttaaataaagggttacacttctaatttaataaatctagaattcttgcgaaagcacacaacctccactccgcgcaggacctagaacacattgccatttatgctaaaacatgtgctaccctatttgcttatctctttatcgatttaataaatctagaattcttgcgggagcacacaacctccactccgcgcaggacctagaacacattaccatttgtgctaaaacatgtgctaccctatttgcttctctctttatcgatttaataaatctagaattcttgcgggagcacacaacctccactccgcgcaggacttggaacacattaccatttgtgctaaaacatgtgctaccctatttgcttctctctttatcttgtgcacttgcacttgctgaaggcattgcatcactcctttaatctcttcaatcgtcgtcgcccaggccgatttcaactgatcatgcctcattaaatctttaacaatttctgcattgtccatctccagcacgttaattatattggcattgatttgtacgtgtacgtactacgtactatctacctgctcgtgtgacagcaacatgcataatgcattggtagctaactaggctccaaaatgcagcagataatttatgaatgtactaggctaaccgaatacgtgcacgtatgccaaaattgacag

SEQ ID NO: 104597 - DNA, 1015 bp, Oryza sativa
ccacaactgtctccaactccaaccgtgtaccacccccactctccctgacaggtgggccatccatcgactcctaccccaacctgcccccacgctaacaaaaaataaaagtacgtccacttctgtggttaagttcttcttaatgtacatgacaataaaaagggcgaagtttttttaattaacactcaaaaaaacaatcatgagacagggactaatcaagatggcgaagttgaatagagaaatgggcgcctcacatggccgtccctctcgcggagacgggggccgggatcattggatcgatcggaagggaggccctttgcaagtaacgtgttgtcactcctcacgactcgatgactcgtggagtctacgaacatttggttaggatggcacaattgacacagacattgttagctacagcagcgcccctggcatgttctccttactgttttcgccacattgccggtggaacactgtagcactgccattaattcgaccgtcaggtattacgcatatgcagacacgtagtagtattaattatccacgtgatcggttagcatatgttagcgtacataaagttgaactatccggagtatgtatacagagcagaggtaaacagaggaatggaatcggatgaatccgttataatattgagaagaggttttgtcagaaattttcagcatatatcgcagataatattagtgtccttttcagggctctcgagccgaatccttgcgtgtttagatgatgaaacaagtctccccatgacacatagttgtagtgatagaacagtcgagcgaacgtcgttgatacgaatttttaatttaaactgtatacatcaaaaacatctcaaactaactgactagatcatagtcctaagtcctaaccgtcagttaacagacataatcagatcgaactccccccccccccctgcccccaccagaattaggacggcaatgcacatcaagcgttcaactacacttccgttcacccgacgatcatctgatggcgaatttattcg

SEQ ID NO: 104598 - DNA, 700 bp, Oryza sativa
aaaaacacaaaaacgaaatggatattgtttgcagacatgacaaaccttagtattgataacatggtggagttccaaagcaaacctctggattgttgtatgctgaaaggtgctggaatatcaagtacatagagagggaaacagaaagcagcatgaagaaccctgaaattagtatggcccatgtgggtgctgcatattcggccatcaaaggcaggaagagcgcaggattgaccctcatgacagctggtaacacttccttgaagtccaataaacttataaggactcaacatcatatagtctccttaaccataaggcggagcatttcaattgaatgggcttggtatcatatacatataacccaatgctgccaccatatgaatcaaattcccaacccaaatagtttactatctgcaaggaaaatgtctaaataatgtaaatctaccaacagcacgaaatttcatatgagaattgggaaattgagtgactaatagaccaccctatttagagataacggtgaataattgagtatgtaaataaaatctccttgcctactccaacaggcctataggaataggagtgagcagaaatgtagaattacacagtgtgctgactaaacgaattcaccgttttaatagattcagttatgcaagaaaaacttctttcccccataaacacaatccaactaggcaactagtataggcaa

SEQ ID NO: 104599 - DNA, 1407 bp, Oryza sativa
aaaacacgtgcacgcaggatgaaagcccttaagtccatgaaatgggccatcgaatgacactctaatagaaccttagcaaaatatgatcatgccatgcaagctgtcccgtaaccctggaaattcacgagaaaaggttgcatgatgtacaattctgtgagacctaccggtggggcatggggggtcagctgcacccccaaacgttttgggggagaaatatgctacctctccctccctctcctttaatttttgaccacacacagcgcctccctgttaagacacaccattaaaaaaagtagaagctcttggatcaaaggaaaagggataatgaccattagatatatgaattgcaactgcctttgttgaggaagtttgctacgtgattaactgtcaaggcaaagcagccaaaccaacactgttgtccgtaaaaaggtaaagaagccaaaacaacagtgttgtccggaaaaaaattgaagcaaaatatgttgcgactcttgccaattgtcagtaattaaccacaacagtttgacaagccgtttgcagtgcatataaagaacacgttaatttcctctaaaaccctcctcataatctccttttctttctgtacagcaaaagcacttccaaggtacacataaaaaccttccaaggcttagtcatactaccaaaaacgttcaagaaaaaaacatcagaaccatgagttaacgttgagatcaatttcaggggcggagacagcttgaagccacaccagggcttagttctattaccttgtcctagctctctataaattcaagcattctttctaaaattaatatggaatttgcatggggtttggatcccagaactagggcttgagctctactgccctaggcctggatccatgctgatcaatggtgagagtaataaaattcagttgcaaagatgccatgcttcaaaaattccattttgctgatgatatctcatccatcaatggtcatatgcttccattgataggtaaaagatctattgtgatattgtacgtcgatagtaaaatttagttactgtacccgcatcctcattttaccatgaacataaatatgcataatcacaaacaaacccacaacatcgtgtggggtactcttagtcagtaataaggttgttggggcttgtgttttgtggcttactaggaatggctttgttttccaaatcattgtgttaaaatcaccctagacaatcttgtataaaatgattgcgcagattcagagatggatggtcctgtaaaatgaataggagcacagtatgctgcaggtgtggtgtgatcgaattatggagcataatattcaagtgctgaagtctcctgacgtgctgccaatggagattgatggatagctgaatgtctgaagtttagctatgagaactgtaatcctgtcactt

SEQ ID NO: 104600 - DNA, 924 bp, Oryza sativa
attctaggagtggagtagctgttgcggccagggttcaatattttggtttgaaattttaggaatcgcaacccccaaccccaaaaagatcgttaaaaaaaataaatttaatcaaaacttgtttaaatttcaagtttttaaggtcaaaattttcgggcaattcgggaaattttgtttctctggatgatcaaaagtatttttgatttgcaagatatagaactttggctgctactaaggctgcatttggtaccaccaattagaaacttgtctctcacgcacgtataacaaagcaagttattactccctccgtcccataatataaggtattttgatttttttcttgtattgtttgactactcgtattattcaaaaaattttggaattattatttttttgacttactttattatccaaagtactttaagcacaacttttcgttttttatatttgcacaaattcttcaaataagatgagtggtcaaacaatgcaaataaaaactcaaaatcacttatattatgggacggagggagtagcataagattaattaaatattagctaaaaactttttaaaataggataatatgatttttttaaaagcaatgttagtatataaaaattttataagagacgcatcgtattttagtaagcgtgcgaaaaaaataagagaaatgttatgggatgttccatacactcgcacgtactacaataattaggttttacgaagtccatgggcatggagtcatggacaacgtattcactaatcattgaaaagaacaggtgcgtgcatatgggaaaaaaaagaaaagagaaatagaaaactaaaaaaggatagagataataggaattattggtccatgtggtgtgtgccaacaataactcaattgatgatgtgtgcagcacaaggcatatgcgagcttcggttttttc

SEQ ID NO: 104601 - DNA, 1239 bp, Oryza sativa
tatgagaataataacatagctagatgtggaggaatcaccaaataatttaatcaatgcaataccatatagaatagcacgtatatacctaaactggttaccacttattagtaacccaacaaatccagtgcttaaacttgcccatcacatatataatatcactcatagaaactagctaatgtataatttaactataatatattcaggaatcacttggagcattgggtagtacaccttctaaagtcaaaattataatggcatggttctaattttcactttagaaggtgtactacccaatgctccaagtgattcctgaatatattatagttaaattatacattagctagtttctatgagtgatattatatatgtgatgggcaagtttaagcactggatttgttgggttactaataagtggtaaccagtttaggtatatacgtgctattctatatggtattgcattgattaaattatttggtgattcctccacatctagctatgttattattctcataaacaagttaaagatttatctatgagtattaatattttagttacaaaatatgaggctaaacttgatttaactaacctataagtcatgggtttaattatatggccatcgaatattaaataagtactagtattttcctatacatccattcatttgagacatcacttatacttagtttatgtggttgctacagtgacaaaacatgttaaatatatttatttgacatctactctactgtacaatatcaattttatttattagcacatttttaagttgaccataatctaatcatttgatattaatatattttattaaatagtgagttatataccattggaaagcttatgaatttagatgaatttaggttcaagtttcactcgaatcggagctaaaatgaataagttatgctagtttaaagattcaaatttgagttaatccgagaaattgtaaaaatgcactgttcataaatgatttatttttaatcggaaacattatccaaaacccactgtggttgacatgtgggaccggccctggttgacttagggtcaaaccttcttgtttaattaccagtgggtcccgcctgtcataggaataaaatatataattgtgttttcttacattttaactatagggacccacctgccattgagtgggctaatcaccgttagggataggattactgtgcgctaatcacatgtgggtcccacacggtttctctctctcctcatctt

SEQ ID NO: 104602 - DNA, 1175 bp, Oryza sativa
gtggatagatttatcgttcaaggatgagtgctgctactgatgacaacccggtgagcaaattcgctcaattgcagcaatcgcccttctccaaacacgggtttccttaacattaaaatgttatcaaatggaatggattaagagaagcagaggttggctaagccaaccaaattgtttactaaatccacaccagctggcctgattagtcggaatggtcagcagctgatggcgccgttgggacttcaggaatcagaacctgcttttctgcatacccaacccacaaaacggttagccaccgacactgcgctccacctcatgttcactggtctgtgcttaatgatgattagcaccagaactgctgctactattcgaactttcgaaagagggaaagcgaaagtagcgtacacacgtttatgactccattgaaacaaagggttcttggaggaatataatcctatgaattcttttattgctccaaatacagagatttaagagtaattttaacataaggtccaacctattggaaacattctgtgtgtctatctttcttctgtttcgtgtggtttcttgcgtttcatccaaacgattatttctatagattacctatgtttctcgatcaatatgatttgagatgctgagatgtttggttgatgaccaatttttatatgtgttttgaatcttactccctttatcccaaaatataacaacttttaacttttaaaatttattttaaaatgtaacaacttcttcatctacattctcttcttaacaaaatataacattccaccatttaaatttaaattcctacttgactaggaaaagtacctgtcacacaacaatgttgtcagcaaattagcaagccagcactcagttcggttcgttattattactacaacgacacttaggatatctgcatatacatatagtgcgtactttagatcgtcatgatggtgcatgaaaccattttcgttaggttagagcgggtagcacagtggcgtaggttttgatgcatgagaaattgagatttgaggaacctctctcgttgagtcattttctgccttggcagcgaacggggttcggtttgctgtgttgggtgcgacgtcgctttcatagctcgcatatgcaagatcctttgtcttgctcgccttggaacatggggcttttttcttcccgtgggg

SEQ ID NO: 104603 - DNA, 762 bp, Oryza sativa
ttcctgcagcccttttttatacaatgaaagtaggattaacatgataaaaatactatatggaaccggttcattaataatttggaagctctccatctatcgctcttatttaatttgaaaaaaaatgtatatattttgtatataggtggtgaagaaaggacaattgcatttttgaagagggagggtgcggagattctggggaacctcttttgcatggtgcttctgaaaaagggatcatacaccatcacttccctgtgaattacatattgaaaccatggagaatgggtgtgaggttttaccagattatcaaatttggtatatttcaatatgtatgaccacttgtccagctagttgaaatggaatttatgattttgagagcatattggttaagtactttgtacctgtgcaggtgattataaagaccctcacagctagcctatccctgattcttcaaccttttggtgcatattgtgatggagaattcaatttgagatgcgggtaagacaattttccattttcacctcttgtgtcttgagttcagcaaagcaaaaggcattcacctttataatttgaatttcataatgcttggaaaaattttataataggaataatgcagagacagataactgcatagaagagtaatgcaatcttcttgatgactctacctgtgtcactgcataagctgttatcaccttgtctttatccccagaatatatgtgaacatctagcagtccacttcaatgaattattttatgcatgcttatc

SEQ ID NO: 104604 - DNA, 1277 bp, Oryza sativa
attcctgcagcccttcaaaagattaaaaattatctactccctccgtcgggagtcctaaaaataatacaattatagcattaaaaagacaaattcgaagagaaagaaaatgatcttagatatggatagaaattctaaggatgggtggctggataggaaagtactactctagaactgcattctttttaacaaattcagtgctatagttgcttttttttcgacaaaggaagtagtttaaaataactagcattgaccttcttgttgtctcaagagtatggatagtacctactatatatatacagaccttattgttgggagtccacttccacattgctaagcaacacccaatacgttaagttgttaagctactcccttcgttccatactactccccctgtttcataagtcgtttggcttttcttcttagtaaaaattctttaggtttaatcaaatttatagaaaaactttctaacatctacacctccaaattagttttaataaatttagcgttgaatatatttttgataatatagttgctttgtattaaaaatattagcataattttctataaacttagtcaaacttagaaaagtttaactatgaaaaaagtcaaacaacatacaatatgacatgggggagtataaaataagttaatttggtcctaattcaaatttctctaacattaacggaatttatgtgggtgaagcacactcatgcaccaagctatttgtgaaaagcaacgggatttcgcacgcagttacctatgccaaccgcatgcgaaaataatttcgatgaaaaaaaaattcctaaaaaaatttcatcgaaaccctagatccccaattccctgaaaccctagctcccaaagccactaccatcgtcgcagttccaactactgtcgctgcagctgaagccactaccaccgtcgctacagtcgaagctaccatcgtcatcaccgctcccaaagccattgtcgtcgtcgcggccgcagctgccgtcgccactccaattgccatgccgtggggaagaactgcccgccacggggccggtggtggcagatccgcccgccacggggacagtggtgtggcttgctccctccccaccacttcgcgggagcgccacaatagatccacccgccaaggggccggcgcatcgtctgctccctccccaccacttcgtgagggaggtggagaggccgcctttgatccattacctttgtgctcggccgttgtcggatggaaggggggaggcgataggtaagtgggagaaggatggccaacctcc

SEQ ID NO: 104605 - DNA, 973 bp, Oryza sativa
gattaattaacaaggctatacataagcagtgtggtggcggttggcgggacttctaaacacgtaacggttaaaaggaaggacgacaggtaggtcgtgaagcaatcgattaaggcggttggcgggacttctagaaagtaaaaaaaaaactacaataataatcatatttaatttttaaaatctcaattacaataaaaaaagaggcagcgatcgggtcgtataggagtacaatggcagagccgccgatggatggtgggttttttagaaagtaaaaaatgaattccaatgttagttatgttcgatttttacaatcccattgacaataaagagtatagtgacaatgtttgatgggatttctaaaaattataaaaaaatgaaacccaatgagacaataaaccataatgataatcatgtttgattctaaaatctcaatgacaataaagaagagcggcagcgagcgagccgtagaggagtacagtgacaaagtcgctgacgttttggtgcaacttctagaatgtaaaaaaataaacataaactataattatgttcgacttttaaaatagcaatgacaataaagagaagatgcagtggacggtcgtagaggagtataatggcagtgtttgacggaacttctagaaattataaagaagaagcccaacatgacaataaacttatagtttttagatccaatttttaaaggttccaaggagaataaatagaaacggtggtagatcgagcaagaaaataaagaataatataacagaagtaaggagtatcaactggtgtgacttttaaaaaactgtaaaattggaaacacaaggatgataaggtttggcctttcaaaatcttgagacaacgagataactatttaataaattttaagtaaaatcatattaaaaaatatataagtttatatgggtgctagccgcgcaattgcgcgggccacccaactagttgtaatagggctgcaggaatt

SEQ ID NO: 104606 - DNA, 671 bp, Oryza sativa
ttaaaaactctactatgatataattttgatggcacgaaattaaatttattacctccatattcaaaagtacttgattatcattttaaatttttgtcacataaatgatattctaataaaataattattggttaaagttttttctaacaaaacaaaatacacattatattttaaaattaaaatatagagagtattactatattttaactaaactataattatagttatagtgtaatacaaattatataaaacttacaaacaagttatataaaattcacaatgtagttgtaggttagttacattataagttataccatagtcaaagttccaaaatgtcgacagttttaagtctcttgtgtactcataaatttttgcctatcccttcgcgcttctaaattttgcctcatctcctacataccctaagtttcaaatttgatccctcaaaggccattccgtgagttaacgattagctgaccattagattttataaaaaaaactagctatgtggggctcactttgtggggtccaagtatcaataggtgatggcggtgaggaagactcatcgccaccgctacaaggaaagtttaaaagagtaaaacattactcttttctcttacttggagcgtgtgctagttgatttaaaaaaggtggcctccaatgtaaaagttgattca

SEQ ID NO: 104607 - DNA, 855 bp, Oryza sativa
cagcagcatatatagatatctacctcttgtttctttttctctatttttcgatccacttgttgattctgaatcttgtgagcatgatatcattatacctcttgttttttgtatttacagaggaattttgtatcatacttctgaattttgctcgtggaaaagcatattatactacacacttgaaaagctataaatggcttatctaagtaatagtggtatatactactaaatctaagaaatagtgtatctacttatttaaagtatatgcatcatatactgacgaaacaaaaagagaagtatatgcagatactgagcaaacaagaaagcagtatgaactcctttagcgaggagatgcagtatatagtgaccaaacaaaatagtagcatacgcagcatatactgaccaaactaaaaaaactagtatatatatgctccttcaataataatgtagtatacactggctagaaatttcaagaaaacagtatatactgttcgaaggaataagtagcatatacttataagaaaacagtatatattgttccaagaagcagtatatacttataagagagagtatgcgaacatactatatactacattgctactagagtatgcagaaagcagtacatatgtacattcatatatatactttgtgaaagaaatcagtacattcagagaaaaaatcagtataccccagctcttaaagaaatcagtatatgctcggtcaagaagaaatcagtacatactctttcggaaatcagtatatgctcggtcaagaagagatcagtacatactctttcggagaatatatcagtatatactgaacaaaaaaagtagtatatgctgctataattaagtaaaa

SEQ ID NO: 104608 - DNA, 1139 bp, Oryza sativa
tgatcagtaatttcaattgtggacttggccccaaacctctggcacatcttacaaaactccggccaggataaatgttctgttgggatatcgtaactagatatccattggtcagcttagcctgtaatgtaggcctctgccattaagaccttctcatcttcaagagtttgtgtgagaaagaagtatttttctactttgcgaatcgaagccttaggataatcaccatcgaaaataggaaaatcgacatgtttcctattggaggtggagtgtgtgttcacaatgacaatatggttcaccaaatgctttgccttgaaaaggtcctctgtcaagtagaatagatggatcacaaagaggccaaggtggttgatgttgtttaggagctggaagccaattgggattgtagggtgggtaatagtattgtgggtaaggtgggtaaggggaagtgtcagggttacgaataaggcatactctctatcctacgacttatgagatatactgataatgtataccctcacgtataaggttggttcccacatacgccgttagaaatttgcctcagattatggaaaatatttctatgagttaaggaattgccgaagtcctactcatcgcgtcggtttacataactccaagtcttacttgggggtcaaggtattccacagtataaaagggacccctagggggaggcaaagggcatcgcatctcatcgccaacacacccaccaaagtttacgaagccagagtccacggagccaactcgccgggagatcttgtcgaatcccttgactacgatctcgtcggtatcgcctgtttcgattactctctttgtaatctgttctcatcatcatcaatcccatataaactggactagggctattacctgttaaggggcctgaaccagtataattcttgtcttttgtctattttgatgtcgtactatgtagacccctgtttcaacgtaccccaatactctattcattcggtccgcgagtatcactcgtcgacaggaagcatatgcattaggtggaggtcctccttgagtatagttccatgggccaggggagccaaattgcatatgtagctgccgccctgttggtgttggtggaataggcgggaatattggtggtggtggtggtatggttg

SEQ ID NO: 104609 - DNA, 929 bp, Oryza sativa
tagtatacctaatttttatcatgtaaaataaaataagctgttgattgtttgattgatcatttagtatacttgtgagacacatgcacacatgcatgctgtaattacttgcataattggaacatcttgcaaacttgacttgtgaaacaggttgaactgtcaactgattctccaattcttggttttatgtatggtaattcataaactaatgaaaacgccctttcgccttatgtgaacaacatgaatgttacattgcacctttgtccacttgataggagcaacatattttcctggggcctccaattcctattcatcctaacaattattgtcctcaaatatcttgacccacatggacacaaacagtgaatagaagaaaataaacaggagaaaagaaaatctgaaaaatacatggggacagttttcggtgaaaacagtacatatacagtacaattcatgactaaatacagtctaaggtgcaactaaccttgcagtgagtcttcacatagaagacacagcaatagatgcccatatatatcataaactctctgcatctcctttgttcttcaatatttcttgtaatctagggaggaattcatcggtcgtgttctaaaattttattgcagttttaagataagagtgaacttgaacaggaatgcaagttttcattttatatgataacttgaataggaccggaagttctcattcttattgctggtgttatctcacaatattgctgttgtcagatagtaactgtgaaggttttcatttcctattcctattcatctacctttaaacctagtgatttagcatttcttccatttgatatggataccattacgaacgtagatacaactatttttctaatgaaagaagtatggagtatgagtgcctataaaaacatcatttggccatactagaatactctgaaaatt

SEQ ID NO: 104610 - DNA, 2581 bp, Oryza sativa
  unsure (1)..(2581): unsure at all n locations
cgcgtgtcgggcgccggccgcacgacgacatggtggcatggaggcgtcaaggcgagctcgaccaacgaaagagccaccaaggtggccgcatggtggctaccagtgaggaagaaggcagcaatgcttcgttacaaggagctagaggcaaaggggaaggattgggggctcggggttgagctcttatagtaggtcgcatgcaagtgggcgctcggttggcgaccgcgaatggcatctacattttcgtggacaacgcgaaaacggcggacattcaggaggcaaaggacggccaaagacagtggataggacagcgaaaattgaatgcgagatgctggaggagcagcagggcaagctggcacatggtcaagatggggctccaaggcgtagatgcagtcgtcatggagctcaatgttcgctaccgcaccaggacaagggggagagcaaggtggccttgcccgcgagagaaaaagcgaaaggaggaggaggaaagggagctttgcctccctccattttgggcggcggggctggcgagacatgtaggagcggcgtcaccacgttggtggcttgtggcatgtggagtcggggacgaggtgacaatggtggatgacagcaaaagtgatgaggacacaactagcccagatataaccaagactaccttatgtattaatcaaccaaaggtgcatatgctttacattagatttacttgttatatatttgaacaaacgttgctacacaatgagttttgtatgtttttgtttgcagaggtacttgcttgggcaaaggaaaagaggccgagcataacgaatacatggataataaaagaagttgattggggatcaaaccaagacatcctccaagtctacttctacctcaccacattacttttggtccatataagacaagaaataaaattctacacgttttggattcggattcgggcctcctgacagcatcaactacaaacggacctacccactgatctagaaggaatttcggggcccatgagtacttgttggaaagtgtgacatcctggcctagggcttaataggattaatagaatactcatatcaacaagttgcaacttcttttccggaagccgatctataaataactctgaggttaagcgtgcttggcctggagcaatttagagatgggtgaccggccgtgctcagcccaagggggtgtgcgccctagggcaaccctagggcgtccctaatcatatttattcagtagccgtcattgtttagagtcgggttttgcttagattaatctgtcaagaacagtttcgccgctagatcagtttgtggaatcccaagttcgagtgtttaatcattcaaatgcaatttggttgcaatctatcttgttcttgcttgtgttcttcgattcacatgcaaggattaaccttctcagcaaggtcaaccgggtttcagcatggttgataatcaggggagacgtggtgctgtgatagcggagcttagtagcatgttcgttcagaagccggatcgagttgtgtcgcgactctgcccaaattgactgtttatcaatacctattggaagatcgggacataacatcctcatcaaaaagggggtggggatggtttggcaccatgtggaaacaagcgggcgccagcgcagagttgatggtggcagtgtcctcgacggttgatggtggcagtgtcctcgacggtcggccatgacaggtcgtgagcgcgtgaagtgatggcagtgacgggatttgaatcggcaaagtggcgatggccggcgcatgtgagagagagagggggagggtattccccaaaaaaagagagagggggggggaggaagagaacacgcagtggagaaagaaagggggagaggagcacgtctcctcggtgggggcacgtgcggcgcacgtggagagggagggaggttaggatgctagtaaaaaaatacttttttttagaacaaactgaggctacagcctgagattaggattttattaagaaagctgagagtacagcaagtcttacagatggtgtggccacgaggaccgagggcaatagtaaaaagaaaaatattacccgggttgttaagggctgtggggcgagctgtttacttagacggcatgtagggtgctttgtgtgtgtatatagactggtgattccccgcactttgctgcagaaatttctaagtaacttttaatatttttttaataaatgagctaaaagtaaaaattatatcattattaacaataaataaaactggtttgcaactatgttcagagagatacatttagtagactatgtaagtagatgaaatttgatatcatacactttgattatatggatgaatatgtgttaaggattataaaaatgatagatatatactacctccatattttaatgtatgacgccgnngactntttatncanncggngaccatttgtcttatttaaaaaatttatgtaattatcatttattttattatgacttgatttgtcataaaatgttctttaagcacgacataaatattttcatatttgcacaaaaaatatgaataaaacgaatggtcacccgttgttcaaaaagtcaacggcgtcatacat

SEQ ID NO: 104611 - DNA, 764 bp, Oryza sativa
aacaaggtaattttttcatctattgttcctgcacttctatatttctttttacaattgcgtccagtagtaactttcatgatcagcatatcctgcctaaacagtcactaggatctaacacttacataatgctgtgttgattaatagtaatggttgcatgcatttgctcacagaagtaaatcaaattcatgtgtacatataatttattaatcaatatttatcatctcagggctaaatttgacttcaattcttgaatgccaacattatttgacatttaccttctatatcagattggtgtgtactttgctatgtaaaaattcagttctatagaccagtattatccaaaatttgtgacatgcaagccactatatccaatttttgccactagaataccttcaacaaagtttagacaaaatttgggttgcacttgatgccatgttaacatagccttctcacctataataaagctaacatccatggcaccttttttttttattgcagcatgagtatcctaaatactgaagcatacacatgtctggataggagccttctcattgaaagaattgaagatatacaatacaaagaaaaatgaagtttttagccataatggatcaagtgattcaacgttttggacttacctaaattcatcgattgatcaatatatatgttttgtatatgtatctagattcattaacatctatatgaatttgagtaatgctagaaagtctaacattgtggaacagaggaagtacttttttaatacacat

SEQ ID NO: 104612 - DNA, 1178 bp, Oryza sativa
tcctgcagccctatcatgttcgaccaaaagtgcagtttatcgaaaatgcagagtttaatattacactacgttctaatttagagttattttttaacttccgttaaacctttgatttgcactactctgtctaaaatatactccctccttccttttttatattatattggttagttaaaataaacaaaagaccagagggtgtaataacgtttagctacgtaaatgttcggcaggggtttcaatttctaaaaactaggtgatatctcgtgctttgctacggattaatgaatgagtatatgttaaatattgttgaaatgatgaaagttgaaatattgagaaaataatgtgaggaagatgatttgacatatacttgtcgatctctataataaatataatattatagatgatgtgtcatgcttgcatgagatttaaaataggctagaatagtaatcgtaagtgagtgaagatgtggcaggcttgcatggttttttaaatgggctagaatagtactccctccgtcccaaaatgtaagtatttttagctataaatctggacacttgtgtgtctaattttgactatattttgggacggaggtagtaattgctagtcggtgatgatgtggcttaattgtatgttaagttttagtttttaataattgtttgttggtaccaactatagaaagtatagataacaccaacagtagagtctgaagtgtgcatgtggagccacatgcacatatctattgcgtgcgaacacaagtacacatcaaagtacacatcaaacttgttttcgtctattatatttggttgattaaaacttacagccaacttctacatatttagtaccgtgaaaggaggcaataaacttggtactcgcagttaggtcgtcataaggaagtatcaggtgctatggaacagttttgtgctcccgaactaccgagcttcaaaaatgcatccaaaaagtcaaaaaaaaagtgaaaataaaatcagagatctgcagcactatgacatgtatcatcacactaaaaatcaaatcaaatacgatgtaagtagggagaaaaaaaagttaaatcttaggtgaatagtaaaatgacatgtttgaacaccgttggagcacgaatttatctttttttttccctgcgtacatcatattttaagctgatttttcgtgtggggctgcag

SEQ ID NO: 104613 - DNA, 1463 bp, Oryza sativa
cctgtccagaaccagccagggtacataaacaataatttgatacagttccacgacttacaaaaataacaaaataaaacttatacgcagcggaaaaactaaagaactagacttaattttcacgaccaaagcgaagtttcctccatagaccacacaggcaaccctcgacgtctagaacaagctcaatcctcagagaactcatcatctgaaccgacttctgcttctgggggggaggattaagcaagactgcgtaccaaccaccgtactcaagtcataccaacgggaaggtatgatgcaaggatattcaaaggaatggctcaaaggctagtttgcagtaaaagcagcatttataaatcataatttgaaagaagtaaaaatagtataagtaattaagcaatattaacatcatcactgtccaacgatatatccacgttgcaacaagcccaaccaaaaccacctaaactacaccagttctaaaagtcaaattattaagtgggactaataacggtgagctagttgatcgcccaataaccatgggcacagctattcgaatagtttactctgatcagaggtgtacaactttactcacaagacatgattccacacatgttaccatgccccgaagtaccactgcgatactgcaaaggggaaaatcatgataaaacccttcatataactctccctaaccgaacatacccacctcaggtttcaccccctccttatgccaagtcgggcagtccgctctcgtgcctaggtaaatccggctatagcaaagcccaaaatccaggtccgaactgcaccacctcctctacccttgccatggtatgttatctaggttaagttatactctagattcagcctggagtccatctggcatgtggtgagtacgagtatatattctagggattctcgagaaccgatccttaattgtcatgggcacgacttccagaactcatgcgtgtacccacgacccaccattaaagcaaattttagtttaattaaaccataaccatggtggtacatcaaaatataattaaggactgaattaaaatgaattccattgtgagctagttggtctaaacatggctaagcattcctaaaccaatcatctagtcaattataacccaagttatcaatggcataagataatcaacaggctgagaataataggcatacatcccacatgacattctaaaaggatgcaatttgatataaagcaggggattttgtaaaataggctcaatatgatcaatgatgtatgtatgacttgccttgctcttgagctgactgaacctcggcaaacacttcgaaataaacaggagcgccggaattgatggaatctaaacgacaaacaaagcacacaagaaatacaagcaataaggctactgaaacagaaaagaaacaaattttaatggattcactgcaatttgaatggacaaaaacggagctcggattattgagttatg

SEQ ID NO: 104614 - DNA, 1061 bp, Oryza sativa
gtcacgttctagctcaccaaatcgacaaaatcagacggctatcttgaattaattaaaaaggccaataatgaaggagaaattatgctgaatttgattatattatagaacattgggagtaaagatatggtcagattttgaaaaaaaaaaatctactgtcatattatatggacaaacagcaagaggacgaaactgacactgatggctttgtggagaaaagtagtccttgtcgatgttgttggtgtctcgtgatctctccatccgaagattaaaaaattgatgcgaattgacggcgaaatgaactcagttgtacacagttgtaaggccatcactaaccctacatatcaacgagtgtcaatagcattaaatacattgtcacataggtaaaaatctgatgtggcaaaagagttaatgaagaaaaagataaaaagagaaaaaatcatttatcatgcaagaaaccatctctacacaagaatcaaaaataaaaataaaaggataggtgaataaaaagagagaagagaaatgattggataaatatttaatttaaagacaccattcgttggatatataaatagtgtctgcataacatgaaaagcatgaaaactactcgatagtttctgggttgggaatggcttaagatgttgatggcttgtttgctgcgttggaagtattttgatgtcatggcctcatggcggttagacttatcccaatgcatcgagtcaataaatggttgtgctaaatactagtagctaatgttgttcactaacttcaaaaagcttacatcacctgcgtggaaatgtttaaaagattgcttgtcgagccctcgtgtcgagggatatacatacagtaactgaagttgatggttgaaagaaacatccatgccttgccccctttgccacaacagctaaaacatatagtttcaacagaagtaacaatcctattcgttgttcaaatcggtgattgttaggaatacctcaaggacattcaccgattcacgatgaaagacacaccttacaggtatccgtagagaatgtcccatataaattagagggctgcaggaattc

SEQ ID NO: 104615 - DNA, 630 bp, Oryza sativa
aggacctagccgatacggttaaacctaatcagctgcggctttatgatagtcagttaaagcaaaaactctaaatatgccctatcggctgtaatcctgtttgtttagtttttatcaatcattttaagacagtattatagtgtcgagggaagtccctcgatagcgggaggtcgtgaggcccccctttcgtgagttcggccgggggaagaagctcgtctcttggaaatctcgtatccgcccctagggctactagctagcttgcacacaatcgaattatactggttcgggccgctgagaagcgtaataccatactcctgtgtttgggattatggttgagtgttacaagggttccttaactccggagagttctcttgctcttcttctcctagagttcaggtctactcagcgtcgtccttcttctcgatgggcaaggacctccttttgtatctcaaggggataccacatgcaccgcctctacctactcttctttcgggtggggacccaccctatcttgaccggaactcgacccgtgccttcgcctggaagctaagccacagcttgtcctcaagtggggcccagcgccgtccctcgcctgacacgggggacagccctgtcattcccccattaatggat

SEQ ID NO: 104616 - DNA, 587 bp, Oryza sativa
cactcagtacttctgatacacccatgagaggcagaggattggagttggagtagaagatgaggagcacgatggaagaggggacgcgatgacggcggtgaccatgaaaagaggaagcgacaactctgttcgttctcacacagagagtagcgatttttttttggtggagggatgtcgaaggaccttgttgcaaatagaagattctgaagaatcgttaagatgtttgaccaattgaaggatctaacggttggcattgtcagatggagatatcggatggtccatattttattaatgacgtggcgcagtaattttgcagaaatgatttcacatttcacattttgattaattaagatttgacacataacgctatttgtgtcactataatcatattcacagaattgtatgattgtggtgccgtgtctttcttaaagctgacgatgagctgcacatatatgaatgacgagaatattgtttcctataaataattctgtaggacaggaaacaaaattaactaaatgccgtctaactaaacagctcgcatatcctatcttactctaaagttataacacactaatcctaaagctccacat

SEQ ID NO: 104617 - DNA, 1521 bp, Oryza sativa
tgattagttgacctgtatatgtggtgttaatggatttttttttatttcaggttgttggtgaatctggtcttttcacgcctgatgatgttgcatacgtgcagaatgctggtgtttctgcagtaagtttactgattacccgttttcagctaagttggtcatacatgtgcttcaaatttccagctgaaatattgtacggaacgtctgaaatggattaagaatatctgtaattggacttaatatttatccacgatataacaaataacactaattctgggaaattttaataagctagtttcagaacaattttactatattctaatttagatgtaattgtagtcaaaattgcaacctttttcctcctcccaattttttttctggtactttgttgtcgtttgaattatggtgttttggaaaaattcattttcgtttagagacaacaaaagaaacactagaccgatggattgtgtttcctcctctcagatattaaattttgaattatgaatcttttgttactttattctgaaataaatccctgactttttttttgcacacatagattttggtaggagagtccctggtgaaacaggaaaatcccgggcaagccattgctggactatatggaaaggatcttttgcactgaataattgatacgcgcggtagttactgtgtgtaccaatatgggctggagaaaaaaaaaagtaaagcctacaagcctcaaatgtaattatgaataagggccatgctttctacaagtgtaatttcttttgttcacatttgtggatttttttttatttttttatactttttttaaaaaaatgaaaataaaccatctagaataatattatctatattttcagaaggaaaatatgtgttccaaatcattggtatgatttctattttttcgaaagtttgcagtgcaaccatttttgcacgaaagacacacgtaagcacacactatcacctacgcacatgacacttacaccagcgagtgcacctcctttaacgaaatgaagcaatggaggaataatgatgaattcatcaacctcgccaaattcctgatgaaatctcacacattaatgtaattatgcgaatcagaatttaaacccgcgactccattgtaatataatatgttttttttttttttgctcacagacagataatgtttcccaatgtgcagtgagacaccaaaattaaatataaaagtagcaatatcttttgtcgtataaaacagtattaatttttatatgcttaaataataccaaatctttgtcataataatatacatattctatttgagcccccaatgctggtgtactaggccagactgggagggaagcaaagacgagtggaagctggtctatctcgggccagtgtgcaaacgagagatgggggaattgggttgggccgaaagaagagtaaagaaagggaatggacgccgaatgcatactggcatttgataatctccccagatttattttgaagaggaagtttgagcatttcagtggatttttttgctctcaa

SEQ ID NO: 104618 - DNA, 847 bp, Oryza sativa
ctaagccgatgactactccgggcttaccaaatttcactgttaacagtaaggatatatgttcttttggctttagtgtatttgccgattgtgcacatacgtataggagtatgtacttatatgtatgtatacataggaatatgttctttcgggtttatccgtttttggttttctcaaatcatttttcgtacatattgtgaggccctgaatgtactaaagatgatgttcaaacttatctgaagaaaacagggattccagagctagctcaatgggaatgatggatagctaagatttcctgataccgcttcgctgtgttgattacacaaatccaagggctgagatgtgcctggacggtctacagagagcttttcgccatactgtagtcgtcatcaagtttgtcctctagttctggcgaactccatataaggcgcgacgctagctaatatcagtatgcgaaaatatgaaccctagttttattcccctcttttgttcttgcggcacactctaaatataatccaatttcagctctatttcagcatttcccatattaattgttgtgttagggtacctaattagctagctaccagcctaaattgtctaaatatttctgtttttcgtgcatatttcttcaagttcctaacaaaaggtatcagagctcagtcaatccttggcttaacctatagatctggcaattctaggctggtaagggttggggaaacaagtattccttgtgaaattccatagccaggccaataaattagatctatgggtggaggaatcgagcagtacagggaggattggggaaggctgtggttcttccctgtgaaatctccgaatctgtgctattcaa

SEQ ID NO: 104619 - DNA, 592 bp, Oryza sativa
atttgcatatctctctaatttcatcctgctctgaattcttcaataaaaaaagaaaccttgctaaccattgggttaatttggtactctcgccgtttgagaatataagatattttggttttaacctaagtcaaactttcgaagttccaccaagtttataggtaaaatagcaacatgtctcgcatgaccaatgatattataaaagtataatccatttttgtatttaatgaaattaatttggtgccgtatatgatgtttcatttttctataaacttgatcaaatttaaaagcaatttaagttaggataaatagagaacatttcgtatgtgcccatcagttttcgctgaattctttctatgttgaattttagttttatcctctacgtgcacatgagtttttattttgatccccactatacccatgccgttagttgaatgtaacttgaccgttaaatttttcaaaaattgactatattgcccttcttatacctactttaaaaacataaatcccaatgtgaaagaaatctataataaaataaaaaaggaacaaaattatatgacaccggatttaaaacataaatctcaatgttataaac

SEQ ID NO: 104620 - DNA, 688 bp, Oryza sativa
aaacatacgcacacaactcaaatgggaagaggcctaattgggccaggatgtcacactccaacacagctctccgatctccactgctaacctaccgcggccctgacctcctcgagaatcacttacacttccacaactcttgattgcgtcatgccctattgcttatacaccgccattacagcaatccatccggtaacacctcatcatcaacacctttccatcagcttccaaagtccacccgctccaactttcgattgatcgcctatcagtttagtcatgagccgaaacgaagaaatcacatgttgtcatcccatgccgccgaacaacccgagcactacatctagtagtttgcttgtcaaatgcagctcatcaaaaggcctggacaaccccgttcggagcgtttgatttcaccgaccaagaacaccgatcatctccagcttcgatcaacctgagcgtgtggccccacgtctccctgttgagagtagctcactagaaagtccaggccacctacctgaagtgtctgatccaccaattggatcgccaatcgctttcgccaccatcaacccgagcaccacatctggtcgtctatttgttgaaagtagccagtgaatggtttagactgccgccctaaagtgtccggtttcaccgattgaattccgttgatcgccgagatgctccaccttgtgtcatg

SEQ ID NO: 104621 - DNA, 691 bp, Oryza sativa
attcctgcagcccttcctttttttttttccttcttttgcttaatatggctttgatttttttaaaacaagagtttttttcatggagaggaccaaaatgcccctcacccctccctcccatctctctctcctccggagtccggacacctctactctccccgtcttctctccctctctcctcatcctcctccgtgttcctgatctgcgcacgcacggccgccctcctcctcctccccccgcgcttcgcttcctcgcgcgcgcgcgtcatcgaagctggcctagagactcctcggcgagaggacggttctcccccctctcccgccccccgcgcgcgcgcggcaggtttgggagatcgacggtggtcggtggcctcctccctcctgtcctgcccggttcgagtcgaattgaaaggtagtattatgttcttgtctacgtagctctctccccctcctcaattccacctcatgagccggcgattggggatttgatggtttatcttgcccccctctccaaccagtttcttccgcatttccccccaaattttgctgaaaaagaatttgggggcgttttgggcactttatattcttacttgtatgtagtacaattttatttacgagatcggcaaaaaaaaagttttcttttattgcagaaaatcaagagaggatgatacgctttgttggactttccctgatct

SEQ ID NO: 104622 - DNA, 720 bp, Oryza sativa
ttcctgcagcccaaacgaggggctttctctcccaatcacccagcaacgaacgaagccatagctgagcaaagaatgacaagggtaacaatggcacataccatatcaaatttaactttttaataagaagttatctgatcaagatggtatggctacaaatagaccaagcttctgaaagtgaatatacccaacgggcgtgctaaaaaaaaaagcaatcaattgagagtcaaatgttgctttcaaaaactttatctgctcttcagcacacctttgaggaaaatgaaatggcatgactgcaagctaacatttaacgcttagtagcactaaataaaagacatatgtaacgagagcagaattcgtaattcaaaattgtggtgccaaagaagccaatcaaggaagcacaaaattcatatgaagttgtcaaccgctagaaaaatgaagtaatggatctatgtttagtttgtgctagttcaggcaaaacaatcagacatgcacaggtttgaaggaaacccttccttctctgatttcttactcaacacagcagacttaaggccaaaatgaaaagaatactttttactgcacacctgcatggaacaaaacagtatgaagaaccaatcagaaaataaggcgatcacaatgttaacttacagatagtttctcctcttcggttgtcaatggcctgtctacacggtatgttttgtttagtcgtctagcccaccacca

SEQ ID NO: 104623 - DNA, 2279 bp, Oryza sativa
agtacaacttcacaaggaccaaatgcaatggttggtttacatgttctccagcacaatacttcccatgacaatgactaggaacattcctaagttgtagtacaaagatttccttcaaaacagcagatgtcatgccatgcaactcatttccctaattaatgctcatcatattttctgaactatcaaacttaattagcctctaatcctaaacaggatgacgccatatggcccatatccatcttctgacataattttccgaataacaacagtgcacgaaatgtcactgactaaaaagaaaccatagaacctcgccaaaaaaaaaaagagaaaaagaaaaagaaagaaaccatcgaaaaagaggcataggcatcatccgggattcaaggaaatctggaaatatatggtggtactaccttgaactcgtagacggtcaagctattcggaacgtagaatacgtcgattgcgctgaagtcgacaagatcgaagtagcggccatcgttcccgatacgcgagcggaaatcctcgtcccttgccacctataagcagcgcagagcaagaaacccaagaaagaagcatcagaatccaaaccaaaccacccccggcccgctccacggattcgtgtgcttgtgcgggggagaatccaatcggtcagcgccaagaagaggggatgaggggaacggagaagatcgccgcaaccacgggatgcaccttgataatctggtggtgcagcggcagcggcggcggcggcggcggcatggcagcgatggagggttttgcgcggcggtggtggcggtggtggtggaggttttgcacgggaggaggtggggtgggggagaattccgttggcgtgctggatagggctgtcaaaaaaaaaaaaaaaaaaagctcgagactcgcaagctactcgaactcgactcgttataggctcggctcgctcgagcttgaaatgaggctcgtgcactttaacgagccgagctcgaatagctcggtaaagactcgagtactagttagtaactgctatgtctcatgctttaccttggtctccaataaaaaatcatcgatgcttttccttggtctgctactactccaacattagtctatgtgaagtacagaagcaatcaattcttgaatactactcccaaagctagtagtagtagcaaagcagactactcctgtgctagtactagtagtacagtacactagtgctcccgtatggccgtatctctacacaacgtgcccagctgcagctctctgtcagcttctctactttttgaaatatgtacacatgcttgtgttgcgttgatgcgagctcgattaggctcgaggctcgtccgagccgatcccgagcttgactgcaagctcgaaggttagtccaggctcgactcgagttcataccgagctcgagcctaaggatctaagctcgctcgagctcggctcgttgacagtcctagtgctggatgcgcgttagaaatgggaatagcacatgagagcatctccaacggattagttattttgagctctccaaatactcatttggccagccatctaaaaaaaattagagagtcaaatttatctatcattccaacagtctctctattctagccatgggacccacgtgtcagtccctctatccttcttttccccttctcagggccgacgcaggccgggggacgccgccgccaccaccacgacgaagcgagacgccgccggtgccatccagcccaccaccgctgccgccgccgaaggcgagggccatcccgctcctgcgcatccaggacccaccgccgccgccaccacgacgaagccgagacgccgccgccacctccagcttcaacgacggcgacggtgtgcagggccaagctcgcctcctcaccgccctcccgagccgcacccgcagcgctggggaggtgtaggcggaggcggcggaagccgcgcgacggaggttgccccctcctcccgaatccacgccacgctgccccgaacccacgtcacgccggaggcaacggaggtcgggcagagccggatccaaacgacggcaacggcaacctcggggacaacggcggtggatggcgatgactggcgacggtgcagacgacggcgacaacgactggtgacctcgacgacgatggtggcgctccggcgtgggttcaagacgtgcgcagtcgttctctccgccgccggcccgcccttctgcgccgtatcgaggagggcatggctgtgtcagcggtggcgttgagatcgtggctgtgcacggtggcggcagcgtcgagtcgtggctggag

SEQ ID NO: 104624 - DNA, 1544 bp, Oryza sativa
tcagcctctcctatccccagctccccttctctcccctctctggctctccctctggtctgccgagtgccgacaatgcacatcgcacgagcggcgcgcagggtgcacaagcacggggagggcacaggcgtggtggccggcgagctgcgcggcggtcagcgtggtgcacaggcgcggcggccggtgaaggcacaggcgcggcagcggcaattcacgggccggcttcacgcactaagagtcaattatgtacaattatgctatttttgatggtgtgtgaattatgtacaatatttgttcttgtcgaatcgatgattgtcttgtattttttgtgctgatgggatggagattttatccaatgtggggccccggtcggggtgcggagccccggaggggtcggggacgggacctgatttggccccgcatctccattcggggccgggggcggggggtgaagtcggggttaggacggggccgttccaacccaacccagccccacccgctccgttaccattcctttcctatacacaatgtaactattattttagttttagttcatccatgcttcttgcagctccatttatgcttatgtattttcgacaccccctgtcctctgaaaatcaggtatcttttctatgcaaatataacaagttagaaagtttcacaaccatataatcatataagagttctgaagtataaatgatggatggccttagaagaatgagggcagctccagcacaggattccgttacgataggaagtcactggataactaaacaagattttatacgtcttttttcggactgagcaccatgttgtccatgtgattgcccccactcgctgccttcgcacagaaacctcaccagtggcgccttccctagctaggagcctgctcggtatcgcgtgcctttgagtgcgatacctcgccagtggcagcactccgagcagaactgcaccggcggcgctttccccagccaggagcctgctcggtattgtagctatgctcgctgactccttcccttgtggaccacatcaataataggaaaaggatgtagtgtgtcgaggggagaaaggaggaagaaaataggagtcaaaggtaaatggctcacctactggccaagcgggtgacagcccgagctccctcctcacagcatgatacctgatacctggtacttggtaacctggtatctatgggtatcagctggtacctaggtaccaacccttataccacagggtatcagtatcatggatgatacatgaggtatcatggatgttacccgaggaatcatcatgcctgataccatggggtatcatggatgatacctgaggtatcaggcttgatacctgatatcaattgaggatgaaacggatggcatacttgtagacaacgtagacgagcagcgaagagctagcgaggaacacaatgcgacaacctcgagacctacaggaaacaccttgcgacctccactttgtcaactccaagatcaccctccacggtggggaatgactgcctccactttgtcgccgatgccccaagcctcatccttctc

SEQ ID NO: 104625 - DNA, 1184 bp, Oryza sativa
taattgcagctcatgattttctagaaaaatatatattcaagtaaatttttatagtgaattttaccttaactaaatcgtataaaagattaaaatagttttcacccgttgcaacgcacgtgcattttttctagttatataaaaagaagaaaaatgttgatgtttaaagaaggaaaaactaaaatacaaccccgcaggggagaacataatctaatagagtctaaccaatcaaagatctggtgttgattggtgttagctttttctttgggcgtggaaaaaggttttccattactcattacttgaacaatcgtcacagatcagttatgatagtctattggcattattgttattggtaaaccgtgtttatccacataaataagtatatgaattaaagaaaaacatgaagtggaactccttacatgttcacaagctgaaatttataagaagatttaataatatgaaaataattttgtacaaaacatgttaaaatatgataacacatttttttcttaaaaaataaaagcaaagtgttaaaagaattataaacatttcatagaaatattgaaaacatgaaaacacctgtggtataagtcactaacttccggaagcaagcttaacttatatctgtgcagctattgtttttcagaccaaaaggacgaaatgcattcatagacagtctgctgcacacacccaaaaacaaacccaaaaagaactaacgggctgttcagattggtgtcattttaaattatactattttttataatattgtcaaagatgtacatacatttagtttttttcaccaaactttggtaatattgtcaacttaccaaaattttagcaaaatttggtaaggtttattttggctataatctgaataacccctaaattaaagtgtggcagaaatacaaaatttattggacaggttgacgaaactatcttgatatcagacctttaccctaaaatatataaaaacttcaaaagcctttatgttacttacttcctccgtttcacaatttaagtcattcactatatagattcattaacatcaatatgaatgtgggaaatgctagaatgacttacattgtgaaatggagggagtaacttacaactcgtaaactaagtgtgtgtttagttcgcgaaaagaaattttttttgtgtcacatcggacgtttgaccgaatgtcgaag

SEQ ID NO: 104626 - DNA, 1658 bp, Oryza sativa
  unsure (1)..(1658): unsure at all n locations
aatctaaaagtggcaaatagttaaatgccccgagagagatggggaagagaggggagaagggaagagagaggaggaaaaagactgcccactgggttcctcgctgatttagctgggttgagcacaatcgacttgccacatcagctgaaatatgatgcaatactaccatagagcttaggtactccggtattatgagttaatgggttatatctagtattgtgatgtaaagaagaacatgatttaaactcctatacctaaaagttaacttattgagaaacatgcactcctctacattttggcatgtttggcatagctctagctccacccaaaaagaaagtagagcttatttggagtgctttcacgaaatgaattaaagatgtggagttgaatttatgttgttagagcatcaacaatagttatcctatttcctttccaaaactgattttgagggtttttagtgaaaaaaaatcggatccaacagatcgcaaaatccttgcactagttttggtgttcccatccccatgtacttcgctatgtggatttgagggcgagagagcgactcccaatctctcgttcgcacgtttgtcctctccttgtttgttgggagcgcgggtgatcgcgatctctttctgcgtgcgtggaagaaagaaaaaagaaaatttctgttggtagtttaaccgaagggcccacttttaatttttgagattgaatttagactgtgtctcttagagggagaagtttttacactccctattttcagtttaggaaacccaaaaatcaaattttagggatagattagtgctaatctgttggcattaccaccggtcctcctataatcccaaaaatgttttttggttttctaaactgaaaatagaaagtgaaaaaactcttcaattatcctaaaattgtttttgggttttcctaaactgaaaatagaaagtaaaaaaactcttcactccaacagatagcctaaattcaatcctcaaaattaaaattaaaaatgcgcccttatgttaaactagcaacataaatttccgtttttccctcccgttcgcacagaaacagactgttaaactaccaacagaaatttccatttttccctcccactcgcgcaganacagatcgctatctcccaagcgcgatagcccacgcgctccctgtcccgacgttgccttcgtgcggcaaggggaggagagaggcgtgagtatgagattgggagtgcctgagaaaacgcatcgagtgaggaatcgggagaagggagcttcaaaactcgagcagcagattaaaggattagttagagctgtttttttaattaaaatcctttaaaatcagttttggtaattagggcctgtttggtacagctccaactcctaaatttagcttcaggagttgggtctggagtggagttgtggagctgcctaaacccagctccacaactctagttcattttgtgagagagctccacccagctccactcccagttttggtggagctgaaactgtttggctgagctccagctccaagagagatggagctggagctgtgccaatcaggctctagatgtcactaaacccaactcctaccattaattcagtaaacccaactcctaccattaattcaggagttggaacctaaaattttttccaatgggctgcaggaat

SEQ ID NO: 104627 - DNA, 1359 bp, Oryza sativa
tcggagtccgcgcccgccaccctcgccctccactgctgttgcccgagccctcgcctctgccgccaccctcgcctgccaccgccaccactgtcgctagagcccgccgttggaggaaagagaggggagaggagtaggcggcagtgagattgagggccaccggatccacgcggggcggcgctgttctcggccgccttgtcggcggtggcgccgcccactccttctcggtgagaagaggagaggagagaaagagagagagggggaaaggagaggaagagacataaggagaaaagaggaagagagagaggagaggtggtgaaaaaaaatctgaagtgttgaaaggaaaagaggagggtattttcgcatacgagccacttaagaggctcgcatgtgaaaatttatttttcatgcggccccttaagagaatcatatgggaaaataagctcatttttgcgtgcagctccttaagtgacccgtatgcgataatagatttttttttacatatggacctattaaaaagtagtatgtgacaaatgaagatcgatttttgcaaacgtaactgttatggtccgcctacaaccagtactcatacaggaaaatatttttctcgtagtagttgggcaacgtcagtaggcatggcgcacgggagaactactttagcgtcccaaatcaagatgaaaatcaaaagagccaaaaaaaaatatcgattgtaatccggtgaaaattatgtcgcccaaacccgaaaagagttactcccatgtactagaaatataaaaataccgctaattgcacgtgtaattttatataatactctctccatccctaaatatttgacgccgttgacttaaaagaaattgaaacgatgtgacggaaaaattgaaaatttgaagaaaaaagttggaatctaaacatgtcctaacactacatacacgtgtaattttatatattacaatgtaattacactcaattttaataaatcttgactatagatatatatttaaaattcaacatatctaaagactttaaacctacccaaaatgctcgtccctcaatgttttgcgctggcgtggacgttgccgcgtcgcgacacgtcaacgcgcgctgaagagaggctggatttcacggcctcctatgcgactgcctcgcctctgtaaatttttttttttaaaaaaaagccctctcttttatatatttcatggcccaacgggaaacctgtacgtccagaccataatgctgtggaggttgtatgggcttgaaacgatggtcgtcgtaaaatttaaacttctttgcctggtgttttgtgacgacaaaattatacttcgtcgtgaaatttaaacttcattttattagtataaatcatga

SEQ ID NO: 104628 - DNA, 1393 bp, Oryza sativa
attcctgcagccctaattattattaatatgttggtctgctgcttgaatatatatatatactccaggtggcaaggacagaggatttctcgagtattgggaaacatggccgctacttcgatctcgtcgacttcagcgtcatcgaggggttcaaagtcccggcggacatgaccatctgcagtttcaaggtagtaaaataataataattatattccattatcctaagaaaaaaaatccttcttaaatcacgggaagatattttctttctttgtattaattggtcagcattacttggacacttgactctagtttattttgatggttcagggaaaaagaaacgctaatgatcgagcatggggtaaatgaatgaattgcatgacctgacatctgatattttgaactagccattgtcactgttgtagcgagtattgtcctggaaaccaaccaaccattgcattaggcagtggcggagttagaaattactgaagaatatagttaaaataggactcaaattaatagagtgttgattttgtaaaaaaattatatgatgatttaacaaaatttaaacatgattttagagggctcaatttttagctgccctatgtctgcatccgcttatgtcgttaggcatcctagcttgtgaaatttatactaatttatactagctgaatgataatgctttgctaagaataaaaataaatatattgtaatattaactaaataaataaataaataaatattctatgaaatatgttacctatcattttattgtaggaatattcatcttattttattttttatgttgttacccatttagattcaattattttcaatattaaaaagtagggtacctttgacagaggtgactgatttactaccactgtcaccacttttcttaaaggatcgagtacagaaatatgctagtttaggatacttctgccctaatataatgagagtatttgccaaatgtatatgctttacacatgtagactaacaaccctgcctgactgtttatcagcctgtcattgtaatgtttcctactccagtactgatagattcaacttgtcacaggagaggctcacagaggaatttggaacccctgtgcaatgtcaacgcctgtggtggtggactagacggcagaacaacacataccgtgttgacaggccattgacaaccgaagaggagaaaatacctgtaagtaaacattgtgatcacctgactggctcttcatactgttttgttctatgcagtaaaaatgaggcattatatactaagaatatagtatataatgactcattttctagtggttgaaaacttcacatgaattttgccctccatcattttccatgtcatttccctaaaagttgtgctgaagagagcagataaagttctcaca

SEQ ID NO: 104629 - DNA, 683 bp, Oryza sativa
gatgtatgtgaaagattcatggacggtttcacatgttcttcaaacactaagaaatctagctggttgcgtggaagtggcagaatagaattgtataaggtcaggcttttgtactgatgcaagctagcttctctgattttcaattgaacagatttatctcgtctgtagtgttttctcaacttctttttatcgaatacgcaagagaattatgtatcatttgtattaagaagatgttctctcactttctggcatgcaggaaataaaatttgacccatgggtgttgtgcgaagccattgaccttcatcgtaccttttcagaaaatgaggtatgtttatgagtacacttctcctcgcttctgcgctttcctcactctcccttaatcaagatttaaattcgttactttctttctgcagattgtaactggggacattatttgctaccagaaaatcttgaagacacaggacttgccaaaatatcattctgttgcatcttttctccagcatatttgtgatcagaaggtagccgttctgctttgttatcttcttgcatgctgtaggtgactttctcgtattttgcagtcaacttttttttactgttcctcctcgattccttgtatgctttctttggcatccctaacagtatctttatggttaggccttgtttagttccaaaaatttttgcctaaa

SEQ ID NO: 104630 - DNA, 914 bp, Oryza sativa
aaaagtgcggtctttttgagattgaggtagtaagttctacaaaatgaccaggatgcaatgtaaaataatgtaaggctttgcttgtgaatatttatcaactttttcttatttgtgcgtataactaattaataaatatactctcatgcatcatcagggcatctccctagcgatcttctcagctatttccaaagtatttactataggtaacatgggcattttattccatcattctcttggttttgtactactcgttaatcagtactgcatgcacagtggtctgtcagcggcgagagccatgtgcaccaccattgatatatgctgtagcggattgatggtggcgccgttggcaattgaatgcctcttcatcaattgcaaatgattactaattagcttctccctagtgcctccagttacttagaacagatacagtagcatactataaattaactataaatgaatttcgaggagataaaagaagagaaaaaaagattagcagctacagatttgtagccaactgcagtatggactcaaatatgcaatatgtgtatgaaagataggatcagatattaatagtgtaatatatatttacagataactattgtataaattggctagagatgatatggaactagaagtgggttgtactattaaacttgctcttactgagttaatggtcaccataatatatactccctcataaaaataaggtagacttatttcattctctagttttctaaataaaattattatattggtagtctagataatccaaaacttaaatgaagagacaaattaaatggttgatattggaacacaaataatcatctaaatacttatttgtcgcatgcacatatatatttcttggtttttgttacgtgcaagatgagttaaaaagtaataagtctaacaaaaaa

SEQ ID NO: 104631 - DNA, 1318 bp, Oryza sativa
aaacataagtcacgtataaggtactattcatgttttatcattccataacaataaaaatattaattataaaaaaaatcaaataagacagacgatcaaagttgagcacgaaaacttataattgtacttaaaataggacagagaaagtaggtaagagtggaagggtaattgagggtaaaattgggagaaatttgaatgagaagtggttaatgagaccattagtactctcctgttataattattttgggacaaatttaaatcctagaaatataattattatggcacggatgtagtacttttcatagatttagggtaacttggtctttgacaatttggtcataaatggttcgtactcctgtaattgaggtaattattggtggtttactcgtaaatcactcattcttataagatgaagattaaatacaagcatatataaaatgagaaaaccattaacacacgactaattatgttttaattattttaaacttaaaattttgatttatctgatattttagaacaacttctgtatataaattttttgtgtaaaatataccatttagcagtaggaaccggactagtatgattggatggagcagaaaaaaaaatgaaggaataaaaaagaagagagaagcgagatttctatctttttataatgttatttttcaattaatgcaagcattacgtaacaacttaacatccggtgtttccaagaagataaaaacagaaaatagttaaattaaaagtgccgaaagaagtactacggactaagtgactccggcttgggcgcccgatcggtttggagaaaaatcgggcgctgatatcagcgtccgatttacgtgcaaaactacttcaaactgatttttctcttaaattatttatccaaatcatgatccgattacaccattaaattcgttgcaattaaatcttcaaaacaagatcacacatggatatattccgacgaaaaaaattagcttattattgaattatttttaaatgttgcacgatattccaccaggtatattggaattgtttcactaagtagatcgaaaatttttcactcgtttaaatcgggtggttttttaccttatataaaaacaatgtttcagcaaatagcgaaagaatatttcagttcactgcaatatttgatccatacatagtgaaacattataagtacactaggtgaaacatttttcggtggaacaaaaaaataaacgaattcccttaataaggggtttgcaaaatatctaggtttttttgttgcaatggagtattttagttcactgtaacattagatctatacataatgaaagggctgcaggaa

SEQ ID NO: 104632 - DNA, 1036 bp, Oryza sativa
atctctttttttatactatctcttaatttctgcacatagttattactgacatgagtaccctttggtctaatattattttttttctttccgcaaagtagggagttgatgggcatggcactggtggagaaagagtctttactctcggtttagaaccctatgtactcccggttttacaaccgggaatacaaatccgggactaaagatacccatctttagtcccgggtaaaataactgggactaaaaatccatctttagtcccggactaaagatgaatagcagccacgtcctagctttttcttttatttattgtttttttttgctgcttgtatgtattccccacccaaatacacgaaccatccacaatccacaaatcaagcacaacaaaattatccacaatacatccacatccacaatccacaaaccaatcacaaaatcatctctaaatcaacccacaaaatgctccaccaaaatatacaaatcattcaaaaaaacattcgcagtcgccgccgcccggccgtggactgccggccgccgcgtgggtcaccgccgcccggccgccttgcacccggccaccactgtccgccgccttgcggccgaccctccgtgctggcctccgtggccgccgtgctagcctccgctgccgccgccgggggcagccctccgtgcgcgacggccgccgccctccgccactgtcgcccggccgcctcccctctcggatccaatggaggggaggccgccgccaccgccgcccggccgcctcccgctgccagaggggagccggaggggaggggagggggagagaatgaggggaagaagagggttgagaggagaggagaggaggaggaggaggagaagtgagaaagaggaggaggagaagtgggaaggagaagggataagatagggcggggaggacggtgcgctgctgaccggtggcgcatggcgatctttactcccggttggtgttaccgggagtaaagcttatgtcgatctttttttcccggttggtaacccggtttgtgttacgggctgcaggaat

SEQ ID NO: 104633 - DNA, 1427 bp, Oryza sativa
atgggtgcttagctgtggtggcgggtgtgggggcaggttatgttatgtgttttgtgcctaattaattcagagtacagtgaactctgcaacattaaaagtgttaaaattttcacttagcatcaaactggagcaaaataaagttgcatctacgcaagccagacacacacccctggtccgcgttcttaaacctaacataaacagtggaaagggattccgactgagctgaaatggttagaatgcccattggtgcaagttctaatattttcatccatcctcataagcaaatcccctaaacaagagcgcaagtcctggttggatgcactgtaccgtgtgaccatgggtcaatgcagttattatttttaaggccacaatgacacaacatatcatagtccattgcaccaatggagattcactgcaataatgcccgtgcagcctgctgcacacaccccatacccccaccaaaaaaagaaaagagaactaaatgagagtaaaaaatggcagaaatatgacttagatcttatgtataaatcgccaaaatatttttcattggacaatttgtgaaactatctcagtatcagacctttaacatgaaagtcaaaaacctttacacttggaactcgtagcctaaccataaagatactgttagggatgatcaaaagtcaaagaaagcatataaggaagaacaatatgtaaaaagtttactgaaaaatgtcacctacagcagggaagatagcaaagcagaacagctaccttatgatcacaaacatgctggagaaaagatgcaacagaagaatatattcgccagttttgtggcaggcttttctggtagcaaataatgtccccagttgtaatctgtagaaagaaaataatacatggatggggagtgcaaaagagactaagagaggataggttaaaagaaacaaaccccactatctgaaaaggttaaatgaatgtcaatagcttcacacatcactgatggatcaaattttatctcctgcttatcaaagtgagaaaccagtacaaatgagataaatctgtttatttcagagtcagggaacctatttgcatcggtacaaaacctgacctcatacaattctattggttcgcttgcacaaaaaccagctagacttcttagttttggaagaatatctgaaggcctcgatgaaactttcacatacagcgagccaacatacttaattcctcgttcagaagaggagcaaaatttagtatcatcaactgataaataagacaaaataagttgtaacaaaaaagtgctgactgtagctgtgctttttctgggtcaaaaagctttagaaacaccagcgcatcatcttcgttgatctctgagtggttgggaatgagggtggagcacctacaacatgccaatattttgagacttcaacagaatgataaatcgatggatgaaa

SEQ ID NO: 104634 - DNA, 1055 bp, Oryza sativa
attcctgcagccctgcaacttcaagatggggaggaagatgagacaatctggaagtgggcaccaaatggaaaatacactccctgctcggcctacagcatgttcttcatggcaaacacggtggcgcgatgtggtactctgatttggcaaacaagagcgctgtcaaaggtgaaattctttatgtggttggccgaaaaagggcgatgcctcacggcggataatctaagtaagcgtggctggccgcaccagcaggtttgccaactttgcttggtgggtgatgaagattgtgaacacctatttgtgtcttgcacctacacgaccagggtgtggagaatgatcaagggctggattggggttggcttcctgctgccatctgagtcaggcttggacttgggcgaatggtggttagcgatgcggcaaaattttcggaacaactacagggacgccattgacagccttgtgctgcttgtttgttggatggtttggaaggaaagaaatgcgcgtgtgtttcagaaccagcggcgctcagccggtttcctgtttggttcaatcaaagaggaagtggcgatttggaaggaagctggggttttcagaaatataggagagtagtctcttagtgtaatctttggcttttgggaagttgctccggtgacaatttccattacttcgacagcttcttgttgaagtaataactttgtatatttgtatatattcttcaatcttaagtaaatttggttggcctttcttggctggcccggcaaaaaaaaaaaaagaaagtctgacctcgtacaattctatcatttcgcttaaacagaaaccagctagacttcttagttttggaagaatttctgaaggcctcgatgcaactttcacggacagcaatccaacatacctaatttctcattcaaagaaacaaattttagtcagccttatcaactgataaataagacaaaaaaatgcagcaaagaagttgaccttagctgtgctttccctgggtcataatgctttagaaacaccagtgcatcatccatgttgctccatgttggtagggaattagt

SEQ ID NO: 104635 - DNA, 1433 bp, Oryza sativa
cagcactaaacaaaatgcatctgcaatctaagtaagcaggattcataattcaaaattatggtgcagaatgaagccaataatggaagggaaaaaatcatgtgaaacctctagaaaaatgaggtaatggatctatttgtagtttataatacttcagtctgaccgatcagacatgcacaggcttgaagggaacccttcattctctaatttcttactcagcacataactgtttaggttcaaatgaaagagcattttttactgcatgggacaaaacagtattaagaaccaacagaaaataaggtgatcacaatgttttactgacaggtagattctcctcttcggttgtcaacggcctgtcaacacggtatgtgttgttctgacgtctagcccaccaccacaggcgttgacattgcagaggggttccaaatttctccgtgagcttctcctgtaaaaagttgaacctatcagaactctatatgaaatatgaaacataagaacgacaagctgcacaataaacaatcatacagggttgtcagcttacatgtgtaaagttatacatctcgcaaataaccacgctgtccttattagagcaaacctaaaatagcatatttaaaagagacaatagttgggagctggctgtattgtaccaattgtcttttttggagtgtatagattttttttagataatggaataaagaaccccgcgtctacagcttgcaatgcacacagccatgagtggcgtatataggataagttcacaaggaaaccaaatgcaatggttggttacatggtttccaggataaatactcgtcatgacaatgactacgaactttctaagttgtgcattggttcccataagatataaaatgtcaagtcaagcgatccatttccttaatgctcattatcatttttttttcttctgaatctgttcaaaaaacatttttttccctgactctgttccaaaaaaaaaactgaacaatcaaaacaaattagtccttattttcctatataggatataggatgccaggatggtgccaaatccatcccagaccatttattcttgacataattttccgaatagtcatcttctaatgtttgtcagattcctctatacattccacaacaatatgtgaaaggactaagagtacaactactacagtagtaagcaactcattagaagaagcagcacacccatcttatgggattcactaccttgaatcggaggatggtcatggtaggcgggacgttgaatccctcgattgcgctgaagtcgatgagatcgaagtagtggccatcttccccaatacgcgagcggaaatcctcttcccttaccacctaatcagaccaacaaacccaacaagtggtcaagaatccgaatccccaatggattttgcgctggtgcggagaatccaatctgcgcgagaagaaggggtcgc

SEQ ID NO: 104636 - DNA, 677 bp, Oryza sativa
aaatagaagctttaatcgttttttctgttgtgatttgacgcatgtaaagaatgttcatggttaattcttgttatccagttgaagcatgtgtactactgaaccatatgtactgttggaaatttggaataaaaatggttcacgccactccaatgtatgattgttatcagtttggtgaagcagacctcttcttgcattagccgatgtgcttggcatatcaggataataaatttgacactgtcgaaggaaagaattctgacggttcaaaagctttgagagagtttttaatcctctgacactgttgcttatagaatatacatgtaggaacatatctgcaaatgccaaggaaaattctagaaaagttggacatgtactcctagaattatacatatatgtaaagtctcatattcaaattcattatattttaactgtaacaaaaaattgaaaaaatcacatggtattaagagtaaaaattatctttttttaggctaaaatataatgaatttgaagataaaatttcacacgtaggtgtaatactactgaaatcatatgtacaattttttctataattttctatgatatttgctagtttttttttaggggaaggtcagtagctctttattcagttaccatggtttgattacagtccattagcaaatcttaggaactccgagagtccg

SEQ ID NO: 104637 - DNA, 650 bp, Oryza sativa
caaaaaaaaaaaacactatttagtagtttgaaaagcgtgcgcgcggaatacgagggagaggattgggaacctcttgtgccgaacacacccaggatagttattacttgtagccttgactagaaatatgccatgtccattttattttcttcaaatactgtaagattatatttatttgcatattgcatctggttacgttgcaagccaaatgttctccctcctccaatcattccctacagaagcaaatgttctggttctgctaatgtgttaatattaataccacatgtctctgtatgctggattcattttggccatatgtgtcttgcacaggtttatgtccaaacgagttatatattgtaaatagtgcataaatgtctgacaatttgatcttcctttgcattggtttggtctttttggaatatccctgtacatgttcattgtctgcctgtacatgttcatcgcctgctgctctattttctcagcctgtacttacataagcataatttgaagtatcaattatcatatctcttccaacatgctattttaacaaactcttgtgcaccgcactgttgagggaattaagtatatactttgtgtaacaattactactatccacaagagactcagcattatggaacacctattgatccttt

SEQ ID NO: 104638 - DNA, 540 bp, Oryza sativa
caaatcacaaccgagaaagaataggcaatgcggagctgaattctcattgtcaaggcggaagatggtcaggcgcttccagcggacgacagtgaggaggccccggcggtcatcccaggcgaagaggttggcgccattggtcttcccgatgacgacgacggtctcgagcccggggaggcaatggaggttgacatggaggcacggagtagatgggtgatgcgggcggcggcgccggtcggggtagatcggcgatgcaggccacgatagggcgcgatggagaatcggcgatgctggtttcggcgtcggtcggcggcggttggcgtgaggggcgaggcggcgtcgcgggtggcgaggaggcgtcgcgatggcggggcgtcggcggcgtgagggtgcagcgtcggtggcgtgagggtgcagcgttggcagagctgggtgagtgcgagagagaggagggcagagacggggttctcggcgtgattgggttacgcgcgtgagggaaggggagaggaggaatgcaggcaggtgtgggtgccaaacgcgtgc

SEQ ID NO: 104639 - DNA, 3296 bp, Oryza sativa
aaaaggtaagacaagacacacctaaatccaaaccacaacgagaaagcaaatcagcaatgagcctagagcacactagtagagaaatgatttttctggacaccggccccggtagatttcagacgggccgtaagtagcgttgtctggaaaaaccgggcgaccggtgccaggctatcgcccgcataggaaaatgcattatcccgtgcaggcgtctaatccgaccgtacgggataatcctcgttatcttgtgcggtcgacttaagaggaccgcacggaaaaattgattttcgcgtgcgggcctcttaagtggaccgcacgggaaaatacctctccctcttttccctcttacccacttcagaattttcacatcatcactcttccttttccctctcacccacttcaaaatttttcacatcctctatcttccttttaccttttattctccctcactcactcctctctctccctttcctctcctctccccctcccctctctctctctctgcctctttcttctcctcccctccccactgagcgcacggggcgtcgccaccgccgccgccggcggcgcgggaagcggcgacggctactggtggaggcggcgcagcggtgacggcggacggtcgtggtggaggccgagagcggcggtggcgcgacgacggcgaccacgagcagcggcagtgcggcaacggtgacaacgacaggagcagcggcagcgcaacgacggtggccatgagcggcggtggggagcggcggctgcacgacgacgggagcggtagcggtgcaatgacggcgacgacgaggacgatggcgaccatgagcggcggctgcgcgaccacgacgacgacgggatttttttgattttattttttttcggtattttttcgtgcgggtggtataatttgaccgcacaggatagtcgacttaacacaaccgcacaggataatcaattatcccatacggttggaccgcctgcatgcaaaaaaatattgattttcgcagaccctggatgcagacgggcgctacttatgtacggaaaaatggatagtaacaacatggaaaaatggattatgtaccggtggcagtactaacaaaccatactgccgttagtattaatattaatattaatgataccaatggtccatcgagtttgtttttcaactcccttatctaccttatctaccttgacaatataacttacttttaaatatagttttaggcaaaggctgaccagcggtgaagtttaagtttaaataattttaataacaattattaaaaaccgagcgcgcgattactctctaatgcgcgctctaacaaaatgaaaaattctacgggatgtttttcctccgtatgataaaagcatattccgctgctgcctgctggcacgtaaaagtggaaaaagaaaagaagaaagaaaaagaaagtggtcgccaactgcagcggggctcacttacgcaggcatcacaggcagcgacggtgtctccctaaaaagtcagcgggactagcttgtcacagtccacattccaacctcttgtcctgcacagtaaacgccgtcctctcgtgaatttttccacccgctctgcatccgctataggagggtaaacatgcggtacgaaccctaacctatgtaaaaatttgtgtaaacccccgatcaaaaagtcatgtaaattcgttaaccaaatcacacatgttagatatataaggggatgttacaccaccacatagaatttcctattcaaacaaaaaataataaatttcgaactgggactttgtttggtaaatttaaattatccccttttttttatcaaggtttacacgagttttcatctagataggtgagggcttgcgctatatatttacctcgctatattaccatcggccaggacagatggtttctgtataataaccgaacagcgtctctttgtggcgtttttgcactctattccttttatacttgcttacaattatgcatactgtataatgataaaatattgagagaattattagtgtagattacctgcttgaatataacgatacattaaatattataagtagtagtagtagtagaaggttatttttggagtgtggagtaaataatcggtaaacaattttaaaagaccaagactatagggcataatccagcagctcgtacagctcaactacaactactcaccctagctaaggccctgtttaaatccctggcaaaatttttaaccctgtcacatcgaatacttaacacatgcatggagtattaaatataaataaaaaaataactaattacacatattgcgtgtaaattgcgagacaaatcttttaagtgtaattgctccatgatttgacagattaattatacttaataaattcatctcgcagtttacatgcggaatctataatttgttttattattaaactatgtttccatatatcggtatatccgatgcgacatgctaaagtagtttttttatttttttgctaacaaaaattggccgatcagaatttcattaagattgtgagggggttgttacacagattggttacgtttcgtgttaaactgtcgagttgggggattgtttagtggaatttaccctttcctttttcttttccagcaaaataaaagaccaagcaccttgtacatacattttcattaaaccaaggggcgtttacgcaaaaccccccataataataacaaacataacctaatcctccacggtttaccgctaatccggagctgagggcggcgcgcggtgacgcgagccgagcccaagcaaagcaacaaggacacggacacacacacccactcctccatcttcctcttctagaaacacgacgcgcacaggcagacaaagaggagaagaagaaaagcggcaaaagccggaaaagaatctcctaatcggcggaaaataaaaaagagagagtagttcttgcaatcttgcttcgcctgcaaggaatcctctccggctctccgccctggtaagaatccctctctctctctctgcaatcgatgcttgattttggtctgtttttatccaagaaggtcaagcagagctggtcttgctgtgttgtgttggacttggatagatgagatgagcggtttcttgatttctttgcctgggatggggtagggagcgttgtgttcttgggggggaattgggagggttttgggtctaattggtgtcactttcctgatcaccgagtcgtcgtccgcggagaagactgacctggtattcgactgttcattcatcctgtggtctgagatgagacaagtaacttgttttttctttttttttttaaaaaaatctg

SEQ ID NO: 104640 - DNA, 619 bp, Oryza sativa
tcgagcttcggcccaaaatcaacatatcctttgggcttttggactatgttgggctctgaagctaagcttagttcacttcacagccagcgccgacgagaggaggagcagatcggctagggttccggcgatggcctcctcggcggcggcgcggcggcggcaggagatggcggcggaggggcagcgccacctggaggagaccatcgccgccgcgttccagatcctctcctccatgaacgacgagctctgcaaccccacgctctggtcctcctcctccgccgccgccgccgcggcgggcggcgccggcggactccagcaccacggcaacaaccaccaccaccaccaccagcaccaccaccaccacggcggtctccctccgccgccgccgccgctgcactccgcggactccgacgccgccgacgccgccgggggagggcccgggggcgcgccgggctccggcgggtcgctcgacgaggccaggcaccggtacaaggtcgccatggcggcgctccgcacgtccatcgccgccgtgtcgtcctgtgctcaggtcagcacacgaatttacccgacattgcatgctcccgtagtatgtatgcaaccacgaaatgcgtgtttctagtga

SEQ ID NO: 104641 - DNA, 723 bp, Oryza sativa
tatatgattctatttttagcagtaagtgtaatcctgatgtgcaaaatatggtgctatggagaaacctcataacagtttacttctttgtaatgatgttgtggttttcttcgtaggagatgggatcgacagaacacaaagctgatcaagctgagattgagagattggaagaacatgcatctgctttgagaaaggtactatcttgggaatgttctagcaatataatcaatatcattttgctgtattcagaatttttccctgaaccagttggtaactggtgcttatttagccatgtcaatcccaaatatttcccaaacaacctgttttgaacataatgtgtgtgtgtgtgtgtgtgtgtatatatatatatatatatatatatatatatatatatatgttccttttatgcttcaatcattttaattcaaaaagtcctgagaagagtgtaatccccaatttttacctgaaaccattttagatagccaggatctagtttggcaagctgtgatactgtgttgcttgtagtgttttggatagtcatgttcatctgttgaactcgtcaaaaaagcgttccatcttgatctttcctggcaatattcatgcttgttaagttgttatcttatcattgttttttctgcactggatactgcatgtcattattgtttgcatacttggatttgcctgctagtttagaacttactccctccgtcccaagggctgcaggaa

SEQ ID NO: 104642 - DNA, 1453 bp, Oryza sativa
taaattacttctagatttcagtaagttacttcttagatatataaaagtaaattcagtaaagcttaaaagtaatttacatatattatagaagtaacttataacaaaaagaaactttaatttagaactatatctagattcattaacatctatatgaatgtgggcaatgctaaaatgacttacattatgaaatggggggagtaactctctgtagtagaaataattatattttgagtgagctgaaataagaaactatgtagagtaaattcgcaagtaaaatgtagagaagatttataaagtccacaaaatataaaattaactaaaaacaataataaacataatcaacttagagtattatgaatgtatagaagtaatttagtcaaatctcaaagtaacttatatatatgataaaagtaacttatgtatataataaaagtaatttataaatataaatagtttttcatcataatataatcatgtaagatcttattgtaaagatttaattgcaacaaacgtaatggtgtaatcagattgtagatcggataagtaatttgagagaaaattcttaaaaagaaaaaaaatagacatgcattgtgtgcactagtaacaagaggaccttttctcacgtagctgtactagcagcacatgaccttctctcacgcactattagcgcttgaccttctctcacgaatgagtacgtcgctctttaacactaaatcgagagcgttctcggtttagattttgcgtttttataaatagggtcatttcgtaagagcttgttttcacttttgtttaccagcttctattccttcgttatctgaaagcacgttttccgaatcattaagcattatgatttttattaaaaaaatctaaaaaaagttgttttaaaaattcatattaatttatttttaaaatttgttaaactaaataatacttcctccgtttcacaatgtaagtcattctagcatttttcacattcatattgttgttaatgaatctagacatatgaatgtggaaaatgttagaatgacttacattgtgaaacggagaaagtaatatttaattaattatgtactgataagccattgggcatcatcttttcgtttatacttatgcttatcagccaaaatttaaatttcgaccttaaatttggagctgatttttaggttttttttatcgaagtttatttctcagcatttgcttttagatcgttaagaacacgtatataaaagttttattacaaattattacttttttacaaatataccctatgtcgtttcgcttggctccgattatgttttagctacgcacgcagaagagaagttaccccgagacacgacattttcctttgttgatagtgatcgggcgatgcgacagaggagggaggcggccgtttttttctcgtttgctaacgttggcgtaacgtacggtgaggaacatgcagttacggttaccg

SEQ ID NO: 104643 - DNA, 727 bp, Oryza sativa
acttaaattttgctatttcagaatttttgtccaaatttttgaactttctccaaatgacaaaaatgaccaacttaatacaaattttgaaagtttacatgtaatttggatatgacaaaaacttttaaaatttggacaaaaattctgaaatatcatattttaagtttttggccaagttttggatggatgtttacaatctgatgtttataatatgatattttggaatttttgtcctagaggtattttggttatttggacaaaattgtacaatactaacataggctaaccggatgataatggtaaatcgtagaggttaaataaaattcgatggcatattgtagaacgtgacaaagtcaatggtaaatcgtagacttgtgacaaactcagtgtcatataatagattctatatatattattaaccagcatccatagcttggtaagattagtcgtgtcgtgctcttttggtctttgttagtttgtgtatcacaatgagtttttgcatgtttatgtactgaaatgcaccatctaataagtttgtgtaatgctaattaataaccaatgcaattcactcattaataaccttgctatttatgttaaataaatacattgaaaatgtaggggggagtagttaatttatgtgttttgaggagaaactatgcagcaaacaagggcagcaagcaagaaaagaaagaaaggaattaattcacatacaagcatagggctgcaggaa

SEQ ID NO: 104644 - DNA, 848 bp, Oryza sativa
taacatttgtgcctcttcttaattttcaacatgtcagcagacatcgtcacgtcccttttaacttgtattccctccttttctacacgaaaacgattcccgaattgctaaacgacgcgtcttaaattttacttcctccattctacgatgtaagactttctagcattgcccacatttatttagatgttaatgaatctagacgtatgtatgtgtttagattcattaacatctatatatatgtgagcaatgctagaaaatcttacattgtgaaacggtgggagtataaaagaatgttgttttttaaaaaatcatattaatttatttttcaagtctttttcatctaatactttatactaatcatatgctaatccatcgctctgttttgcgtgctaaatactccctccatcacataatataagggattttaaatggatgtgacacatacttgtaaaatgaatctggacagaccgtcacatccacccaaaatctcttatatttcctttgtcccattttaagtgcagccatggtttttcgtgtccaactttgaccgtccgtcttatttaaaaaaataaaaaataagttacgagtaaagtccaattcatgttttattatctcattacaacaaaaatactaattataaaatatttccaaataagacggatgatcaaaataagacgcggaaatctataggtgcacttaaaatgggacggaggaagcattatggaacacagcctaaatctttttaaagccatttttttccttttaaagagatatatactattgctattaattaatacataataatcctgagggggataataagctagtgttaatctgacagctcgatcctg

SEQ ID NO: 104645 - DNA, 708 bp, Oryza sativa
ctgcagccctttgcaccttccttaaaactttaattccgttatgaagctggatcacatcaattgggaactcttgtgtgctaccatattgctcttgctatagctagctgctagtactgaacattgtcatttctgtggaagtgtaacctaaggagaagctgcagtttgtttccatttactgttgctgaaaaactatgattcttatatattgtagattgcctaagcttctgaatataatgtaacatagcatgtgtatcttagtgatcttcatgtccagtaatttcagttccattttatgtctgccattataacaactgattctggctgctactgacaaccaaatgaatctctgaaccaaaccatggattgagggaaacacaattttgctcagatctctgctcttaactcataccactagctatgaaacagcttccacatttttctcttgtgtgcatgtttacttctccaagattctgaagtttacttgtgtaagtgcatcaagatcatcatctgcttgacagctccagctctgcagcagtagcagcaacaacaccacattactgcaatcctcaacagctgctgtttttttttctactgtgttcaactactcttacctctgaactagtatggcagtctttaagtgtgttcttaattaatgttcagttacagtctctgcatgatagcgggctggcatcgtcaggctccatctac

SEQ ID NO: 104646 - DNA, 625 bp, Oryza sativa
aaaaggggaataatttatatatatatatttgttttttttacagggacagcctgacctactctttttctactgctactggtactgcccttctctctcccatttggtattacacaaaatttggggctttgactaaaagtcttgagctaaaaaagctttcattttttagagcttttgctgctcctcccttctcttctccctcgaaagaaaataaaaattcgggggcaggaaaaaaaaattgcaaattttttttgcgggccgacgagctgatccgcatgggtgcgcgctgaatcgacgaatcccccccccccccccaccgcctctttcttggctctcgatcgaggtgtttctcgccgccggccgtggcggcgagcggcagatctgggggcttggggcttggggccggctagggtttgagcttgaagctttcctttcttggagaagctctccgatctcgtctcgtctcctcgcgagctgcgccgatcttccgtctcgcgaagctggggggcatcctggtgagcatcctgtcactttttttttttggtctcgaatttgctcgcgttaaccctagcttctcttgttcttgttcttctagatctggaggtgttttctcttaattttgccttaa

SEQ ID NO: 104647 - DNA, 704 bp, Oryza sativa
cgacacatgtacatatgcttttaaggtatgcgggattatcagagttctgttgttgcttcatgtcacaaaggagaggaccattttattggtaccatttatccatatcatgatggccatggtaaagttgatccgcacatatagcgtaatcaaatctcatgcttactgtcataagttagtaactttaaacattttttttgtgattaaatgatttacaacccaatcaaaacaccttgaattacttcaaggcaaattaggaattacatatcttggtaaagagctcatatcattattttattttgtttttaattaaaactttcatttttcctcagtaaatcatgaagttacaagattattattttggttttttcgtcaacgaacaaatcattccatgagaatgtcaatgtatgcctgtatcatgctcaaacacctcgatctaattttcagatgatgttaacgattgattgctgcaggatagaggcatacaaagtgcaggcaataattatgtttttaagatagctcaaaagaatatttagtgaaattttatctggggtgaatatgctgggattgcgagtcctccatctttaattgtttcagggtagaggcatacaaagtacagacaatatttatttcaggagttctgtcctgaagctattgttttttctgcagtcccttcagcgacatctggaaacctaggatctcaccta

SEQ ID NO: 104648 - DNA, 727 bp, Oryza sativa
tttatattatatcatgcaaaatttgtattttttatgcaaacaactatgtatcgtatgatacatgtagctgagaacgtgcattgcacgtgcacgattactagtactaatataaaaaggagttcacccctagcaatcctactggtgaaatcaaccactctcatctcatccgtccatctgacatctcatttaatctgagccgtccgctgtacaccgtagatctatctccaccagcgatttcgccccccacgcggtgactgtgacgcgcaaatccccggggccgcctgcatcctcactctgcgcctcctctcctcgcgacggtgtcagacccaagaaaattcagagccaaaaaatagaattctcccctctctctcaatctgttgggcgccgcaagactcggaaaaaactagggttctaagctactaagacaataatttggttcttgttgcccttctcattagtctcgctgggttatatactcccgagcggatccaaagcatcagttttaacctcattatagcttagattcagcatccaggtaaaagtaaacgagcatcagctcttaaacaaaaattacatgacagtgaataagagaacagcgaatcgccaccgtcgaatcccgctgtaaatacgaatcttcgcatctccaccgttcattctcattaaatgacgtcagccaaacggtatcaccattcttcagactttcttcagttatctgggctgcaggaat

SEQ ID NO: 104649 - DNA, 549 bp, Oryza sativa
attccgtcaatttcatccaaaaataataatttccagaggggaagatatgtggtgcattcagatccaatgcggatggggaagaactcggctccggcggcaactggggacgacgtcggctccggggaagaccacggctccggcggtggctggggacgacctcgtctccggcgtgggcagcgggggtggcagcggaaggggacgacctcgctgccccgtcgcgaggagggaggatgcgcgcggagcgaggaggcggcggggattcgcgggcgcggaggagaagctaggaggcgcggggattcgtggggcgggcggcgaggaggagcgaggaggcggcgggctatggcagcgggggaggagcgaggaggcgggggcggagttatcgcggtggggaggagcgagggggcggaggagggggtggggatttgtgcggcatagtcatcgcgtcatttctgaattggtggaatcgctcatcgtgcgcacagtgaggaggatagcggatggatgagattagatcagatggcggatggacggtacgggttgatctgggtg

SEQ ID NO: 104650 - DNA, 1635 bp, Oryza sativa
aggtttcgaatccaggtcgtttaacccaccatcttgtggagctagccggaagacccctgagcgtttctcagggggatgatgagctagtcaaaggtggatgcatggaacgcggataacaggatgagtgatatacttcctccgtttcatattataagactttctagcattgcccacattcatatatatgttaatgaatctatacatatacctagattcattaacatctatataaatgtgggcaatgctagaaagtcttataacctgaaacggagggagtatgtaaaagtctaggctgcatatcaagatcgtttaactacggttttttttttttagcgtgggagagctcgtcaagagaggatgataagcttagtcgtcttctgttttttcctcggttatgaaacttggagtctaggaattctataacttctacgtatcccatatgtgcatatatagaagctggatttctgtgtattacttaaaaaaagaaagaaagagagaaatagggtcgtgcagtacatatatatatatatatacatatatatgtatatatatgtatatatatgtatatatatgtatatacatatatgtatatacatatatatacatatatgtatatacatatatatacatatatatgtcatatatatacatgtgtatatatatatatacatgtatatacatgtatatatatatatacagatgtatatatatgacatatacacacacgtacgtatatatatattgatgacatatatatgcctgactgaacggactataattagagagatgtttaattagtaacacaaaataacccataaatatgtaccgtacataagtgccgacctaatatgcctggggatgattaattaactaaatggtgtcgaccgcgcgcaaacccagatccagcttgacaagagagtttgatgtttttaattagttagttaaagtgacatctggactattctgttatatataagctgaaagcatataacgaccaaacagttaagcacatgaatgcctggtctctgtgcaccatgcatgcatgtatggtttgtcgttagacatggcactatacatatatgtttgcatgcttgcctagacagacccaccacatgatgagtagtgctgatcactatgcttaattattagataatattagtcgacaaaagctgcctatcaatgatttatatatatgtagagtgtactaaacaacttatacatgcatagtatttattttatcttaaaaacttaattagtagtatatatgcatgggctatgcagacatttagaaaataaacatggtgggcacatacacatagttagaaaaagaaaacagtaccatttgtataaggacttaattttacaaataagattggccacctagctagtggaaatacacacacacacacacacacctcatataccatatatttgtaacctctcgctaatggaaagtagagataatatttgctaactagctaatggacttatcatcatgcatgttgttattggtcccatatatatatacattgtaaatatatgtatctatattattgcataatcaactaattaattagacttttcaaatgattcacacctttgaatatgtaagatcagagttgggcatatataggg

SEQ ID NO: 104651 - DNA, 713 bp, Oryza sativa
aacgcgtggtgcaggtcctccgcatcttattaccctcctctacgacttaattgaagcattatccttctcaacgacttaattgtatcagcaagcaaagctaatgcacacacaaaaaaaaaagctacccgattggatacgactgacaattcagcaaaagattcggtctttatccgataactcgtctatcattctgatattaaaatgatagaattaatcaaagcgaccgccaagtagattaagcacagcaaaacggaattgctattatacaatcacatctcaaaaagtgtgccgatgctataatatccattgtgaacgcacaatgcgtgcacgaatgcacaaaacagaataatttctggagaaggtgtggagacagcacgttgaaattatgatgacacttcgacagtaagtactcaaaaactccacgcacaagagcaaaataatcacaatcatccaaagatcaaagggattaaataaaaggcgagctagctagtagcaaacagtgctgggtaacagcagcaaggatttatgacaaataaaaccaccatatggtctttcaccaaacgtgacttctatgcaatgtagctctggataattatgagggacaaacattacgcaccggcactcaattcccaacgaattctttcatgctcttcaaccaaaccagatactccttctcatccttgctcatcatgtactcgcacagccagtcatgc

SEQ ID NO: 104652 - DNA, 657 bp, Oryza sativa
gagtatccacgccaccctgattgaacacacctggaagccgtgattgaacacacctggaaggcctcgaaacggtcaagaatgtgggatgtgggtgtaggaggcacagaagaaaagaaggtcagggatgctggggttgaagctagtatggagagcgggcgcaggccgaccctgaggaaaccggtgcactggcggcctcctcgccaccaacccctcgacgtcgtcggtggtagctagtagccacgaagacgacgatgcaacgaggacgagtggagcttgtggtaattgggagggcgccaacctggatctatagcgagccccatccttttcaatgtcaggaatgagaagaaccgtcaggaggagctcgagatggctggcggcatagcagcaagcttgagcggagcgggtggggctgttgggaggatctcgtcatcatcgacccactcccattctcgctggagctgatgatgcccttatccacgaacaccgacaccgccgcgcccccgaatccaatgctagcttgccaccatgtagctcgttagagcatcctcaaaattgtttgtgagcatgaactctatcctgggaaacttcttagtgaaaaacgtgtgaacaaaatatggcgaccgagtgatcgaagcaatagtgccgggctgcaggaat

SEQ ID NO: 104653 - DNA, 726 bp, Oryza sativa
tcctgcagcccagactgtgccttttcattaaataaagcgggagaaaaatacagcccctatgggcaagaaaagggaaaaaaaaactctgtacactatacagtgtgaggcgaaaagtcacgtaagcgctttgctcctgtcattgcccatgtttgcgcctcttcatttattttggcaaaaaggaaagacgtcgtggcctcatcatgcttgaagattcgttggttactctccttcaaatctccaaaacaacaaggaagatgagagtgcgcagtccatttctgtaactcccgctgtgtttgctagagattcccaccagtctgggtcgcctcccattctctagggtcaagctgttggtaagccacccagacagctagcatgctccatattctttttgtgtatctacaactgacaacaagatgtagagccgtttcgccttctctacggcagaggggacaaagcctattattttgccatcctctaattgcgagccagtcgaaggtccaaaccctgttttggatgacaagccatgcgcggaatttacatttccccggtgccaaactttccaaatgagcgagtgaaaaatcgtttttgcgccccaaggcactatgctgacgacgccgagtattagccaaaatttattaattttgtttctacttattgaatttgaatttgtatgttggtgaatgccatatctcatattgatttatcatgtgattttttaacaatttt

SEQ ID NO: 104654 - DNA, 681 bp, Oryza sativa
atatcgctgctggcaccatcgacgaggaggcatgcaactcttttttttataaatttggttaaactaaaatagtttgattagaaaacctttaatatgaaacgatgagagtatcttctattcatggcatcaacgaaatgttcgtgcagtagaacagggatgaaagggaggaggatgagaaaaaatagaccgtggtgggtaatttttgtcatatgatttataaacacgatagattaatatctattaatatgtattatatcactctataaagatagattaatatgtattatatcactctataaagatgtaaattaaaatttaacttacgcaagttgtagaaaaaaaacaacaaattcgacatcgtagaatcaacgtagcagtatgacggggttttgtacaattttaaccaactcaaacaaactttaatgtccaagcgattcaaattcgaagaggaaatttatgagatttacttccaatgctgcagttctgcgaatacagttaaaattgatttgaaaagaatcgcttgctactttatactctactgtaccatgtaccaatttgcacggcagaattcgagacgataaatcatcgtactacatataggtataaagaatatcataagacgcacagtcttgttgaaagtaaaccatctccaacgcatctgtctgatcaatgatcattgtg

SEQ ID NO: 104655 - DNA, 692 bp, Oryza sativa
catttatttaaagtaggatagacaaatagagattcacgtgtcagtgataggagtggtggtgacagattcactgccaccattactaccaccatttaaaatagtgtagatgtggactggtatcatagttatacgttattctcatgaaaatctatatatagtacactaaagtaggatttcaaaatttgttattaatcgattaattgatatttttaagatagaaatttgcgaccaagtgtcaaacaatgtgtaatattagttccttctcaagtttaaccataaaccatattcttgaaacaatgccttttaatttgttgggtgatttctataaaatcaacctataaaatcaaaattaagctagatgggaggtgcgtggttttaccactaccacaattaggcttcgttcgaaccaactgttctgctgggattttttgacggcatacaaaacgagataggacattagtatatggttaatcgagtatcaattactaaaaattttaagaatggatttattatttttaagaaacttatttataaattttttttttacatgggacacaccgtttagctgctaaaaaagtgtgatcgtggagaacgatgaaatagttgtttcgaatatagttgcctagaacttagtcttagaagcaagggtggccaagggaaaaatacggatcatgaccttagggcaagggcaa

SEQ ID NO: 104656 - DNA, 744 bp, Oryza sativa
taaattcacgtgaacgaataaatgttacagtactgcagtctaatgacagataatgcttctttattaaaaacaaggacttgacagctttgcataaatgccatcaacaaatacaaacactccatgctacacccagatatagtctactgtcaaagaactgaatgaagaaatgcaacctggtgactgatcaaagataacacactgcttccaaaagtgcacaccatttgacaatgtctaaagctgtgctctcctttgtagcaaccattattacagttatattgcaacagtgaattggaaaattttcataaaattgagatatccgatatatttgatcataagtccattgttaatctaataaataagattgcaatgaaattctggtacatcactttgtaaaatgaaaattcatggttccacgtgtcaatgttaaatgggctaaaaagaacaaggatatactccactactctatttcatcaatttgaggtgtccatgctttttgcatatgtatggggcttgcaaaacaatgggaattggacaggatgataagaagattaatctcccttctaccacaagtttgggccgcatttggagtgtgggaaacaactacctgccaaatttctacattctaaacatatccttatggtatacatcgaaagcttattgattgtttatttaaataaaataggatgagagtggaaattcttgctatgaacaatgcttgacatactaagcagcagggctgcagga

SEQ ID NO: 104657 - DNA, 573 bp, Oryza sativa
tccctgccatacattcggagagattcacaagttaatgttgggattactaaatagagttgaaggtggactaggcatgatttgcaagttaatgttgggattattaaatagagttaagggtggactaggcatgatttgcacggctgtaagtttgatatgaccactaaggccccgtttggtagggctccaaactctaactcttagctccaaactacaacttcaatgagagctagctcctgttagagttggagacttgttaaaaagcgtttggctaggtttcagccccagatctgaaaaaaaatgaaaaagaaaggaaacgagacgccggctgtttgccgacccaggcgcgcacctgtgcaacgtcccgcgcgcgccgcccgtcgtcgtcccggtcgccgtcgcccgtcgccgcagacgccgccgtcgcccgccgcctcccgccgccaccatcgcccgccgccgacgatgccgccgtcgctcgctgacaaagatgctgccgtcgccaccgccgttgcctgccaccgtcaacgctgccgctgccgctgccgctgccgttcgccgacacagatgttgtcg

SEQ ID NO: 104658 - DNA, 2526 bp, Oryza sativa
ttatgagtttataaaaaaagacttttaatatatgttttacgatttatcttattcaaaaaattatataaatatgaaaaaatataaaccatttcaagtacctttaataaaaaaatcacaacaaaataaatgatttcatattttttattaagaaaataagcgatgtcatacattaaaaaatgagaagcgagtaccatgcacacgttacttccattataattcatgtttattttcacagtcattttgtttgtaggacatcagcaatatcctaaccatgtgttttattttttcaatcaaagttcttgtcagattttaatttcctgaagataataaatttctagttacctaaaattatacaatgtatgttacgtctaaaattgcgagactacacggtcactgatggagaaatcgtttttagtaccggttcgtaacccccctatagtcccagtttttaaaccggaactagaaatctgggactaaagatccctatctttagtcccggttcaaatacccgggactaaaatcgatctttagtccactaaagatgggagcgggtagtcacggttagtttttttttccatttattgctacttactacttaaatctctaatttattttctcccaaattaggtgggatgcatattcccaaatcaaaccccaaaatcacagtaacatcccaaatacacaaatcaattatatacaccacagattatacatcccaaatcaaaccccaaatcaaaaaaacatcccaaatacacaaatcatgtacatctcagatccatgcaatgagattctaaaaaagaaattatacatatcaatccatacaatgaatcacaaattcttcatctcaatatatacatgaataacaaattcttcaaaaaaaaagaagcaaagccgccggccggctgagctggctgccgcctcccctcctccccggccgccgccgcgccgcctccgccggccggcccgcccaccccctcctgctacgcacaccggagtcgggaagggataagaaggaaaagagataaggaggaagggaagaagggatgagataaggattagagatggagggagagaggagtttgtgtggataagaaaagaggataagtaatacggattatatagtgcgttttgatctttaatcctggttcgtaataccaaccgggactaaagattcgtaacaccaaccaggactaaagatcacgtgatctttagtcccagttggtgttacgaatcgggattaaagatccgatctttactcccagttggtaactccaaccgggactaaagatcctagagggtctgacaacacctgacagcatgtgaaccgagactaaagaccaaccgggactaaagatcacgtagtcccgttctgcttataaaccgggactaaaaaccatctttagtcccggtttttactgcaaccgggactattgtggtttttggtcgaccggacaaagatggtttctccactagtgggtgtaactttagtttatttttactataattttgttaatgggtgtggatttgcttgtttgatacaagtttgaatattaacttgttatattttattttttaaaaaaatattaaccatataaatttatattacgtctaggttaaaataataagtttgaccctttacttaaaaagtggttatgcttaaataggaaatgaggagagttatcaaggtggttagatatttacctatttattaaaggtactatttttctaataataaaatttattctaccctttacttcaaagaattatagccaattattacaaacttacagtttagaacgactgtgaattaacagagaaacaagagaactaactggaacacactaattagggatgcatggggtgaagaacctttccgtggaacgtggcgtagttggctcgcgttaggccgatggatcacatgtggatcgcgttagggattcatataaatataaatgttaatgaatatagatatctaatgctagaaaattttacattgtaaaacggaaagtatatactctctccgtctaaaaaaagacaaaccctggttttcgtgtccaacgtttaaccgtccgtcttatttgaaaaaattgtgataaaaattaaaaagataagtcacgcataaagtattaattatgttttaccatctaacaataatgaaaatactaattataaaaaaatttcatataggatggacagtcaaatgttggcacggaaacccagggtttgttttttttttgacggagggagtagacatgatcagaaagggctcgatcagtcgacacacatccaccatgtttataattaattaattagtataattgttacctgtagcttagcctagctagtaccgtacggagtgaggatataattaagcgggtcagcccaccaagactggctcgtttaaatagcctacacgcgcgcaggttcgctgccggtatacgtaattaacatggtttttcacttacgtgcgattttactgtcagaatttcagagtataaatccgtcaaaagtttatcttcttttacg

SEQ ID NO: 104659 - DNA, 1240 bp, Oryza sativa
cctgcagccctgataggtatgtaatagccctactgctattggccgaagccggtattgcttttatatattagtatcgcacgagtacaatatctaggatgacctaatctaatcaatgcttcctcgaacatgaactctgtgagattggagatgtttctagatccctcatgtctgtctctatgactcctacattgggtttgtctagatttgtattatcttgtattcacctcttattggtgtgtcccctctcctcttgggatcttgtatttatactttgggtgacccctagtccaaatagaactaggcaacgtatggatacaatacgagtagtccttgtcctgctcaaggaggattttgcttctctttccttatccagaacaccttccatatatatgagacttgatttcatgcaagatttggcatatggtggatcccactgaggctaacgcaaaagtattaggtatgtcttatctataacactgatattagtacctaacatccgtccgtctcactggtggagaaaccatctttcgtcggtcggccgaattccacaatagtcctggatgcaataaaaaccgtggctaaagatgatctttagtcccggttcaaaagggtaacgggcatatttaatctttagtcccggttcaaatgctgtcagggcctgtcaggccccccggaatctttagtcccggttggtaacaccaaccgggactaaagataccaacctggactaaagatctcggggatctttagccccggttggtaacaccaaccgggactaagtcccacccctatatatatgtcttcttcctcctccagctgcccgagcaagcttcaaaatttcttcaaaaaagaagggaggtcatgccaaaatttctagtgaatttattttggtgattacatacaaatcggaggtgtctaaaaggttggcaactaaatcctccaatgttttgttgtcatattacatttgcagctatgttttgcacacttttttgtctccaaaatttagttgtaagttgatgagagagaaaatttatgtggggaagaacgaatatatagaaatttagttgatttgctaaagaaggttttataaaatagttgagaaggaaaactatagtgaaagttaatcttgaatactagagaacaaactaaaatgaaaattaagagaagtaaaacacattaaaattagtttaaaactttagaaatagtaaataagaattatttggtgtaatattttatgatt

SEQ ID NO: 104660 - DNA, 2456 bp, Oryza sativa
tctagagattaccatgttattagtgggataaaaagagagataagtaggcataaaacttatccaatgtaggaaataataaaaaaaacaaagctatagaaaaaggcacaatacacatccatactaactttcatgtttttatattatgtatgtttatagtacactatatgtatatattagttttcactactacataaattttaataggaaacacccttaaatgtgccagtttaactaaaaccggcatgcatataaggctttccctgtccttttaattcgtcatatggatctaaaatttaaaaccgacacatataacccactataagtttgttttttttagaaaaacgacaccaataatatttctaacatctaggggatataagtgtcggttttttttaaaaaaaacaactgacactttaggatgctgagccgagccaagagccagttgggccaggtgtggagcacgagaaagaagagaaaaacaaatattttaagtctcgtgactctcatccttatcctctttgtcctcccgccttgtttccttccctctgcacttctctctccgcacctctctcccatctttcaacacagcggtggtagatgtggctcctcgacatggcggcagcacggtggccatgcagtggcgggcacgtctcctcagcattgtggtggccactagcacaacgacgcagcagaggccgggtctccctggcgcagcggcggatgccatatccgaagcagtagattttgattggattaatctgggcatctcatgtacttgattattttgtgatgattttgattggattgggatttagttttgtgttagatttgtgatgcatcgagtcttattttttttcattcctataaccttaaaggtgctagtttctaaacaaacactcttaattcttcacatcaacctgtaaggtgtcgattgggaaatgcgataactatgccaggtttccaatcgacatctatgtttatgtcgtagtgttttgatgaagaattaagtcaagtgaccactaaccaataaacagcaaaaacattttaagataaaaatacatatcagttcaagtgggctgtgcttgtacctaagcgtatctggtcaaacccaagaaacaaaatttaatcggttacacatagaccatacgtagcaggcgtatcttgcttgtacagcacgccgagccatccatcagacgtgccgagtgtttggttacacatgtcgccgtcgatcctacacatgatttggacaatctgagataggttaaattcacgcactttacggtcgcaaaagctcccaactttatatctttgtttcgctgtcattagagtacaggtgtagcactgaaagtacctgcagccacatgttgctcacactgccgtggctgctcggcagttatttctccccaattgaaaaatggtgtacttctgagttgcttgccaatggcatcatatcatatggactaacctatctgtatattgaaagcgacaactaatttggaagatagtattaagcagacatggcctattgccctgctttataacttgccatgtttaccttccgttttcgaagttaaaaccgctcccaaccaaaatccaacaaaaccgatcaaaatttcatacataaacaagctaaaaacaatatattttcataaacctccaaccatcatctgtgaaccctggaacttactagcattttggggacggtggtctatatataagttgatcatgccacttgaccgaagtaatgaaaaataattttaatggacataaattaaaaaacctccccaaattagtttcaaattaggttttaaaattcaaaattacgcagtaaaattaactggtggatcacagcgttgaagttaaatgctcccggtgcctgcattgcatctgaatgtttcggtacttgcgtgggactgaggtggtggttgctgcatggacagcaatggcggcttgctgattttgttcgccgcaggtgagtctctatcgctcagtactgcgtttggagtgagtgcgagaaacttctttgcagtattcaccatgagtcattaagaaaagtttaaccctttagtagcaagtcctaatcatagattagtaaccgagcaaagtagtgtttgctttactactggctactgaatattgagcttaagcataccgggggaatcaagccgtactaacagtacatcaaattatggctggctacctgtaaagttcagaaaacaggcatcagaaaaatggttgtgaaatagtattttgttagtttagaggagtataattaatagtactagaggatatgattgtatttctctgtatttttcagtagtgaaaactttacctatatctgaagtggcacataagtattcaagaactactcatttcaaaattttgtattttagaacggaggaagtaacattcatcggttcatcttcgccctaatagtattcaatgaagacggtctt

SEQ ID NO: 104661 - DNA, 621 bp, Oryza sativa
gcgggatggaggctgagtgtgggccggtggcagccgggcgcgagccaacggtagggaggccggccggcgggatgcaggaagagcgcgggccggcaacggccgggcgagggccagtgggatggaggccggccggcggtggcccggcgcgggccggaggcctcgccctcccctccccagatccggacggagaagaagctgcgggatgggggtgatttgatttttttgagtttttttatctttttttttatgatttgtggatgttgtgatttgtgaatgttttgaatgaatatgtgaatcgatattgtgaatgaatctgcgatgttgtgaatgagtctgtgaatcgttgttgtgaatgaatctgtgaatcaatattgtgaacgtatttgtgatgttgtgaatgaatctatgaatggatattgtgaatgaatttgtgatgtatttgtgatgaatctgtgaatcgtctgtgaatgaaaagatatgaaaggaggaaaaataaaagaaaaagccgaaggagaaaaaaaaattagtcctcccggttggtaacactaaccgggactaaagatgcaaccgtcttttgtcctagctggtgttaccaaccgggactaatgatccatctttagt

SEQ ID NO: 104662 - DNA, 627 bp, Oryza sativa
ccaagggaggaaggagagatttatttggttttctttatattctaattgattaaatgaactttgtgctattaaaattacttcttgagctgcgaaaattcgcgggaaatttgagagagtatattagggcacaaagaatattacaaaatattcccggctaatgatttttaaaggaaattttaatttcctcaataattctcttgattaaattgatttaatttttatttaaattctagaaaatgcattattaaatgattttttaatcccgaacgaaaattggggcactacagttgccggggatgcaagctcttgcatacctcacagactagcgtggagaatgagaaggaggccaagctagaggaggcccgtgtggaggaggtttgatccgcttgcggttcgggcagcttgggacggcggtggcgatcttgcagctcgccgccccctatgacgatgccattgttgctcgggtcgtctctgctgtgacgatgtcattgttgaccccaccgctgatatgcccaaagctcaacctccaccacccatctcctcacgattcggtggttgatagccctcccaagccagattcctcaagcctcttttgcaggtttcctcttccccagaccttgcccgttg

SEQ ID NO: 104663 - DNA, 1399 bp, Oryza sativa
caaaagcttagattaataataattcgatcacacggacatatctttcacaactatatcaaagtgattaggcagaaagcacacaacatgttgttactagaatagaaaaccgtgtttgattagtgaacaacttataacacagtataattgagtggtttacaccttttgagtggtttataagcgctatttaccactcttagttttgggaaatattcttatatatatgattaatcataacatgctttaaaatctaattgcatcatcgactatgcagtaagagattattttggagcttttccatggttattgctcccctatgcgtggacatagcttaatctgaataaactttataaatatccacacatctcacaaaatgagtgtctaaatgcctctaaacttctgagatcattggactttagaaatatgagcatgttacttaagattgtcatgcaaataatgcaaaacattcttaataccagtggtctagtctggatttaattaaatactgccaagattcccagtaaaaatatatgccaaatctgtatgcatccagatttgagctaatctcaagcttctctctgctgaatcataaatgattatctttataatttaattttagcttgactaactataactaaattctctcaaattatttctttatgtcaatatatgacttattgatataagccagtactccttcagaccaaaataactcagggaaaaattttctcggtttctaacagcaatatgcattgcttgacaataaaatgtcattagtatagagtaccggtgaatgaaattcccacctttaattttcatgcacttgtccacctcacttgaattgttcgaaatttccattagagtcaggcttaattttattaacccacttaaatggcccagtattttgactcattcagaaacttctacaaaattctttattttgttcatcaatctcaattattcttgtatggttcaaaaaccatttagatgaacactttaatgtcttattttgttcatccatctcaatttattcttagatggttggaaaaccatttggatgaatgcttatttttaatgtcttataaggtgaacaagctttatttagtgtttaccaccataatcagatctcataacttcatttgattttagcattagtgtcttacatttcttaaaggaaatcggaggtcgcttatgggtaaacatagccataaataatcatttgttggctaatttcttaacttagtgaaattttcacttaaagctaaacaatgccattaaaatctaagggaaagaatatctctatctcattagacgttccaaactcccctaggtatgtgacataagcgacaatgacacaatttcaatgacgtcttacttccatcattatagaataattattgtc

SEQ ID NO: 104664 - DNA, 938 bp, Oryza sativa
atttttccatgctaaggcctgccgagtagcaaagacgaagactgtaaagggcgaaaaataagaaacatggtgcatcgaatagatgcacctaattaggtgttgcccccgactatatgattagttaacaaactaaacatgtagtcaagaacaaaataatcgcataatcatgcatcatatgacaaaagcatatgcggcgtccaacaaaacattcagccgactgctttccagccatagtaaaaagaatccgagtgaataacactctaaaaggttcacaaatgaacatatttgacaggcatccgagtaaaaaactctaaagataatccatcaaatgttataaaaattatggtaattaataagtctaatagcctaggctatgactctcaccataattaaaataggcatataacacgccaagagaatgaccattgtaaaaacaagtcatctcaaatcaacccagatagcttttgcagcctaaaaaagcttacaaaaatagtataacacttttctgtcgagtacatttcaatttgcattgcaataattccgaagaattatataactgcattaaaaaggattttatcagcattgggccacaccattgcgagcataaattgccaaagcaaaaatgcctaagtccctaaggagcacaacgggccacgctgttaataatattgggctgaagtactgttcaggcctaggcacattagcacccccgaaacccttaacaaaaaatcccgaagtctaagcggcgcttcgtcttccccgccggaactctcaccatttcccccattccttgctatagtacagagctgcgccggcgaaactagggttcaccattccactccaatccacctccaaaaagttcacaaaaatcctccacgcaactcatcgcttcaattccacatctctccccagccatccctcgaatcaaatcaactcat

SEQ ID NO: 104665 - DNA, 835 bp, Oryza sativa
tcgctacttatcactgtaatcgggagtttgcagcaatcatgtaataaataaatatattcatgattataaacaatgagtttgttatgtttatggaagattcatgttgaggatgcaatgtaccaatgctaagcacctttccttttaggcaatgcttagtattcatgtaatgagggagaaatgtgtaatacagacaagttctatgaggattcttttggaagatgcggatatgtgattatgtgtataattgcttactgataaaggagacctagggtctcattccagaggaactatgttctaacctcgagttaataatcaacctgatgatggaaatgaaaatcaagcgattaaccaaagagacatttgtttggacaagagtttcagatgtgtctttttcggatgtcagggttgaatgtgtaaaggaatactttgaatgctaaataatgacaacatgaagggaatagtgggaagtaaactgaatgtaaagaaagtgaatccgagttgcctgttcgtgggaactattcctagttatgaaccaagtgaaatgttcgaagatagtctatagaggtcagattaaaatcgcatctaacaacaaagcttcagatttggcaggaaaacgatcagacaataacaagttcagcagtaaagtcaattaggaagacgtcaaagcatgtcaagtgggataagttggttctgttgagaaacataattcaaaggcaaagttatcgacccttgcatcgaatagcagaagtagctagcacccggagaccaggaaaactaatatgaggcagtttgtggcaaattagaagtaaatgacaagcatgatattcttatgatg

SEQ ID NO: 104666 - DNA, 1037 bp, Oryza sativa
aaatagcatctgtgtgtaaagtatgtaaaacattttcaatagtttagggtgtagaatgagctaaaaactagtttatgggctaagtacttcaatgaaataatttagaagagtgaaatggtgttaattttctcattaatatagatatattactatacaaacatgcaagttaaatttgatccatagatcgaagaaaaaaataaattactcttgctaatacttgtactatttacagttaaaattttcttcttcatttgcttgtaatatgtttgatttaatctagtgtgattttaaggaaaagacgtgcatttgtaaagtgatatatcacccacgcatataatttatattttcaattttttcataagtactttttggttgacaggaaaaaaaaacatccccggaaaaaaaccatcaccgctttgtagcaaacattttaataaaatgatttgctaagcattctgattagcaaagaggtaattaaatggatgcttttcgtgaaccttttgggtatttcatccccaagagctgggtcactaccaaagaaacgatatattttaccgtagggcccaaaacacaaatatatcagttagagatactttaatatcggttataaaagtcaagttcctacaaacatctttggttgtggtgtgtgttactaactatactaaaatgcatctttaaaatgcatctttagtactgtttggtaacactaatctgtactaaagatatttttagtactgttggaacaccaacagttactaaatatacctctttagctagaaagaaagcatctccatctaaattagatgtgtgtagtagataggacgtatgagggctaaggtgagagatattgagttcaaaatccatatcccatatattttttttgatttagtatgtattttagatcgagatgtttagtcacgatttattagtttcggctgcaacaaccaaaaataaaaaaaataaaggggtttttaaccggtggtaaagattctctctaccagtgagccagtgagtataacaatgtcaagaattgattt

SEQ ID NO: 104667 - DNA, 690 bp, Oryza sativa
ctatgagtcataaatgaggtagaatatcttctcttattagagctcttgatgagctcccacttattttattatttatgtaatggaagcataataccttatgaacttgaatcacttgatttactttagctttatctaagtaataatagatgtcagaaatttctaagggtgaagtgtctcgaccttaatgagacgtatattctcccctagaaatgtggccgaaaaataatgccataatttcgacaatgtctcataatgattcaacccaaaataatgccattaatcttcttatttaactactttcttaaatcaggacattaagcatgtccctattgcttgcaaagaacttacagaagaaaatttcaagagtagcatacataggacatagaggcaattttatttccccttgagaggaaagtgagctttattattattaaatttggagttgctacaaccccttagtaaagcttcatcttttccatcaaatgacaagattaataggatcttacatagtttgcctcttagtcttctatatttcttattgatttgtggaatgatgaaccaagtcaattatggtccactttgtcttagtattacaactctgaaaatgaccgtagcctaatgggagaagaatcatatgaaatggacaagtggcgcatatgaaatgtgtgatgtccatcccactatgtttgc

SEQ ID NO: 104668 - DNA, 1516 bp, Oryza sativa
aaggtcctaggaatgaaaaaaaaaagagaccggctcgatgcatgcatcgaataagtccccttcaccccaaccagatctgattacacttttaattacatttaatccaagaaaatgcaagaacactaataacacaagaacatcaacaacacaagcaatgagaggggaggggagggcgctaccgccgggtggtgcggtggagagagagggatagggaggaggcggagaggataagggggagagaggggggtaataaaaagagtgagtgaggggcgatcaaaagggagagatataggtggaaacaagtcgtgattcggcttattctactcagtctgtcggttttcttaacaagtgccattttttttataaaaacaaacctacaatataaatatagttatcggttcttgaaaaaccaggacctaaaacatattataggtaacggtttttatttaaagcggaccctatctctcaacaaaggtaccggttctagccgatggtgtgccatggatgcgcgttttgggtggaaaacgcacaatagctaggtttcggttttaacatttccggcaaatatactgccgatcgttatgttattgcatgcgcttctacaatttcattcaccaaaaggctaatatgctggagtgcatgctagcatgatgatcaacattttaaatcatttgcgctattctaagctagtaataggtatgcactgtgcttttgctagccacctaatagaaacaaactaaagggactaaaagtaacgcactgatctataaatatcaattgtttgtacaactatatattatatcaccacatgaggatcactatcatatgcgggaatatgtgggatcccagttgcttctgacacagctgtatttcctaaaactctcctattccacaatctccaagtgaatctagttaattagtagttaactaatttccttgaagaaatctctcttctcaaaatcatatggaatgagtgttcttgagttcatgttttagcttacaacatttcaaattacagcatattaatttcacagggatttaggtcctgtttgggactactccagattttagacccataatagacttgaagtttatacattcaattacagttgctttaaaaatttaagtttcatctgcaatatgcacaaaaactttatctaaatgttatcaatgtaatcatagatctagatccatgaatttgtgaacctaggaatatccagctccgagaaattttggattcagagttgtgccaaagagggccttaatattacgcgtaatggcggaaacagaactccagtctcggacataaattttaagaatttaaacattgttttcttctgacctgaaaaaaaatgctggaaagaatattctgccaggtgggccaacacagaactaaaatttcaatccagaatttaacatctgcctccaacctatgtaaatagtgagaataattctaaaaataagtcgagaggtactttgtaatgcatctatcgtcctaccaaaagttgagtgtaaa

SEQ ID NO: 104669 - DNA, 1233 bp, Oryza sativa
agaaattttttttttcaggtggaaaaaacacgtttttacatatttgatcatgaagtgttttacgcaaaactagatggtagtaacgtgtgattaatttagttttaattattacaaacttgaaaatggattaatatgatattttagagtaactttcatatataaagttttcgcaaaaaacatcgtttagcagtttgaaaaacgtgcaacgagattctataatttcatctaataattgttgaacattcgaaagcatccatatcatggatgtcagctcgagagggatagacataagaggggcagcgtaaccggaaatgctactgagcgagggatcgccctcgctcgcccagggcgatcatttccacccccgcccccccttccctccctccacctctccatctggtttccttttttggcaccgcattactttccgattttagtaaatttatatacctaaagtttacacatctaaagtttagagcccaaaaatttataagtcaaaagtttatatatccgattcaaatttgaatttgaattcaaatattttttatatatagtatttctatacatctaaagtttatagacctaaagtttataagtcaaaagtttatatacccgtttcaaatttgaatttgaattcaaatatcttattcaaatttgaatttgaattcaaatatttttcatatgtagtatttctatacatcgaaagtttatacacctaaagtttatagacctaagtttatatacccgattcaaatttgaatttgaattatatctgattcaaatttgaatttgaattcaaatcttttctatacatagtatttctatacatctaaagcttatacacctaaagtttatagacccaaagtttataagtcaaaagtttacatacccgattcaaatttgaatttgaattcaaattttttatatatagaatttctagacataaatttttctaacttttgtttttaaaaaacaattgtgtggtctactgtagtacaaagaggagaaggggaggagaaagaggggagaggagggaggagtatagggggaggggggccagatccgatcacccaggcgatcgcctggcgatcgatcgcccattagggcccccccaagtccagggtttggctagtttccgagctaatgaatgtgtattttagtttctacttttaataatagagttatgagccgataacatttcgatagaatcgggctcgaatgtggttggatatg

SEQ ID NO: 104670 - DNA, 523 bp, Oryza sativa
tagcaccacatgagcatcactaccatatgggggaatatgtggtgggatcctagttgcttctaccacagctgtatttgctaaaactcctcttccacaatctccaagtgaatctagttagtagctaactcatttccttgaaggaatctctcttctcagaatcataaggaacgagtgttctagagtttatgttttagctgacaacatgtcaaattacagcattcttaatttcaccaggatttaggtcatgtttggcattactccagatctcaaagccataatagatttgaagtttatacattaaattacagtgctaatttagaaatataagtttcatctgcaatatgcaaaaaaaaatgtaaatgttatcaatgtaattatagacgatgtagatccacgccaaaaaaaaaaaatcaatccagaatttaacatctgcttccaacctatgtaaatagtgagaaaaattctaaaaataagtcgagatgtactttgtaatgcagctaccatcttacattgtcaaaagggc

SEQ ID NO: 104671 - DNA, 1040 bp, Oryza sativa
cattcctgaacaaaatcaataaatatttagacagagacatcctatcttactataaagttatcccccactaactccttaagctcattatcatccactaacaagatgccacatcaacatcaactaacaatcatcacatttaaacatcatgcaaacatgctatatctttatagtttttataatttaagatcttttcaaatacaaacatgttaaattatcatctaacataattcacataatgtttcaatgtatatttttattatgttttatgatatcctatatacttatataatttatcctcacttagttagtgcttaaatgattaatctatggtctaagttatctttctccttttttcttctaattaagtcatatcacatcaattgtttttagcctttagatgattaatctatggtccaaactatctccctacttttcttcttccataaagtcaatcgccattctacatactatttaaatttacattatcataaaccacattaatttattaatttacttaatctgatgttatctatctatcttacacgttatttttttttattgttatcatactaaattcccgcagtaatgcgcggggtttcacctagtatctatatatactggatcccaagccaataaagggataatcatactctaaataagaacaattttgtagttttgacttttgacagttgttgagaaataccataatttggaatattagcttgtagtacctcctgttacttttaaaaaacaacataccaaaaggtatttaaatttacactaaaacataccataatacatcctcgagaaactgtaaaaagcctcgttaaataagctacctggattgtggcatgtgaaggatctcccaggcagactggacgactcaataatcctgataatataaagccactattcatcattatatcttctatgaataaagacaaggcacatgaagattgaaaacgtacgaaaatatatagacgaatgaaactagaagaacgccaaaacgtaacgttgatacgaagatggaattttcattt

SEQ ID NO: 104672 - DNA, 1312 bp, Oryza sativa
cctcggcattgctctttcgtcgaaggccaggtttgctacgctgcatctgagcttgaggtagctcagaaccgggaatcctgcctcgtggaagatgatcctttcttcaggggcgtcactgacatggagcgacagtacggtgagttcagacaatccaccaagaacatccatgtcgccatcaccgagtttcctgactgcaatcttcagaatgcagaggctgccaagctctctgatccagtttggaagcgtggagaatgtgcagacatgaggtgacagatcaattctctgaagcaaccgaggaggagtgcacatttgccatgacattcttgtagtagctgaactgaaatgagcagtggatgatgtcccgttcaagaagccagcagctagagctaaagatttgaggttgacaaggctctcgatgacagaaccgaaaatgttcatggtttcccaaagaagctggactgactgaaaataacagcaggtcagatgaagatcctgaagattgatcagatcaacaaggctcttaacattttctatgctgctaccactgagatcaagatatgcagattcccggcagctcggtaggaattttgacgtgggaccaaaaccatctgaaagtagactccataagctttccaacaagtactcatgggccccgaaattccttctagatcagcggctaggtcgaagttgatgctgtcaggaggcccgaatccgaatccaaaacgtgtggaattttatctcttgtcttctatggaccaaaagtgacgtggtgaaatgaaagaagacttggagaaggtattgatatggtccccaatcaacttctttgatcatccatgaattctttacgctcagtctcttttctttcgcccaagaaagtacctctgcaaacaaaaacacaggaaactcattgtgtagcaacgtttgttcaaatatataacatgtaaatctaatatagaacatatgcacctttggttgattaatacataagatagtcatggttatatctgagctagttgtgtcctcatcatcctccccttcttgattggaaactgtcctcagtttcaccttgtcatggagcgtattgtacttatctttgtctattacaacatcctgtgctgaacatttcttgatgaccatatgattggatcctaaaatctttgtagtcgaaaaactacaacactctccttcttgcaaaccaacctgtaactcatttaaacaactagaggaactagatagataattatttatatacatgcggtcctctagacaatacatttcatcatgaaaaggatgtatagtaaaattcgaacaa

SEQ ID NO: 104673 - DNA, 694 bp, Oryza sativa
gagattaaatcattagcactaatattatctttcagatgtaagtgttatagttttgtaattatattggtgctaaacttgtaattttaggatgaattttgttaataaatctgtaattttgtgatactttattttaatatgtagtttcacgataattttactttttttaaaagaaaataagatcaacctagaaggaactagattgactttgttttaagaagaaaacaaacaactaaattcctctcgatgaggataaacttaggtggtctaggcgtgcacctacaccgtcaaacaactaagccagcctcagtttctaagagaaatttatttctacgtatgtagttttatgataatttgattaaagtatttctagtttgacgaaaattggttaaagtatttatataaaatttactcttcataaaatactcattccattttagatataattaattctttgaactataattttaactgttagtttcatttatgaaatacccgtatatctatgatattatggcggtacattttaaatgcatcaatgttttattttgagcaaaatttcatacataaaaccatatataaggtttagcacaagtcacataaccacacactttctggtattattatttcatgaaacctcatcttaagcaaatcttatctatcttacacatggagtcgctggtaggttgtcatggcc

SEQ ID NO: 104674 - DNA, 571 bp, Oryza sativa
ctaaagattctggtctagctccaaacaacttgtgctaaaatatttgctactgaggctatatttagatctaggggtgtaaagttttgccatatcacatcagatatacggacacatatttaaagtattaaatgtagactaataacaaaacacattacagaatccgtctgtaaactgcgagacgaatttattaagcctaattaatccatcgttagcaaatatttactgtagcaccacattgtcagatcatggagcaattagacttaaaagattcatcttgtaatttacacgtaatctgtgtaattagttatttttttgtttatatttaatactctatacatatacccaaatatttgatgtgattgggtgaaaaattttaccagatgatctaaacagggcctaagttgggcttccgtttcatattttggttcaattagttggtcgttggtatatgttacgtccatcttattaaaaggtgaagtttgagcaggaggcatgtcaagtttgtcatttcaagggaaaaatggttgtccctcccacctttgtttgacattaatgttacccctgtttaggg

SEQ ID NO: 104675 - DNA, 1145 bp, Oryza sativa
ttacatagaattgtctttattcagtagcttatttgtagcacatttattgtctgaaatagtactccaggacccctcaacaattagatgattgatgatactttatatatatttcttggagatatgtctaatttcatctactgctgagtttcatcaagtaaatcttttgatatcttcttgctgtgcagacctttctgtatatgatggtccctagaaaaatattatttcaattactgtgaattctgtgtcactgtgtgttacacataagtggacattaaaaaaaatcctgtttaattacatgccaaaccacataaaattttatagtgtttaggatgtccataaaatgctttactcacatcataacaaatgtcttcgtgtgctctgatattttacatgatatcctagaaaactgtcaatgcttatgcagctttatcagtagcccatgctccgttcatcaatctgttgttgtttttttttaccaactgtaaatctgccattgattcggggtgaaaattgcacatttgtcaccttttgtctaaactagtggatgaatagatagccaaaaaagcaatggcagatctgcaaagtccaataagtatcatggccacttgtatagatttccctttttgttagattgcttgtatgctttactagagccactcaacagaattgcaagcctgcaattacttgtatcttattcttctgtaattttagccgagttaatgtaatttcaacagagttaatgggttagggaatgtggacctaaatccatgcaggctgcccttcatcacacaccatatgcatcatcagtccagtatttctctctcattaaaacaatatgccaatggtccctctggtttttgataaagccttgcagtccatgaacattcatggaatattgaattggtttttagtcaatctaatgaaagacaataatatagttcatgagttgatttctgagtggtccttttgatgtcatattttgttaatagattttgccaaaatgcattttccattagttttgtactacagattttaagttgtagtttggttaacttgtacaattgtcttttatatttttactattgtgaaaaacaggtgggagtggttctcttatcctgggtatttatcctatctaaatgaatatt

SEQ ID NO: 104676 - DNA, 2805 bp, Oryza sativa
ggactcgggagagggggcaaacgaaagaggagatcacggggaaggtttatatgagctcgaatcgaagagatcaagccgcaaacgtgaggaatcgagtcgggaagatctcggactcggttttggagataaactcgaaaacgaattcaaatctcatccaaacctcaaccatttgctttgattcttgggggaaaaggaagaggagaccgagaggaacaaaacccctcaatcaatcggagaagacggagtcggattcggccggatttggggcgggaaacggcggctagggttcggctcggcggcgcccggccggaggttgacgaagggcctgacaggtgggccccacctgtcagcgcctggaggagagaggggcgcgcgggcgcgggcggcttgggccgacctgggccgagcgcggggaaagagagagaaggagggaggagttgggccggattcggcccaacggcctaggaggggactttttgaactttttaaacaaaaacaatttgtaaaatgttgtttcaattattaaaaatacttcccttgctcaaataattcccagaaaattctagaaaatagtatttaataaaattttatctagctcatttttatattgaaaattttcctagaaaattagggtttaacttgtaggcttttaaataatttctaaaaattcccatttaaacaacaatttatacatttaaaatttttagggtgtgacattaaagtggtaatgctgaaataatccattgtagtatagtagcttataagacataagcaaccctttgacatgttcatcaatgtgctatttatcagaaacatctattttaaatcgtgaagtactatttctcatcttgttcttggggactatctgctcctggtactggtgatggcattctctgtccttgtgctgaaatcttgcttaaatcaatagagttgctttagttttttttttctgtttcttgattcctgtattgttctttgggaagacgagggttcagttgggttccattggttgttgccatgcatctctcttcttgatttttatgtgtgtgtgcagtatctttcgtgatgattctgtaccggcagtttgtggtacaaacaggggaggaaaccaaaattagctttctaatgtgtagtaaataaatttctagtattgctggaagttgacatgtttaattagaaagagtaaacaaagtaactccaagaattaaaaaaaaaaggtaactacaagaattaaaaaaaaggcagcaatgtgcatttcacatgttatcctcccacaatcatgtatttaaatgtaatgagtatcccttcagcaaactttagtaagagggtatctatagagggtatgcacaaacatataggcacaatatgcaatacctgagtatgcagtccctcctccttgaagaatttgtgagggagattccttgccccgtgagcctattaaggagcaaaagtttgaaaaaaaatttagcaagcttaagagttagaaatgtccaacatcgccgcaatgataagatgagataattctgaaattcaacttaaaatgcagttgatagtgagtgatactgtcatggctattatgtgtgcatgcataccccaattcatagatctggctgatgcaaagtatggttctatgtcgtttgtatataataatatagagtgttcaattaaatatacaagttaaatttataatgtaccagagtttttcttagctgtgcacttatccatattaagattataaccccagattataactacgggtatctataggtagataagcaaaatagagtgaaccgaccacagcatagaccgttttacattaaaatgaatagtgctcccatagaccatttgtcccataagatgtatactcccctgaatttgttagctatagaatgtgagaatacaattattgtggactgtaaaaaagaaaccatttttattttggtcatagattcagaaaagaaaatgagtctgaatgaatatttgttaattaaattggtcctaagtgtatttgtcccctaggtacgtattatttgaggggcaatatttttatgaagataggtagataagcatcctccagaaaatcaaatgaacacctaaacatcacagaggatgcaaatgccgtcaagaggcaaattcgctaagcaaaccgttgctttcctggctatacgacttgaagaatgatacatggtgtctacttcccacaatgataaaatcacacccggggaagatagctaattgtctggttaaatttcagcaaatgaaagctctattcgcaggagcggagttggcaacatcggggaaaatgaaaggttggctacctgcgcgagcgctgggcacatccacgtcggatagatatagtgcgcgtggtggtggaattttgctaaaaaaaaccctccggtttgtgcgtaattcggttgaagcccctcgcgaacagttcatgtgaggtggtactatacgtggaggcactttggaaatccagatattgcacatgaaggagagaaaaactgcgaataaggactacagatccaccaacatgttctctaaaaacaaagtaaaataaaacatatacacactttacatcaaatgcctctaaaactattatctttaaaataactagttttacataagctgaactttagaggtttatataaaattcatcttagatccttttcgagtaaacccaagttatgtagaatcaccaaaacatatacttccaagttataaaataaaattatacacttactgtataataaaagcctctaaatatttatgtaaggaataaccaatattgaacagcctttaatt

SEQ ID NO: 104677 - DNA, 1037 bp, Oryza sativa
ggataccgatagggggagagtgtgcctagacttcactcaatgtcagttcatttcgtatatagtacaaccacatgtgctagtatgggatagcccaagcttagtaaattattgatggtttagccttacattctggtaggccggtgtgtatcagttcggataactcaaaggaacttcatatttaccccgacgtggtagtttaggtgactaagtctttccaatacaacatggtgggttcccgttgtgtccgccaccacgttgttaagtttaaggcatgggcccgccacttaacggctcgaggtcatatttccagtatgactaggatggaggaacacatatcgtgctggtgtaaggctaaatcatgaattttggaaaagctttgttgtgagtaataaatcggatacttatgtatcgcatgccatgcttttgcatgattattatttcgcatcatgtgggtaaagtgtacaaactctacagagttaaaactaatcgattagccgtgctcgcggtcatgagcggcgtgtagatatgtattgagtatagacttgtatttattcttctaaatgctgaaatttaccattaaattatgttgaaatttgagaatgaactccttgctgccatgcatggcaatgaggtgtatatttatacatgattaatgactactttgatgcccaatatgtcaagtactagcttgctgaaatttttttgaaagcaaaatccgatttggaaatttttatgtaaataaaactcgctttatgctaaaaagatccatattatgccttccttgattatatgccttacatagttacatgtagagtgttaggcttgtcgtggtgcttgccagtatattatttctaataatgtactaactcttgctattggattaactatttgattgcaggtcttagacttagtcttttgagtgatgcgggtgatcgaatgcttcttctaggacttgaacttaatggggtaaacccctagtcggtgtgcttgaggattgggtagtcaagcttccgctgttctctgatatatttatttgg

SEQ ID NO: 104678 - DNA, 698 bp, Oryza sativa
tcgtgctcaagataggtggcaaccggccggcgagatgggcggggcatcgtgggggtggtggagaggttaaccggcggcgaattttcgtggggagagtggggaaaagggtggaggacgtggggcgacggggtcccacgaccggcgggctcgcgcgcggggtggaggaggtcggaaacggcggtgtcgtggggtggctcgggcggccctggcgattgcagccggccagccaaaggtaggaggaggagctgacaagtggggccttgggtcccacctgtcggggagagagagagagaggggaaaacgggcgagggaggtaaagtagacttgagggagagagagagccgagcgggccgagggagaaggccggcccgagagggagagaaaagggcgcgtgggccgcgggagggaaggaagacttgggccgaaaatggcccaaagagaggaagggggattttaattgtttttctttttattttaattgatgcaatgatctttgtgctattaaaactatttctcgagctccgaaaattcacggaaaatttcggagagtacattagggcacaaagaatattacaaaatattctcggccaataatttttaaagggaatttttaattccctcaataattcacttgattaagttgatttaacttttatttaatttctagaaaatgcattattaaatggggctgcaggaat

SEQ ID NO: 104679 - DNA, 702 bp, Oryza sativa
ccgacgctattcacatttgaacatacgttttaactattcgtattattaaaacatatatatacaaatatgtaaaaatataagtgtaaagttacaataaaataaataataattacatatttttttaaaaaaaataagaggcataatcaaatctatatccagaagttgacggcgtcatcttttagaaccaggcgtcatcttttagaaccagacgtagtattttaaagatgttacatagatgaaaagaagatgacagattctagacaatggcagtaggtaaagagtggaatttcagaatgaaaaagggaaaagcattgctgatgcatgatgcaaagttgcattcagagatctggtgctaacttcggatggggacacaataatcgataccatattttgtcaaagattcaggctatgaaactttgacacgccaaaggaaagtaaacagatactcatatacatatcatttccagtggaacaaagagatttaatatttgttagatagaaaaagtgcaggtcagaatttgcctttttccaggttgtggaaagagcttcaattggataataccggtctcagcatgcagctcacaacaatggaagttatatttacttgagaaagtttcaacaacttctgcgttttcgagaaaaaaggaagtttcaagtttcaacaactcagaacataaacttatcagcacatttattagtttt

SEQ ID NO: 104680 - DNA, 617 bp, Oryza sativa
ctgcaccccgagtatagccatgttgttaacacgacaagcggctggacgggcgaaccgggtttacaacggcgaattgcctcctcgggtaaacacccacaaagctgacgacgatgtagggccttcgtgaaaacgaattgcgcggacaaaagtgaagcttgcccctaggaagcgaagggttcctgttcgtcggactccgacgccgacgacgaggacgatgccgaagaacgcgacggcgaggaggaggaagaggaggaggccatggccgataaggccgtgaacgaggcgatcgaagaccgcgtcgacacccctagctacactcctaccccaagtcccggtcacaacgagactggggtggagtcgaacagctcccccgttcgacggaaggatttggaaggagcgaaggctctagttgcgttctcctcgggcacggtggcgaagggaggtccggtgaagaaaagaaatctcccaaaaaaaaggaaaaaagggggaaaccctttccggtttcgggaaaccaattttccgggccccccccgcgtttcagcgacgatgagtcttctgacgagactccgacctcgcctgctggccgcagtttggacctctcaactgctccccttgct

SEQ ID NO: 104681 - DNA, 520 bp, Oryza sativa
cttgtgggttgaggatcaccgtatgcccagaccaagctcactgacatgggaagaacgatggtcgacaatacttttccatatattccttctgaaaacggctgaggtggcgcacatgaatgtattatttctgaaaggtggcgcacttgggccttccttgagttctcaaaaaaaagaaaaaggtgcaaacacgtcgtattattttttggaggaaaatacattgtattctgaaatgaagtaaaacaggtcgcacgagttctaacacgtgtatatatggtacaacacacatgtatccatattaccttgtaagtcgtatgtaataaaatcaatttcttgctacagtttggaaaggtacataatatagatgataccctgtgtgttgtttgcatggacttttagtaatataaagcaatacaagttgtatatgtaagatgcctgcgaaagggcatgtagtctagtggttgcagtgacttgcgttgcaccgcaaggtccttagttcaaatctccataggagagaattatt

SEQ ID NO: 104682 - DNA, 551 bp, Oryza sativa
attatagtaaattgtgtttattgctaatttgtctctgattctctagaaatacaattattatgtaatggaggcagcagttgattaataaaacaagtaacacttccaaatctcttatatttatggataaatcttaagcctcaaaatcttttatatttatagacgacgggagtacttgactctttcttttttcctttcatagtgttggtgatggagctgcaactttgatgtataaaatattttcatcaacaaaagggtctgatgacataaattttagacagctaaatgtagctttgaacatatgctagtacaatatcgaatgttattcctggcatatattatagtagcggtaaataatattactcaagtcaaattttatttccgacaattaatcgcccacatggtgtagtaaatttccagctatggtcgctagtaaaatggactgatgaaatattccatagtgacggcaacaaatggacacaacaattaagccgaaaaagagacaattgcgtagaacaccacccagcacctctgtctgaagtctctaattaacc

SEQ ID NO: 104683 - DNA, 757 bp, Oryza sativa
  unsure (1)..(757): unsure at all n locations
tttaattgatttttatagcacaaaatatgcttccaaagtgaatttttaagtaaaagaatanaatcagatcattttggatgtgtctgaaatctgaatttacggctgaaaacaagctcttaatgattctctgaacttgaacatgtccctgaaactgaataaaatttatgtaaagaatattgaggacaaatttatcaggtgtatacaatatgattgctctatttagagatttgtgccatttcagcaccctgcctgtatatctctaaaatctggctactacattatgcagagacaaattagtaataatctgatataaagtaagaggacaaaccagaacaaattatcttccacagatatcttttatgcacatgaaaagaaaagggtttgtcaaattaactcctttttgccacaggttccagtattgtctattaaatctaatgtgcttctaattaatcctatatacacaatatgctaaattttcagtattttaagcactgtgctaccatttgcagaaaaataattggttaataaactaacagtacactgctattaccagctgttctgataagtggtaattagttgggtgttgtaagtatgcaggtagaaagtgataatagaaaagtgtgccaatcaaagagctgttgtgggttcccagtgacaaaaaagatgagtctttagaaggacttctagagcaaagtgttacagcaaggtttgttgaaaatttaggagttggcacaagaatggaagagggctgcaggaa

SEQ ID NO: 104684 - DNA, 812 bp, Oryza sativa
aaacgactccacttaaaagggcatgcaacacaaggatatcctaccagcttgccatatatacattaaaagagagtaagagacacttatacagttatcacctactactataaaaaataagcagatcatacgatttacttggcaattagtcactgtgcctctaacagtggaaatataacagagtatttggccatagctggaaaagcaaagaagactctaaggtgggcaaaactgagaagtggcaaaagatggaagtgaatcttacttagtgccaacagacaaattttcccattgaaaaagaaaagtaataaactttttaccctgatttagaatgcagctatgatcacatggccatttgagagtatgaaataagctttcaatcttaactcagaacaccatataggattatacagacatttacgaatagcaggtggcaataaatttagctgctaaggtgcttttgttaacatttgtcaaatgtaaacaggtttgattaactactgttaatcatgacataatgcaagaataagttgctgcaaagatagaagtccatttgttcaattttcatttccacgcgcagcgcttgctgaggactactccttggcacaggacaagcttcaaggaacaaaaacactctaattttctgctctcatcttacttcgataaggcatttttttccttaaataaacaccgcacacaagcaattgcactaaaaatggctctgtcagaccaaatgccgccacatatatattccatccgattatacagaacacaataagtgctacttcctccgtttcacaatgtaagtcattcta

SEQ ID NO: 104685 - DNA, 2707 bp, Oryza sativa
taaacagctatggggactccactccacaagcaactcgacccgaacaaagcctaatcctcctgatcatcaccttcactgaagtactcctcctctgatgaatgaatattgtaagaatgagcatatgacatactcaataagccacacagcaaatatgcaagtgcacaggataacaaaggatggcataataaagctcatttgcataaacggcatttaataaacatttgagagaatagtaaaacagtggagtaatttaagcaatattaaataaacaccatacaacacacccgtgttgcataggcccaaccacatttgaacaaccaaccccggttgtacaaaccaaacctccataccaggaatataccattccaaaccaggagtcaatttaataatcacagtattatcattattaatgagtaatgtgagactaatcacgaaaaatattgttagacccacccttaaccacgggcacggctattcgaatagttctactttggccagagatgtaccactgtacccacaagacacaactccacaacatgtcaccatgcgcctcaggaattcttctatggcggcgacccacaatattctcgacataggattcggatacacaatgaaacctcacaaactagatgaacaacacattgcccgtgcaacgcaccttttcactacggattcacaaaaccacatgctttgataggttgatccacttgactacgcaaaagtggatctattgccccctcaattccctgcaaggaaaagcaagaacaatctatggcagaactcccaattcatctctctagtttggcggcagcaacacaaaacctaggagaagaacaagagcaatcatgctgcaattttcattagaataaacatggtctgaccttggcgggtcatgtacaaaggcatatataaccatttcatggattagaaactaactaggaatcaaatacaacatagtatggaaacttttctgcaacaccgtcagtttgtttcggctcttgcggtggaaccaaaaggtttttgtttccgtgggcctctccatcacatgggacatgacgttagctttctaacaagtgctcgcacatccaaaacggactccaaacgagagagaaacaagcattttagtccaggtatatccaggcggcccaaaccaagtccaaactgaatcttttcttccttatcttcaaactcctcatttcagaaggcttcaattcatggggaacttgtagatggattccatcccaacccaagatgggcattaggatagtagaactccatccaagcatttcgtgcaaggcccatgttcaacatcaatagagctgctcgtgcatcaatcagtctgcttgtgcaacatgccttcaacttgcaattgttggtgatagagaactctgaatgatgtgcctctacctccttctgaacccacatgcacgccaatggttcatatatctcatgtctgataaagtgacaaatattatgtagcatcaagttctcatatatttctcggatagacttatggagaaacgagttcaccttattttctaatccgcatgcacaagtaatccccgccatttatctttcacatattgtatactctccgtatatatccgcagcaacccacaggaaatctagttccttatatgattagacgcaaagaaaaaaactataacctataattatctgctttgggtattgcatccaagattagaatggccaggaacagccatcacacctacaattccaatcatttcaaactagtacctacacattccagaacaaactttgtatgtgcaagctataagactaaactgacaataaatccaaattgactccaaagtgtccatcctcaaatttatttttgataatgatctccatgacaaacttgatatgcgctccaagattcatagaaccctaaaaaggcagtcaatctcagacaaacaaccttgaaatttctaactttcactggtggaaaaaccatctttggtcggtgtaacgccccgattttcgttcggaataaaaatcaattaataatgcattttctagaaattaaataaaagttaaatcaacttaatcaagtgaattattgggagaattaaaattttccctttaaaaatcattggccgggaatattttgtaatattctttgtgccctaatgtactctccggaattttccgtgaattttcggagctcgagaaatagttttaatagcacaaagatcattgcatcaattaaaataaaaagaaaacaaataaaatcctccttcctctctttgggccattttcggcccaaatacctccccctccttcctctcccgcggcccgcgcgcctcctccctctctcgggccggctcccttctcccctggcccgctcgcaaaagtctattttgcgtccctccttctctcccttcgccgacaggtgggaccggcggtcccacccgtcagctcctcctcctacctctcgccggccaaccccaaccgccattgccgtccacgtcgccacaaaatccagtgccctcccgcacccgagctcgcatccaacgacgtgggcacgatcgcctccacgtcctccaccattttccccgctcgtcccacaaaaaccggcgccggccgagccgccatcaccccacgtcggcatcccacttccccggcggttgccgccccgactccgcctctcccgggctcgattcggccctccctcccctataaaaac

SEQ ID NO: 104686 - DNA, 1636 bp, Oryza sativa
  unsure (1)..(1636): unsure at all n locations
ttgttgtctcattaagtaccaccgtcgtcgctgccaccatatctttgttgttgtcgggatataaaaaaaggtcagaagtttctgttggtcaggtttagagttgtaaattgctagggtttctatcgtgtgattctgttttgtacgtgaggaagaaggaaggggacaagagttttgtagattggattcggtttccatctttccatacgtgatgaaggaggaaggggacgagagttttgtacttgtagattggattcagtttccacgaagtgtgggggcgagtcggtctctgtactacgtctaaaggctgaaccctcactcagccgattcctctccaccaggaatgtccgattcttatctaagtttgagtcacattgtccctaaattttgagtcgtgtcaaacatctaggtgagaaatatgagtcaaaatctgtttgcaaaaattaaactacgggacaagagcattccagttttgcatagtcttaattttagggtttacacttttacatttgagtccctatattttctatatgtatgtttgagtccccatgatctcaaataatttgaggtccttgagtttattttgctaaaaagataaaaaaagaaaaaaaagcagaaatgtgcttaaaaagtagtaaataaaagttgtgcaaaaaagagtgaaagcagaaaggtggaaaaaaagataagcagtaaaaaaaagaaagaaaagaaaaattcatttgtgatatatgatattgctttcatatatcagagttgtgcttgagttgtttcaaatataatctagtagtatcatttttgtccagattttcgtctctagtatacgttctagcctaggaccagcatggtactgactttaaacgattattcaacttttcattatctgatctgagcatttcctattcttttgttacatatttaagcctaccagatctcgctagattttattacagcgtacacatgtgtttgccaacacatcgttacatctaacctccattgggtcttggttgagtcaatgtatgtcatcatttcggttgatgtaagaacttgtaatgttcttacctctcctttcgcaactgacctctctttttccacgtgcacgattttcaaactactaaaatatgtttttgtaaatattttctaggcnaaaaagaatttacaaaaatcatattaatcatttttcaaaaaaatgcttaattaatcttgtgctaatggactgctccattttgcgtgcgttgaggatttgttcccacaatctagaatgaacacagcctaagagctttgctaaaagtttgagagtgtgtagcttaccacctagtagttgataggagtgtacataatttgttatgtttcttgttttctattaacagtggcagggatatgcaagaccattggacatgacattgcttaatatcgacatctttatcaagacatgagaagtgatcaacaagattttaatgaggtacatgatggtgttctatctaagatcaggtctacactatcttattttgaaggaaagtatgatccacatgcttacattaaataggagctagcggttgataaagaatttcaaaagcttaacttgtctgagaaacatatagttatgtattaaaaatgcttcttattattagaaacatat

SEQ ID NO: 104687 - DNA, 708 bp, Oryza sativa
tgcatccccattgatctaggttggcaaatcttactacactatttcgttccctcgtaagtattaagttcttttagggcaagtactataaggttctaagcacaaactccaaagtgccatgtatgcttaaataatgatgtggaggagagaaaagaagagaaaggggaggagccacccctcatgcaaggggcaatctccaaacaaacttcaagaaacaagagaaaataagagggctgattggtggcaagtgtattgggactagtgtattaaatgcaatgcatttacataagttaattttaatttttggatggatgatgtggataaaattggaggtgaccaccacatctattataaaacttgcccttatggaacatatttttagatttaattccaatgataggcttgaagatattttgcaattttttacttattgaagttgatgtgatggagctaacatcagctggaagtcaccttgaaaatggcacatttgtgtcttgcccattaactgtcaagtatggcacaattattagtgtgttttcccctttctgcggtgcagggagacgcatatacatatgtatccctctattctctggatcaaagagtgcagaggtccttcaattgcattctaaggggatagggttcataattgaatcgtttagtgatgtttgcaatctcacaaactcagatgtcgttagcctctctagaagacaa

SEQ ID NO: 104688 - DNA, 662 bp, Oryza sativa
aaattaatgggttacaaaggcttaatttggtaggatcatttcttgaatggctctgagacggcagctgggttatgggagtccaagctcgtatatgcagcagcgtctgttacaggtaccgatttgaccgatttgacagtaccactaacggattaatagggattctggatgtcaaagatttgtttgacccactcgtaattttggtcttaataagtagcaatttaaggtaacaagaaatttaaactcgaaaacaattcaggtaactgaaatgcagcaaatattaaattagtatacctaactgatgatcacaagagtcacatttcatcattggtatattattgtcgaacactattccatgaaactcagtgctacatcatatcttactccatttttctatataatcggtacccacgaagaaacatttacaataaaccaaaacatacaagaagtcacatcatcaataattttaaactatcaaatcacattagtaaaaaataataaccgtttcatcgagaagctacttatccatctaattcaatcatttattagctatccattcacttccctttgcttgacctcatagtcgcatatagcgttattacatatgttgtatataacattgtatttttcccttccaagtactggaagataaagctaattttttt

SEQ ID NO: 104689 - DNA, 509 bp, Oryza sativa
ccagtactctatcaaattagactcaactgcatgttgtattttttttatttcttcattgaagtttttcatgtgcaaaatgttagaccaaagcaaggtatatagtaagaaatgtgtatgattactactatgatagtgcagtggcaagcggtgtgtggtttcaaccccgaggtcccgtgtttaatccccaacgtgctcacaatttattcttaaaaatgtttggagggacgtctctccctccaaatctccttttttttatgattactactatgaaatttaataatttactaacaaatgtggatttttccctatatacagtagatttttgggacacaattatttttccaccagcacgatgagcatgtctatatgccctatatttttattataaagtgggaaaaaaaaggaatcctctgtgcagagctcaaatggatttttcatgtgcgaaactctgaattacgattcatgtcaggcacgttttttggtgtgctactatgaaatttaataattta

SEQ ID NO: 104690 - DNA, 1794 bp, Oryza sativa
  unsure (1)..(1794): unsure at all n locations
ctagcagcaaaaatttaaagcaattgttccaaatttaaaataccctcattaaagtacatccaatcattaacatttaaaaaaaatagggcgagggggcgaagcatctagtccctattattaattttggtaattaatgataagtgctaattatagactaactattctatttgagtgatataattgagttagaaccacatgatgtatatgccaatgatgtatatgccaaggatgattaccatggattaaaatttatggcacaaagaaattaatggaataaggtggtaaatctagcctgattattttaatcgatcgaggcgttgggcgattgaatttttgctaagtttatttctaactttgacatactatcaagaggggtagtgactttggtaaataagtgatcaaaataacacagtaggtcatttgcatgagggcttggttcgataattttattcatcttattttttgtccaaggtcggtttgaccatgggctccagggcagtctgactggcgtgccctagtctttctgaccaggctgggctcggtctaaccgggcacctggcaagttggttggatggccacgtcttggggatccaaagtcaccagagccgatggcagtctgaccgagccggggccagtcagattggagccaccaacagtctgaccggcaagtattcccacgtgcattcaatgcacaacaacggctagttttctaggcgttgccctagaggccaatctgaccgatcaccccttggcagtctcactggcaggcatctgagagttagggtattggctccaacgactagttttgatgggtggggtataaatactcccccaccagcaacgaggggcctctcttggcacactattcacttgcatatactcaatacattcactctttgaccaaattcgttgtgattgtttgagagtagtttgattcaagacaagtgcattgcattattgtttaagctaatgtgatacttgatcatctctaagccgggttgttattacttttggaggttgccgcctcctagacgatgttggtatttgctacggtcacaggtacatccgcaagtgcacggatacgctatagcatgctatccatgagcatttccaagggtatatatttatatttccgaagagaaagcggcgacgcaaaaatatagtttatacatcattaatcaatttataattaactcatcatagtctaaacatgggttagaataaatatgattgagtgtattatgtattatgccttgtaagtaaatacataagagaattacgatacaatgtctagtatacacttaatacataatacataagtcttacaaggcntaaagggtccttgggacagacctccacgaggtcagtaaaattcactcataccctctattttttgcctttttcaccctatacttgtaggattaggtaaccaattgtggtgcaatgtctctcgtatgaatcctgtctctagttagttgcttgtcaatctcttccttgatgcacaacgtactcttgatcaagtgacccacatgatagtacaagatttatttttcatcataagattttaatgcaaaagtaattagtcagtatgcccccagcgttttttatacaactaaaataataaaaatgattaatcctattgaagtataaaaataagtaacccatagtacgctcacgataagatgaacatacatggttgtcttataaccacacttccgaaagaacatacgcgtggtcataaacatggttgcttaaggtaaaagtataactgaccgctgcacagggctgcaggaa

SEQ ID NO: 104691 - DNA, 715 bp, Oryza sativa
ccaccttgcttattctaggagagggtgacctccttaaaagggaggatgccctcctagccacttgaagcatgtgtggtggagagaagaggggaaacacacgcacgcgctcgatggcctgccctggcagggcagggcaggcggcaccgtgcacgacgtacgcgttgaatggtccacaaaattggctcctcacccttgcgcagatgcagcttccttttgtagttttgttttgctgcgggaaattcggatttgttttgttttggaaacattccgaaaaatccggtgcgtgaaaacggcatggagttcggataggttacgcacgacttatccggttcggtttacgcgggcgccctgatcaggcgatctatctctatataaaccgagccgccgccttcacgcaacacacgcgaaaccaatctagggtttgcctcctactctgtactgcgccgtcgctcgtagactactccatcccgctcaccggcgtgcaccggcgatcgggagagcaggtctccgaaacctctaccttcgacgtcctacaccgggagaaggcggcaataaggtttttgggaagcgcttcgcgcgactgctccctgtttgtccgcgacggctcgccttcctctccgctcgcgtgcttcgcgtcttcgtcgacgctcgcaaccgcgagtagttcctgccgagcaaccggtctttccaccacctcggtacgtgttcgacatgt

SEQ ID NO: 104692 - DNA, 645 bp, Oryza sativa
tgcttagaaataaacacattcaataactataaatgtaaatgcatctgaaaaattgaagcactaaaaatgaacttattctctttttttcggcctgagagacctcaaatagacttatttccggcccttgccggtaggcccacggccttttgcgcacgcacgggcgcacttcccctccccaggccacaacctgggcttgggccgaaaaagtgacctcactctcgatccctcttgggccgatttcgacccggccgacgccggccgtccgatctctagggttttgatcggacagccgagcgtcgatatcggcgaaacaaaaccccctccctctcctcagccgccgaaactctagcccatttccttccctccatctctctcttcgccgccctcccctctgcgcccccgagcggcggctacggcgccccgcgagcggcggcggcggcggcgccctcccccaccaccggcggcggatctagcgggaggggcccccaccatcgacggcggcggcatcctcctcccgagagcggcgacgccctcccccaccaccgacggctgcggcggcggcaccctcccccaccaccggtggcggatctagcgggaggggagacggcggcaacgctctcccctccaccggatccagtaggaggg

SEQ ID NO: 104693 - DNA, 2037 bp, Oryza sativa
agtttagtatgtaaaacaattttcccattagaatgtagatctaaggagttcggtaagtggtcacctagttggaagggtccttatcggatattttgaatcattcgagggaatgcatattttattgaaactttacgaggagaacggtttcaaagagtgatcaatgggaaatatttgaagaaatttttcctgagtatctggtaagatgcttaggaggtaataaggccagtaattagattatcaccctaagatcacgtgttctatgtttttcggctcacaattcgacaaaaggcagggtggcatgtcttaccgcccaaatttggcacctagaaaagaaatatggaaaatatggctgaatttggaacatatcgggtctcttccgtgatgacggtctgaccgccaccataaggccggtctgaccgacggcatggggctggtctaaccggcaacatgtggccggtcagactggccgagtctgacttcgagtctaattttatcgagtctcgggtttccccaattttattgggtctcgggtttccttgtaattggtctctacccccgagtaagacatggagaaggccctgtacgagataagaccaacccatttataaaggctatgattggtgcaattgagcacacaatctacttccaacacttttagccaattgaattgctttttcaatatggcatttactttttgcctagtttctagtctagttcatccatctttgttgatttgtatagtaaatcgtctgcctttgttgtaggagtgtgaatcatctttataggtttgtcccaataaccttccattccacccacgagataggtgtttatctctattttatctaaatgagctccgctagccggttttgatttacaaaactcatcttaatttggatttgttcagatcaaggtggttggcgactcccaaattacagcaaagcattggttgtccggtcatgattggcgatgtgatcaaaaaagtttccaataagaccatactcgtctgaacatgcccattaaaactatgacaaaaagtaagatacatatagggtggagctgatgtgaataggcgcctgatcttctcacatagatactattggtttgatttatctacgtgaagacgtgtcatgagttcttcccattgattgtttttcttctgttgttcatcgagtgatacaattaaattaagcacatttgggatgaaattacatggagaggtctagtgcgtactatataactagctaggaccccatgcattgccgcaggcatatgatgaaattagaagttatttcaatcttttgccaatcaatgaaatattctttatacatgtatcgattgttacacgggtttatatatacatgacctctaatcgtttacttatctacctaaagtgggcataactcaatcatcataacataatggaggcattgaatttgtgagagaaccatttcctccattagctaattaaagaggctaacagagcatgcatactcaattcacttcaaatccactgaaagatgtacttgcagaatatggatgaacaaattccttatacttggtagcaccaatagaaaaatctcttcatagaagcggcagcaccagcttaatgaaatacgtatttatcctactcactaattggtgagctgaaataatagacctggaggctatcaaaatataatatacccaagcaagtacattggtgtaaaatcaaaggtgtttttgattattattctgtgatgaacaattggcattggagattattggttttgatatttggaatttatttgcgaagtgattttggagatgatcgggattttacaggcgatctacaggtactgctgattgggtccggtcagaccgggcacgggttgccggtcagaccggcagtgatggagcggtcagaccagcgcagccccggtctgaacggccgactctgtgtcgtttttgattttgggttgtttgtttggatatccgtgattgtttcatgattaaggattctagatggatactatgcgtatgtaatactgtcgtttgcta

SEQ ID NO: 104694 - DNA, 655 bp, Oryza sativa
  unsure (1)..(655): unsure at all n locations
ttgagggaaactatcaaagcttgaatgaactcaagagcaaactttggagagggaatgaaaatatgttgaagtggggtggaattccctctctcggccggctggcttttatagggtacccacaacggtcagaaattacatgtgggacccgctagccattaccttgccaaaagtggcaggtaaccgttgcctggccggttcgaccgaaccagtgggttcgaccgaacccttggtgggcccaaccggccccactttcggccattgggttctaacggtcagtgtggtcatggcacagtgaattttcgttaaaaattttattttggtttgctctaaaaaattcatttgaagaatttcctcaaaattcaaaaaaaaaatcctaaatgcaattttaaaaaccaaacatgcattgatgcaaggaatttaaattgttgaaaataaacatgcggatacatatcaatttaccagttggcgaaggtcgcgtcattttaggtccgacgtgcaagaccgtacctcctttcatttcagttcgtggattttccacccgtctatggaggtgatagagtgggcgtctttggcttttccttccacaccttatttggttntggtgtgaaagacggctttctctgagccgactgttccaccttcttggccgatgtac

SEQ ID NO: 104695 - DNA, 677 bp, Oryza sativa
cacttccaacacccatgtactagtattttattctattaatcacttttccgtactaatatctaatatcatttctcctcaatttttatctcttctaccacctccgtcctataatataaggatttttagaattagacgtgggtattaaaaaagtgggtagaattaaatgaaagaagattgtgtgttgtcgaatgacaattgcgtttgtcaagaaacttggttcactcttgattgaaaagtaaaacaatgtgtattgatattgcattttgttggtatgccacattatatatcccttggggtttatttatagtcttagtataaactcatgcactctaaggctaataaatacagagaaatttacatgtatactcttgtgatatagatatatataaaggtagttgtagataatttagccatggacttctcagtgggccataacatgggcctaatttgacgaatcagcccctacaggcatagagttctctacttctgatggcaaaggcgcttggctcagtggcgaatgcttccatcttcacccaatcggtatttcactctggtgctttgctttggacagtggcttgtttcggcagactcggttgaaggcccctgtaacatgctttcaacattgtaattggttgagaagtggaggtatgtgaaaagattgaatggcggagggctat

SEQ ID NO: 104696 - DNA, 815 bp, Oryza sativa
ttcctgcagccctactggccatcatgtctgcaaacaaacagatttattacaccttctaatgagggacatatctgtgtaactgtaaagttaacactttttttttagaataaagttaacacttttctttaaacaagagcacagtaattaaagtaacttgccatgcatgcatgcaacttctgaacatgaaaagtaactctaggaacttaattagtggcataatttatactagtaaagatgagtagaaaattaacaagttctgtacagtgcttaatttgaagggctagctagctagctagctagaaaccatagtattaactaatcagagaaaaacaacaaaatttgaagggctagctagcttaatttatgggtattttgtgacttaatttatatagctagtttaacacaagttactagctagcttaacacaaattactagctagtatcacaaacaaatagctacttgttttgtgatactagcaaaaggtaaggaactctgacaactttgattaaacattgaagaaatatatattagttacaagagcgaggttttacggtttacgtaattaaagatttgaaaactcactgtttttaacacttgatcatgtgttattcatcttcaacttctttttgactcaattcaaggtcaatacacacacgtgaatcacggggtgtactcgattctccgggatcctttgagcttctggtaacttgctcacttgacgtgctttctccagagttaagctgaaattaattaatcaagatgatgtaaattgtatatttatatatcaataatattctacgacatttttgtatgt

SEQ ID NO: 104697 - DNA, 664 bp, Oryza sativa
tgcaatatattcggataagtttcataatagaacttgactattaggattagtttcctaatatgactcttaagtattttcccattaggactcatatatttctcctttatatatcccttgaaagtcgcatgagtagggtgcgatagcccaatgtatcccctgcgtttgtatccaactcctctatactgatcattgtcggttggtgcccgtggtttttttcccgcaagggtttttacgtaaaattcgtgtctccgttgtgcatctattttcattacagcacatatatatatcttctccctcctttgtgttgacacactatgtatatgttcttgctgataattctccattccttctctaggctaggtacatattgtggcttaattagccgcttagccggcaacaccatttatcttctcttttcccatccattgtttttctaaattccaggatatcatatctgtacatatatacgcccaacatcttatcaagctcacacatgcattgcctagaccaagataattaaactggtgtgtgtatatgatcgatgcatgtggtgcttttgcactgtcacttaaaaaaatgggttttatatacttgattttgcaaagcctcaagagctaattaagctcacatgatacacatctcggcgcagatgctacaacctgta

SEQ ID NO: 104698 - DNA, 663 bp, Oryza sativa
aaatagatgaattattatagattatttttgggtaatccctataagtaatcgattcacggtagaaattcggatttaattactagggattttagccgtgtattatatttaatcatttagtcataaactaaattaaatcgtataatatttctaggatttcgtccgatatttagctcatgatagaaatttctaacctattatatggatataatgctcgggaagattaaattaaaacttatgacaacgaaataattatacccgcaaaatagcttaaatcgaaattgggttgccgtagttcgcagatagtaaagttaataaaaaggaataaacccggggtcccacttgtcagttggtacaaggctgtggatatgtcttggattaaaaataaatcgtttatgaacagtagcttttcgcaatttctcggattaattcaaatttgaatctttacactagcataacttattcattttaactcggatttgagtgaaacttgaacctaaattcatctaaattcataagctttccaatgatatataattcactatttaaaaaaatatatttataattataaattaattaataccaaatgattagataatagttaacctaaatagtgtgccaatgaataaaaatggatattgtacagtagcataattatctttaaca

SEQ ID NO: 104699 - DNA, 1763 bp, Oryza sativa
ttcctgcagccctgtgggatgggatattgcatggtgatttttatgctgatggagccacttcctgagaggagggaaggtggacgtcctcagaaaaccatgacgactcaatggcgggaagctatccttgggatcacaatggatggtggacagaaccgttgttgtttaatgtgaacactggaactaaaatttgatcagtctatgataggtcttaggcttgtgaaaatatttgcaaaacgcagctttatgcaaaagaacctaaaaccattccttgaataccctctatcatatgcattgttgttgtggtggcttgctgagtacggttggtactcacccttgctatttatatatcttttaggagagtgttgaagagaagcccttgtcggtacgcttgcgtatcccacgagatgatcagagtgcggtcttgttctaggtctcgttccccagtcgactgcctgtggcatgttaaccgggcccttatattattttgtcttccgctgttgttctctgatagttgttggcctaactggccctaatgtaagtgtttaactcttttagcctaaattcattcgtgatatgttgtgatccaactatgtatgtgtgtaccaactactgatccagggattggtacggataaacacagaagatttccgatttccaaaatcgggggtctacaaaaaccctatcgctagatttggtgatagacattagtaagttttatgttggaattgatggtcaaatttggtcgttaaggagcgtcaaaatgcatgcagagcaaacgagcaacttttggccgagaagttagcagtgagagcaaagctagcaaggctaagagcgcaagcatctgattcttctctatttatcggagatccaatgcgtggcactctccaaaaagagtgccttattctttggtttgtgccaagtatttgctcgtggctttgttttttttagaccgactcagtgcagtttctaggtgacagggattgatgaatgatgtgagggatagttgttgcacaataacagaacaaattaaaggaataatttaggagaagattgaagcttagtcttctaacattcttttttattcaagctttctttcttggtatttcgttcttctgtttcaaggcttggagtctgttaactcctctatgtgtggatacagtggctggcataggcggatctataaggtggtccgagtggtcaaaaaagtgatgatcaaccctattatatatatcccgaaccaatccttagtggtatgatgcaatgttttacaacatactactaaaagagaaagagcatggtagttgtaggggatcttaccatgacaacacacacctccggggagcattcagaggtatctcgttgacggagggagttcacccagcactgataaggtcgccaaatgtgcaccgaaaattgctttcccctttcttttttgaagggaaaaagagttgtattgattaagtaacactatcgcaatcttgctgcaaaatctgttgatcacaaaacaatgcttgatcacgccaaaccgcttaatgagccatccgtttagcatattgagcaagttcaagcgtctcagatctaagagcacaaggcagtgtttggcatctacatctggttgcaatcatgtcgactttcgttaggcagaagcgttggccggtttgacgacataaccacgacgaggtggtataatgccgagagaagatcttcatgcacacaatctggatgaagggggggcagcgatgaataaggagcccattgaagat

SEQ ID NO: 104700 - DNA, 1705 bp, Oryza sativa
ggcaagtttgtcaaagaattcatgcggccgcaacaccgcttcacgccatctcgctaaattttttgaaattattttttactaatgatggataaggcaatcacgtttccttaaaaaaagcaatcacgagcgcatatataaacgtgtgctcacccatcatataaatacacatacacacacctaccctaagagaaaaaatatttgtctccaaaaaagaggaaaaagtatgtgcttagtatttgctagaaaaaacatatacacatgtcatcgaaaatgtcgcatagaaccacattatatctttttaattatgtcattctcatctatataatgttaataattaggacaaataattttgacaatatagattattcaatcgtatattacccatgaacatacataggtaaatcagatgtataataaaagaaaaaacaaaacaaaaaatatattagcttatatatttgtgaacgatggtgagagatcagattatatataaccgggacaattcgtaccgttcttattgtttaagggtgtaatcagacattttccttaaaagtcttccacataaggatttataataaaaaattaatcaacactaaacttcctacaaacactcctaagcctccacgtggcatcctataaatgctcctaagccgccacgtggcactctaataaattagagaaattcttaaaaggacacaacgtataatcattaatttttattaaattttgtagaccattatttgtaaccattagatttattagaaaaaacatatacgtacgtctgctcacccccccctccccccaaattctttcacccctttttttacctattttttatcctattttcatgcttttagaaaagcaaaaattgtatgccaaacaattaggaaatgcagcatctaaattataatgctaatatttgatctgcttatgtctttagatattttacattttaaaactcatgtcctcttttattcaactgtaaagagagaaatgtcacattaattggggatacattttctgacttttgcgtgtcatttaagcaattttaaaactataaaaattaatgatatatatttttgtcatcgtatataacttgataataattaaattagatctaataaaagtaaataaaagtaaaatgaacagatctatgagtaatattaaaaaaaataccccccccaaacattgtaacacagtaaaaaatacgcatcttataaatactcctaagatattatgacgttctcttaaatcggagataatacactcttaagatattacgtcgttctcttaaataagagaaaatcgtaaaaattctgacaagaaaacaaaacattcgaccatcagcttcgacttaaacatctgacataattttagtttgttagattaatcatttagaaaaagaacatccgaaatgtcccttcctccctgctcgcgtacagcatgcgccattcttttctctctattttttaaatctccttagcaactgaaattaaaattatctatatgtaaaaaagacacaaatggacctccatctattacttatatcctgtcaggtgtctaacgactttctactaacttaattaatttctcttaacatacctatgagggctatgtacctatataaattgaccttgatacttttaaaatgatctttttaggagataaataaatattcataagaaagatgatcatagcatcccaatta

SEQ ID NO: 104701 - DNA, 1528 bp, Oryza sativa
ttcctgcagcccgtgactgctgccatactggacgcctggtcccgttaattggccataagcccacaaggtgggtcacagcggcgaggatgccgtcgacaactcgacatcgtggtgtttcagactgagaccgaggataaggatgctggatgctccatactggacggcagccgagcgaatgttatctggtgtactgtccgggaatattgaaactgggatttgaagttgtacgaacttgaatttttatttcaactagcaaaaatgcccgtgcgttgcaacgggtaaaaaaaataatccaatgacaatagacatttttcaagcgtacccatatcaatgataatgtttctatggatcgttgtagctaacacaattagaaaattagagcatctttatgtaatgacccaaactcgatgatggcaatctttttaccaatgcttgctttaactaaaataattggattattcatataacaatatacatataataaaaaaaatattctttcaatattattcttgcaaccaataataggttaatcaaatcctacactcaggatcaagtctacacaaaatagtcaccgtgcactcttctctaaataacaattaaaaatatgtttatttttaatactattttcatataatatgttattaaaaaaagtctgataatgataattgcatacaaaaagtgcagggattagatgaggaaacaaatgatgtgtaggaaatgatgtgtaggagatggaaaaatatcgatggatcttatccgacccaagcgtccatcaattttatctcgctttgagtcggacggtttctcggagcggttctttttataaacggcggtttttttctcgcattgagttggatggtttcctctattttttttttcgaaatgatggtttttttctcgcattaagtcggacggttttctcgatccttattttgaaacatcggtttttttcgcgtgttgagtccgtttgttttttttggatctgttattttataaacagtgtttcatcggttagttttttcagagcggcttttttttataaacagtttttttttcttgtgtggttttttgaaaccatttttttagaaatggtgtatttctttctgatagtttttaatagcattttttttgtttttttcagacgaaggaaaccgtatttttcccgcgcatttttttggaaattatttttttcttgcgcatttttttcctttttaacggatgatggaaacttctctttctaaaaagttagattagattgatagattagattagagttaaagagatatatacggataacaaggggcgactttaagtttggtcgggtcgttttttcctccttttctttttacggagtttgagttagatgttttttttcttttttttttattacggacgagaaaacctctttttcacgagtcggactttttttttctctacgggagtcggtcctttttttcctttttttacgacagaaggttttttagagatagatatttatttttaattaggtatttattcacgcgtgttt

SEQ ID NO: 104702 - DNA, 1758 bp, Oryza sativa
tatacccataatcattggatttcaatgtacggtgacaaatggtcttgatgcaaagaacttttcatcctctacgtcaacatcaccttttactgtattcgaatctgtgatgaggaatgcgcatgttaacttggttttattagcatttgacctggtacacgaggccaaagccgatggcatgaagcaggccatacatgacatctccaaggataaataatatagaataatgataattttatctgttcagtataccgttgataaaacaaggaacaaataagtctaggagcttcatcggttacccatattctctaataaaccaaaacaatttattagagaatagcaattagtttgcaggcaaaacatttatatatttgttcgtagtgacttaaaagtcaatattaaaaagaaattacattgaaaatattttaaaatcaacttcaaaagcaaatttaaaaatttaaatttttgcttttctttgatttattagtccagcagatggggcttagacaggtaggtctaagttgggctcccaatcgtctaactaatgtagcgtccaacaaggacgagaagaaaacccgcatcagcagcgatcgcaaggcttgcacggctacaccacgagtttttttttttgttagattattaatttgtttattaagaattcactggcgtgctgctttctgaaacttgcctcgtttccttgttgcttgggcgcatagtgcgcacgctgaaaacgagtggaatgcaaatgcctttttttctctttcttttctgtttttgcaggaatgttctccgaaaacagagtgcagtagattgttttgctccgcagttcgtagtataagagcaaatgctggaaaatgtatgtgaattcacataaaaaatatatatttcagtacaaatccgttgtcacaggcttggaacatcgcctgatcgccacatagtggcctggtggtgttcatacataccgccagttttcagttttcttcttaaatagtacaaaatacacatatagagggaaatttcaggagaaaatcagcattcgctttcattggatattcatcttatacataggagtaatacttatctatagaatttatagaatttcacaattcatatcagctctagatcggattatccatgaaaccaagaaacatctaccacacatacattttcttcaagaacaacgagccttacgagtgaatttccccccatccatgcggtgaatgaactatttctctgtaaaataaatccaagaaagatccaatggggctcaaattgtcgccaccatgaggacaacatccaatccaatccaatgcataggtccaatccaccttcagtaacttactgaccaaccaatgcaaattcaagaaagcagataatgacgaagaaattgacttgatattaccatggatcaaaagtccacaagttattagcttcgtccattgatagcatcactcaagaacattaccatgaaaaaaagagagaaatcatggtaatagtagagacgtacatcaagttcaacatactagagagcaatagatacttgggttggggaggggcaccagctgctggggctgccctcgcttcgctgcaaaatcttggtttattttggcgtcggtggtggcgccgccgccgctgccggggcggttacttcttcttgtggagcagggcgacggtgccgtccttcttggcgacgaccaccgaggtggccatgccgaggaacatgccgtgctcgacgacgccggtgatccgtaggaggcggtc

SEQ ID NO: 104703 - DNA, 3773 bp, Oryza sativa
attcctgcagcccggaaaaagcgtttgtcgaccgtcgcctttttttttttttttttttttggcgctagagaacgagcaccggggattcgaaaaggatttgcgctggcgagtgttgactggtctagtatactgtagtacccttttcacgcgtataacgctgtggctgacggtaaattgatggagccacacgttaatctcttttcatgtttcacctaatatctcgtctcaaaatataagtaaataagaagacattttctaatactacaaatctgatcagaaagcatgtccaaattctttttcgaaaaatgctacaggacatgatgatatctcttatgtatcggctaatatccattcggacgggatgatactggtatcggacgatatctcagagatattatcccgcccgaacgggaaactgtcatgtagcattcctcatattttctagttctatgaatctaaatagcataatctgggtttctatatcctaagatagagggagtaaatattatgtccacatgctaatatgcacacgtataacaacaagcacacatctctatactaccttcgtttcaaaatttaacaacctgactcatcctaaaactacgaatttggataaagtgtatgtctagattcgtaattctaggatatatctaatcccattatagattgctatattttgagatggatggaataatatttgccgaaatattggtaaattgaccattttacataagctattttaagaatagattatgccaaaaactaaatttagaaatggattgtgacctcagcatcagcgggttagtgctgaaatcttgtctgatgtggcaatatttgccacatcatcaaatctccatattggcgctgacctttgttcaatatacaaagcagttatggtggcgttagcgcagtggtagacactcttgctcctatccaaaggtcctggagtcaaatgccagctcaatatctgtttatcctaagtactcatttggtaggtcaaatcttttttaaattcattcctttttagcttggaataaataaatttgagaacttattttaagtttgtttaggaaggtcatattttttaaattcatttttatttttaacatatttgagaaaataaattataatattaatcttactgaaatatttagctcaataactatacatttttcaaaaaaaagagatgaaaactgtataatttaattttcaaatccgtcggaacccactactttgaacagttggtgtccaacaaggcgtctcatggtggatgaaaaccggaactgggtagaaaccaagtttggggtaatttgcatgatattgaatgttggacgaggttggatgtctggtttagagttgaagggtgtgttttatgcaaaacaaagaattcaggggtgtaaaatggacttatctcttaaaacaactatgacatggtaaacattatatctattgaactttacatttgcaattctgtatatatggaatgcttgccattattgcaaacataatttcgaatcgaaaaataagctctcgtaaaaatcacagagaagataaagaagaaccgtcatttctcttcgctcatgtgcatgattcatgatgcctgaggccaaacaaagaaagcttgacagaatgatccatgttgcttgaacacagatgtagaccttataacagcgtgattcacgcttgctaagacatctcgagtacacataacctacgttcatgcctttaagatgaatagatgatgcaatatctcacttttttagctaccttttgcttttaagattgaggcgacaaaattttcattaattaattgtgcaactagattgctttcacaatcacaagtcaaaggtcgcaggagacaaaattaaatccaatgaggataaactttataatagtataaataaacattataggccaccactaagtagcttttagatttctctatttttaaatgaattattgttattcctcgtcgtcactttacgaagttggtgccctccatattatcgtcgcccatctgtggtcggctacaatgtagtgagagaaagcaaccatttatgtcctctgatataaatatgcaagtaaatttctcgtatgttatatattgtgcatcaatgttagtatatccacattaaaatgtcagtatatccaaaatacattaaaaacataagaattttataggcttagttaaatttggatttgtttatttttgttgcatatctgaatttatacgaacccaatgatcaagtgaaactcatcaaaccccaaaatactatagaaataaatatttttttgttattagcatatggaattacttattaatgctgaatgataaaaggttcagtcgtttaaccataaagttccagtgttatatgtttgtgccatgttctaggggtgcatgtgtacgtgtgtatgtttatgtggtggtgtggcatggttctgtgactgtgtgcgtctataattgtactctcttcttaaaaataaaaaataaatagatccttgatagtgtgttttattgctctataagatggaggattaatttatgaattgagaaaatcgtcaacactcaaggaccaaagctttgaccagaatattactttgaatatccgtcctgatctgtctgactaaataagcaattgaaaagtgtcgcttctgctggacttcccattttcttgcaagaaatttgttgacaccgcatggatttgaagattagactttgtaattttaagcaccgagcatattcttttgtactgtataccttaatttggtaagaactctctaagactgagtattcaagagtactaggattttgtttagggacggcaacaagaaattggataaagggtttctttttttttttctgttcgagtcgatcagacaaactttgaaggtattcctggccacatttgagtgaatttggagaacttttggggggcgcctaatgcgcgactgaccgcgcgtggggtaggcgcgcggcgccccctagtactactgttactagtactgtacactagtatagtacactagtactactagtatttactactagtaatagtactactacactactattactactatactactactactactaacaaatatatatttttatgtataaaaaaatatacacatatacaaactttgtatacaatatgtataaactttgtatacgatgtgtgcaaatttgtatacgaaatatataaactttgtagacgtacgtattaaaaataataaaaaaaacacatcatgtgtatacgtatacaagtatacaaaccttagatacgaacgtgtatataaagtttctatacacatatacaaactttatatatgacgtatacaaagtttttatatatacgtatacaaactttgtatacatatatataaaaagtttgtatacgtatatgtaaaaaaccgaaaaggaaaaaagggaaagaaaaaaaaaaggaaagaaaaccagaaaggagaaaccgaacaaggaaaaaaaaaggaaaatcgcgcggtcccaccttacgcacgcgctgccgccgcggccctctccgcgcgcgccacgtgcctcgccgcgcgggagggcgcgcgcgcgactagccgcgcattagcaatttcggaacttttgtgctgcaagttcgctttattcccttggctagtacataattttgccaacgcagagagatttgacatgaaacagaatcatatgctccgggaatttaggaaaatccctctggtctccaagcaaagtccatgggtttcaccagaatccaaatcattttaga

SEQ ID NO: 104704 - DNA, 641 bp, Oryza sativa
cacgttttgaaggtggatttgggtggattggtgaaccctagttcgccggcgcagctctttactgtagcgtggagtggggaaaatggcgagcgttccggcggggaagacgaagcatcgcttggatctcggatttcttgttaagggtatcggaagtgcaaatgggcctaggcctgaacagtacctcagcccaatacttttaacagcgtggcccattgtgttccttagggacttaggcattttttgctttggcaatttatgcgcacaatagtgttgcccaatgttgataaaatcctttttatgcggtcatataattctttagaattattgcaatgcagattaaaaggtgcctgacagaaaggtgttatactgctttttgttagctttattaggctacaaaagctgtcttggttaatttggaatgacttatttttatcatagtcacttccttggtatgttatatacctattttcattatggtaaatagtcatagcctaggctattagacttattcattaccataatttttataatacttggtgggtaatctttagaattttatattcggatgtctatcaagtgtgttcattcgtgaaccttttagagtgttaaccactcggatttcttttattatggctaaaaag

SEQ ID NO: 104705 - DNA, 658 bp, Oryza sativa
tgtgatttggatggatgaaacacatcctaatagtttaaatctgaacagaggtaaatcaaaatttgtagtactcaaatatatgttattcatttaaaatctcttatatgttaagatgtagatagtaataatgtgacggagagtgtaataaatatggactcttattccgtactatggtctgttgtccgtcttaatggaattaaaagcgcttcatcagcaagcgagagtgaggcgtggtccctgccgcgtctctgtccgtgtcataaagtagctcctaactgcattttctaacactatttaacagttactatttatttattttcttattccctcgtatttaaaatatatagctatcatctcaacagaatactaccttccttatgtagaaaactaacctaggctaggctgtgtttagattcagggtgtaatattttggtatgtcacatcggatatatggatacacatttggagtattaaatatagtctaataaaaaaataaattacaaaatccgtctataaatcgcgagatgaatatattaagcctaattaatcgtcgttagcaaatgtttactgcagcaccatattgctaaatcatggtgcaattagacttaaaagatttgtttcacaatttacacgcaatctgtgtaattagttatttttt

SEQ ID NO: 104706 - DNA, 601 bp, Oryza sativa
cagtagcgccgtgggattacatataaacaacagaaaataccaagagattaatctgaaatttaaagatcaatctaataaacaacaataagttgaaagggaaaaaacccggcgaagtcggagattgaattgttgaacttgccgagattgatctcctctatcggactgactccgagacggagaaaattagtcattggtgttgcactgtgttgctaggactgatcaagcgatccatagctcgtcatgtgtagagttttttttttttttgagatacgtcatgtgtagagttatggatgtacatattgcccgtattctcggcagcagatggctgttagatcttgatcgatgtcctgcaaacaaccacgtacagctcccgaatatatgcaaaacaagcaacaaagtatatcgttagcctgttattagcaagtagagagataatgactatatatggatcaatttgccctgtacgtatccagcaatattgaatgcgtgtatggctggattaattaatccatgcatggcgattgaattgacacgtcctgtacatctccagcgatctcgtcacgtgaactttcgtgcttgtcctgcctgcccacgacttgga

SEQ ID NO: 104707 - DNA, 1252 bp, Oryza sativa
aactatcatgttcttagtttaagtaagaagatagaattagggagtatattacgattaaattattgttaatctgattcaccttgtactttcatcaggtcatatgcacaatccaaatctctagagttcaatggataagaagaacaaatcagaactcgcatcgactgatctgcacatgaaccctcatcagaatggtcaatgaagagattgcgtggccacgaggttacaacataatatttatcatataaagatttcactgcaattggtgaatctttagtaatttgatccataggcgaagtttctcctataatctccagctttcttcatggaactgcagtttgctgctgatatacaggagagtaaaaccaacttaatctaccaaggcaagtgcctgtaaaagaaaaaaaaagatgtcttaaacaaaaagtacattgaatgaagggtaacaaagcaattgtagagtgatgtgagtttgtcttttaggtttgtttttcaggaagctacgaatttagtcctaagataaacttttgatcctttgggagccctttcctaggttgggttaccctacagaatggtctaaattctaggctgtttgaaccaaccttctgctggaaagcagctttctggaagctcaaagatttgcataaataatttttttttcaggaagttcatgcttgctgctttctacatgtactatttggttcaaaatgatatttactttaaaaacaatgcaatgatttgctttgttttatactcaattttaatttacggaaaatcacaaaagaaacaaagggggcaaacggtaaactaaactgcaacccaaaaggacacccaccattctatgatttgacccaagaacatttcagttatagttagctggggacttttttttttcagaattgaaatttaagtgcttctgcatacgcatctgggtaactgggttgttttggcaagaaatttagtggcaatgtggtagctaatttgttaatccaaaattatcatgaacttcatctctactttgtcttgtgactaaccattgctggtcaaagatggaaatacatgcagttccaacttccaagtttcatgtggtcagtagtgaggacttacatggaagaaacctctcaacttccaaagctcaagttgatgtatggtggtgtttggttggaggaactaaagtggggctaaactttagtccctctcacaaaagcataagtttctatggtagggacttatgtttttgtgagagggactaaat

SEQ ID NO: 104708 - DNA, 1007 bp, Oryza sativa
ggagccgcaatgcatgcgtgtcgactgtatagatacaggatttaatcacgggcagtttcttgtttcacatgtactccgttctattaaaaaaaaccaatctagtattatatgtgccacattttattactacgaatttagacatatatatattcagatttatcgtactagaatatgtcacatccgattctaaattcgttttttatcggacggacggagggtgtacacatcctacacatttttctttctttttttattttttttaagaactacgcatcctactcctacaacaaggtgcattaatgtgagctagctagctagatagccacaactcatatccttcatgcggcatgcatgcatatgccatcatccttgaattgcgttcgatatattattgctgttttcttgaaaacttatactccatatatattattgttgttgtagatagacatggataaaatgctcttgcaccaaacgtcatgactcgggatacatatagtgctcaaatatgaatttcgcaagatgtatagatttatttatttcttcaacaaaaactggaccaaagtttggatatgcgtgacatgctttttaaaaattactaaacgatatgtttcgtgcgaaaacttcctatataaaagttgctctaaagtttggatattttacaaaataaataactaaaagtcaattaaaaaattaatcatacgttgataccatatcgttttgcgtaaaacacttaggccgtgtttagatgctgtaaaaaattggccaattttttttgacgtatacggatatacatttgaagtattaataatgtaaactaataacaaaacaaattataggttccgactataaactgtgagacgaatctttttagcctatgtgctaatcatgacgtaattaggctcaaaagattcatctcgtgatttacagccggactgtgcaattagtttttgtttttgtccacatttgatgctccatacatgtgtctaaatatttgatgtgacgaaaaa

SEQ ID NO: 104709 - DNA, 684 bp, Oryza sativa
aaaatcctgcacaagaaagaagaatcttagtgtgtacttgatagaagaaaacttggagaaagcaaggcttggtaaaacattaagcacagagagggatctaatatgaaactgttttttttttactcttttcacaaacaacataaatcaaaaatagcatacacctacccaagagctaaattggactgtcattccccattgtctatggcacctggattgtatttaacataattagtacttgtgttttcctctttgtattgggggattaggggttttattgttatacaccatatttatatatactgcaccattgggctgtaatgaatacaagcgcaattcatagcatggtatcaaggccaaaggtcttgatttcgaatctagacatgagggggagtgttgaagtaaagagtaaattgcctggtgccctactccatcagattaagcttttagttcaactagctagtgcatgcaactcaaaagatcggaccttcccccatgttgagatgaaacatttcctcaagcattaaaaaagtttcactggtaccagatagaacatatgcatatggtaccatcttattaattggcagtgatgtacatccaaatcatatagtcagactaaaaaaaaaactatttctcccacaaaattactccctccatctacttttgatagtcatatttccaaatctg

SEQ ID NO: 104710 - DNA, 1635 bp, Oryza sativa
gttccatttttgctcttttggaactttaggttgagtgtagatgggtaatagttttttttttgttgatcagggtttcacatgtatatgtaacttttgttgttcgatatgttataattgtcggtatatataaagatactgaaggatagattaatcttcgtaggaagtcaaggagaggatagctaaattcactaaccaaactagctgcggaatatttgatgggtagttgctaaagtagcaagaaattaatgttacatgtgtcaagtaacattagagatcaagatggtgataaccgatgaaatagttagtgtatctaacatggggaatatccagtgaaaaccatcaaataagtgaaaaccataactaaaagttttgtaaattcatgaaaaaattactagagataagtataggtatgaagtacattcatatcaaatcttaagtccaaactaaaattcatttgagagaaaaaaaaagacaaatttggggtgaatagtgcttttcatgaatttataaaacttttagatatggttttcacgggttttcacttatttgatggttttcaccggatatgtccccattcaacattgtgacatagggttgcgacgtggttttcatcacaacatatgatataagtaaattggcgcgaaggaaaacatgtagaagaattcaaaaagagaaattttggtcgttaagagtgtgatcattatacaaaacgaaacgatatcttacttacttttgcctttttatattttttactatgtcactcggtaatgtattggagaacaccattttttcctcatacatgttagagtttattgaacttatttcctgtatatgttttgaacgttactcttagtgtttactccatattatgatatattcttttttatcagcaaccatgtgcaactatcccctttttttatatatctaattgtttggcatacatttatccaccccagggaccgaggtaggcctagtaatccttatgtgaatttcataaaaacatcatataatatctaaaattaccatgactctgttagcccaactccaggttacagcacgtttagttcaatatactccgtctatatcgatcacaacattattaataaataataaccacacctagccgcgctaaactagttgtcccaaacaacagtacttattcaagattgatcctatgaaatatggccctttttgcaaattgatcttaaacaattattctttaccccaacctgtcttacacggcagtaacacaactagtctaagttttgtctccaacaaaacccaaaattctaatcatgtctgcttcgatattaaggctctctgtcaatatttatagtatcacaaccgttattatattgttatattttatattactttattttgtatatttagttgcagcgtcggaagaagagtgggcctaagacagagaaacccctctcatcgatcgttcgcttgcaacagcttatcattaaccacaaccaaatagagagtgtaaatttttaaacttaatttagggctaattttgagttttttttgtcatattctgcttattttacatcggcttttaaatctcaattgataaaaaattaaaagctatgcatgtaaattattttacacgttcaaagctctatgtgt

SEQ ID NO: 104711 - DNA, 723 bp, Oryza sativa
aaaatgcatcatttatcagtcatacaaaatgtgggagtggcctaacaggacagtgcctaagactaatcaaatgtcatattgagtgtagaaaacattttatcagtgcattaattattacaaagttgaataataagtttatttgatttttaaaagaagaacttctacttaaaaagaattcagcgtcccacgataatttattactactccactaggtcgtaggaggttcaaaagaacaagacacaaattgtcaaattttctagtattattttagggaataggccgagtagaatttgctatgtgtgaccatttattccaacatatttggctcgaaagccaaaattacacgtgaaatcaaccccacaaacagcttctgtattcagaatctggatggtcaaattagtattagcatggttttttaaataaaaaattggttgaaactaaatataatgttagcctcaataatattgctccctttatagccttataggtacatgcctaattgtaagatagtttaggatcgtgacttattttgttgtaacctattttgtttgaaagccaaaattacttttggaagcaattcccaacaacttgtgacatcaaaatgaagatgatcagattagctagcctgtttttttaagggtgtgttcagatgccccattttccaacccctcttcctcgttttccacgcgcatgcttttcaaactgctaaagggctgcaggaat

SEQ ID NO: 104712 - DNA, 621 bp, Oryza sativa
tcccaaacatcccattggattaataaatttttatatgttctgtggctttcatgtgtaatacgttccttcatcttatctttcacatttaagacatgcaaacaattctttattaaggctaggaaaccaaatattcagtatgggcactcaaattcgaacatagtggatgagacatatactcacaactccaccaaatatccagaaatcatctcctcgttttacctctaaaacccaataacttaaacaatccatgcagtatataagttgtactactctaaaaaaataaaccctagctacgaatctgaacataaatatgtctaggttggtaagtaggattgtttttttttcttttttacatagggggtacgatatttcacattcaaagctcatggtaaaagacagctgttctttttaacttgcaatatcaggcaaatgacttacatcaatgacacagcaaatgcacacaacaaccatccccatggtgggccctcactgtcagccacaaatgctcacaaatatctaccccaaccacagggcccacaccccagaacaaagcctgcacacatcatgtaccactcctgacacaagccctactgtggtatggtagccatccccatgtaaaaa

SEQ ID NO: 104713 - DNA, 732 bp, Oryza sativa
attcctgcagccctataactcaatgatttcgactgaacatcacataccttatgggctcttgtgaagtcagatttgtggtagcgattggaccaggagatgatcaatctcaaacagtgatcagcgtattatcatagcaattatttttctccattttgtttcatgatcattcagtcagttaggtcacttttgtaccaagttgcttgtagagaaatcaaggatgtctttgggaagatgtggcatcaacgacctgataagacgtgagaagacacacattttatggacggcgagcttctgatcaaagaaagttcagaagaatctgatcattcagaagaattcttttggacttagcacatttcacaagctacaaaatgcaaccatatctgcaactctgcaagcatgattgtgggggactttgttctgtttctccttgaattgtgtgacccaaagaggggaagatttgatgccattgaagcaagtgtagtgtagtgtacagagtacagtatactgtagcagctcacatggaaggctagtgtctttgttgataccatgctatgcttccagctgaggagaagaatcttggcacaggacaattgattctcaagtcccaactttctcttattgtagctggtcacagttccaggactgacttcagagttctagattgcgacagagttggaagaacgatatactccctccgttcctaaatataagcgtttctggctatgcacctga

SEQ ID NO: 104714 - DNA, 1588 bp, Oryza sativa
acaaaaggcagttaaataactaatctaaacaacacgaacattaacaccatcaacgaataataccggagagtccccgcaaaaaaaaaataccggagagaaaaaaattctctggtctctggtcaaaaatggcgagagatgcttgtatcagcacgagaaaattattgcacgagatcaaagataaaaggagaggtaggtgtcctgtttttaattgttttgctaatgataatgacgatacagaagatggattaagaccttaattaccatgtacagggcataattgtgtgttcatactgattgaggccgacatgaacggctacgggcaccaaccaacgtgccgtctcaatcgcatcattttccactgccgatttgggatttgttttttgcgtgataacaaatctagcaaggagatgcctaaccttgcaaaaaagacagaaaataatcagctctgaaagtgttatctgatttactacataataacaatataaaattaacggtctcgttgcaaggaccacttgttgatttctttgtcaatattaggaatactagcatattgcccgttacaaagggattttaattaaataaatttattattaacatgttattatcatctcgtaatcattgtacatgtgaaccttattaaatctatatttttttccttcccaccaaagtaagagttggtgagagtagttgatatatgagcactctaaccctacatgtctttttttttttgttaaaagatgggagttggcattggggtggtggcaccactactcccttttacaaggactcaaggatagatagtaatgggatgataaaaatactggtatgagataaatacatgtgaaaaacatagaaacaatggagaaacttgtttaaaacgtataagaaaaacatagtattagaaatatgtttttttttcactaagatacttaaccatatcataatgtaatcttgtgatacctacttgaaaaataaaaaactatccgcttgtgaaattacttattttattatacataggtactatatatatatatatatatatatatatatatatatatagatagatagatgtgttgtcggtaggcaccaccatacaccgatggattggataggatatcaacgtttttctttttcaagttagataggagtccttaaccggttcacgttctctatcgtaatggtattatcattacatctattataatgatttttcgttatatagatattatattagtagatcctcacctgtacttaaccatatcagaatgtgaatcttgtggtggtctacttgattttgttttatttttaaaaaaatctaacccaagtggtgcattacactgtagtcctcaggattgaaatggacatgacggcataagacggtacgacctgcttgcgacaggatcgtcttaactttcacctgcaatcttcagttaaaaccgtgacaaaacacatgtctcacctacactctcatgccttctcaaaaatcacaacctacttgtactactaactacttctacttaaccatcaaactgcaaaacctgttgcagaattgaggaaatttcagagcagagagcccacagttttttcg

SEQ ID NO: 104715 - DNA, 739 bp, Oryza sativa
aggagtgatttattagatgcctaattccttctctatccatattaaatatggtgatgtgctaattggaatcaacaagttgttatatcctaggtagtttaagcctatcactagcttatgtgcattgtgcgcaggaaatgaagcgacctggacagtatagaaactaagcactctgcagtaatgggatgcatgcatgtaggggaaagcgactaaaacatcaaaaattagcatactttggttctatccccaaaacgtcaacaagattagaactcgagggagtatcaaaaagtagataatttattcctcaattttttattcccatcccaccaaaactcccacaccctctaaacaaacataacaattaatagtctcatccctctaatctcccaatccctcatataagctccctccaaccaaacccaccctctaggtgctcatatgctggtgagaaccaattttgaacactacatttgagaaaataacacactatgttagtaatttagtatggcacgtgaaaatgagacaacaacacaacactacttagaccaacagtggttgaaacactaaattaaatcaccaaaacactagtccacctacaagccacaaatactcatatttaaaagaaatttatccctttttatatattccacatgcaaagactcatctcccccccctaaaaacaaaatgtgagcaacaaatttgtcaacagtatatctagaattgagatgcatgaatagtataa

SEQ ID NO: 104716 - DNA, 2362 bp, Oryza sativa
acaaacgagaccacacgcacagtgagaggaggacataaaagcagaagggccccattttaaaagcagtaacaagcattgagagtaggcaataaaataaggccagttgtgttcgctaggggaggatgagaacctgcacagtacgcacggagaacgatgtagtgtatcagcgcgtgattaattaagtattagctattttttagaaaaacaatggatcaatatgatggtttaacaaacattcgtatagaaactttttgcaaaaaacgaaccgtttagcagtttgaatcacgcgcgcgcgaaaaaacagcctctcaattttttttcatgtttcccaaatagtaatgtaaaattttgataggagtacttatttgtcaagaaagtactacccctgttttgttttgaacttctttaaatttgggcaagtttataaaaaaaaattagcaacatctacaacaccaaattagttcccgttaaattaacatttaatattttttataatatatttgttttatgctgaaaatattgatatgttttcctataaacttggttaaacttaaaaaaattatctacgagaaaaaaaatcaaagcagactaatctatacttctactacttaaaaagaaaaaaaagtttcagtctatgtaaagataacaaaaaacacatgcagaaaaaaaaatcctctgagaaaaaactattagaaaaaatcggtgtttataaaatatccggataaaaaaaaccaccagttataacaaaaccgtcttattcaacgcgagaaaaaaaaccaccgcttataacaaaaccgtctgactcaacgacaacaaaaaaaaccatgtttataaacaaatttgcaacaaaaatactccaaaaaactgtcagaaaaaaatcattgtttatataaactatgaataaaaaaccatccgactgtacacaaaaaatcattgtttatataaactatgaataaaaaaccatccgactgtacacaataaaaaaccactgtttataaaatttctgtgcagaaaaaaaaacgctcaaaaaactgtcagaaaagatcgttgtttataaaaaaatacggataaaaaaatttcctactcaaagcaagaaaaaaaaacgccgtttctaaaagaatagtttgagaaaactgtccaactcaacgcggaaaaaaccaccatttataaaagaactgtccaactcaatgcgagaaaaaaccacggtttatgaaagaaaatctgtttcgaaccgtgcaatgcgaaaaaaaaactttcctacttcgaagaaaacatctgattcgaggaaaaaaattgtaacatttatatcgtcaggtctacgacgtcggtttggtttttacaaagcattggttaaatgttctgatgttctgatctaaaataagtcttgcttgagccttttctttctccgaacgagatcaaattaatggatgcttgggtaggatagaatccatagattgtttccatctcttacacgacttttgctccctcatctattgtcctgtattggaggttatgcccatctatagataattattagactactttgttaaatatagctactattctttataacgtatcatatgaaaataataaaaaaatatatgtttttaatttttatttagagaagggtgcacggtggctctattttgtttagagttgaccatagaggccgtgtcgatttgattgatcctattattattggttgaaagaattagattgaaagagtatttcagattatatgcattttactagataaataatccaattcttttgggtaaagcagccattgataaggttaccaccgtcgagattggaccattacattgaagatgttcccgtttttcttatgatatgtcttagctataacaaccgatataaatattatcattgatatggttatgtatgaaaagcgtattttataatcgaattttttttcatctgttccaacgcacggatatttttttttagtatagtagcatatatgcccgattcatacgtaccagtataatggccttgatttcgatcgtgccgagctgaacaccagcgtccatgtccgtctcgttgacgtcgagcaacacgtccacgaaatcccggtgatcgccgccgccgccgtcgtccatctgcctaccgacctcacggcggcggcgacggtggtcgtcgatcaccttctcgaggatgccgtccagcgcctcaaatgtgcgctgcaccttcacctccattccgttcaaagcgtccacccacccgagccatggcaggagctcccccatcggctcttgcccgagtagctccacgaagtcgtcgaacagcttcctcagcacgcgccccctgtcgaagtcgccgtacaagccacgcgcgctctcgt

SEQ ID NO: 104717 - DNA, 3130 bp, Oryza sativa
gatttgatgataagcctgataaaactatacattgatatacttatcgagttatttggcccagttctgaagtatagtaggaaaaatatggtcacttcacggcaggctgcctgaagatgcaaaatcagctgcaagtcacatggcatgccaataagcccatgaccatttgtaattttgtactgacgtagtgaagattacagcctccctacgataaaactcaatgaggtcagatttattctgcattagctcatgttaagattgaatacgagatctccgggttaaaatcacacacctcttgttatcaagtgcatctcatggttccaaatttccaactttacacttagcagttagcactggttgtggatgggatcgatgcatggatgatcgaatctcttcgcctttgcgttttgcaagagcccatggctccatgtccgtccatggcgtgcacatggcaacagcgtctcacgctcgcgatcgaggagcctgataagcctgaggcactgcatgcgtcgacacgatcgaccggtcatctcagccagtggtggctttccggtcaactttctcccctccctagcaagcacaccatgctccccagcaatggcagcaatggcaatggcgctctctctgtcaggtatcttttgtcacatcacctgggactgcgaggtgtcgccacacatgcatgcaatcccgaatgcatttgcaatttatttggatttgcatttgctttgcgttgcatgatgatgccattatactatggcccccccattgcttgctcctctcgtgctcacacgaggtcacacactttgttcttgccttcagtcttcagagccagtacgatcacctgtgtgaatatatatgtcacatcgataaagcagtgtacgtagtaggtgaggagcagtgcaactctggtgatgaatggtgatcgattatgatgacgatgatgatgcagtggaagcactgtattccttcgctgtagagattggaggatcgatcagcaacaccacatgtgcatcggtctgtctttgggcgattcattgggggtgtctctggtttggtccttgttgccattggcttctttggaatgcttaaaaaaaatttctccaaaacatggctccatttcagttctgtactgctccctccgtcccaatatattaaaacctagaaaatgtcccatcctgtcctagattttaatatattgggacggagggagtagtagagagcagtgatgctgtttaagatgtttacgttggagactttggaggagagagagcctccaaaacagcagtcatggagtcattttacatggactcatcaaggtgaccactcgcctgcaaagtgcatcgtttgctgtcagcatgcagttcagttcagcgttcagcactgcgactgctcgagacgaatgttcaactcatcaatatatctgggttccaaaaagtgtgtggagccaaagctccaagcatcatctacagaagtgcagagaaggaaccctctcttcttgtgatctcttcgtccttctctcgggtgcaataattcagaggggccaattcaacagtgcatctggggctagaaatagaagagctatttggctacaaatctagctcttgtccccctcacgggtgcactgatcaaacaatataggagtggtgtcttaactctctaaccactgtttgagctttgagccagtcaggtttacacagttcatattgctgtagcatgctttgctctctgtgtgtgcgtgtgcagtgctctgtctgaagcatgacaagagctaataaacaacatgagctagtattactgtagtagtactcccttggtacaggaaccaaagtccggactgctgtaatttgggaaaagaagagattcggggttgtttgaagtcttgcatatccgtctgttgcaaacggttcaattccaatatctcgttcacggttcaccaaggccgtgtttagattaccccaaacttccaactttttatcgtatcatatcacatcaaaaactttcctatgcacgtaaacttccaactttttttccaaactcctaacttttcctaaacttccaacttttttcaagaactaaacacacctcaaattcacgtctcatagacaaatcctcaaaaaacaccatattaagaggtgtcaaatcctcaaactccccttcacagatttaagaaagatgcgccaatgggatatgaatttgcgtggttgatacaaataaatataatagaaagaaatttacttatagaatagaatagcttgtcagtctatatatgaacctgtgtcaaaaccaggacggagccaggagagtaccaggtaggaacaagtacacccaagattttcagggaccagggattatgcatgtatttgactagtagtacttcgtatgttaattcaatcataacacgaagtgggagtaaggtgcaaaaagaacctttttgcatggacgattcttggtttgtaactagggcctggtttagttcccaactttttcttcaaatttcttcaaatattcaattttttcatcatatcaaaaaatttcctacatacaaactttcaacttttccgtcacatcgttccaatttcaattaaacttttaaatttaacgtgaattaaacacaccctaagtaatttattgtttaaatttcttagctagtaattatttagaaagtgtttgagaggaggggaaaggttaagatacgcaaaacaagttgagttattagcgtataattaattaagtatcatttatctatatgttttttcaacgccgattcaaaccctcatgttgttgccacgccgatatgcctcctcatgcgtatccttcttcaattgattgtaaaaatcgattctccactactctctcgtcattgttcccatgtttttctatttcatttctaatttaattcatcggattgaatctccattttaaatcgtagttttcatctaagttttacatatttgctccgattttaataaaaaatacacgtgtcagttttatggaggttgaagacacagctggctatacgttttggacctatagctctacttataatcaaagagagacagaccaagccgagagatagtggattgggttagtaaaaaaaaagaaggaatgaataggctttcaaaataatatatgg

SEQ ID NO: 104718 - DNA, 547 bp, Oryza sativa
attcctgcagcccaatgttgcaacagattgtgcgcgccggcaaagccatcagcccatgccccatgcccgttaccgtgccgtgtcaccaacaaatcaaaccgagcgccaggtgatagccagaggccgccgacctggcctgacaccggtgggtgggtgtgtgacagtgtgagaggaacaagaggaattcgcgtgaaacatcgccaaaaaacgcccaaatttctcgtgggattcgtgtgaaatccgagcaaaactcgcaaaaaccggtcgactcgtgcgtgcgtgccctaccccgtgtcggcgtgtctcgcggtgtcccaatgggacccatctctggtcgttgcctgtcgtccgtctctggttaccatgcgacgcgacgcgatgcgaagcgacggctcgcgtcgcgagtcgcgcgacccaccaccgacccggcccaccgcgagcgagcgcatctccgcgcgccacgaggccgccgctggcaggtgggacccacgtggcccaccaccaccacctcctcgtcctcttcctccacctccccccctctctctct

SEQ ID NO: 104719 - DNA, 3341 bp, Oryza sativa
cccggtgtgatagttgtattcatagagaccaatttgcaaaacacataagtacagccaaaccctcagccaggaatctttgaacacccctgcacacccggagaagaggagaagcagccccgaagctaaccacgaagtaatgatccaccagatgccatctttgtgtcgcatcgatggacaagaaaacatctaacaaacctgtcacccactgtacatacatcatttgaattactgtagttgatcaccatcaaacattcaggagccagccaaaaacgccatcctgttctgcattctgcatgcatgactgatgagaaaccaggtcatcagtctccgcacctccacagtaccgcgtgtgaactcggcgaccgttccaatgccagatttttcacctcatcccggtggaaatttcatcgcgtgaattcagcatgtggttggctggcggcaacgcaaggcgtctatatatgccgggaacgacagcgatgtctggaagcttccactctctttggtgtcatggtgtgcgttactaccttacctgcgctttgcccccaagagaactaggccatatttaagttcctaaaaacttttcgcaaaaatatcacatcgaatttatatatatatatatatatataaaatattaaatataaataaaagaaattaattgcacaatttgcatgtaaatcatgagacgaatcttttgagcctgattagtccatgattagtcataagtgctaccgtaacccacatgtgctaatgacagcttaattaagctcaaaagattcgttttgcggtttacaagcgagttatgaagttagttttttattcgtgtccaaaaacacctttcaacttttagtcaaacgtccgatgtgacacctaaaaatttttatttcaccaactaacaagcactaattaaacactgcaacttttactatgttacacacaggaggcgcctgtacaattaatactataacatgcagcagatgcatttcaaggcaactgaaaagtacttggttaattaactatcctcagcttcaggtttctgaagattgattactatctgatcctatcattgctcggtgttctagatgaacaacgactttttgatgcaagtctcagtgatgatttcagctgagttagcttgccctgatcttctagattgtacagccgaggatcagtacagacacatggtctgaactatgacaaaaaatgtgatgaacttttgttgggattgtaacatgtgacagtcgtattaatatacagtatctgcttctagaacgaggcatgcggcaagacaaacgtaccgtccggattcaggtgattctgttattgacaatttaacaaacctcaatctaattattatgacaagatattggtcatcgttttctcagaaaagcatctccctggtaattaattcttttagtgactagagtctcatcggttatccaaatttactaataaatcaattaatttataggtaaaaatattatatatttattcgtagagacttaaaagctaacgctaataagatattatattgaaaatatcttaaaattaattttaaaattaaattcgaaaatttaaattttggtttttctttgattcaatggagctcctagttaacagttactaatacggagtaaaatttgacagatttcaacgaagaaatttgtcgaagtttttcgaacatcggactcagaacttaattactcttctgactgcctcttgttagggtaccggatatgatcgacgactgtgcaggtttatgccttggttaacaagaaagatgtgagaacaattttctaaggttggaaaatatgtgcacgtcaccaatcctccaggattattgttcaacccaagaatcttagaatcgttacttcaagtgaaacaaatatactgtacttatctgcagtctgcagagacttttatttcctgtaatatttgtgttgaatctcatggccttattaatgattttttttctttcctaaaacgtctggagggacatgaatcatgctgtagttatccttttttccttctcaataattcaaaattcattcagggacacaaaatactgtcggcaatggtggtctgcggggggaaaaaaaagcctttttttcaggtcagattctatctaaatgtattcttttttttttttgcataatctatctaaatgtatttgatttgaatacaataaggaacttttaaatactggtttattcttgtatctttaggaaataccgattgacttcattgactgcatagtaaccgaagtgaaatatctttcttttttttaaaaaaaaagtcaacccaagaatcaaaattttaaaaaatcactaaagactcctttggaacaaggaagtttggagcatttgatgaaataatccgttataacatagtatctcaaatttcaaatcataagcttttgagattgttcatttcagttggttgtcgcagctacacaatttacggcttgttcgtagtagtaaaagctttctcccgcagtagctgatggtgcgatgactacggctttttggagctgtagtcgagcggctgtgccatgccgctgcagcctaaaaaatcaccgtaacatgccctttgtaaagttgtaggccctgtttgatacagctccaacctataaatttaactctagaagttaagtgtgaagtggagttgtggagctgcctaaacccaactctacaactctagtatattttgtgaaagagctccacccaactccactcctaattttaatggagctgaaactgtttggctgagctctagctccaggaggggtggagctcgagctgaagctgtgacaaatagtcccgtactctcaaaacaacacttcaacacgagctgcgcagtgcacctgaaaatctgacggccccaaccaacgaacgcccgtgagttagggcctgtttggggagctttagattcttacaagcagttgtttggtagccagcttctgagaatctggaaaagttctgaaatccagcttctccagcttttggcttcttagttcatttttgagaactacagattctcaaaagctgtgaactatttaagacaacttttagcagaagcagtttttctgcagctgggacaagctccccaaatagggccttagacctaacccgccccgttccgtttcgccgcggaaactgaacggaccacgtggcccccctcaccgtcacgcaacgcgaatacgctatcacgaacggcatccagccacctgtccacgtcgcctccgttccgcaatccgtccccaccaccgcggcagccgctgccaccgccggtctccctcctcctccaccaccactccatcccccgcttcgcttcgcctccacaaa

SEQ ID NO: 104720 - DNA, 632 bp, Oryza sativa
ttggctggcataaacaacatgggggtccagccggaggtgacgagtgtagcagcgcacatgtggaagatcggatgctattatgttcatgaagttcatggcgaattccgcattgatgagaaggctttcaacatgaatggcttatatattaggaaaggttatcaagtctactttccatcgaatcaaacggcatgtcattccgagctttctaccaacggcaattgcaagttgaagacatcctgtgcgggcagaccgggtgtcgcgcaagtaacaacaatggtgatgagcgtcggctttgcacggcatggttggatggagttatactatcctatggcccatcttgggttgggaaggagtctatctattatttctccacggattgaagccttccaaaaccatcagtttcaagataagaaagaaaagattcagttcggactcggtttgggccagcttggacatacatggactaaaacgcttgtttctctctcgttcgtagtccgttttggacgtgtgagcactcgttggaaagctaacttcatgccccaggtggtggatagggctcaggacacaaatttgttctggttccaccgcaagagccgaaacaaattgacggtgctgcagagaagttccatatt

SEQ ID NO: 104721 - DNA, 1243 bp, Oryza sativa
ttcctgcagcccaagaacagttaatgcgaactgtttttttccttgtgtaacacgcatattccgtttaacttaaatctgcatccagaagtgcaggtatttctctctttgctaaatgaaaatatcgaagatgttcagagagcatgcgagcttcactttcagacctgatacaatgtccaaaaaatctcaactcctgtttacagaattacagctgaagaatttcaggtcgtgtatccaaacttatgtattgacctcctattaaaaggacttagcaaatttcaccatgaattcaccatcgctgatgaaaaggaacgaatgctagccggtcattgctgaagaggtgccatacctttatgtacggtgtttccttcagagaaaaggccagcaactgcatgctctcgaatagaggaagatccaaatatccaatggaatgtaccctgtagcagtaccatcatctcaattcaaaccatgagaacaatttgagctcgtggctgccgagggccaacgcaaagcttagaatcacaatcactgatctactgaagatcaagaaaggcaggttgcttttagtagtagataggcatgcagatgagcgacagggaggaccattgctggagcacaatattccaaaggaaacctgaaagagagatcaagagatggtgcatcggcaaataaaggttcatggctcggttgttcctctcgaatagtcctcgttctgccaaggagcatatgccatcttagatccatatctcgaggccgatggcgagctatataagcgaggtcaaggcacaaccatgttcttccaagagagcttgcagcaccaaaaaaaaaaaaaaaaggttcttccaagagagcttcaaaattcagaaatgttaaggttcaggatttcagattcagccacagtatgcagtgtgcgaccggcgaattacagggcggtttctcctttggcacgtacggaggcaaggcatgcggtgaaaaatctctagctagccatgcgtgccaaaggagaattgccctgcgattcaccaacacagccatgcagttctcgtcccataatgcaatctcatttcgcaatgcatgttcagaacttcacattagctcgcttttgtcactgaatatgataataatggactgccttgctgcaggtttactcaggatggttctcacagcaggcaatcgctcctgcagttgctctgcatgattagaaataggacaaatagggtttattgatatggttaagagcaagagt

SEQ ID NO: 104722 - DNA, 2205 bp, Oryza sativa
ttaagcggttgcgttagttaatcgcgtactctgtatagtatatagctatagtgattctcttttttttttcctttatccctaggagttgtattttctcctgctctattcaatgaaaaggcactctcgcgctgttttccattaaaagaaagagaagaaatgagcaactacaccagccgacaccaacacaatgcagatcgcccagcgcaagatcgaaaacgagcagtcgtcaaatggaaactgaaacagttagctgcgcaaaagtttaatcacaaaaatcggggccgttaaatatcttcagaagttcagatatatcatatatattgtgctacgaataatgccgattcgatctcctcgcggtgcttgcgtgactatgctggcctctctgcacgctgcctataaatacgatgagaattcgaatcctcggagaagcagatatagctagctatacatgcatacaggcaaagaccagcgaggtgtctctgactttatggggcccatgcattactgggcaggtctcccttggcagtggccgatcgagctgatcaaaccacgcaaaagccactgccaaaggagacttgcccagcaatgcagatttgaggccacaaagatcacattttatttcccttgtaatcatattaccatagtgcgcagagatgtcgtcgtcctcggctgcagatcggtctgcatttctttgcttcttctgcatgcgatcgagtcgtcgtctggactatactatcggcgacgcatcacgcattctgcattcaatattcatgccggccggcgtgctgattcccggtcaataacatggacgaactcgatcactgcatgctgcatgcatgatgcatttggctaacgctgtgtttagttcgtctgttcctgtgccacaattttttaaagtatatggacatacatttaaagtattaaacatacactaataacaaaacaaattacagattccgcctgtaaactgcgagacgaatccattaagcctaattaatccatcattagtaaatatttactgtagtaccacattgtcaaattatggcgtaattagactcaaaatattcgtctcgcaatttacatgcaaactgtgcaattatttttttttctccacatttaatgctccatgcttatgtccaaacatttgatgtgacagaaaaattgaaagtttgacgaaaaaattttgaatctaaacacagcctaagtgcaaattggcatttcatttagaggttgtcgaacatacttttttaaacactaaatacccatgctttattatgtatagaataaaatatataatatgccatagacatatttgcttatttgatatatgatgaataaatatgagactattatataatattagaaaatatcatgaactattttgtaaaaaaatacaaaaataatggtggtatccaccactgttttctataatagtatatagactcgcactaatctatactactttaaagatgttggtggtggtgaactagtgatgccatcaccaccctaactaccatatgagggccgtgaaaagtgaggagaaaactttacatttttcctatccacgcaagcaaatcaacccccccaaaaaaatgttaatcaaacactcttattatggaattcttcgtcgctctatgatgtactattagacgataagaataacttattttagagacttcaaaaatatatagaatgaactatttttttttagaaaaaatccattgcaatgccatggcattatgctagtttacaaaaggtacaaaagtagttgtggtggcatcaccactctagtgtcttttatagtactttggatgtcctataataattgtatttctattatttgaatttgtctcaaaataattactgcaacagagtattaatggtctcattaatcacttctcatttaaatttctccatattttacccttaattacccttccactcttatctatacactatttagtaagaaaaatcatagtatttcgcttcttaaaccttataatatgtactaaacaatctagaattataattattctgtgacgaaggtagtagcatagatacaaaattttctgaggaggggaaataaagtctcaacatgtaaatctggcctattcaacatgttcagatcagatatcttcgcaaaaaagttgctttaaaaagttatattaaattatttttcaagatttttagctaatacttaattaa

SEQ ID NO: 104723 - DNA, 1393 bp, Oryza sativa
  unsure (1)..(1393): unsure at all n locations
atctctcgcgcgcgcgcttacgtacgccacgcgcagaacgctcccgctcgcgtcaaccttgtattgcagccgcatgagcctgaaaaacacgtgagtaccccgcgcggggcgcgcgcgatacgtacgagtagtaacctgtagaaggacgaggatcttctaccataataacattatcattacaatcacaatcactaatacgtgggtttcacttttctatcgtttcacacaacagtatatataatggtagtgtcattataatagatagaactcgtgtacatcagcaaacgaccggtttcaccgatctcgcccttgccgcgcgctgctccgcctatcttgccgctgcacgtacacacaaaagaaaacgtgagctcgatcgagtgccccgatcgggcgagtccccgcgaaacacgtttatcgagttcgggttttcacagcgcgcgtcgtggcgcctttgcttgcctaaccttggcaggcgcatggatctgatcgatcgacgagctgcatcatgcatgggcaaatagggcaatgcagtgcggacgtgcggtgggagtgggacgggttcagcgcaggaaccaagaaaccggcagcgaacatgctcatggatatccctattccttctctcttttgatctcgcatgcgggcactttttccccttgattcgatccttgttttccagtggtctcaaggggaatcaatctgcaaaatcctgccttttttctgaagtagcacacgatcgaggccctttgagcctgtccgacagaccggtgatatgtccagctctgggtggtagctgcagaggcttcctggaggctggagatcagcttgctactaaattgcgttgtgtactgctgcattattatggtgatgaaatgacctgtgtgactgaaagtctgaaaccagtggagaaaatcagattgagctagatttctcagcagatatttgatgctacttaactttacatggtctggacagcaagaagctaggctaagaataaacggggaagtagccccatgacctaaaaagattggagatatatgcactacaatgatctctccatttcagactttgttcctgtaagtgggcacaatctagagagcaggcattgtcctacagtatatcctatcagcctccgtgtgcctttgcaggaggagcagagaaaggccgtgnnnnnnnnnnnnnnnnnnagctgcaaaaagccttgctgcctttcaccatgcaggagcgagtataaatatcactgcacaatgatcagtgaactgtgcgctctacacatgaaactaaatgtggcacacggatagaaataggttgagaccatgagatgtgcagctgcattgctgggcaagttgtcctttggcagatgttgcagttcatcatcgatgctgggggttaccag

SEQ ID NO: 104724 - DNA, 3482 bp, Oryza sativa
gctagaatgacttacattacgaaacggagggagtattttttttaaaggacagcaaaagctttgccatgtatatattaatagagaagatagtagtaattttttttcctaaatgttaaaactttgaaggagaaaaaaaatgtgcagcaactatccacatagtataaaggaataagaatccgtcaatataatttcgttaaaaaaagaatttgtcaatataagggctacaaaacaccatctcaagccagtgtctactcaagaaagaaaaaaggagctcatatggtctggcccaaagctgagaggctaacacaacacaagcttgcagcccagcacaaactaagcctgatctaaagcaggcccagtccaaacttcaatacagctaaagaaatgtttggcataaatctatcgattggatggatgattaatggaacagttgttactaatttgacaacccagagatcggtttgccccaaaaattggattcatgagataaaaataagatgaaaaagtgaccaaccttgaccatacacccatgaccttgcctttcttgacctttatacacttgatgtgcactaattagaaaatttgtatctacgcatgatactaatggccttgaaataatattgcaaaggaatgaacttacagagtcctagttttcatatacatagtactacataaagagccacgttgatcatctacaagactcgcgggaacaatacctgacatatagaagtatgttcacaaatacaagaataataaagtaggtagtcagtatataaatagatagcaacacttgtatgacagattatagatgaacttgtgctttgttgcctgcagggtggtcacatattagtaagcacatttttaggatattagcaatgaaatttcaaattttagaaataacttacataaatttcgaaaatagtctgggagttagaatttcacaaataaacttacataagttagtgacaacctaaaattagcaatcaatttcactgctctttcttttgctttcatatgtaaaaagggaaatataagtctcggaattctattgctaagatgatggcctgcaagatttccatttctgtaaaaactgccagttgcaagagttgttggtcatactcattatctctatggttgagaattatgatcgctaggatgccgagtctttcctttggggaaatggtgcattctattctgtatatatatagatagatagctctttctgggtactctcaaacctttcctataatagacggctttggcaaaataagcattaagtttctctataaacacctttgaaaagggaaaaaaatcagtgaaagaggtataccgaaggagaaaagaactatagtcacaatatgttcattatgctccaggttgtgtacacattgtgattatagttgtgcaaggccacatcgtcattccctataaatcagacggtgacatgaaacaaaatcacaatatcataccacctactttgccggtagaatgcaagcctcaaatccatcgggtcactagaatatgaatgagctaatgtattgacaatctacttcaattagttatatcttattagctaatatacaaagccttgcatatccaaaaggataaaaaataatagataaattaccaaaatgtgtaactcttggaggctgcagcaccataccatcctccaatccaagcacgaatctagttggcagaatagcaccaaactctatgatggcttaaaagcttgacctgccgtgccttgcaggtgatgtttatgtctggcaggttatgcaacacgctcatgagctcgtcatcgggctgttacgaaatacaacaaacgtgcatagtttgcataaaaaaatgtgcatttggaggaaactcatgttctgaggtggtaagaagggttctttgggacctggtcggggtaattgtgcttttggtcttttggtcattataccttgctgaagaaaataacaaattccaggagccactgtatcctttttcaatcaagaaattagccgcatcaactccaatatggatttgcgtaagatttttccttcagcctataacatttccctaagaacatcgaaacaaataaattagccatgaaaagaagagtagcagttaggttttgtcatggaagtaaaaaagatagtacatgatgagcaggaaaataagtaaaaaccatgcatctactttgtttgtgcatttattaaaatctgaagaaacaaaagtgtgtgtggatatataaactcataaaaacacaatgatatatacctgtaattgaaatgccactttctcagtgataccttcctaaacaaataacttatgtacaaatgcaagcatatctttaccatcaacataacaaaaaaatagaacaaagacatttttttttattttgacagtgaatttgaaaaatagggcacatcagtgcccctaggatacattcattagtgggcctaaatgcattagggtcaggttatttttcagtatatctcaaagctaacaggaaactaaacctgaattaattggttacatggctgcagcttttgtcaatgaaaaaaattaggcaaaacaagttaaaatggatgtggcaaacaatgctaggaatgcccaatgtggcagatctacaagttcattggtatgttcatctgttcatggattcatgccctttggattgactttctcatgtgcaaacaaacgatatttggaactgactttatctggttacctttttgataattccggtgttcattaagcaggcctcttataaacattatattgtatgattctatgacaaaacatccagagagaagagatcgatcacacatagcaacctgcttgtgcagcagatcgccggcgagagagtataacagaagccacctggcgtccgtgcccacggcgacggccactctctcaccagcctccccggcgtcctccccagcgagcgggatccactccacggcggagatccggccgtcgtcgggccccagcgcgggcctcaccgtgaccctgccacctcctccggcgaccggggcaaccgcgagcacggaccgcgccgcaacggcgacggcgagggcgcgcgcgcgcggcgcgaggggagggagcacggcggggtcgtccagccacccctccctctcgccggggcccacggcggcgaggtcctcggaggccgacgtgaggagagccacctccgccaggtagcctcgcggcgccatggggaggggaagcttcgaggcggcggcggcggcgtgagagggagagggagagcacgggtgggacgagagggaggaggggactggggcggcggctagggttggggaggcgccggcgccggcggcgtgagaggagagggaggaggagaggcgggcggaggcggctagggttggggccttgggggcgggttagtgcgcggagctttgcgaaaaagcccctagtctttctagtttcacacagcagtcccaacgcgcgattttcccctccttctcatgtaatat

SEQ ID NO: 104725 - DNA, 1759 bp, Oryza sativa
aaacactctaaaactaaagaatggcatgtaagttaacaattggagaaaatcaggcaatgcctgaaaaataatgaggtagctcatagcctcataccctcactgccctcacttgcccccaactccactttatctcatcctccgccagccatagaagcagagaacaggagggataatatcagcctcccagctccaagctcctgaatcctagcttgcccagcagcctgccaacggtggtctgccccatgcagcaagcaaaaagtcttttagttacttttttatgcactgtggaaacatattcagccaagcttcaagagtttcaaacaaaccaaacgaagcattgtacaaaatagttattacagttgaaggaaccaacaaacataaaaataattgttcctacatagaaaccagtaccaaacaaaatgtgtcgaatcacaaattttggtctctgctcttgcaatgaacagtgcaatataaaataaactggaacatacacagcgattccgtcgtactataggatatgcattttgagtagattcttactttgaacgaagtcagccgcacggcaaaggtcctcaaattatggtatacaaagataatctctagttggtaacaccaggctttcaattccaggaacctgtgatcaaacacaaatttcagttatgtgaccaagaactggtagttgtttgaacatcctctcatgagcagcagttacaaacatagatatgtaaagttagggaaatttgcacataacttgtaaattacataaaaacagcaccagcctgagtaggcaacatgcaaagatagatcaaatgtacagttacatgtaaaacaagcagattgtattgcacgaacatttcaatacctaattagcattttttttttgaactggaacattggttcatttaaccttgtcatttaggttaaccacgaggagtttacatatcaataacctttggctctttaatctaccttaattatcacagccaggtaataacaatgcactaacaaacaacgatttgctgaaccgtcagcgaaataaaaagatattgagtatttttctcaaaccattgatcatatcagtggacatctatatggcaaacagtgacaccttcagtaattgctctattcacattgcaatattgcaccactgagaccattggaacttgattgcactatatgcacaacgtattttacaacaaggccatgtccacctcaatgatatcagagcaaccaacaaataataaacaggagcaatacatgcagaaaggaattaataaacaaatgctgcaatacttgcttgacagaacttcttcatattattcagcccacgtattggtcaaatagtggaacgatttggttgtgtgactacctcttacaggcacatgggaaccagccactcgtaggatttgttcagttcacgacactgcaaactccaagctccttcaacagaaggtcttgtggaatggaatggcaccgagcagaagatgctgatcaaacctaaagaaaaatacacaatcagagcacagcaaactaaaactccaaatgaatcaaaacatcaagactgtaggaaaagtagtagctccccaacatcaagactggatccacactctgaagaagttggtggaagcgcgaccatcggccaccacgtgctgcctggtggtgttttcaacaacaaatccacaggcgaactgatcacctggacagcactttggtgccaccattgccgctcagtgtaggagccagctaagcattggtttaa

SEQ ID NO: 104726 - DNA, 1008 bp, Oryza sativa
attcctgcagccctatccctaggagcacatccgaaagactgggccgatatattttgaaattaacgaagtcatcgcgggcgtctcgctgtcggtgagtacgtcacctaccactaaaataataattagccataaatataaacacccacactactaggaaaatcattttcccaagaggccaaaaatattttttccaggcgggagaaatgaccgcttgtaagcaaaggcttacgaaaatagatgatttttacagacgttagatccacccacctgcaaaaatattttcagcgaacaaaaaaaatccgccgccaccacccctacctgccggcgctggcgccggcgctagcctccccatctggcccttccccctccgaccgatggctctcctcctccgtccgccgctgctgccggctggctcgcctcttccgtccagatctaggaggggatggggcgacgctctctgcggtggccgccgccgtcggctcctcccccgccactgtcgcctccaccgctggtagacggatctgggaggaagggagggaggattggagcgccgctgccaccaccccttctcgtcgccaagctgctgctagccctccttgtcgctgctgtcaccgggccaggagagggaggagctgaaccaccgcctcacctccttgttgtgaccgacgcctccactcctcatcattgagccaccgccatcggctggagagggagcagccgagccgctgcctcacctcctcgtcgccgcggcctcccctccccctcccctagaccggtcgctggcggatccgtgtgcccggggcgagccagtagtggatctaggaggagtcattgtcatcgtcgtagctggcggcgagaccaaggtgtccgcgtcgtcgtcgtcgtcgcagccagtggtgaacctccttggagccgccgacgctcctcagccgatgtgtgatgagagagagaagggggcggaaaatgagtggtggagaggataaggatggtgaaggagaagataaggat

SEQ ID NO: 104727 - DNA, 8698 bp, Oryza sativa
ctacgtgggtatgaaggagtattccatgaactaacaacaatcttgatagagtggcatctattactgatgttgattttgttctctgttgcttctgatgatttattttgtccccttgctgaacttgatctcagtcccatgtacattgaatcttgtctagaatcccggcttgattcgtccgatggttttatgtggtacatttatcggaacacgaatcagcacatgcatgtgcaccaaattcctggcttcattcatcgacctcaagaactatccacggtcttaggaaccattgccgcaagaagtaatttagagtgaattccgtcttcattctttcataagatggcatttcctctattatgattatggatcgacagatctactctcaggaaagcgtggattgatcgtttttatgtacttgacgcgtctttcagtctgtcaattaattcacttcataattgatgccgtttctctcacccccactgtttctagcacttgatgattaatacattatccaaattatttcttattttttattaatacatgatccaaattatttcttttttttctcataaagcaatatcacctttgttttgcttttgaatgaccaatctatattgtctccttcctttttgttttttcttttatgaagccaactcaccttaattttactttttgaaatattatcaccttagtttttttaaatgattaatcaaaagatgcaaattatttaaggctatatcgtctagctatcttaaaatttgtttatactattatcatacaaaactcaaacaacaccacgtgcggggttttatttagttggacataacttgcacacggagaaagatcatgcaaacttatatgtgaatagaaataacgctattaccatcttttttttaaaaaaaaactgacaattgagtcttagaaaatccaacataatggcatgacaatggaaaatgaacaaaactaacgtttgaggtatcaaaattcaaatgtagctaagaagtgaagaaaatgagaaacgaacatgctttgtggtaaaagattttcctaagaaaaaagcaagaagaggaggtaattattttttttatttgtgcaaaattcagttataaccattaattaattctaaggccttttttttcaagcttgttcatgatgtcagtgcaatagattatttgctctagagctctaaatatatgttttctcaaagaaaaattattttacttacattatttagactatttggtttaagcttttctttcaattttgtttcctaaaatatttaatttatccgtataataagtatataatcagcataaatagtttaccaataatttatttccaccatactaaaatatagcaaatattggattagacacaacgtacttgattattatatctaattcattactagttggcatattttggtacggatagagaaaataaaaatagctgaaatttatcatctttgagcgtatgtaagtgttgtagtataaataaatttattttgcccgtcggtttttggatgaagcaaataaactccctccctctccctccctccctccgtatacccaaatatataaactaggatttgtatttgtttcacatgattgaatacattaatgtcgaagctttaagaaacgggaagagactagtaattgagaatatactagagcatgcactaaacagcacaaatctggaggggaatggatgtctgcagttggatagggtcgtcgcaataatgaaaatagtgacaaaaattcctctaatcatatcgatcgatggatgatgctggatcactgccacgtctgcactgcacgcccacatgcgtgtgtacacctccgcaccacacaactctgacttttcgtctctcttctcttccttaatttcttcctagagtatacgtatgtctagatcatgcatgtatacatatatacgtagtagaagatcgctgtacacgctatcacgctgacgctggtgagtcagatcgcgatgtatacacgtgctcatatgagtattaggcgtggactagggatggcaacgggggcgggttgggctagaactcctccgaccccgacccccgacttcacctcccgcccccggccctgactatggatgcgggatgaaaacatcacccgcccctgaccctgcggggccccgcaaacccgaccggggccccgcatttggtagcatctctatccaatcagctcaaaaaatacaacacaattatcatttcagcaaaaacaaatattgtgcatagttaacacaccatcaaaaatagcatgaatacttaaatatcatcataaaaattcagccaaggaattagctgtaagtttacattacctattatatgggttttttggctttctttgacctatactttaaagtttatatgtacccccgggccccacgggtcacccgcgggtgaaattagtcccccgtcccctccccgcccaaatgcggggctccatacccgacgcacccgtgggtcgaaaatctcctccgcccccgtcctacccccgtaggggcgggtccccgcaggggactcggccccgcgggggaaattgtcatccctagtgtggacccactaaggcatgctgtggcgtgtgccccccaccccagcttcctgtaggtgttttgtagctcctatgaggagaagttgaataggtgttagattattttcgattcattgtgtcacatttttttaattagatatggggatatattctaacccatctcagttgttacaacttacaaatattctcttaacaagtgtctaaaatttaactttttaaatatttaatcaataatattttattacaaattaagttttatttgataaaataatttcattgtattaacatttaaatttacttttatatatgattttaatttttacatttgaagggtcttataataacatgtatagcatatctatcctatccaaattttaccacctatcaaatagtaatatcaaggcgactgtacctcccaaatctctcgttcaagctctctattagagaaaaagatagaccatccaaactgctatacaataaataccgttcggacgaaatgataccggagaaaaagatagaccatccaaactgctatacaataaataccgttcggacagaatgataccggttaagtatcaggacttaatacctattaagtatcagggcatttaaccagtatcatcatgtcatgatacttaattggtatcaggcaatttctgccaggtatcaggtaatacttacccattggtacttgatgttgatacctgttaataccacctgatactcgtcgataccagagcgcaatacctgccagatatcatgtgtttcttactaggtatcaggagctaggcaccgagacatcgtcactgctagccttgtcctccacatcgagcccgtcctccgctgtccaagccccatgccgaggctcgacgccggcgaccgaatcttccgctgtcatgccccacgccagggctggtcgccggtggccgcgtcttccatcgtacacgcccacgccgaggctcgttagtcccatgctagaactcatcacccgtggcgccgcatatcttctccggtgatgtgctccccgacgaagcagtgaggcgaggcagcgggggccttctccagtgagctcccttctctcccttcttcttctgctgttgcatgcccgatgccagcgttgctccgttgccgcatgcctgtgcttgtgctctggggaatgagggagacggataccgtcgcaggtgctaggcgtgagataccggtatctagcttttccaaattgctaatccggaaatactatataacagtctcccgtccgaacatggcgactgaataatcatctacttaaacatcttatccatatcagtataccaagtatttggtcttatcctatccctgtatttcttcttcccctcccccccttcccccctctcaccctcatggctcatcagcggtgagcaccatgtggtcatcggtccgtgtggtcaacagcgacttgtgctgttgtggaaaaccaactcaacttgaggtggagaaatcgcaggggccattcttgaggctttttcgaggtggtggcaaatcggattggcgagctttttattagttttccgtgtggtttttaagcattttttaaggtgatttctcaggctagttttgctcattgatttgagttagctagtcatattgaaggactttgcgtgctttttcctacgcttgattgtttgtttttaggggcaatggaatatgtaggaattttctggctataggggtagtttgttgttattttttattagatttttcctagaattgaaattatttctattgattttccttgagttttctcttgatacattgtgttttacgtgtagttggctagttgcttacgcaggtagagaaaagagaagggtttattgaagtatacctttctaactatatcttgtactacctccgttttaggttacaagactttctagcattgctcatatttatatagatgttaatgaatctaggcagatatatatgattcattaacatatatatgaatgtggataatgctagaaaatatctagatttattttaatatatatataaatgtagacaatagtagaaaatagtataacttcttgaacatatatgatcacgtaaaagagcaatcgtccatcagtgcttccaatttttcttccagacgtttcttcttttttctttttttttttgtgggggtggggtggggggggggggggttcaaacaaattaagccgaaagaaacctttttttttattttaagaaacaaaatctcttcagatgatgatctaaacatgagcagcaggcggtacattggaaggaggagaagcatggtgaggcggcggcgcaggtggtggtgatgaagcaggggggaggggcatgtggcggcagagagggcaggtgttgtggttggcgagccaccggtagatgcattccttgtggaactcgtgcctgcacgccaccagcgtgcagcacctctccccctcctccaactcccccaggcatatgctgcactccgacgattcatcccgctgccggcgatggtgcgtgtggtccggcagccagatcttcggatcgggcggcggcgcaccggcatgtcgacgttggcgatcgacacagcagaggaggacgacgcacacggcgtacagggtgctgccggcgagggctcctgtgagcaaggagaacccgaacgcctgccagatgggcagctctttcaagaacagcatcgcgcaactatatcttgatatttctgttttttccaattccacttgaattgtgttcgttctgcgccgcccatgcatatatgcgtaataatgtgttgcaagcatcaaacagttattattatatgttgcaccctttatatatatgcagatccaaaaatagtagcatcagtgtattttaggtatctgtgtgcacaatatatggatctcttgttagctcggacttgatttttaatccttttgagatgagataaaaatattgttatgatccagcagtccatgcatacatacaagaaagaaatggatcaactacgatattattattgcctgttgattggatctttaattaatcgccggagaaaaaaaaagatcgatctgtgatgtgagatgctctggtccatgtatgaggaggcgaagcaagggtcgccgtggctgtggcgcaggacaggaggacggtcacgtgtcagaaacggatttactttttgctaatccaattcagagtcgatgatcgatccatcgacatatacgtacgtacgtacacaagaaaatcgagacatatcgatcgactcgagtgtgtgcagtgcatggacgcggaggatttcatggacagctggctcatgtggggcaacatctttttcttcttcctcgccctcgccatcaccgtggaggtcgatctcatccgcctccgccgcaacgacgacggcaataacaagtcggcgcaccagtacgacatgctgatcgagaggctgctgctgctacgacctaaagacgaccaagacaacgagcagtgcgtcatctgtctgtcggagaacgaggacgatgtcgacggcggcggcggcgagcgggggagagggaggatgctgccggggtgcgcgcacgcgtttcacaaggattgcgtcgtcaagtggctgcgcaaccgcacaacatgcccgctctgccgttctgacgtcgccgtcgccgccgccgccgccgcagataacatggtctgacgctatctcagatttcactaactatctctcacctccgtcttaaaataaattaacctagaaacagtagaaacagtagatagtatcttatccaatcatactttgatttattttgagacggagagagaagtactaactcatttgattgagagcatatatatatatatatatatatatatatatatatatgcatctgacctctatacgtatgtccagtcagtgcttatgtatgctgctagtatttttatacaagtatattttgagatgtataattgatagatgtatttcatgcaagagtatattgagatgtatagctgacatttttctatttttagaaaagatatgtaattaattgtttggaagcttcggaagtttggttacatacacttaattactgtattattatgacaactagcagaatggcccgcgcaaagcatccatagataatcatctattttttacattattttctttaaaattgtcaatagtcatagcgttgttttggaattttttttaaaaaacccaaccttatcttcatcgagtttttttttcaacttataaaagttagaccaactatcaccccttgctcctttgccgcttcgtcacggcttttattcatcctcattgggacctttaagaaattaggcctatcattttctcattggttccttttatagtattttaaagtcttaaagaaaacacggtcaccctactcctttatggctgcccgctatcccatgccctttattattttcattgggattttaaaaattaaacccaatcattgtcggggttcatttttttactttctaaatgtcccgtttgtgaacctgctactttacgatctactcgttgccctcccctttatcattattggggttctaaaatcgttattgaaattctgttttatagtttttagatgtcccatcaacatgtcactctactccaatatggctcacctgccaccccctctttattgtcatttgctgcccctctgctcgctctcccatgccaatcaccatctccgtactcctttgtcgcctatcgactcgttagcccgtgtcgtctctcttcttcgttgttgtcgctacctaacaaaatcaaaatttattgtcgacgtgattaggttagatatcccgccaactattgttgatatacctccttccctatcttactcgttttacacctatcgaatcacccattcatagctcctaatattcgttactttagcagctcgccctctcgccaccctagcaggacttagcccaatgtgtatttttaattgtcaatcttcgattttatcattttggtaatcaaaatagattacataagtactgtaattcttacggaactcttcatttatctgttttcttaatctacagtcttaaaatctagtagatataaaaaaataaatgtaattcttacagaactcttcatttatctggttttcttaatctacaatcttaaaatctagtttcatcattttcaataaaccaaagtgaacattggtacttgttttaggtcctatatatccatcacaacagcccacttcgtttgcttaaatatttttatttagaatttcaattatttctagattatattattactttaaatttcatttttttaaagtttatttataattagtttgaaccaaatttcagaatttattttatttttattcagaattttagttactcttacttttggatatttatatattgcattatactatgtacaattcttcatatgcggcatttactttttaaaaatttttatgttattttttttcctaattttagtgatgttttaattttatttggagttagaattaataatattcttttataatttttttaattatgaattttaattaatcttgtgttgggttctatgtgaaatgttcttccaaaattccttatactttattccgaacattttattatttctaaattgtattcctatttgaactctcatttttatttttctaatttcagaatttattttattttttattccgaaatttaatactcgtgttatgttctaaatgatctcttctttcaatagtccttaattattattttaaattgattatttctaagcctctaaagtgaccatggtatcttatttttgagttattttgaactgcatgtctttaaaatgtatggttcatggattattgctttgagttaggacatgttatttattaacactcttcgctttttaactaaccaaaatcatgtaaaaaataaaaatggaagtatttctttaaaaataaaaattgacaaatataggctttgtagtatttacgattagaaacttgaaagcaaaagcgaaccatctatatgaaccacacgtatatttgaaaagtagcatgtgctagtcaataaaaactttttgtaattatattagtgaatgaataggattacggctagtcacttttagattgaagggctgcaggaat

SEQ ID NO: 104728 - DNA, 705 bp, Oryza sativa
gatgactaacgaatgaacctctgaactaaaattgacgctcatttaatacattcgtaatcaaagtcatatgatcggtgttttcatctatgtgtagaaataaacaacgggaaacagccgatatagctaaattttgcccaaaaaattacatgtcttgtcatttcacttacaattatatgcacatatatgactaaagtttctacatatatattgtaatttatgaaccaatgaatcaccaaatatggaggacttatgtggaatatgcaaataaacaaagagaaaccatttgtgtgcacgtggaacccgcgtcacaaggggtaaaattacaatgttgtatattttatacattttacatttttaaaatgtagttaatgatcaaactatcatgactctccaatgtctcaaatcaaagctgcagctatatatatacaaaacacattgtggtttgatgcacttttctgttgcactggaaaatatataccaatcaaagcagaatactgtaaaataagaagtaactctttctagtctataataaaaccttcacttttgaaacctactacagactcatacttgagtcaagttgaaggttcaggcattcagctatcttgaaaataaacaatctgaagtgagttcatcagatgctttttcactgtgccatacaacatatctcggagagctaaggggactgaaatataccttacatttcga

SEQ ID NO: 104729 - DNA, 689 bp, Oryza sativa
gcatccttatatggatggttattttggctttacacaaataagaggcattagtgacagggtgcaagttttctgtggattctgtttatgagagacacatcacatggcatgcaattatgtgtttgtgcatttgttgtatgaaacacttgaatatttctttgttctttcttttaaagaatgtattcttatatatttctatatttaatatggaactatggattgatgatgatatcatattaaaataagggattatgtctagtggttcttggtgacgctccactggcattccgaagtagtattagctagaaggaatgatgacgccatagaaattaaatgtactgccaatctggaacctgtttcaacagtccttgtctggctctattctttgggttgtttcgcggtcagcatggggatgtgggactgtatattactcaatggttgagagtggagttcaattgactgtctgtccaaactaaataactgataagaaccacgcctgaatccatggatggatgagtgttgtttatgtgaaatttattaactggttgtttcaccatagaaaaatcaatattgttttttggatatatatatttttacattgtagatgtctgacacatttgtttagaaaatgtgttcagttcataatgttgattggtttgcctgcatctcttttgacttttttgtgaatgaca

SEQ ID NO: 104730 - DNA, 1786 bp, Oryza sativa
acggattacattcatcggtgacgggcttttatttaggcccgataaagaccagcagcaggccaccagggtggcctgcgccttgtaataaaaagaaagaaaaatgttgctcgtcaagggattcgaaccagggtttaccttaccgccggtaaccgcgcggttaccgcggttaccgggcttactgcgggggtacggtaatataagtaccgcagtaacctccttaaattcaaataaatttaaaaaataatttaaatttttgataaattttgcacggttttgtacggttaccgcggggtaaccggtaatcctggccccgacggtttgggaaaccctgattcgaacctacaactacatgaacaataagcctaaggactaaccactgagccactcaagtgttttgtcacagtacatgcacttttctttatatatcaaaatgttatcaggtaatggacctgcatcactactcgtgggttcatcataaaattcacaagaatagtggcacatttttacttttaatgcgtgaataaaattttaaagtagtttatctcgctcatatgaactcgaaattggacgattcctttttcagtattcttataaaaatattgtctacaatttcaagcacttatagcatgccgttaagtaaacagtgaagactcatatattgaaattcaaaattttgaattgtagaacaagtgtggtttttctttttaatctctggctaaaacttgtaggttgtctttctcccccatactaactttaaatttgattattcttttttctaaaattctctaaattcgtgatctatcaatttattgtgttattacaactattatttttgccatactttcatgtgactttgttttatcaattgaagatttaaatttcaaaaagtgataacttcaaacgacattttgaagcagtaaatgatttcagctgaaaaagtcatgaacacaaaaattgtagaactgatcgagatctacaaaatttattttggtcgttcattcaacaaactgataataatgttgttcacaaaatttacacatctctcttataatttatgaaaccatatgggagatacgtaaattttgtgaacaacgttactatcactttgtcggatgaacaaatgaccaaaataaaaactgtagatatagatggattatacaattttgttgttgatgactttttcagttgaagttgttcactaataaaaaattctatttaaagttctcaaactttgaatttcaaatttcaaattgttcaaatagagacagatggagaaatgaccaaaataaaaattttgcatcttgatgagctctacaactttttttttggtgaattttccatttgaaatcatttattaaccccaattattgttcgaagttgtcaaaatttgaaaattcaaaatttgaattattcaaatgaactttttcgtaaaaaagaccaatacaatagttgtagatctcgatgagttatataattttatttcttataatttttgcatttgaaacacaaaaatcggcctaaaattaaatttaaagttctcataaattgaaattaaaaaaataccacatatgttagtaggcctaaaccctgaaatcggcccgttacagaactcggcccataaatttctggccattgattcttggtcgaatggctatcgttgcgccaatgaagcatatgtagggttgcaaaccctaaccctccgcacttcatctcgcatcgcgttcgccgccgctcggatccccttcccacgcgtccctcctcctcccttcgtccaccatccacaacc

SEQ ID NO: 104731 - DNA, 1864 bp, Oryza sativa
catcatagaaaaaaaaatcctaaaatcaaactccaaatttaaattttatctgataagtcgattgacataagcatagtcagcctgctaacctgtttcggaatccacgcggtgtagcgcgtgaaatcttttctagtagctctaatacaaacaaatgcagtcgcgagatactcgttcgtacagttggaattaattgaagcaattaatatatgtgttgcattgttgcacggctgagaagatttagctggtcattatcgattgagcagagcaaatattaatgcatcactttgtgactttgtgagagaatttttgactccttaatatgttctgctactattaaagtattaatactatcctgctgaaaaagatataaggtgtacagccttcaatttgatacagtttccagtgttaaactttaatatcattaaaatttctaaatatattatcactaaccaggaaattaattgaaagtgatacaaatccaatacatggcacatatgtgatgctaaatatattacccgctccgttactgaacaatgcacaatcaaacttggcatgacctacagaattaatctttaactttaaatttctcatatattataatatttatgatcacaaatcataattataagaaagcaaattaaaatatcaatctaataatactattttcatcaaataaaatttaatttataataaaataattattgaccagatatttaaacaattgaatattagaatacgtgtgtgtcttattcagtgagaactgagatggagggagtagtattttcacaaaaattaattggtattagcttaattatttttgaaaaaactacaaatgtaattttctccaaatactccctccatctacttttgatatataggtatattttcaaatctgaaaaatttacttttgttaggcatatttcaattgaaccacctatcatcttaatgattttttcagatttaatgtgtgactttttatttttccacataagattgactacataggaatcgagaaatgtaaatattaatgaattgcttgtctacgagtaataactagtagcatgtttaaatggatgataaatagaattacttgtcctttgtcattgtgccaagatgaaatatagagaacgtatgtacgcgaggagctacaggggctacattattactataaacaatgacttttcaatagaaaatttaaagctatcactattagcgatatatttaatgaagtgattgaagatcagctatagtgaagacctgttggcagatttttgattggctgtaacaggatggataaccatccatcgacgccggtaaaataatcctatacacatacaaactactcttataatcatgcatgcacgcagcggggggcaatatggcaattactcctatagtcctatttgcttggcatgcatatattacacacatgcattctcctacatatcgtgttgactgcagatgagtcgtcgcatgagcagacaccagatgatgaatccatttctgctggcggtagaggtacgccgccatgaggaaccggccgtacctagacaataacatcacacacagtagcatccccacacgttgcattgtactgcatctgtttccaaatatgtgatattgttattttttgaatttgatgtttggctattcattttatttaaaactacttatgtatatttattttattgccacttgtttttattgttacatataagaaatttaaacacaacctacgtatttacatatttattacatgcactacttaatttttaaataaaagaaacggtcaacacataacgtttaacagtaaaccatgtcatgagtaaaaaaatagagagagtagtactattaaattaatttt

SEQ ID NO: 104732 - DNA, 801 bp, Oryza sativa
aggatatataatgcttgtctttgtaagcatgctgtatcgatcatagcatcaagttaattgtaagcttgcttcgtttcttctaagcatttgtttctactcgttcgtaatagtgacttttctttttctttttttttttgagaactcgtaatgacttttcttgctgctccatctcatttctcagtttttatgtatttccacgagcagtcggtccatcgctctcaagcttgtgtgggttcaaagtacacgcaccagcccacttgaacatttgcaagagactcagacaagggccgcccaaccagatagataagatacacatgcagacatgcttgtgcatcagtccaggcgaatccggcggctacccggatatatcatctgctcctttttcacaaggggataatgatagtctaatctcacatctgcaattccttttcttttgactgggatacatccacccaacaactctgaggacttactcggttcatagggttttcaaatcattggtagaaaaaaaatgggattaggatgactcgtgcactccaattcatagaaatttttccaagagatcacccataatataaaaaaaaacttatagaattaggttgtaagaatagattcctagaattggataggatttattcctatgaaatgaatgatggtaaaaaaaaattcctaaggtttcaattcatacaaaaaacctttgaaaatcctttaaatcgaatgcggcaccggcagaggcagtgagtgagctagtgagctttcatcatgccgcaatcatgtccatgagcgcaacaaaatagttag

SEQ ID NO: 104733 - DNA, 1437 bp, Oryza sativa
cctgcagccctcaagaattagtagaaagaaacgctagaagatgatatggagagaggaactgcataccttccggtgacaggaagaagaggagattcaggtaacaaaaggtgaactttttggatctgtccctcacttctttctcaacacctgtttgggtagagagagagagtttttgagtggtagtatcaggagtggatgcgaggacagcgagaagacggggttctcttttatacagggggaaccgatcaagaagaggagaggaggcagccgccagttggagaagaaacagtggtgccttgcattattagcagagattgatttgacgttaatgaccctgatttggctgcgccgcgtttcctgggcaccgcatcgcataaagagcatatccatccgactcacccctgactagtcgcccttcaccacagcaatcattcatttggcttggcttggattggtttggcttggcttggggcttaatgataatttaattaattatttcacaattgatgatggtacagctcatcattgtgttcttgaaacaggtacagcacataatgtaccactaatcaccttgcctaatcctatttatagatctgaaggctgtgatgctgtcttacagaaaatgagcacttgtttccttctttaatctgattccgttaactgcaacttttattttctgaggaaccaatgttaattgaggcatttgttagagtagttttccatgtgatgttgtgtttaatttggtttggagttactcaaatgcatggcattggctcatctctcatgatctgatcctttgctgactcatcaatgggttggctgttcttcaggtattggaccaccggaaatggttggtgacttgcagccatttatccgtgtgctactagctggatctttggtgagcggtattcaattatcaccgtatatacttatttcctccattcaaaaataaatttattttttacataaatatgaatatagtcaaattcatgtatagaactgaacttatttaattttagcatggatgtagacatgtagtatttgtttcggtcaggcatcattggtttttattgacatcggcctgtctatattttaccaatgaataatcagcttatccataagtttttcagaatatgttgttatgcatattgaccttagatttaaaaataattacttaagttactagaagaaaaacatacttacaaattaacctcaaagaaaaccgatcaatacaaacttggcagctgtacagataatgtacagatagccgatgacggctcaattggtttgcatcaatcaagcctttcatgagagcgaaaaaaaatctgtgccacttccaagaaatgtctttgtccaaaattaattatctgcacacgatatgtggagtccatgcgttgtgttgcctgcgtgtgacaaaaggaattacattggaatttg

SEQ ID NO: 104734 - DNA, 1114 bp, Oryza sativa
  unsure (1)..(1114): unsure at all n locations
ggagcccatggcgcagtcggactcttcggttgacggcggctggatacgcggtggcaacgaggaggcggcggcggccaggagatgctccaccggccccacgcgcacgcgcgccggcgggatccgcgcgtcgtcgccggagtccttccgcgacgacctcagctgcacaggcgttggcggggatggcagggagggcagcgccccgatcgccgtcggcaaggcggcatcggcgcggcggtggagatggccatggccgccggcgagctcttcacgcgcgggacggaggaagnnnnnnnnnnnnnnnnnnnnnnnnnnnngatggcattttggcgaagacacctggttgaggatggtatttcagcgaaacccgtttttataatggtagtctagtgaagccattcttatgggatgattcttatgggatggtagatatgcaattttctcacttttacggggtgggtgggctaaaaagtggagccacgctgacacgcacgcgccgttcgccgccggcatcttcccggcgatctgctccggctccggtgggcacctcctcgacggtacgcagccactgccccctccgcgtatttcttcctattggttatctccagttttccggcgagcgcactcgcgcgcgccggataccttgtggacgatctggaaactctgcacgctgccaggaggctagcggagtagtggaggagggcgtggtgagggtcgggaggcagggatggagttggacggggagacgaggtgtagcaccggcgctgaggtttgatggtacttctcctgcatctacgaccccgagtttgctcagttgctgtcttgcgggaacaggcagtttctcattcatggataatctgaggaagtcagatggattgatgtctcatggctgtgaattttcagtgtctctggcgatttgctgtttttcgtgttcttatcagaatacatgagcttatctctgaagagattgcaaagggcaatattaagtaagctcttctctttttttaagcaatgtactcatcctactgttgatttgattaagttaagagttaagagtgactagccgtctagccgtattcgattccttctatttgcaggtccgaaagggctgcaggaa

SEQ ID NO: 104735 - DNA, 609 bp, Oryza sativa
ctgtggttggattagggttgagagggggtggaacctggacgacgtcctcggcgcggtcgttgcagcggtgcgccttgggctcccgcttgtccccctccggcaagccccatgggctctccctcctcggcaccggcctcccctcgctcatcctcctccaaccacctccctcctcactgcaaagaagatcgaaatggctcaaattcgcaaagcaagaggcattcccatgaaaccccagatcatcgcgacgcgtccgagggagagatcggaggaggctgactcacctagcaaccaccctacctcttccgcgccgcgtgcgatcccaagacgagacggcggccggcggcggcggctggttgccctccactggtcggagtccaagcggaagcgacgggtagacgaagaggccgaggggagaaaatccggcccaactttttttgttcggtgccgcctcagatgcccaataaggcccaacattttcggcccataacgagttgggcttggaattaccagtccaaccttacaatgacagatggggcccacctgcagcgaagagcgagcgtttaagcatgcgcaaacagagctaaatcgagcatctcccaagactctgtc

SEQ ID NO: 104736 - DNA, 934 bp, Oryza sativa
  unsure (1)..(934): unsure at all n locations
attcctgcagccctatcttctcctatattaagtttttttttatacggagggagtatacaggagagtaccaatgtaagtggatttggttatgcactagacgtagtacacataagtaggtgtaggagaaagaagataccatttggaatttgttctagaaggttaatttggttttattattggttgcgacgttgccgtccgaggagatcgttttctattgtttagaggtgaagtctacctttttcatgtattcgacacgcgtaatttctttttctacgagatggcatgcaatttttactttaactccctttatcgtgaatatgtggatttaatttaaaatttggtggagtggtacatgatattatactcaggttgtagaccttttcccgtattttctgtattatactccctccgttttaaatatttgacgccgttgactattttaaatatgtttgatcatttgtcttattaaaaaaatttaagtaattattttttttctatcatttgattcattgttaaatatacttatatgtatatatatagttttatatatttcacaaaagtttttgaataagacgaacgatcaaacatgtgctaaaaaatctacggtgttaaatatttagaaacggaaggagtatttgagagccacgaggaggatatgggccaagcatgaaaaaaggccaacttagtcttggctctcagttcagtttgcattccagcttgtagcctgtaggcccaaatatagcccaatgaattattttcgaggtagaataactggctagatgagaccattgcagtgcagtaatattgtcaaatcaactaatcacaaggacaaaattcactaaattattatttattccatggacaaaaaattacatagactctgcacaaatatctatcatgacttaatcacatctcanaaccctaaactctgagt

SEQ ID NO: 104737 - DNA, 681 bp, Oryza sativa
attcctgcagccctataagctttgtgttaaagttttgaccctcttcgtcaggttatagacaccgacgtatcagcggcgtagtaaggcccacaagatggataccatttcttattggctgctgtgatgattttcggttaatggcatattcaatggtagagataaatacgatctcctagacgacttaagattatttaaagaacatatttttataaaagttaagacgatgaaggctctaaccattaacttaaaaaatattacttttattattgtctctcatgcaaaacatgtttccatattataaatactagagttattgctgagctgtctttactcatagcaatgacgtctctctcttacatgtgaacaaatattcttaataattagcaacgctaagagatcagtattaacaaccattatacatgtccttagctgtagctagaatgtaatttttgaaacataagtttaaattagtttaaatgtttcttcatcgtattttctattttaccttttaagtactgctaagagtatataatgtaaagatcttattctaaaatcattttcggttgggataagtcgatctatttctctcccccctcaactatcatgccattaatctcgactttaatgtttttaattagatcgagtacatggtaacatgaaatggtacaatcatcatatatg

SEQ ID NO: 104738 - DNA, 675 bp, Oryza sativa
caaaagagagaggaaatgggtcccagaaaagcgcaaaagggacggaacttggggggttgcttgcctccgcaactgtcgcttggcttgcgcgcgtcgccggcgacgtcgaagccgccggaatccgggaggcgccacgcctgggcgcccccgccgaagcagcatctcgcggcgcgtggcgtggtgatgatgcgtgtggagacgaagccacgcaacgcaacgaggaagacgacgagcgtatgctgggctgggccttatccgaaaacgggtgtcggcccatatcaacccaggacgttcggcccacgttacttgaccacaaacgggattgcggacgacgagcggcccacgacatttgggccttaaccggattgctgacgtgcgtgatagtaagtctattttgcctccctcatgttctctgcgagtcagcctgccacgtcaacaggaaccaccctacaaaccatctaagggttgatctgctacggttttcgcttattcgaatcgtttattagcaaataaaaatttatttatgagtaaaatgtttatatatgtccataataacttaaagcaaatgttgtaaaatataagcattttaaaaaaacaaaaaagcaaattcaaaactaagttctcaaattcaaattttggctcataaatataagcataaccaaacaataagaccga

SEQ ID NO: 104739 - DNA, 741 bp, Oryza sativa
gatatgcagtctcttgcaggctacatcagggtcgttgggatatggaagatgctccatttttatttgtgctgaaagatacacattgttaatacaggatattaacttgtaggctagtcaacagctatgctctttttgtggaactttatgcaaacaattgaaagatgcagtttcttgcaggctacaaacaaacaaacatagctaccaagttgaagatgatggcatccaaaagcaaaacaaacatctcatcttttgttttctttttttttcctgaagacgagatctaatctgaacgatcatgccttgcacctactatacccaaccactggcattgtttgcaatttaggatgtgggcaacatacttagacctatgatggattcctggaccaaatacttgcagatatggtccatgacagtcacaccacatctagctatctacatacatagtaacaaccactttactgatgtagaaactagaaagttaaaatacttgtcattaatcaccacactgtgattgacaacttgtcaagtgtactcgtagtggttggtatattaagatgctgcttaggtgagcactataatgaaggctgaagcaacagagtaaatgagtaatctcgcattagaatatgatactcttcaccaacttctcttcgctgtctttctgataccgtataactgaatattggtaagaaaaccgaagtgtggtaagcttggaggattcagaatgtaccggggctgcaggaa

SEQ ID NO: 104740 - DNA, 832 bp, Oryza sativa
agtacagggtcaggaagcagtacacttccaaagaattcagagatgttgagctagatttcaatagctatcttccaaagcaatagcacaagacatcctgtattcagatgtagcacgacaatcagacaagcagctgtgttcgagaaaccaaattcagaaaattactgaagcattgttcttccttttcctctgagtcacttgctcgctatctgaagactgaagaggaggcaaaagaagtgaagtgggataagcgcataactctgatgaaacaaaaagacctgtgactttgtgacattgttagtaggacattatgtcattaccttactgaagttacagggaagcttgttgcagtatagtaagactggagagttcattgcgttatatatatatatccttgaattcattatgctttttgtctgaacaagagaaatggccgtgaataagagcaaatatgaatgggattgttagttttcggctgaaagctcagagtgtgtaattcgttcaaaaaaaaaaagaagctcagagtgtgtctctagactgtagttctctacttatttccacaaccaaaagagctggctacaagaagcaatattgtcgaagaaatttttcatgtcatgtataaacattgtgtcaaagaatctgaatggacagacttctaaatatatactctctgatcatgactactagatcttggtattgaaacaaaataggtctactagatcaagatattgtttccgacaataatgatttgtggcaaagatcaaaagaattttgtccaaaaaaatatgtcaaaagaagaacgatctgtgcggtgtgccatttgggctgcaggaat

SEQ ID NO: 104741 - DNA, 926 bp, Oryza sativa
tcctgcagcccctgcttctctgcggtttgagcgagcgagggaggaagaggaggggaggagacgaagatggccggggtggcggcgttgcagggcgcgatggcgtccctctccatctctgcgccgggggcggcgagcaccagcagcttctggggccacccgctctccaccttcgccgccgcgccggctggggtttgtgccgactcccaaccctgattctcatttttcgcattcctttatgtttgctctgctcttatgattcgctggaaaagtagaaatgccagcttgcactgagatttaggattttagagctcaccaacagcgtggcattgcaatggtgatgtctacatcgcctcactgtactgttgttgccttcaggagttcaggctcaggacctcaactagccaacaaccaacgttgtgtcaaaattttgtggtatattttttttagagaaaaggtctcaaggattttgtggtatagttgaacctagttggctagtataaggagggtttatatgaattaatgaatgcttgaaatctcaagtttgagtatatcaactgagtgaattcagaagttagaaattgtgttgtctaccatgggatgtggcctgttatgtttcagtttaaacttgaatattatttttttcctatggtggtataagcgatggatacccaatattcagcctttcaagcagaggattatttttctgaaagatgtgccctctagtgagacagaccatttcttgttctaacctgctgtatagatcacatttcgctggctagaaacaattttgcctttgaactttaaattactcaacagtagaaatttcacagaagacttccatgggaaaatgatggaaactcatttcactcggggatagcctgtagcaaatgattggcacactcggtatacttatcagactgaacttg

SEQ ID NO: 104742 - DNA, 1480 bp, Oryza sativa
attcctgcagcccaaaactgcaaaaggaggctgcatctgcgcaagggtgaggagccaatttttcggaccattcgacgcgtacgtcgtgcacgcgcgccccctgccctgccctgccaggcgaggcgagcgagcgcgcgtgtgtttcccctcttctctccaccacacatgcttaagtggctaggagggcatcctcccttttaaggaggtccccctctcctagaataagcaaggtggtactaaactccacatgcatgccatcctatgaggtgggcttttgtgattttccaaagaattaatcttcgagtgggctaaggcccatcattaattccaacactagctagtagtttgcgtcattgattctcaaaattttcatacaaatataccccctcctcctcacatcgatctcttcaaaatccttatattatgggatggatggagtagatagatactatgtagtaccagtgagcaatgatagttgtgatgtagacatgcatctgcatgccacagctaattacaccctcgtgttgatgtagtcacgtagatgtcagcgttaaatggatgttttgatgttttctgaagttgtagtatagtactccgtagtaggtctaacgttgcattcttatttaacactgcatacatatcacttaagatattcctagcttagctaccgtccacatacttgaggttcctagctagatgacaatactacgtgcaagccattgcaggagctgaatatcttgtagtacttgcgcatagttgcatggtccagaaaaacagatatccagtacatctctcgttttctcccattaattgcagagtactgggtatctgatcagttaatgaaatccgcaaactgctgaacaaccatctacctgtagatttcaattgaggatttggactaagataatatacaaatggtttttaggtacaaacttcagagaaactgcacttgcactggttttctatgaaattcaaccactcagttttgtcaccgaaccatttgaaatgggttatttggattattttcatataaggataaactaaatacttttagaaataaacttacttaacaaaataacaaatactatgctgagtgaagaagtatagtgctgtagaataagtagtttagaagcaatatcatagaaaaaaaagtttttcgagaaaacatttctttttagacgtggagtaaataatctaatatagtaattgaaaagcactctcttcgtttttttaatgaataacactgttcacttttaaacatatattttatcattcatctattaaaaaaattttatgtaaatgtataagatataaatcatgcttaaaatactttaagtgataaaacaactaacaacaaaataaattataattacgtaaatttttaaaaagatgaatgggtaaacatgtgataaaaagttaacggtgtcatttattaaaaaacgaacgaaggtagtagatgcttttaatttacttctgaact

SEQ ID NO: 104743 - DNA, 795 bp, Oryza sativa
gtcagaccggccagggcacgccggtcagaccgccactatgtggccggtctgaccgcccctggtcaggccgagcccagtgaaagcaaaggtgattatgtgtgtgtgatgaaaatgtgagcacaagtgaaaatgcaatgacctaatgtggcaatttaatcatctctttgctaggtcattacccccctttatagtacggcgaaactaacaaataaacttgcaaatttgatcgtccttcacctcgatcaattttaaaattaaaacactagttttaccgttttcttttcttcgcttcgcgccatcaaattttaatccatcgatagtcatccatgcgcacacatgacgtggacctaacttaaaatatatctcaatagcaatggttagtccataattatcgcttgtcattaattaccaaaattaacaacgggggcctagatgcttcaatctccccctttttggtaattgatgacaaacaccacaaatatatataatcaaacatagaacacatggatatatactgcaaaggaaatcaaaagcttcccctaaacatgtgcataacaatcacaaatagcaaatatggagccaatgcacatttcaatttcacaattcaacatatcacaaacacaagagcaatatctcaatgtgaagttcaagaaatattcatccatgagtataagatggtcacatatatatcaatatcacatacaccatccatcatcgcacaagttcacatcacaaaagtcataaatcatcctaaaagggctcacaaataaacataggctattgggctgcaggaat

SEQ ID NO: 104744 - DNA, 687 bp, Oryza sativa
actattctaaaattgcttatattttgaaaattagttgcggtcgatcaaaaccccagtttcagcttatgacagcatcgtttctgaaaagaaaagtaaaaccattcacctaagctaatgattggttaacttgacacaaacggcagccaaagatcgattttcacgttatatcctaattaagtcgattgattactagtcttcaggatacacaactcgatcaggtttggtgttttatctagcttgatgtagctagctatgtggtgtttgcaaatgcgtagtacaagccaccgacaaatagtgaattggtgatgtgatatcgtgctgcaaaatctgcaatatgcagagaacgatagttaacttttgcaaattctttgtgtgttgagtcggcaactaggacacgctctcactctcactcacatcacaccccagtaatgctgtccccaaagattcagaagatgaaagatatatagcctcaatcacaccgatttccatgtagtaacaatactaacaaacaacgatcctaataggaacactacagatgccgaatttctatccattatctaaaaaactctcgtgccacgacaatccagaattgaacagacagctacgtccaacagggagggttggatctacttaattcatagaaggccaaaacttagctgaatcttgttcacgggtatcgcatcaaat

SEQ ID NO: 104745 - DNA, 1099 bp, Oryza sativa
ccccaaaatttgtgagttcaatctatgtcgagacgttctaatatgtgtaagatctcttcactcctttttttccttttgattttctctctttctgcttcactgatctggctagaatgagatttttattcttgaatccagtaagtgtttggtaataatcatggctatctcaaaaatgtgtagttcatgacgacgaggtgaacgtatgttccaagcaataataattccatttttcacttaataagaaaaactaaattagtgcaatggttttttttctacttaattagccagatcgtcttactcaccacatatgtagtggcgatctggctaagtagaaaaaaagagtttcttcggcatagctctagttgccgttgatcgtgaatgattcctactcgtctgactatacctttataaacatataagcattagattgatactgacttttctggcgtggttagagtcattggctgtggtgcaattgagtaaaaagtagtggtagtagaaacccatcccattgcattgtaaactatccgcatcaagtcaaaatgcatataaccctgatctgttatgtaattttctatgagtatattttataaatataaggcatcgttttatatttagtgttgggtccttagattttgagggacgactctgcacgttacatgctctactaagaggaatcgcgcgagaaagatccatttgaaaaaaaaaaatcatccatcaagtagatggaatcgtgtcaatttcgcaactgcagcgcacgcgcttgaagaaaaatgtaaacatttcctgccaataactaaagttaaaaaaaatagataaatgatgatcaataatacaacgagaactttcttgttaaaatggactccctccagtcatgtatataccaaaaactactagtacaaagcaaataatgcggcatatttacaataaaaaataatttgtgaataaaatttttatgtgcgtactcttaatgatgtaaaagcaaatgctgaaaaataaactaccataaaaaaaacccaaaatcaactccaaatagcttataagcataagtatatacataaaaaatatgaggctatatacttcttgtgctacagtctgc

SEQ ID NO: 104746 - DNA, 536 bp, Oryza sativa
attcctgcagcccgaaatacacattttctggaatattagggtatttttatgttggtaggtatataattaaattaatgttcaagtaaagtaagtgtgagaaataaaatattatgtttggatttaatttttattaaattttctatattaattacactctttgaaattttcttggaatttacatagcttaattggtaattttggtaattttgataatacaaatatcatttcagcatttatttaaataaaagtcaaaataaaaatcatttttctctatgggcccttttcagcccattttcttctttagcctgcaagcgcaaaagtctacttaatacccccatactcctcctctcacttgctagtccaccggccggcgtgcggcccaaaccctcgatcgatctgagccgttcattttgatggacggctcagatcaattccaaattgatgaccctaaccctccccctcccccttcccccagctgagccggccaccaccctgcgcccaacgcctcctctccccctccctctctccccaccggc

SEQ ID NO: 104747 - DNA, 767 bp, Oryza sativa
tagttgtaatacttacaatgattgttcgattggtttgttaatcgatctttgatttttttttatctgtccggcgtacacgagtaggctttggccgtcgtacggatgtaattgcgcgtgtatatggagggtgccgcttttctgattgacggacccaaaattactatgacgaaaggaaaaatatgaatctttatattagttatagattatagatatagatatataccttgttaaacattagtagtgtttctactatccatcattcgcttacgtaagcatgatgttgcccccgctttaggttggagtccgattttgctttactaagggttatgaatgattttttgtccattatcgctctatataccagccgcgtacgatggaaaaatcataaaattaaatatcgataataagaaattcaatcgggcaaaactcaatacaaaatccagtcatgcaggactaaacggaccgagaacaccaccataaaattcaatcagctctgctcgtagcccacgccctcacctcgtgccactggacattggcccgcttcgcgggacagcggggaggcggaggcgaccattggcggctcagacacaacctagtgccccgcaacacccaccgtgtaccgccaggttttgaccggcacgacggggcaacgtggaggagaggttgctgatttttttttcataaacttggtcaaatttaaagaagcttgactaagaaaaaaaatcatatgactataatataaaacagaggaaatatttaaatataca

SEQ ID NO: 104748 - DNA, 668 bp, Oryza sativa
tgaattgtccagcactttcaaaacaaatatatgctagtgacatgagtgacatatacattatcctaactgtacaagaattcagcaaacacgaagcattggattggtttgattcgttattttctttcttttttttcgtttttgttatgtaggaagccacgtgaagtgcacggtatatttcacagcatttacccgctaacatggagtacccgaccagtatccgacttcccaattttttgatggctcataactattttctctaattttattttcaatggctcgtgactatttatctgtgatgatatatagacacgtacttcgtcccgaaagaagccaacctacttctagtatagcggatctgaatatattcataaacatataaacaaatagggccgttttgatttgctaccaaaactgagacataccaatattttggttattggaatagtaaactggctagtttggattgtgatctaatcaatggtagtgcctaaatttaaattggtagcaacggctaaattcaaattgatattgtcatcggccggaagtgcctagaagtaaccccacacaactaccattgtaattatttacgctatataattaccatgatgagcaaaatgaacctaattatgcatatttcttatcatcttatttgtgcttattctgcaaca

SEQ ID NO: 104749 - DNA, 949 bp, Oryza sativa
tctaaaatataagatataaccacccctaatctaaagaccaagaaaataattataatcatcttgtagttttgtagtttagatcatcctaataaatataatgcatgcatccaatagaattagagaacatgagagtggaggatttaaaaaagtaataatttaatggagaagggattatagttaattgcctacatgcatgcatgccttatattatggaacatctagaaaaagtggttgtgccttatattatggaatggagggagtaataagtaaggtaaggcttaacaaaagtaggtctctttgttatcaaaattttcacaatgtgtatgaggcaataagatgggtctcatgaacataaaaaatctaatagtctaatgagaaagatagaaagaagagagttaacacatagatgagaaaataatgtttttttatttcttactaccaggttatagtgttattgcatggtagttgttggtactatttccacaattatttactacttactataacggttgcatttatgcttactacctggttttagaacacattgtggatgttcttagagtataaaagcaggtagtaagcaataaaataaccttacaaccacaccaacaaacattgttaaagctagcaatagcaactatgtctgctaccaacaataagcaacttaactatagtatttatacagtgagcaatgtgcgtgcagagtatgtgaggctagggattttggtctttttttcccctcttgtggactctatcttatgttcaccttttacattcacacattatgacatagagtatgtattatttccctaaaaattagagtatgtattagctactacccactgattcgtaaatccaccttattaccaattttgacaataaacattactattacccttatatctatatggagggaattgacttttgcattgaccttgcccatccttat

SEQ ID NO: 104750 - DNA, 645 bp, Oryza sativa
tatataagtaagtacatatttgtatagggtgatgaggtgctcagtaacatctgtagcatatataagagattcatggcatgccatcgaccccttcctttatcacaatgccatgctcatgcatgcctcttttagcggagatgccagcagtactctccaagagcccagatggggaatatgttgcggtagttggggtaattgaagaagagggagcaattgaagcatccaacgtgttcctaacatcagtacaggagcacaagcaaaacatgagatagaccttaatatgttcacacaagtaatgctgaatcaccttagaacatccccaggagttaaactaattggccatctaattagtttcttttcaagtttccataatgacagttaaagatggaattgtatgtcttaaaatccttgtacagaaggtattgtatggtagatctcagttccttacatgttgcgaagtcctgatttttatctaatgtaaacaccatggttctttcctaaaaaccacttgatttgtgcgaggaagcaatagcccatggttcagttcttttctgaatgtaaacagaactatattgagcagtataatgtaaaatttagtctagccatactatgtattacttgatgaccatagttcacatcagagaa

SEQ ID NO: 104751 - DNA, 686 bp, Oryza sativa
gtttggttatgaattggatgtagagtaaattacaagttcaattttattactaaaatttcactttataccactatttaaataatacattttttactttggattaagtaaaattatatttgttgtaatttggattgcctccgtcttctcgagtagtatatccatggttttcattataccggcttttttacattaggaattcccctcctgaagctatatgtaggccatacctttaatataggattagttggtatgaagagataagtgagctgagatagtctaaaccagtacagaggtaacattaactagtctaaactaaaatgattagataaagagtggtccaacttaaaactttgataatgaaagatagtcaaagtgcaattcaatcttagatttatatacacgactctttacatctatttccacgtatataattatattttgtacataatgtatattagatatacaaaacgagtgttgatatataactcttatcttatgtttctatagatacaattgtacttatcaatctagattcatctcaatataatgatttgttttttcttcaattaatatggtaatatttagacatctagaacgagtatggtgactcattttcaaacaatattaatataatataattataaataaactttttttctaaccgtatttccaaaaaacctaattaa

SEQ ID NO: 104752 - DNA, 679 bp, Oryza sativa
tacgtattcaattctggatgctccgcaattcgcaaaaaatatgtttgcgtgcagggaaactgcttctcgtttcctccatttccctccatttcccaacatttctcctcgttttccgcgcggacgtttttcaaactattaaatagtgcgtttttttaaaaaaagatttctatacaaaagttacttaaaaaatcataataatctatttttgaaaaaaaattaacaaatacttaattaatcacccgctaatcgctgctccgttttcccgaacgcagccttaggggtagttgtgaacttgtgatcgacacattttcggttatactttcacgacccgtgccttcccgaaattttgaacaccacacaactacgacctgtgccacatcaatatagacttacgaaacctcccattatatctcgagaaaatatcggtctcatatttttattaatctattgtcctaaaacatatagctactctttaacatttaaatctccttttctaaattatagatatctatccacttgccttttcatttcaaccaatcagaaacatttttaaaaagtttaaaggtgacaacatttcgagataataggagggtaccgacaaattttgttatacgccactttaatttgtaaacattttgaaatttgccacctaatttgtgtggcttttagaatttaccac

SEQ ID NO: 104753 - DNA, 686 bp, Oryza sativa
ttttaacaaaatttgcatgttaattaggtttttccttcataatttagattttttttgtagtttttttaaaatctagtctaattttcataattataatccacgtaattaatatgttttaaattttcactcacaatatgttaaagaatgaaagaaaatacaatgataatatcagttgttttgaggacatattatgttagagttaaaagtattttatattaaggattagatgtatgaaaattcaaataatttgaggtaattaaaagatattcgatgtatgcttaaaaaatatatggtttttaaaattaaaccccaaataatcttttattagaatcaaatacttaaaagatattcgatgtatgctaaaaatatatagttttttaaattaagccctaaataatcttgtattagaatcatatattttaaacttcctataatattactcttgaaactctaacaacaatcctaatttcgttaaaactcttcgatcataagcctcaaagcttagattagaggtacattttgagatatcaaatattttacaaatcctaaccaatatacattatttttctttgtatgaaccaatgttaggtgatgatgaacacaccgcccataccttatcatcccacatcttatatatacccaacacttaataaataaaaaaattattacaagtctttctaaaaagg

SEQ ID NO: 104754 - DNA, 3915 bp, Oryza sativa
caagactcatgtccaagcccaaccctgacccatctgccttacgacagtgtacggcttcgactgcgaggggtcgatccgacatgggcagggagggagggcagcaaggggttgcgatgcgtcgtcgtgctcgtcgttgccgacgcccgcggcacggcgacacgtccggcggtcgccgtgcgtcgtgccggccggcgaggggacctttttattactatatcccctttccagcatggactactactaccactctttttcactcctctagctgctgctctgctcagaggctcgtgagctattcgtagctaggctttcgccagccggcggcgaggagttggatgacactgacgcacgtactgtcgctgcacagcggttagagcaagtttaagagcacccgcaatggtaaagtaagttgctatctataaaacatgtacatctcagcaatagactcaattaatagtaaaccaccttaatagtatgtctacattggtatctataattctctcatgcattgcctcgtttttctctatagactatctctaagttagtagatagctttgctctctctcttcatttaataccttccaagtagaaaaatatgctgacatggatctcttgtagagagcctatagataaccattgtgggtgccctaatagtatagctaattattaattccaatttatctatagccaatctaatagtttattcatataatagttatatactacactattaatatatggtcccatctgttatacacactgcatcttggagtccatgctatagctggctacaaatctgtagcccgctactcttctctctccttattatctacttaaaatatgtttataagccaggcttatagcttacgcaattgtacctgttcttaacggtggccggcgcggtgacgcatgcagtactagtgcagagaggtggtcggattccgaggagctctcctgttctgttattgtcctttcaaacttctaaaaattttatggaacattaaatatagataaatgttgtatttagattgatccaaagtttaaaatttggttgaaattggagacgatgtgactgaaaagttgtgtgtatgaaaggtttgatggaatggaaagttggaagtctagaaaaaaaaactttggaactaaacacacccaaaataactaattatgagacaaatcttttaagctaaattacgctatgatttaacaatatgatgctacagtaaacatttgttaatgatggaataattagacttaataaatttgtctcacaatttacagacggaatttgtaatttattttattattagtctatatttaatactatatttttatatattgtccatatacttgaaaatattttggtcagacaactaaaccgtactacatcggttgtgtagttggcacgcttcttcatcagtgtggcctcggtgcccgcgccgccgcgtgcgccgctctttcatcggtgcccgagctcaacacacacacacacacacagccctgccctgccttctctcatgcgagacccctccaccgaatgtagtttcggcttggctagctccagagaaaaccatagaaaaaaattccattttggttatttgagacacaggattataaaaacgtaaaagtagaataaaaaatacatgaatgaatataagtagaaagtcatgtgtagaatagagtatcgaaaaatggtcgttgtttcaaaataaatcaacttttgtgttgattgagagatacgtaaaacgagatgagccattaacgtatgattaattaagtattaactatttttaaacttcaaaaatggattaatatgattttttaaagcaactttcctatagaatttttttttaaaaaaacacaccgtttaatacttcggaaagcgtgcgtgtggaatacgaaacaaactcaaagaacacaccgttttatcatatcgtaggttgtttaattttggactgaaggagtatgcattagatggagcatatgaaaaacataatgaagggccccctttaaaatgtaagattgtcaaaaacacgagaatagaaaaaacatagaaatatgatgttatgtccgttggatttctaagagatttgaaaacacaagaaagtttcaaaactaccgtttgatagccatacaggaaaaacgtaggaattcaagacacggaaagaagaaaatgtgaggtaagacctcaatgatatttcttgaattttctcaaaacaatggtacttccttcattttattctctccatatcaatgaggggtacagtgatattttaatcacctacctaatttgtttttaactagctataactatgtcttgttccatagtaagattaatacgacctcatacctcatactctttatttcattctatgtggtctccctagtttcatgtgtttctttctatacaagttatccaaaggcataattttctaaattcttatgttttgggttcctataaggttctatagcttacaacatttattcatgtatttttcttgttcccgcatttcaaaggaggccatagactcgtgaagtgagcgtaactcaactggttaggttccttgtggtggaaccacccggttttaaatcctaaatttgatacgagtgctcgcatttacggctaattattatttcagtggtagacgatgtacccgtgaatagcaaggcgccagtagtgacttcgtcaatctcaagatatacccgtccagttcggaggtgctcataggggtagggtcaacagcgaagctagtggtgactttgtcaatctctagatatgccggttcagtcttccggaagtgcttataggggtagggctaacagcgagacgctagtggtgacttcgtcaatctctagatatgccggtccagttttccggaggtgctcgtagagtgtgcgtatgtacgtttatagggatgagtgtacgtgtgttgtgagcgcctgcgtttatacatgtttctaagaaaagaggccatagactcaaagcccgaattaaactggctccaactaatttagaaaaatcggtttcactttagtaaacatgattaattattagagtggtagattagcagtaattgtactaccatacacgtcacatgagtacatgatggtgctccgtacttgtatatgtaagcacccatacttctacttgaaacctcgacagcgacaagtgccaagcactagctagagaaccgaagaaaagacatggcaaggtcaaatggccacgtagcaactcatcaccaaaaagatagtactactacaaattatttttcttttttttaaaaaaaaactcaacagcaagaagccaagatacccggtacttgtagtggtacaacatgtgtaggcaggtcaggtcaggtcatgtggtcaaccagccaatggaaagcaaccgagagatgccttccatggattaatgtgcatggtagtagcaaatggtggccagcatatcgttcgatttttcagacacgggacaaaaatcgtagggactcaatcttttcgctttatacttatccgttaaaatttaaattttcaatcttaatttaaagctgattttaatttttttttattttttagcattttacttttagatttctagtaacacgtatataaaagttttatttaccaattacttctcgtttgtgaatatacgtttggcttattccacgaataaaccaaacaatgagaccggtactcgattcaccttttaaacctctcccttgtcttatgaagtataatgaactaaaaggacaagtaatttactcctttcatcttaaaaatacaaaatttgaaaataaatttggacagtgatagaaaagttagaagtttgaagaaaaagtttggaagtaacacaaaggctaattcacctccaggtggagttaccgtccgtactgaaaacattcatacggcagacatatt

SEQ ID NO: 104755 - DNA, 1305 bp, Oryza sativa
ttagaggttacgggcttatttagtttggaatcaatttttgtactatcaaagttagttttggcactatcaaattaggtagtattgaatttgaactattatgggtaaatttggtaacaaatcaaacatgcacttgctactattaaagttagtaaaaattttagtagggtaataaattggtatcaaaccaaacaagccctacatcatcatacagaacatagagaaacaatgagtcatgaaacttgaagagggttgatttggtttgtgacataaattggccttaccaatttttatcaatgctaaattctgacaagtttatagctaattttagtaagacaattgtatttgaattgaagccaaaatagtctaagttaacttttaaaatggcatatttcttaagcatgccaaaatttggcttcaaaccaaagacactaaacactattgaaactaccaaattttgacaaattttgacatggctaattttagtaagacaaagttgtatttgaattgaaactaaaatagtctacgttaactattgaaatggcctattttttaggcatgccaaaattgacttcaaaccaaaaccaaataggcactaaacactatttaaattactactcccttcatattaatgtgttaaaaatatttgaccattcgttttattcaaatttttcttgtaaatatgaaaatatttatgtcatgcttaaagaacatttgatggtgaatcaagtcacaataaaataaataataattacataaataataattacataatttttttaaagaacatatgatgaatcaagtcacaataaaataaataataattatataattcttttaataaaacgaatgatcaaatgttgaaaaaaaagtcaataacgtcatatattataaataataattacataattcttttaataatacgaatgatcaaacgttgaaaaaaaagtcaataacgccatatattatgaaggacgtcatatatcatgaaggtagtaatatacaaatagacactctaaacactacatatattatgaagataatatacaaatagacactaaacactaagaccaatttacgcctcaaagcaaacaacaaagcaaaccagcccgaaaccagacagatacagatactcagaagatactcagaagctgctactgatcttgttcttgacataaatatagttacagccttttttttggattttcggattgttctccaaaatcaccatccaaactcaccggccaaaagattagtacagcactaaaactagaactctaaacatctcctaaactcgtctactaattg

SEQ ID NO: 104756 - DNA, 1065 bp, Oryza sativa
tgtttttttcaaaaacatcacatcgaatcttcaaacacatgcatgaagcattaaatatagataaaaacaaaaactaattgcatagttagggggaaaattgcgagacgaatcttttgagcctaattagtccttgattagccataagtgctatagtaacccacatgtactaatgatggattaattaggctcaaaacattcgtctcgcggtttccatgcgatttatgaaattagtttttttattcgtgtccaaaaacccctttcgatatccggtcaaacgtctaatatgacacctaaaaattttcatttcacgaactaaacgggcctaactgaactctgcacaagtactaccaaaagttgctgtgattattgcgttgcggcagcaagtgcatgcacggatttgaaatcttaatttggacgcttgaagagaagtattagcgctatttggttagcaactaattttgtcacacgtcgctttaggtaaaccacacttctttcagaagatagtgttggtttatatcataactctattttatctaaattttaatcacctggcccacatgtcatacacaatatttcttgtctattttttttctaagcttagtttattatttgagtgaaatacatggccggtccctaaatttgtgttgtggtgtcagttagatccgtgaacttgaaacttgtacatttagatccgtgaacttggtttaatgtaccaactcggtccaaacgtcctttgagtgcgtttgaccgccaacgtagcatgccacgtaggcaacacttttgctcttagccccctccacatcacaattcacaacacgtcgcatatatctccttgtagctatatagtgacaccagaatccaaaaaaaaaaatcctcaaatctccatattattcttctccttgcatgtgtagaaaatgcggtcctgattagcaattgccattgctctgcgctccaaaatgaccttatcattgcataacgggctcttgatcaacaacaccttcttccggcgacttcaagaagaggacaagcttggagaatcaggatacctagcgtgcaagccgcatt

SEQ ID NO: 104757 - DNA, 721 bp, Oryza sativa
cccatcacattgctgcatactgcatagaacatgtgaaaccaaataaaagaaatttatggcgttttcaagtttccaattccgatcttccttaacgaaaactagatgcagaactgcgaccagattgttttcacttgctgcaacgtttatcattgatagagacttcttactgaatcagcacatcaagctcttatatactacatctggttgttgttgttgttgttttatggacagttttcatttccaatgcatacaggtacctttatgtttgtgcagcgacagtatgcacttgcgctggagtgttcattatagccgtgacagcagtttacacttgcactgttttttccttcaggatgagaaactacaaggataaatcctataattagttttaaaattagtagttcttatatagtcatttatcagaaaggaagagtaacattgccttcatcgagaaccttttttacggtgtgtttttttttttggggggggggggggggcggggtccattttgttgtctagtttagaaaaactttagatcatacaattccctcttcaagggtgtaaacacacatatctagagattttctgatgtatgtatttctgttatactagcatgttcaacttgaatatttgttctctattattagtctggtaaatgttgcggtttgcatggttcaactggggatgttgtcttcgaaattcgacagtcacattggaaatatac

SEQ ID NO: 104758 - DNA, 786 bp, Oryza sativa
ggtgcccgggctccaaggtataaaacacacaaattctctcaaatttttaaaaattttcaaattgtgagtatatacctaggtatatgaatttgattcatacatatacctaacaagaaaacaacttaaactcaactttatttcacaattcattattacatacctaacgaattatatgtttgaatgttatatatctagaaccaaaatctaacaaaaaaaaaaggttcaaactcagttcaaacttgtttgaacttattagtaaagaagttaatgttcatatctaaacatttaaaaaaatttcatactcattcaaattgggtatatactcaatttgaatcttggagcccatactccatatagcaccaattaatatatatatatatatatatgtcgagattcattaacatatatatgaatgtggacaatactaaaaagtcttataatatgaaacagaggaagtacataaatttctcagcagaaatgcggccatttcttttctttagctgatgttttagtccatttctattctttagctgatgtttttagtcaacattgcaagtttgcgtgaaataatctgttctgcaaatgggatgttgacagattttgtgctgcagatccgtgcctacgatacacttaaagttacatacgactaagattgtatgggcacgggaaaaactaaaattgtatgctacttacacttggaagttacatacgacttgcacttgaattacatttgtaattatatctaagttaatataattacaacataattatactataattacattt

SEQ ID NO: 104759 - DNA, 689 bp, Oryza sativa
attcctgcagcccatgagacattctaatactacgaaactggacaaagagtatgtccaaaattgtaagactataatgtgtcacattctttcaaaatcctttttattacgggacggatagagtacaatcctgccgcagttagcagtagaagttgccataaaagagtctttgttgtactattgtctggagtgaaaataagccccttttcaaattagaagtgccttagaatttaagactcgtgtacgctctacgcggttcctacatactttatcgaacgtgagtgatggcagattgcagagcttgctcaatgctcggctagctcaaatatccgtcggtacagcccaagtaaccaacgtaaacagggaaaggaaattgtggcgtgaaccttatgatgctcggagctgaaagctcgggacgcttgcaaaataaggcgaatcaacgcatggtagctagtaggagattgcccgtgatgtccgggcggcccatgcccatgtgcagctaacatggcgtgggggcacgaaatggatggttaattagtcacttgatagactacttctttttgaaagattggcacgcatgttctctttgaaaggaacggattatgacgggaaagctaaccgcgattttgttttcttgtcctccaatacgtgatctttgaaacatcgatggttccgaattcatcacgctatca

SEQ ID NO: 104760 - DNA, 967 bp, Oryza sativa
caaatagatttttttgtggtcaccaaatagagtttttttttggtggtacgttggttagacttatttttactaccattgccgccgatgcctctatttttatgtatagcgattagaatagaaattccataataaattaatataagtcacatgaagttaattttacccaaaattagatctgaatcagtctagaacaattctcctgcacatagatgggacattatattaagccctgcaggaggaacatgtgccacctacatctacaaggcatgactaaacatgcatagcgcatatataattaacacggccatattggttattcgttgcagcaaaccggcgtgcaagccctgtaatatgaatatatatatccatgaaacaatattggcgtttaaggcgatcctggctcaagatgggataccatcgcaacatcatacatgattttatttctttttttatatatagaatatcatatgattttctttctctttttttagaatattgatattctcttttcaagaaaaaaaatactcatttctcttttaatacatgtgatcattaatcttatttaaaaaattatgatttgatttattattaaaagttctttaagcatgtcttatatttcttttatgtttctacaaaagttttcaacaagacaaatgattaaagatatgttaaaaagtcagttatgtcatatattaacttggtagatagcatggttttatttgtcgataaccaaaaacattatgatcttttcgaacgaattttcgatcaccatcacgaattcacgctggatcgaattctggtagctagagtgactatatatgcgaatataatgatatgaatttcttaactcagataacaatatcaaaaatcaggctgcctgcattatctcggtcatcgtcgaagcaactaaaaatgtgacccagtacggtattaatttggcgtacggccggcatatagcggggtgcag

SEQ ID NO: 104761 - DNA, 2904 bp, Oryza sativa
ttggtaagatgacttttgagacggcaaccaagtttattgtggaagcagcttctcatggagagtctgacacactggacggcccttcggcaagcgtctgtctggggaaacctgttaaggtggggacgggttcctttggcttgctgcagaatttttccctggagcaacctgttgcgatgtaagcatacatgtagcatcatcagcctgtttgctttactggattagtccaattttgatggaggctgccatagagcagtaggaatgtgttacatatacggtactttttgctagcaagtgcagcaagttatgtcagttctcagttgtgtttgtgtagcaggaaacgaacatgtgaacactgatactccctttggtagtagtatggacattagtctctgtgtagactgtgtggagtatcaggctggcagcagcagtagcagcatgatcttggtttctttgccattttagatgcatttcagcacccttgttttttctgcctttaaacccaaatccgatagccactttgccgttgctgtctgcatgaggttaagatggcagctgagggggaatatatctaggactccagctgcaatatcttttctataattgagtgtgcaagacagcatcctctgattcagggcctgtttagatccctggcaaaaaattttaccctgttatatcgaatgtttagacatatgtatagagtattaaatatatggaaaaaaactaattacacagattatgtataaattgcgagacgaatctttagtgtcccgcccagcggatccctcgatgcgacacgttgcgggctttctgtcctggcccatcccactttgggcttcacggaagctcccgctgccgatcacaatttcgttctctctaataaaaaaagcagaccacgagcatcgcaaatacacccgtttatcaattaatgctagctgctgcattgcttgcatcgcaaattcgcatagatggacggatgctgcattgcttgcatgggggtgaaaacgctaggaaacggtcgaaatttacgatacccaaaaagggtaatggtcagaaacaacggtactccttatacaaaaatgatgctcaggcgatcgagttcatcgcatatatccttccggactatcctttaaaaaacatccatctctatagtgaagaaaaaaataacttttatacatgtgttctacatacatatgagtagatggatctccttcttctcccttgtggttctctatctctgctctctttatggctgacgagctgtgccttttataggcggtagcggcgtatgcgagacccagcgccgccagcctctatacggttgcgtgatccgatatctccgcacagccgcgcgcgatggatatatactatccggcagtttgtttggatggatagagcttgaccgtgcttatcttctgatcggtttgttgcttcgatcaacttgtagatgggcatagccgcgtacacgtacgcactttttgaagtagttggtggtgcgtcaggatgccatcgacgttggtgatgaaagatggggtcgatgcaaccgttgaccttagtgaagtagacaaactcgtgccgggatgccgtcggcgccgtagtaggatgagggcgccaagttgccctcgatcttgccggagtagatgatgtcatgtcgagaagccatcgacaatgtagagggacggtgggattggtgtagacctagtttggatagagcaggtgatgaagtgccagaaaaccgtcggcgatgtagatgggagacaggttggttctgctgaagtaaatgatgacatgccgaaatgtcgtcagcgatgtaaatggaagacttggtgatgcggcctccaatctggttgaagtagatgatgtcatgccggaatgacgtcgacagtgtaaattgggtatgggtggcattgcccccaatcacgttgaagcagatgatgaagtgtcgtgaagccattgatggtgtagacggaaaatgggtaggtgttactccctgtctttatgaggtaggtgacgtcacgtcaggatgtcgtcagtgttgtagacggaatattgggtggcgttgcccctaattttgtaagtgagtgctggtaagccattagcagtatagatgaaagatgtgattaatgttgcttcccgtcttgatgaggttggcaatatcatgccaaggtgcgtcggtgttgtagtacaacatgaatatggactattcggatttggagacagaggaattgaagtactaaattcacatggattggatgcgccaaccgttgtcgttcggttactgcagagcgagtaccctcgacgtcacacacacacacggcgacggacagcgacggcacggcgcgtaccgcccggtcggcagcggcgacggcggggcagagcgcggtggctgtcacggccggccggccatggacgcaacgcacgagatccgacagctatcatcagctgagctgagctagctagcctgtctgcaccaatgcacatgcaatcatatctcacccggccctggatcgttcgatcacattctccgattcgcaattttgcaatgaattaattgataatggatttcacgaacgtgcaaaagcaaaaggattgcacgtcaatatattagaagaaaaaaagttatagttacacaacgcaatcagctagaccgaccaatttatgctagagaagggaaaaagcttagaaaattacgacggctaaacataaactctaagtaatgggaagaataatcgataatggatggatataggtgtgaggatacgtacgggctggcgatcgatgcattatgccatcctttgctgctgctgatgctggcatgactccactgttgttcgccatgagaaagatctgtccttttgctaagtactaccacaactccatcgtatcattcaccagcaagggctgcag

SEQ ID NO: 104762 - DNA, 657 bp, Oryza sativa
ttggcattcaagatcaaggcaagcgagtagttccaactgtaaatgtctaggggtttttttgcccccattttcaccatgcgttgttcatatagcctcgccgagatctcgttatccttggaccctttagatttttttcccatgatcgaataggatatacgtgtgcatacacaccactacagacacataccacgtgcatactcataggagtgcattcttaatacgacacagacacatgcattattcaaaaaaatgcatggtagcatcaaattaattgatcttgatcttactaaatttttatcgaaggtagatccatgtatgtaatacttgtctgcataaggattttcatatcgatgtatgattgtttaaaatttgattaataatttttgcttcaaaattgcttcttattcagaacatgttctccgaaaatataaatgtatatctcgtgatattttgcccgagaccgcgaccatcagtgctctcctagctttttcccccaaaattaacgaccgagatattatatcgaacatatataatctgttccatacacgtgtgcatgacaacatggacccatctgtctgtgggactaccttgtgggctttaggcccagatgggggcccaagatgtcagccctagctatgggcttaggtaagctagcta

SEQ ID NO: 104763 - DNA, 755 bp, Oryza sativa
tcctgcagccccatgaataaattaaatttgtttgcgtgcttgcaatgcctgatatacatatatgcatctattaattgagttagatttattagttggcatacacctaattttctctccgcggttctttttgacgccgcatggcctttttgaaaaagctctatcacgctcatttggacaagtagtacaataattaagtaactgatctatatgtattatactgtaaacgcgttgattaatttccaaaaaatatctgcatgtacgtactgcatcatccagtactatatatatatacacgtatgtagtgaagtagtggacagcaaaaagttttaaatatatgatcgagttttcacataaataagttaaccaacttgtttctgtaggaagaaggggagaaaatactttcacatgtttcaccagctactgtaattaattactctgaagagagatgataagtaataagtagctagtgtttgctgtgaggtcctgttcaggatcgatgaagagagatgataagctgattagctggaactggaagactaatataaatgaatcaattaaatgttatatactacccccctccagtccttatttataccctgtcaccaatcactattcatatttaaactactttgaccatttatcctttttttttcaaaaattttctgaatacttaaatagatatcatcttatcaaattgtattacatactaatcataagaattaaaaattcattcatcacaatctaaccatttaaaa

SEQ ID NO: 104764 - DNA, 938 bp, Oryza sativa
cagcgttgcactaatctgaattcaagtcaacattgcactaaaaaacggttttgctggctctctgccaggtatatcaatgttaaacatttttttgaaggaaaaacagaatgattgtgccttttcattaaatataacgggagaaaaatacaaccctaggataagagaaaaactctattacaatgttgcacaatttaattcaaacatcgcactaaacaatggctttgctggctctctaccaggtatatcaatagtctgacaggaggggtcaaacatttttttaaggataaacagaaagactatgccttttcattaaatataataagaaaggaaaaactctataccctatacccctatatagtagtgtgaggcaaaaagttcacgtaagcagaaatatgtttcaaaaaatattttaagcagaaaaccatctcttcaaattcaggtagaaagttggagcttctgtttaaaaagtttggagttaacattctgatgctcttctaaagaactggagagaactggtaaattcaagtaaagaactggagagaacattgaaaaaaatttctccagcactaccctgcattcataatcagccctccgtaaagctgggccaagtgtcctcaaattttcaattccactattactccctccattaaaaaaatgtaaggtatattttttgttgtcaccaacaccaaataggaattaactcttccctatgcaataaactaagaaactatatgtatcatagcaactaatgagtattaaaataactgcttggcttccaatcaacagttaatttaatatatggagactaaaaaaattcccaactcttttgaaaaaaaactcaaaaaatgaaatatactcaacacttttgcatggagggatcaataaaccacaagtccacactgctagccctcagaacatgagcctatccacaagacgta

SEQ ID NO: 104765 - DNA, 2302 bp, Oryza sativa
aggaagccgacgcgcgtagctcctcccccgcccgccaccacccgcgcccatcgcatccagctcatctccgtcggctgccgcccgtcttcgccggcggcgtggagcggggcgatggctggcgtagcacgcaggccgccgagtaggtgattcgcggatccggcgccgcggagcggggcagtggcggacgacgacgacgacgatggtgacgagtttgaggaggaggaggacgcgcgcagctcctcccctgcctctactataactcattgttctccgaactcgccaaaggccctaggttcgaatccattgccgcccgccgctcgtgcgcagctcctccccctgcgcgagcacggccggcggccagcggagagcgacatgtgggcccaatggcatttttgacatttcacgcgatttctctctcctcttcaaccggaaattattattttaatcggcgcggtgtccataggcaaattaccacgtttatggagtgtttttcccaaaagtgagtttgggtagtgtcctaaagctaaaaccacatataaggagtgtcctgtagcaaaatttccctatactttatcattttgaaaaacatgtactaatagaaaccgacatagaaactatggccaaaggcctgtttagttggtgaaataaaattttttgggtatcacatcggacgtttaactggatgccagaaggggttttcggacaggaatgaaaaaactaatttcataactcacttggaaactgcgagacgaatcttttgagcctaattaatctgtcgttagcacatgtaggttactgtagcacttatagctaatcatggactaattatgctcaaaagattcgtcttacgatttacatacaaactgtgcaattagtttttctttttatctatatttaatgctccatgcatatgtccaaagattcgatgtgatgtttttgggaaaagttttttgggtaactaaacttctcaacccaatgattaggatggtgtccatagcattaaataagctgccacctagaattaaaaataatgtggcaagtgaataaatgaggaaagagaaaaaaaccatgtcttgcatgagacatagtttctacacaacattcaagacatcatgtgagataagtagcattaaatttaattatagaatattggtatttgcattttagaagagtagtgtctagtactagtttcttgaggccatccccaacctagaaactatctagtagtttccatacttgacatgtcatatagacaccatgcgtagaaaatatgtttttaatggatggtgtcttcaaattaagttctcatccaatcccctctcttctctctccttttatccacctatccccttaattttattcttggttcttgtgtagaaatggtttcttgcatgagaaatggtttcttcatatttttacctctctcatcattaactcttttgccatatagaatttttgcttatgtgtcaatgtatttaatgctatggaaaatagatgacatggagggttgagaatggcctaataatgtggagtttatggaaactatgtttagtgtcttggtttgggaatggcctaaacagcccgtaaattagaaaccggtgcctatgaactgtgagatttcagtactgcatgatcccagtacattgaccagctgaatttgcgtactactactgtcaatctgccgtagcagtggtttttaactgcgacgaacttgccaaatcagccaatcagtatttgttgcgagtttgtgaattgttagtttgtgactcatgacggcggcagctgttgcacagctcagaaacgcgtccagtggcacgaacaatacataccgtcagatcggtagtactacgggttattaagctggctgacgccttggagcctggaacatcgaccagctgtgttgcatggaccagccgcgcagtcaaagcctcaaaggcttctgattgaaccaaatatgtaaaacgaggaggcgctcgtacgatggtggccaagtaatgcgtgcccacgaccacgctgccggccgcgaagaagacgagtcgacgacgtgacatcgcctcctctttcgtactctgaggttcagacatggaccggtacattctgtgtaggcaattgcctgaagtctgaacaattctgcttaagaaagaaaatgaattagtgcctaaagaccaaccaacggttgccacaaatttctttcacatcacaattcacaagcagaagtgcaggacaccctcaacttctgcttgataaaacaagtcttcgtttaatttcaacagcgagtaatgcagacaacaggcagaacgaa

SEQ ID NO: 104766 - DNA, 677 bp, Oryza sativa
ggtgttaatgcaaataataggagtttgtctaacaagtttagcaaaattttaatttattagtgtacaatcgacatgcaagatttacaaacattttcaataacctccaaacataggttcaaagtgatcaaaagagatagggaggtgggacttgccttgtaactagaaaatgtcagcacctaaatcatttcttcaccgtttaagcaatcatctatacaaagtacacgttatgcaattaaacaccgaaatatgcgaaaaatccaaaatgctctaaaatgcatgatttgtgcacagtgggttggtattggtataagatgaatttaggtgaaagaattttttgttttatctctttttatttgagagttatgaattttagaagtttgcttggtatagggtagtgcctaagtattataaaatatttttgcaaagtgacttttattagatttgacttctcaggagtatagagatgtttttttctaagactaacacatttggtttcacaatttttggagttaatatgaattctttatgcattttacaagttataacgtgttgtaggtgtatattgtagtcaagacgagtgaagtgacaaggagccaagagataggatagcgtgctcgagttctagcacaagtgtttgactcgggcaatcaaagttgagggaaagtaccattgagcaa

SEQ ID NO: 104767 - DNA, 714 bp, Oryza sativa
cctgcagccccggatgggaggaaaagaggggaggctgggagccggcggcggttggttttgatttttttttttttttggagtctctatgtgatacacggctgaaaaaaattgtagttacagcccaatttatagccatacgatgcgcgcacgtgtcgtcatcccactgctccgttgcctcttccacgcgccccttgcctttgttttgggtcggatcttgtttgcaggcctgtttgtcatcttcagaaaagcccagcaaaacaacacgctctatccgaacaagtttattggatctgggcttcaagcccgtttgttgtcaaaaatagaaaacaaaacgtataagttcacttgacgtccctctatttgtcacccagtccgaaattcatccgtgtaccgtaaaaccggatacagcgcatcccctaacttacaaaacagtacaaacaagttccctcggtagtattatgccaggttatggctgacctggcacctacgtagctcctttgactaggtcttcgccctccgtcgcattgacatgacgcttacgtggcaatttgatcctggaaaaataattaaagccatgggaccaacatgtcagtttcacatgcaaaataataaaaaatagtggggcccatgtgaccccacatatcatccacactactcttgcttttaataatttaattaatttatcaatagaccatgccattaaaaacatatacc

SEQ ID NO: 104768 - DNA, 793 bp, Oryza sativa
ccaaagttgttaatgacgtcttgcctctctagagcctcaccttgttgcatcctgcacgcattgtgcgtatcaaattggacatctataatctcggtgtttggtagcctatcctgtacatgggtttgtacaattggatcgattacctcatacataaccactgcgtgttgggctatcggcaccggcacaccgccgtcctacagctagagtatatatgatactgacacatcacacaagcaaccgctcaatattgcatctaattataaacattttgttagaatgatgataaaataattctctctgaaaagagagaaacacctgtcaaaattagggtggaaaacaatcagataattgtcattgattaatatttgataatagtgtagaaagatgactttttatataggatcagagcctccaaaataataaccttatatcctattaggattgatatgtatgaatagtatatgtatacaaggatgtataaagataaatctagtcgactagaaaaaaaaaagaggaaattctgatgacagagtttgctagatgtaatcggcgaattggtcttcaagtaccgatctccttgattggataattcagatatggttttggtgtcattagtttgattatgggttcgattactcgatgtcctaactccctcttgggtgggggcggattcagaaatgatggggaggagggattcatctttttcttatgctttcggcccccctacttttctttccccttccttccctctctctctctatgaggatccaacggggtagggggcttgagcccc

SEQ ID NO: 104769 - DNA, 644 bp, Oryza sativa
aatttatcgatcaaagctcttatggctgagtttagttttaaattttttttcttcaaacttttaacttttccatcacatcaaaactgtactacacacataaactttcaacttttccgtcacatggttctaatttcaaccaaacttttaattttagcgtgaactaaacacaccctatatctaggtaggcaaggggaagcacgtaacaatacgatttacttgcacttttgctaaaaataatattacgccgctggacacgtactactatatgatcaagccacgagagacaatattccatccaagtttcatttatgaggatctatgtcgctacaaaactcaacttcttgtcttgtccgaggaagcaaaacagttcatgagcagcaggaatttttttttttgatagagcataacttcggatatgcacatgcatggacattggatatacacgcacgaatttccaggccctcgtcagctcaccgataggccatctcttcagcaactgtgtgaacctttttatgggattagagaatttcgttcaaatgtttatatgagtaaattaatggtcgtcttaattaatttctttatattctaaacgtacagatatgttcatattaattccgtctcaaaattgcaactcaaaaaatcag

SEQ ID NO: 104770 - DNA, 678 bp, Oryza sativa
aaaaaaaaagtatatctaatattgtttttattttttttaaaaaaaatagaatcttcactggcgggccatgtgtcggaacaaggacggtccatatcttcgctgtcgggccacgtgtccatctatagaagccttagttcatttttcctagcatgccacgtggcctaaaataatgtgagccgccagcaaagaactatcttcgctggcggccgacctaaggctaccgcaagcggagatatttctttgctggcggctgtgttatgtctgccgccagcaaagacatgtcttctttggcagcaatcctaaggctaccgccagcgaagacatgtctttgctggtggacgttcctttgtcagccgccagcgaagatgtattttggctggcggtaaataaccacgagcgaagatcgacattttcactggcctttgctttgtggcggctgcgatttccaccagcggaaacccaaaatggccgccacgaaagatggtttttgtagtagtggtatcagcaaacggatggccgctaaatccaccaagcagttggcgacgctgctaccagcttgtgataattagataaggtagagttaatattgatgtgacatatatacatcatcgagcgatgtaagtcaattagtgtctattcgcttaattggtgactcatcagagcctgttcataatgggt

SEQ ID NO: 104771 - DNA, 741 bp, Oryza sativa
ttcctgcagcccgttggctacttaacacacgttgaaaacggaacgtacgtggattaaaatctcaactcctccctaaaaaaaaataatctatgtttcacttttcaaattcaaagctacgtatgacactcaaccactaaatttataatcatacattatgaaaacttacaagcgtgtgatattatgaaattttttagccatgccatatctgaatatagtttggcagactatatatatttttaatcaatacaacttgactacatgtagtggcaagcttaaccatcatgaggaaaaaagttagataccacgaagaagccaaatatcaatactattgagagaaatatgaacttacttacaaatttaacgcagatagataggggattcgatggcggccctgacaactgggttagcccaactctataactaagttaagaattgagcttttaactgggtgtactaagtggttggagatgtatttttcatctttcatcatccttgaagataatcttgagctgaacaactataaagataaaaaaaatgactattaacatttaaaacaacagatgttacttgctagggtgataaaaactactaacctctgaactactatatttataaataaattaatggcaagacagaaggagccgccactcatctgtacttatacctacttcagaacggcatttttctttttgattttgccgcccctttacgggaagtaatactattgcaaatccgacatac

SEQ ID NO: 104772 - DNA, 833 bp, Oryza sativa
ttcctgcagccccatttgtgcagtctctcatattgtacttgagctagtttttacccgatctacttgcatgcttaattgatttagttggtgaccttatatcttgtttagatgccttatttgtcaccttttgatttatatacattttgtttatttgagctagaagttcatagctagtgttttcttccattatccgccgaacttttcggttgagaccggaacttccaatctcatattggaagttcctatttgaaccgaaagttctcatcattctaatatgctatgaagttgtgataacttttaggaacgcctattcatccccctctaggcgacattaaggtcctttcacattcctttccacccactcctcacccttcggctgctcttgctcccctaccttcatcctcgctctggtgcctccccttgtcccccttcctcttctcgctggtggcacttgatgcctaggctgaagttcgagaaggagctcaaggctcgagcttgacatctgggagctaccaagtgggggtggagcaactacttagtgctggcaagagagtcgaggaagcagtggagggtggagcactactaccatgggtagtgctcccatgcgccattgtcagtgttcactaattgaggtgccggtgcaagccaaaatttgctggggtagtagggcagttcaagtcaggccactctgactgccctcaccaccctccatggaggatgtacccccaagcttagttgccatctccgcttctgttgtgagttcctcacctccgcctggttcccttctactgattggaatgaggagagaagatcacgatacagagaaaggagat

SEQ ID NO: 104773 - DNA, 632 bp, Oryza sativa
atgggtggggtgttcgcggtgttttgcagaagaagacgcggaggggatcaacaacaagctgcagctggtgatgaagagcggcaagtacaccctcggctacaagaccgtcctcaagaccctccgcaactccaaaggtagcttttgattcgtttcctagtcaccgctctagcttcattcgttcatcagtcaagcctggtacatatagtgtgataaatctaaatcatttggaattgggggtggggtggggggctgtaaattttcggggaacacatcttattatgttatattccagagtatagcatggatcttgggcagttttgccatgacagaaagttgccctctgtcgtttggatgttgtcatttttactcatgtggatgtcagaatgggactggagtttggctcttcggcttgccctttttgtgtcttagagatgaatgcagcgcccaacaacaattcatctttccttgctggtgttctccttgatcaagtctaggggactaagtgagattgaaacatttactgcgtcactgactcaccgttgcttgtatgcgcatcactagttgtttctactataacttacaataatgtaaatgtcctcagttgagagaacttttgtcagccgtatagtaat

SEQ ID NO: 104774 - DNA, 748 bp, Oryza sativa
atcgtcatatgaaaaatctcttgactttctatagatgatgaggagatgacgagcagaccggtgagcgacctggaaaaatcccttcgcatgtttgtcttggagaacgaattggtaatgcccgcagaagtctgcgtgaagctagccaacttgtatgccatgctgaaacagtgggaaaaggttagggagtacagacaaaaagcggcagaattccacgcaaagacgagtgatgcgttgttcgacacttccactgtttagtactacctcttttaatgtatgacaccgttaactttttattcaacgtttgaccatacatctcatttaaaaaattcatgcaattatcatttattttattatgatttaattcgtcattaaatgttctttaaacacgacataaatatttttatatttacacaaaatttttgaataaaacgaatggtcaaacgttggtcgaaaagtcaacggcgtcatacattaaaatacggagggagtatatctgtatatgtaggatgttgactgtcaaattgtgagatgccaagatgatcaatatatatatatttttgaaatctagccagccgagctggtttatattcagaaggaaaacactgtacagaggtcacatatatcccatacatcggattccagagttgcactgttccagagatggcgttgttcgagcatatatcccatacatcgtaatcacacggggtttgctcgagctgctgcgccctcaagaagacgggctgcagga

SEQ ID NO: 104775 - DNA, 677 bp, Oryza sativa
ttgtcaagattttataagtgaacaggatcaatggcttaggttgctttcctttgaatgtagatgcgcgtgctggcatgatatttagaaaataggttttcccttgaatgcacattctattagttaatttaaatgaacaaaatctttatgcattttttcattactttcgagagaagaggacactgtaacaaaggccaatatagaggtaactttctgattgttatatacatggtaatcctggcggcggctatcctacccacgacgaggctacccaggtttttgcttgactccctgattgattcaggttcttgttgccaaaccattctccttcggggtatcagggctactccagcgaggagcagcagccaccttactactaccttgccgtcgcacaatttctgttcatctttttactggaagttatgctaattgactaaaactgtgatggtactacacattgacttgacaattgacatatgtattgcctacaatgagggttctgtagtaggtgcttgatggaataccccagtgaggaaatttgtttttgttctgtaccagagaaaaggtagcgaggagatctgtgagtgaaaaaaaaataacagttcaatgtccaggccacccctttatatttaccagttgtaacttcctcttttgattgcattcagttgactctgcaaagt

SEQ ID NO: 104776 - DNA, 672 bp, Oryza sativa
tatcttcatccagaaaggaaaacatatattatcgtgcaaacatctgatcatctactagacagatcatagatacttgaattagagggcacagacggctcttcaaggatcgaaaaagatgaatgtgtcaaatcacctatgctaaaataaagctcaattaaggaggggccaaagtacaggcaagacaaaaaaaacatgtactgcaaatggctaactgaaacttgccactttcaagagcaagtgcagcaacagaaaaactttcgattgcaagtgcagcaacagaaaactaataatcctcatgtacaactaatctgcgtgcattatcctgaagatgaacatggagctggcaaatgcaggctcatgcagttattgtagatatgaaagatgcagatgccatctcgctgtcaaacaaagctgatcctgcagtatccagttcctcttctttctagccaaggcttattaaatgaggtgcatccagaagttagtagcttgagttgatgatttttccggtggggttggctgacatctcagccatgtacaagcacttcttccctcatcaatgtttctgaagaattgatcagatccagcaaccagcatggtaagcatcatgtcatcagagccagggaaactactgctccctccgtcccataatataagggaatttgagtttttgct

SEQ ID NO: 104777 - DNA, 648 bp, Oryza sativa
tttgaaatgagcccataatgacaaggaagaccattctaagcatggctaagctttatagtaacctagtgtcaccaaaactcatatataaagtggtatagccatattgttcctaaggttaggaatgaggaatatggatatatgtggagttaaggtgataatgcaaataataggagtttatctaacaagtttaacaaaattttaatttattagtgtacaatcgacatgcaagatttgcaaacattttcaataacctccaaaagataggttcaaagtgatcaaagagagggagatgggacttgccttgaatcaggaaaatgtcagcacctaaatcacttcttcaccgattaagcaatcatctatacaaagtacacgttatgcaattaaacaccgaaatatgcgaaaaatccaaaatgttctaaaatgcgtgatttgtgcacagagaataggtactggtataaaatgaatttaggtgaaagaatttctattttatctcattttatttgggagttatgaattttagaagtttcgtcggtatagtgtaggatttacttagttactattgtgaaatgctgttgtaaggtgattcttattaagtttatgtttgctggggtgaatatatttgttttctaagactaacacatttggttt

SEQ ID NO: 104778 - DNA, 1361 bp, Oryza sativa
agaaatgaaaaatctgttggaaataatgcatacttagccattaattttattccaagcattattatttgaaagcatatacagcaagcataacctacttgcgacatgataggacaagaaaaactcataaattctatcatgctagatatcaaacaaggcataaataaccaagccaagtaggtcattaggctaatcacaatgctaatctagccgcaatattttaatctagatgaacagtaccatgcatataaaaaactcaggtacgaacaaaactagattagaaatgcaccggttcctttcctttgtaaacgaaagaattcactcactgaatggatcgacggagatcagcgagttgaagcagtgcagtcaatcgatgatgtcgagcggccgcgtagaaatacgctgcccagaaacctttacaccgcccccgtgcaggtgcgaatgcggcgaaggctcggagacaccgctcgccggaatgctcgttgcacgacgagcaccacggccggcttggatcgacggcgacgcaacacgacggcagtttaggaatttcagagtagatggctattgtgttctgtgtccttcaaagacgtctccttgactcctatatagagctaacactgaacggcagcccacgctcaatccgttgctcctccgcgtcaaagccggatcggctccgtgagaaacgcagccgccaaacggccacaagcgcacgttctctcttcacgtgagaaccaagtcttcaggtgattgactcgatcagcagaggttgttttatgcaagcatcttgtcatccaacacatgctgatcgtgcggctaagcattaggcatttaaattgatgaaatgatcaatgtttccaagcatgttatttccatcaaaatcaacaaccatttttacacaaagtgatgaaaacagtgatgataaaatggagtcaatgaagaatcattagcaaccattatcgttttgagaatatatatagcaaattaatatgaggatctagtgaatttgattatatatttgatggtctgattcggacaggaaatctgtagtaacaatactctttcaagtttcttcttcatgttgataaactttgacatgtcaagtttagtgattaagtaaacacataaatacttgctacattcaagaatgaaccacatgttacccaagaatatgctgagagcgctcaaaatatggtttatctgcctcaccaaaaaacatatagagatgagagcaatgtaattttgaaaacatgtgcatgatacaaactaatagaaacaggaaaaattacataccgtacatgaaaaatccttgtgtccaactcaagcaaaaaaattctatgcagatcttgtagtgaaaagataattgt

SEQ ID NO: 104779 - DNA, 2190 bp, Oryza sativa
ctcgctcaacctcacatgtgcccatagccatagagctctgctattgctacgatcggtatatatatttttattcacacatggttgtaatcaagatgctagtttgatgtgtctaatccataaatcatcgtcgagctttgcatggttagcaaattgcctgttgccggcccacatgcatgctgttggttgccacttgtgcttcacttggtggattttcatggtgtttgtccgattttgaaaaaaaaaaacttatcttttggtttaatgtctcgagtgatttttttaaaagtcggaacacgatcttaaattgatatatgatgacacaatcttaaatttattgtcatttttttataagttttgatgtccgattggatgacatgcaaattgccaaatacatcaaatatatttttctacttttttaggatatatctttctacaagttaaaattgtacgtgtaaactttgtcttaattttctgtactactttgaaaagagtagtagtggtggcagcgaatcatccaccccacctatttccattgtaatttaacaatttatcccattaacttctctgtattaaaaatcaattaaatctaaatggatagccacatataaagttaaattaaggtgaatattccttatagcaaaatgatagataacacgtttcatggagaatatatcttttatttattttgaatattattattatatttcttttaccctagcaaagattcagctagtctattatatttataaatgctagtgaagtggtatatgatgaaataatatatagtatctcaaatgttcgaatgacttgcaaaggttctcaataaaaatttaaagaatatacatttttacaagtgaaacaatagtcaacacgtgtcttaaattcaagttgtgattttaatcataaataacacaaaaggtgcaaatagataaaaaaaattgaatgtataatttaaaaattaaaagttataattatttaattttattgttacaaataatatataatctaaagttattgtatttaaaatttttcgttggaaatatttccgtaatgaagggaaaaatttaagaaaaataaacggagaagacgttcgtaagtgactggatcctctcgtacgggtatggcatgtctcctttgtttttaatctaactagctaggtggcccgcgtaattacgcggctagcatcatacaaaattttttaattttttttacacgtggttttctttaaaatttgttaaatagtcatctcgttggcttaggattttgatagactgaaccttatcatcattgggtttttaattttatagtttttaaaattcatactagccgttacctcttactccttttctatcgctttgtttgcttccacggtccgccacgatttctacttatgcaccatgaactttaaagatcttatagctttaaagttcagtgtcacatcatttttatttttatattttttagaagtactatcaaacgtcgccactgtactcctttacaatccgcccgctgtacccctctttagtgttattttgatttgaaaaatcaaacttgatcaagtttggtttcttttttttttactttctggaagtcccgtcaataactgcgacccaacttctttatggtctacccgccacccctcctcttaattgtcattggtattccaaaaatcaaacctaaccattattcgggtgttattctatagttttaatgtcacatcaaccatcatcaccatactcctttatggctcacccttgtgccccctctctttagtatcatttgtgactattgtattctagatagattgttcttttaatattccttatagtttatttcgaattttttatttctaaattgtattcctacttttaactctttttataatttcaaaatttatttttatttttattccgtattttgattaatgttgtattgtgtttaacctagactgttctttcattattcctaatttttttattcccgcacaattgcacggctagtatccatacaaaattatatatttttataatgattatctttaaaatttgttaaattcttattgtcttaaaaaccttatcatcatcaggtttgccgtccctttgtttacttgcttgacctactatggttctatttatccttcttggaacctcaaaagttttttttttcgaattttagcatttccacgtgtat

SEQ ID NO: 104780 - DNA, 585 bp, Oryza sativa
gtaattaaaatagggatttcttaatatgtattgctctttggatgatttcagtatttcaacgagttcttaatagacctttttttttcatctgtgcatgcaagaggatgcaacctacttgggatggtggcacctctagccataggtttggaggagggcaacaagcagatgcaccaaagggagctcaaatatgaggaattatgtggcaaaaatagcttgctgaagaggaatcttggtaagatatgacataagttcagaaagttaatcactgctgcaaccatctctggtgagtctttttgagaaagaccacataggaaagggacgagatgagcacttctagctacagatgcttaggcaaagttgggattccatacaaaggaaatgtatttaactttgtatgaattgtacatatgcactaaaaacatataaatctgctctcttatgtgtggcttcccaagtttgataaactagccgtcaacccgtgccttgcacgggttattggtattggtagtataaagatcaaaattttaaccatacgttcactaggttggccatattcgaattgtagcatgttagattgaaataagg

SEQ ID NO: 104781 - DNA, 708 bp, Oryza sativa
agttaaaggggtttgtcatattacctatcatctttttttatatgtcgaataaatttatgaatgtgtatcttagatagaaatcggagatgtaaaccatttctgagaatcaagggaactgtataattaaagcaaacattattattcgtacccactttatgcgtgatgcactgggagcaatgttctaaatctctggagagagtggatggggaggagaatagctaggatataccaattttgacgctacgatttatcggccgctaatagctacacttagctggagatagccgctataatagccgaagatagctgcacttagcggcagaaaaactgaaaaatagactcgcaaagttcagcctaaaaggccacaagcccagcccaaaactaaaccataaatcccccactccccatccatactcgtgttctcttctcccctagtccccgactcgcttccccagagtagcggtggcagtctttttggttgcgagatataaaagttgaatttaaacttgtatatttgtagagcgatatatcacatgttaatacatcttctcaatttttttaaatctttttcataactatttgagtgacatgtaaataacgaggggatatccccttgagggatcagaatagtttccgcactcactagcttttagccctaatatgctactgcactcaaggaccaaactacattcgtggggctgcaggaat

SEQ ID NO: 104782 - DNA, 979 bp, Oryza sativa
ataacataaatcaaaattttctatcgcgtaaactaggaaccatgcaagtattagatcatagatcgttaccactcgacgcgctgcgcagcggaagaagacgttgagaagtcaaaggaactctcgcgaagtagcgcgcgtcgatgtagatgaagtagtcgatctcaccggctcaaccttctcctcctcgtgcgttctcctcgccgtactcccacgccgattagcaccgcaaaccagtggcgcctctaccggtatccacacgtacagggacggaacgccacgcacagatgtgctagcacccgcgcgtggctagggttttgctcgggagggaagtgacggctagggtttctcacatgatgcaatgcctccgccggtcacacccctcacgaatatataggatccatcactcgggcctccaaggcccgtaggactcctatttggatccctatccgaattaagctcatattggatctctatccaatctccttattccgacccattaagcgtgcgaccctgtaggttcatatatactcagctgtaacccgaaaactccttttcggtccacgcatcaacagcggtccctagcagaacgtattgacccaccgggcatacataaagatcatatcggctaaacctctagtgtatacttgtatgaactcctttgcctcacgatatcgattaagctcaaggctagatatgtgccatcctctaatagctcaatcattcactcgaacctgttgatagattatataacttgtgattgactcctcaatcacctttgacatggccatgcacttccataatctacaacatcgaggggcccagagatatctctccataggaggggcaaatcccattttgattattcatatcccactacatgtttcatagcatacccgaaaactacttttataactacccaattacggagtagcgtttagcagtccctaagtaagctactacatatgttgagaaccatgat

SEQ ID NO: 104783 - DNA, 1113 bp, Oryza sativa
atgacgtattgtaaggacctagccgatgcaacctggatcgagtcggctgtaaagtataggataaacaaaggtacgtaatcctaaaacatgttgcatcggctgtagataaaaaagggaggggcggctagggcttcgccccgagctaccggcgcgtgggcgacgcgaagtgcttaagcagactatagcaccaagcaattaatcaagatctgtccggtaagtaacaaataattcctgtaccatactcggatactagggtacaagagttgtatccaaatacatacatacatacatacatacgtgtacaattatcgtatccgagtataaccagacgatacgtgctaggggatcagtatataccccaccgagcgcgagaaagctaatggacgatcgatcgcccagagcgatcacccctctactcctcacgtagttttctttttttggcaccgtattacttttctattttagtaaatttatgcacctaaagtttgtacacttcaagtttacacatctaaagtttatacacctaaagtttatagacccaaagtttataagtcaaaaatttatatacccctcaagtatttgaattcaaatttgaatttaaattcaaatattttttatatataatacccctcaagtttacacatgtaaagtttatacacctataatttatagacccaaagtatataaatcaaaagtttatatgccctattcaaatttgaatttgaattcaaatattttttatatatagtatttctatacataaatttttttctaactcgttttttttaaaaaatttatggtgtagtatgaagagaagaagggaggagaaagaggagaggagtgtgtaaggggagggatggggggtgatcgctcacccgcccattagcgccccccgaaggcggcgtgggtggtggggacgacgggcatcgtgctggcggtgccgctcatctggatcatggaccgggagcagatgcaggttgagtacgagtccgtcctcgaggccgagcagcggacgctcctcggcctctgatcctagctcggttcacgggtaacccctcctcgccatcagcgacagcggtagcatcgtggatctaggtttttaatcttgctttt

SEQ ID NO: 104784 - DNA, 1118 bp, Oryza sativa
tccatctcagcctcaccaaccttagtatgcaccttaccccattccaccattcgccttaattcagcagcagacggaaacatggtgcggaaagtatcatcaccattgtcatgaacaacccacctccatctaccaggaattaacctttccaactcaactataacatcatttacagaaagcttaccctttgataccttaatcaaagctgccctaggctcatgtttaattttgtgaccagctgagagaggaatatgaaaaaaaacccagaccatcagcagcataaccacataactgagcagtaggtttaactgtagatctaaaagttgggcaacggatagcaacatgatccacactttcacaaatttcacagtaaaacttagaagaacaatcctgcatcgtatgcccctttgtaagacatctaaagcaataaggtttacctgatcctttactttctacctttgacttgcctttgccaacatcaaccaaacaagctgccatctcatgttgaaccggctcaccatgaacctgagactccttgccacctccacataccgaagcggaaggagcaagagcaaaagcaccaaaagctcctccactaggtacagaacccccagcaggaccaccagcagtaggaccactagaaatattggagaccattgcccccgaacctctagtctgaatcccacctccatccacctttaacctatcctattgggtgtttcctttacttgaatcagcaattttcattaacgaaacagtctccgatgcaacagccgatgtagcagccaacacaccaccagttagcaaaagatcacctgccccaactgacccggcaccaggagtagcatcattcgtcgggaagccagcctgcaacccaccacctggcacaccaccggtcagcaaagcaccagactgcaaaccaccggcagccatctgcaatctaccacccggcgcaccactagtcggcacagcgccagccggcaaaaccccagtcagcacaccaccaccagccatctgcaatccaccacctggcgcaacaccagtcagcaaagcgccagccggcaacacacctccgccagcagccgggaaaacaggagcagacatccctggtaccgcaccaa

SEQ ID NO: 104785 - DNA, 697 bp, Oryza sativa
aaatgctattgagctacagtactctggaaaaagttttcatatgtgcagaggatatcagatccaaacgcattctctccctactttgtacaagaaaacatatactccctccgtattttaacgtatgacgccgttgactttttaaccaacgtttgaccactcgtcttattcaaaaattttatgcaaatataaaaatacttatgtcatgcttaaagaacatttgatgataaatcaagtcacaataaaataaattataattacataaattttttgaataagatggaaggtcaaatgtttatcaaaaagtcaacaacgtcgtatattaaaatacggagggagtatgaaagtgagacttgtctctcaatccaaccaagaagcgataggttggactaactctcgtcctcaaacaaggagcaagtacaggtaacataagttatacataagaatctatactaaactgtataaatattttcccttgctttgacaaacttgctgtatcagatattcagatatcagcatggagaattcctcaggttcggggaaggtggctctccagctcttagtgttcctccgagctccgtcggcactagaggaacaagagagtggagcacatctgtgatcagtggcctgtagcttggttcagcctgcacgcatagaacagccactgctgcaacctgcacatggtatgggaatatgtatt

SEQ ID NO: 104786 - DNA, 1963 bp, Oryza sativa
gagtaagcagcatcctaattcctgaagtatgtctccacaactacaaaactttgccatcatgcagtattaacaattaagctagatgttgcttcggtgacagcgcaagtaggttgaatatttatgaggaagatttggacttggaaagtaacttcaataataaggctatgtctagttcccaactttttcttcaaacttctaacttttccatcacatcaaaacttttttacacatataaaacttccaacttttccatcacatcgtttcaattttaatcaaattttcaattttagcgtgaactaaacacaccctataaggctataactctaattatcattcatatgttcaaattgtcaaggaaaatgacactaaatcgaatgttttacctgcttgacgatcggtgagagtattcaacctataagcctgaagcctgaagaagataagcagacctttttttttttttggcggggaagataagcacaatactgcagtgaatttacaaccgagatgtatcaaggaaacaaaactgaatgcaagagaaattgattttatcctaaggggggtttgagccacatgcaaagacagtggatcaaattcaagttgcaattgattgggccagcatgggcctaaatggctagtgagagctatatcaaattggattggatttttctccagtagtattcagtagtctgccctcagcttatatacttcctgatttgggcattctgtgttcttagagatggcattgtatgggccaaaacctttccttgtggctgcatcaagcacgcccattattccctttcaacctaccatttcattttgtcatatgtaattagctaattatgtagtaccgaaggtgtttaaaaggcattactaattcctgcaaacctgttcgagtgaagcaacgaagaacttaggactagaccacgttatttgcatttactgcgttatactgatgaagaggaaatttcagagaaacatagactaatatgcagggaaaaatgagtgtctaatctgaaactctgaatcccagcacatgtaaaatctcgtctctgaaactctgatgaataggagtttattacagtttcgaattcatccttcatatgctcttgtttcttacctcgtctatgaaactcaattacatcgtgtttgcaacaattctactctatctgcaattcattaaaatccaagaagatcagaggagcctgagctatcaatcccaatagactaccctaaaccaaatttgtctacggattaattgacccaagttggtcatgaaagtttcctattgttagccagccaggcaggcagtctacgcaagtagcaccaagacgtcaaggtcacctatttatacaattgtatagaaacaaaacatcaaattcttcaatttgattcttcagagaaaggttgatggggacaccatttgatattgacaaggctggggactcgtaaaatgtcatttagctgaccttgactcgcatcgttttgatccgaggaccaatgtgttacttttagtaaatcacttaaatgaatgttcatctcccttctcccactcatgcattaacctataccattatgttatttcggtgaagtctatttcggtggtattggtgttttggttgcaattggtgtttttctggtgtttagtgtacctataacgattgatctatgatgatgttttcagtgtgaaccgtttttttagatcgatgtgtatctcttctttatcaatgaaatgggacacagcttctgcctttggttttttgtttttctgctctttttttaaaaaaaacactaagtctatcgaaacatttgtcttttgcaaatctgcttcactctgtactgggcatttgatcttatattcatgatggtatatccaatcaaccggtaccatctcaatttatagaagtgcaagttttgcatgagaacaaaaaaaaactagaatattagggaaggacataatatcaaa

SEQ ID NO: 104787 - DNA, 679 bp, Oryza sativa
cactggctggcaccgcccttcccaacctcggcgccagggtggttggcgccgccctctgcctccctgcaaattgaagatccatattgcacaaatgtaccaattcacagttcgcaattcaaatcacaattcacagattcgtacagactaaaacaggttccaattgcacaaatcacaatgccaaaagtccatcacatagtcctcagatagtccatcacatattccacacatcaaacaatgccaaaagtccatcacatatcccacacatcaaacaatgcaaaaagtccatcctatattccacacatgaaacaatgtcaaaagtccatcacatagtcctcacatagtccatcacattttatatcacatagtgcaccacatatgtcatactaccaaccaatagattaacttcatacaaattacttcttccgttgcagccgaattgcttgcgagcccggagtgtacctacatttgaaaatccaatgtttaaaacattttaaaaacaaaataagggaaatcaaataacatttgagaatggtaagctcattttacctctttttcgctgcccgagtggatcacaagttgtattgcgtgggttgcgtcccctgaggcgcgtcgggaagctgtgacatgtctatctcctcggcgtctggtgcgacgtagtcctcatcctcctcgtcctcat

SEQ ID NO: 104788 - DNA, 695 bp, Oryza sativa
aaacagcaaataggtgtcgacgctgtagataccggaagtgctaaaaccggcacctataggtcttttttcacctccacggattgaaaacaaagaaaaatcggcacctttaagtgattataggtacattaggtgtcatttttcaaaaaaaaacaacaccttaaattatttataggagtcgaattttttaatgaaccgacacctataataaattaaaggtgacacattttaaaaaccgagccgagccgaggagcggataagaccgagtgagcggtcgacagcgctgaatgagcggacaactctctctctctctctatctctctctctctctcgctctcatcagcgcggctcccatgggtggcggtggcgccctcctctctaccagatccagccgggggggaggaggcggcgactgcggcggcgggaggcgccctcccctccgccagatcttgccgggaggggagtcggcaacagcaggaggtgctgtgacggcccgacagcggcctccccacccagtggtggtggcggcccgacagcagaggcggctaaggtggcccttgaagaagttattcatgttgtgttccccttgaaggaggtgttcatgttgtgttcttgtgctcggttgtaaggggttgaacgggagaagggaattgcttattcgagccgatgcattgagccggtatttttttttttttgcg

SEQ ID NO: 104789 - DNA, 705 bp, Oryza sativa
atataatgaaataaaatgaggtatctaacttagtgatagggattattacctagtgttggtgaaatatgtgtatgcaggtattttatggatgaaaaccacccgtcatgcgacaaaatacacctccggacaatcaggacaattttaggcggattggagggtccatatgtcaatcaaaaccaattagaattaagccaaatcaaagtacatgatgttgggggcccattaagcaacctcctagtcgaagaagaggccggaaggtgggcttttgggttcggccgaaccaccagttcggccaaacccttcctagcacctcccaccatctgcttcctcatgtacctgcctgattactcctcaatgacggttggagggcatttaggacatttctcatagctgtaaccgtcatatagagcctataaaaagagaagctcatcttacttccatcacacacaactttgagctgaatcacaggaggctcttattttatatttttttgactgagagaacccaagtagaaaagatgtgtttgtcctcggtccagcaacatgtagccttcgctaggtctggttcaaacaggaatgaagcctcactctcttcctacactacagtgcacttcgaaccagaccttaccgggatatatgccacttgtttgaggggtaaactaatcatttctaattgtttctatctcttaataataaaataatggcc

SEQ ID NO: 104790 - DNA, 605 bp, Oryza sativa
aaaataagttttcaaaaaggacccaattataaaaatttgaggtccaccgggtgtcatggcgctgccgtacgccgaagggccaccgtcgtctgcctcccgtcgtggtgccgccatctgacgcagccccttcaccggcagccgggcgccagagctccgcaaccaggcaagcgcagccgcacatccctcactgcctagtacttttcgttcttctactccgctccactctctttccaatccaggcttatctaaaatttgttcccctttgttattttcttggtacaagactactagtgccatatcttgttagatgcgatgtattttgatggatgcttgagtggtaatgcatctagatatccagcaactagcagttctaatggttgtatggctgctaatgcggctgggcattggaggagatagctttgagttgtttcatggttatgttggacgactgattttcttaagcaaactgaccttgagagagtccagaatatgttggtgtattggacccactatttttacacttatttaatttgctataccatgttccttataaaatgccgtatccctttatcgccgtatcacgtatccgtatccgtatctccgta

SEQ ID NO: 104791 - DNA, 503 bp, Oryza sativa
aactgtaaccaaataggactagtatattcgacacctattctaacataatatgttgatagcaatgtaaaaatggtttacctactttccagataatttcgtaaattcgcttaccaatagacaaaggttctgaaaaccaacagacacaaatcgattattgacatgtatacctatttttaagcatacaaaaatagctgcagtaatggttaatattgttttggctgactgcaaatattgttaagtgcatgatggactcacacctagttaagagtttgaatgctttgattacagtcaaaacggtaaaactagaagaaatgtaacataacttacaaagcttgggtgcagtctttttctggaaatgccaggttctacctagcacaacataatcaatgctaccaccaattccatgtgcttattgagtcacagcccctacccacatgatactgatctaatcaccaaaaagaacaggtcgaagcatgtacatgatgaaacggggctgcaggaat

SEQ ID NO: 104792 - DNA, 649 bp, Oryza sativa
aaaattccgatacgtcatccgtgtttgagttggttctatatcacggtatccatttcgacgtgactctagaacaactattatacacccccttcctagcccaacgcctccctctccctctccctctcctagtgcacccaacccagccagcccacaccatcccaccgccccatccagcgtgcctccactcagcgccacacgcccctcccctaatcagtgtctttttctctcttttttcccctatttctccttttctcttctcccgatcatcctgacctctccttccgtttccaatctcctccctttttcctccttttctcttttttttctgtttcaaatttctctactcacaaatatttttctattgaaattaccattaaggtgtgtatgtcgcaagtttgttattttgcaaatgcttttcatctacaagtaaaaaaaaactttcactacttgaataatcaaaacttcaatctttaataaatgacgtatagcagaatagacatgcatcaacttatggaatattcacccaatagatttgtgaggctatggaaatgtgtacataagggattcttcgtgtgatgacgtatgaagcgagcgcaaccgggttcaatactatatactctctccatccaaaagtctgagactattctat

SEQ ID NO: 104793 - DNA, 4889 bp, Oryza sativa
ttctctttcctgctgctttcatagtggtggtggtgcttgtgcttctcactctctctctgcccttctccatctgctactactactagtactgtcttttggttctagagagaggatttctctaacatatgctgctgctgttgctgttgtttagacggaggaatcagatggggatgaggtattgagatggagaggggaattcttggtttttttttctctttgatgtggagaaagtgttttcttcaaggtgcatatcattatctcatcatcctgtgggtcctaatggagccctctccctagcttgattgacatagcttgtttagagatttttttttctttcatttctttctcccttaccttgcaagacaatttttttggggggaggtggaggcatgtgtcaagattgtttggaaaattcaagctcattagctttgtggtttctagtgatcggggctgtccctttcatggcccaattattgtatcgtgttggcgacggtgacgagagaacttgaaccattagtccatccatagcaacgggagggaaaaaaataaatatgccacaaaggagacgtgttgtatgaacacgagctcgcatgcaccacaaacatttgtgtcgtggtgggaacattggtcgagttgtcgacaacggtgatggcgtgctacgttgttttctgcttgtttctggttgctttcgtgccaaatgtctagtttcttttttcaagttgttgggaaatcaaataatttgtgctgagattgaagtaaacaaattagcttgcaaccaacttgattgctacttaattttttctttagcttagctaaaccatcttaaaacaaactagtagaatttatcgactcttgctacaagttgaggttataacgatgctcaagtagtaatatcctagcaattatctatatgtagtaagtactactaagtacttattgggataaaccaaacctctgtccatgtccaatacaggtgagaggatgggaattggggatgaaaaaacaagatctttgctcgatgtcctacatgttgtcctttagcaaaatttagtgattggagaaaaactagctccaacaaaaatgtcctatggccctatttgcttagacttataagccaacttataagtcgaaaagtttaaacctaaacaaacaagtagcttttttttgtttttttaaagccataaaccactactacactattaaaaaaccaaaagttagatttgagaatattttctttttggcttatataaggtagatgtatgactccatcattaaatttaggactttaaatccactatctcataaataatattccttctctcttattttcaggttcctcctatctaccctctaacatcccttatatttgaaagatggaagttcatcccctattgtcatttctatataatgagaaaattacttctatacctctaaaattttaaccaatccttacgcccctgaattttcctcattctcttatatactcctaaattttggttgtgatccttctcatatttttccgttagttgaccactagttgaccttgtaatgagcacataaaagccagttttacccttagatatgtaaaaaaaatctaccgttgaaaatatagttgtttattgcgcacctagtttttattgcatggggaagtattatacgtaaaatgttaatacatatgaaaaaaatgcatgtgtagcatttttctataataggaagaaaaacaatcaaatctatctcgtatatcattttcttttagataaggtatacaaccgacggtaaatctattgcactactatcacaaagttatgctacatatactagttttagtaaataaaaatgaatgtttaatttctatacttcttcgatacataagggcaaaatagaccttttcaaagcaaataaatgatcaattaacagaaaggacatgtaagggatcaaaaccaaaatttagcggatataaagaagtgagagcagaacattgagcatacagggaatttactccaatatataatggaggggatttgctcgagagtgaagaaatgaatgggaggaattttttggactatcccaacacaaaaaaattaaaaatataagggataagttttgttgacgcttctcgagatgctctatacaattttttatgttggtgtggtattgttttgggaatctacacgctctaaccataatacatctgagctaacctatttagtatttacatactaatacaaattatttttctgcttaggataaatttcatctgatgaaacggccgagttatacattactaaaaagaatgacttgctctcttcataaacaagtcaattttacaagtcggtcgttatccaaacatgactatatgacttaatgtcttaaaactatttgattatgctatacttgcatctaataaatatgctgggtttcaagaaaaggaacacgcggtgggtgcacaactgcacactacacaaatgctttactttttgacagaaacacacagactgctgcagaagttggttgaagtttgacctttttgagagtgggtcagtcttttcggattaatctataatagtccagcactactttggttgagcttgcacctttgtcctgctttatggcctttactgtttggtggctgctaacctaaagaaattagaaaagcactaggtgctggttcaatgcacatgtacttcttggaattcttctattttttaagatcaaggattgcgtaagtacctggtttgttacccagattaattaagtgtttcataattttgttcttctgcagaaaatttaaaggtcttattaatatcgttcagttttggtacttcttgtgaaggtcgcaatcggagattcggcaaagcaggttgggtgccagtagattctagagagtttgattattgcatcttcgatatcgtaacctgtaattatctttttaagataataaaaatggtttacatctttggcttatgccctaagacacatagccataaatttattcaacaaataaaaaaaaagagaataggtgatgggacgaacccccaactcccctttattgttagctagcgttaaaccacatagattcagtcaacaattcaaataaaactacgctatccatcgtggaataaaaaacctttcgctcccaattccaaaagtatagcactattgcgcatgatatcatgcttctcctgcggtagcgtcgtatattaagagtggagtcaatagaaaaaaaacacaaagataacctacaccgggttagacaattgattaccattaaaaacttggtcattgcgatatcgccaaattatacatttttttttgtcatctcaatgagagataaaggtctacagtatacaaattagttagagttgaactatatattaaggccttagttaaaattgatgaattatcttatttttttagcaatttaagggtataaataaataaatgaatcaactcttacaaagttgaaaagttgttatagaacagtattctaagtaaattttatacagatttttttcataaaacgtgccgtttaagtagcttgagaagcatgcaaataaaaatccaaattgtagaataataaaaaaaggtgtgttatgttattttgccttttttgttgcatgataaaagcatatgtgcatacaccacacttcatgcatacatccgcaagtatgctatcttaattaatccacaccgtttagaagttcaagaagcatacgtataaaaatcgagcgaacataagttgaaaaagaatacaccattgaatctataggagttttggaggattagttcatgtgattttaggtatgttcagattgtagctaaaataaaccctaccaaattttgacaataccaaaattttggtaagttggcaatattaccaattttttaggatttcttatgtatttactaaaatttgacaaaaaactaaatgtatacacatctttgacaactttgaaaaaatagtatggtttaaaattacatcaatctgagtagcccccttatattcatgtgccccaaggagggcctttataccggtaataagaaatggaatatcatggagaatatgccaaatttatcagtgcgtctgatcagattatgcctttctgatcccttgattccttagccttcacaattccgccaatttagccatggcaacctgaaaatattttccaaatcaaataagattagcacgtgcccaatttaagaaaaagagaaaaaaataataccaatacaaactcatgccattaattcttttaactctgaccaaaatttaattaccgtggggagaaggagacctgtgtggcaattaatcccagatcatatcgcctgcaaaacaaatcggatggaatgaatgcacatgtggtacaacagattggaacgatagagaatctgggcacagtgtaacccactgtttgagcacagcaaagtaaccagagcaaacgaatttaaggcgatttacctgcaatttaccggctgtttttttttttttgaacgaaagcaatttaccggatgtttggcgtagagaaattggtcaaattgtcctggccgagcatgtgctgttttggtgtactacctcccaatgcagtcaggtggccatattgcgtgcactgtaggggctgcatttgatgtttgccctgctgaattaattgacagttggatgcatcttgcatatgaagctgaagctaaccagcttgggcttttaactatttgctactcgttacgaatgatacttaacgatttgccactagacccacatgtcatagacacatgagggcccacatatcatagacggtgagtggcaaatcattaattgtcatatcacaagagtagcaaatagttaaatttcccgattatataagtaggacttatacttttaccgcatggttaat

SEQ ID NO: 104794 - DNA, 2353 bp, Oryza sativa
gagtgtagactgtagagggaccaagatgaaaaccctcaaagggacagaacggattcagaaagaaactcacgtaaggagttatctttttcgtataatataggtggtgcagtacaggccttaggctcgcaggcggggcatgatgcgtacgtccaattcggcagctaccgtacgtccttatgcacaccccatactccactgcaatttcgatcgcactccacctgcaagagcgctctggaaataggggcgtgtttcacgttaaattagaagtttagttaaaattggaacgatgtgacggaaaaattagaaatttatgtgtgtaggaaagttttaatgtgatgaaaaaattgaaagtttgaaaaaaaaaagtttacaactaaacacggtgtgtgcaccgcctcacgaatctccaagcactgatatgaaaattactagcctgcagcagcctttgtacagtactctctctagcttgtctcctgcatgccctggtcagatgttctagcgatttttttgaatttgagctagacatttcactttttttttcgttcagcactcatgaaaataaagccgagctagaaactataaaaaaacattaaaattaactaatcctaaaattaaattctaaaatttaaaatgaactttggattataatgaacaaacagtgtttgattggatatttgacatttggccatttgggacaacttatttcataaatggatcacgatcgaaagaccataaaaaaaaccccctaaactcagtactattgagactgacgctgaggccgaacatctcagtgctaacctcgatgcaatgacccctatgccgtatctcctgtcacatcggatgtttgacactaattagaagtattaaaattagactaacgataaaacatattccataacactggactaattcgcgagacgaatctattgagcctaattaatccataattagcctatgtgatgctacagtaaacatgtgctaattatgggttaattaggcttgaaaaatttgtctcgcgaattagctcttatttatacaattagttttataattagtctatatttaatactcaaaattagcgttaaaacatcctatgtgtagttcttggatccaaacaccacccaagtggcataggggtggctagcgtggcaagtggttagcactctatcaaggatgcagctaatctctctagctcagttcccagtgtcgttagcgctaagataagacaccataaagttgttagcgtcgaggtaaggcattaccataaaattcatatgccaacctatctctcacgcacattttctacaaaacatgcagttcaggctgggctatattgaaacaaggggttttaagggatgttagaggagttcagtccgatgaaaaaaatttctatgtggtgctttggattaaagcaatagccatccaaaaatcatagaaaatcctttggattggttcaaaagatagaaatttcttaaaaatcatttgtgtatatctctcttctgatttctgcattttttctgcgctccatccaaactatcctttgtgtagtttccctacatattttcaatccatagaatttgaagtgttaggacacttcactcatgtatttttttctattattgtgttttgagaatcccgtgttacaaaaaaaaaaaagccttagactgttcagaagtgactctgaaggtaacaactgatctagatataacccttgtggatcaatattgttattaccttgacagattgatttttcactttatataggtaatgctcagattgaagtcgatctatatgcattttcgttctcaaaatcttcaggttttgttgggaaaatcggtaggtaatagctatgtttgacagtttgagggttgtaagtaggtggagaattagggctcaaatggtggatcatgagtaatggaactttcttgttgatttgtgatagcagtacatttgctttcatggtagatttgtgaggggataactggtattatatatctttttccatccatgtgaaatggcaacacattggttttttggatatgatgatgttgagggaaattttgataattaagaagaaacatctttaaccaaacatacatccaagcattgtttgaaacttaaaaaataatcctaaaaattaaattctactacctccgtcatatattacttgtcgctttaactttttgcaagtaacgtttgaccattcgttttatttaaaaaattagtgcaaatataaaaaaatgataagtcatacttaaagtattttttataataaaacaaatcacaaacaaaataaatgataattttaaaaaaattttgaataagacaaatgattaaactttagaaaaactga

SEQ ID NO: 104795 - DNA, 1043 bp, Oryza sativa
gtaataaggggcacatgagcttgccgcgtatggttgtaatctccagaccgtgtcttcctgggcaggctgcccgcctggtctggaacggctggtatccagcgattctgctggtttggtaatataaatctctcggtttccctaaaaaaaaaaacagctagcttcagggagcgagggagtctttaaattaataaattaaagctcttcaatgactgatgatgcatgcaggaccaaaaaatagtcgaaggagattcataaaaataatttggcacgtgtggatccaaattaatgtctcgccgatgaaggtgctcaatattttacacccgttaatttgcatcgaacaaagcatatatgcacgcgcattaatattacatatggctcgaccactatgttttcaactccctctatctcgaaataagatcagttttactagcccttatttgttcaaaaataagttaatctttaaacaatcagtaaatgacaaatataataaaagtagacaaagtgtgaaacaacttattgggagcagagaaaatagaggaggactggtatggtaggataagtgaaaaatatataaatttattttgggatggaggtatatatgtaccttttgtatttcagatatatatagtaccattgaaaataaatatagagaggatttaaagataaggtataatagtacaaagctaagtattcaaaaacaatcatcacgatcattgcttgtgcctctttacgttatcggaaagtactgtttggtaggcaggtcgaagagaccaacggccggcgctatataaatatatctacaaaaagcacggccaataatcctacttgaactgagttaattgtatattattatatactccctcttccaaaaataaatataagaatctaaaaccggatgagaatctacctgtctagattaatttgtagtactagaaaatatccattcaattttaggtttttatattttgggatagagagggagtatagaacatgacattatgcaatattaacacggcaaattaagttgatatgatcgttcatga

SEQ ID NO: 104796 - DNA, 8144 bp, Oryza sativa
cccatggcggcacccggagcccatagggagtgggtagataccgccgaatgaacatctgggagggacccccatttaggatgaatgcacaccaatttgtcctagactcagtaggccagctaggatgtcctctaatgctgtagagacgacagacgatgaacaattcggggattggaggagactatatacaatttgacataggtagcaagaagagggaagatgtagtatattgagggtttcgaataatagattgattttcacaattgattgattattgtttcaatcggtcttggcccttatatttatgggagggatgatcttgcctctctatcactcttgtccatgtcctagtaagtttgagaagctttacagtgaaggaaaccccaacgatcgaagaaagaaatatgaggaaactccaattggattcgaactatatgtgctaaaagtctgaccacccacatatatacctgcagtctgaccacagttaattgtccggtctaactagccacacaatggcggttgatcgaccttcgctaggaagtctcgatatttttcaaatttggctttaacttcctataagtctaaactactgctaaatttgagtatcgacaaatcgggatatcttgaaattgacaaagtcaacacatgcgtctatctgttgatggatatgtcccctaccacgctaaagagtaatttgtcgtaaatgtgaacacttgtatcaagtctagtacttaaacccagatggacaggtttcactaccaggaacctaaccaaattgagttacgatcactttgcaacaccaaatttttcatgaaactaaagatttaagctagaggctcgtaaatctacatatttaataaaatggttatcacaaaactacaatattttagagttcaaattcctatcatatttctatattggagttataaacactgtaattttgtgatttagttggttctaaacctgtagactactgatatttttttaagtaaatttatatttttgtgatatataatcataaatctgttgttctatgagaattttggtgctcaactgagtttttttttgatccaccatctttaatccaaaatctattgtattgtagttttgggttgattaaaaaaaatgtgatagtttagccgaagcatttttttgtgaaaattttactcttacatttttataacaagatctcacataattattttctgttgacataaatatatagtatgtttgaaccgttaaaatttgatgttttatatgcgagaagtgaatgtcttatgttgtacattgtaagttaattgcttttggttgtgtgaatcctttttaatgtggcatgtggtatcctaagtttacttttaaatattgcacatgatctttttttatgttttaactcttttttttacattttaaaatttaaaattttgtattttatgtatgatatgaaaatattttaattatggacataattatatatactttgttatcagaaatataatctacgatctactttgttattcagtgtaagattttattttaaatattaattactttgttatgtaattttggatcgtagatcggataagtaatgtaagaaaaaaaataaagttagttaaatttgtttagggggagaattgagggagagaagggagagagagaaagagataagcagtggctggaaggagcgcctgctttgtggcatttaaacagctcaccacgtgtacgtagtatcgtacggaaaatattcgttcgcgattctgcatgtgttgattcaaaacagaagactctcccagacggagaatttgaccaatatgcattccaataggttagaaaaactgttcagttttctagtttacatgattgttttttatttgggatgcccacgtacgtacgcatatgtagttgaccaccactagctagttatcaacccacatgcacctacctatatatggtctatacctctagaaaatattgatataactaattaaatctatggatattttctaaaacatatatactcccccatcccagaatataaacatttttagagttgggcacggttactaagaaaataggtagaattgaatagcacaaggttatgattggatgagaagtagagatatgtgagaaatttgaatggtggaggattgtgattggttgagaagagaatattggtgtagaagttgttatattttgggacaaattctagagactagatattgttatattttgggacagagggagcatgtaagtttgcttaatgatccaatactttttaatcttttcttactataaagttataacccactaactcctaaagcttaacatataaagatgtcacatcatcattcactaacaatcattaaatttaaacttcaagcaaacatattatattatctataattttataatttattaaattttagagcttttaaaatgcaagcatgttaaatcatcatcccacataatttacacaatatttcaatatatattcattattttttataatatgctatgtacctatatatttcatcctcacttacttgatgttatttctctcttctatcattcagttatatcatataattgtttttagtttttagatgattaatctacgatccaaactatttcaatactttccttctttcataaagtcatatcagcttacttttacatttgaatcatcattctatatatcatttaaatttaaattatcataaaagacgttaacttatataattttatgttgtctagttgtcttacatattatttttatttattattatcatacttaaactctcgcagcaacacgcggggtttcacaaagtttatataatgttcacctccaaaaaatctatcttaccttccttccgtaaaaacttgtgagcacgctagctttattaatgattttcacagcttcaaaataattatctgtgacttgctataatggcagtgtattgatcatttagaaatgtgatgcttcggggcaaaacaaagagagcttttattgtgtttacatttaaaaacaaattaaaaatctaacggtgcatagtaaaagtacttctagctaccacttaaaacataggaaattgctataaatacaacttgtatgtatgacttgtgtccgaccaacacttagctgctactcgctctggcccacatggaaagaagcagactcatatttggctgatgaggcaggtcggacaggagtaggacgatggggtcggacgtatagcgcgattcaaaaacatactctccatccgaagtccaagacctatttcttttagcaccacaaccaaaaagtaatagtaatgcgaagtgaccatagctggttaggtttctcatggtaaaatcaactcacctggatttaaatcttagatttaacataggtgttcgtatttacggctatttattctttcagttgtaggcgacgtacccgtcgacaatgagacacgtcacccgcgcgatctccgcttccacgcacacagccacactatccccgcgccccagcgcgtaatgacaccgccatagcgcctcccgactctcgacacctcctcacatgacatgtccccgccaccagccggcaggttgcgcctcactaagttgcactcgttggcactccgccgcacctccggtcttgtcgtaggctctccggacctcccattatattggagagatgaagggaataattcaagtcatcaaacaaacataataaaacatccgacgcctcaagagaagaatattagacattgcttggctaaaacattgctaggcctttagcctgccagtcaactcagcctgagatgtgcccgtcaaaccatttgaaggtggcgacaagatgtgttacacattcaggggacttgacaaaaatggctaaagatctacaacatctcaaatattcttaactcatactcatgtgaatctaattttcaggatgtgcactagattcacactttcatattaagcagagttatacatagcaaacacaaataagatggaagcgattataaactacatctactttagttacactggctgaccggccaaataaataatagaacagcagaagcttgtctacccaatccacaagcacaccgactaggggtttacccccattaagttcagatcctagaagaagcagtcgaaacccgcatcacttaaagactaagtctaaaacctgcaagcgaaaggttaattcaacggcaagagtcagtacattattagaaataatgtactggcaagcaccaagacaagcctaacaccctacttgtaaggcatataatcaaagaaggcataatatggttctttttagcataaagcaagttttatttgccatatgggcatcaaagtaggcattaatcatgtataaattaatatgcacctcattgtcatccatggcagcaaggagatcattctcaaatctcatcacaagttaaaagtaaatttcaatatttagaagaataaacacaagtctatactcaacacatatccacacggcgctcatgaccgtgagcatggctaatcgattagtttttactctgtagagtttacactttacccacatgatgcgaaataataatcatgcaagagcatggcacacgatacataagtacccgatttattacatgcaacaaagcttttccaaaatcatgatttagccttacaccagcacgatacgtgtcactccatcctaagccatacactttatatgacctagaaccgttaagtggcgggcccacgccttaaacttaatgccgtggtgacgaacacaacgggaacccaccacgtggcacaataccgttgtattggacagacttagtcacctaaactaccacgtcggtcggggtaaataggaagttcctttgagttatccgaactcatacacaccggcctaccagaatgtaaggctaaaccataaataatttactaagcttgggctatcccatactagcacatgtggttgtactgtatacgaaatgaactgacattgagtgaaatccttaggtcggtttgggcacactctccccctatcagtacacaactaatcacaatatgtgcaccacttttggcccaaacctaaaatccatgttttacatcattttatttatcaaaatcacaagtattaaagttttgtccagattatttcaaaatcatttttcatgtttgtaatgagcccataatgacaaggaagatcattctaagcatggctaagcattatagtaacctataatctagtaacatcaaaactcatatataaagtggtatagtcatattgttcctaaggttaggaaggagagatatggatatatgtggggttaagatgataatgcaaataataggagtttgtctaacaagtttaacaaaattttaatttattagtgtacaatcaacatgcaagatttgcaaatattttcaataaccttcaaaacataggttcaaagtgatcaaagagagggaggtgggaggtgggacttacattgtaactggaaaatatcagcacctaaatcacttcttcaccgattaagcagtcatctatacaaagtacacgttatacaatttaaacaccgaaatatgcgaaaaatccaaaatgctctaaaatgcatgatttgtgcacagtgggttggtattgatctaaaatgaatttaggtgaaagaatttctattttatctcatttcatttaagagttatgaattttagaagtttcatcggtatagtatatgatttacttaggtactattgtgaaatgctattgtaaggtgattcttattaagtttaggaattacttaagtttatgtttgctgagtgaagatatgggttttctaagactaatacatttggtttcacaatttttggagttaatataaattctttatgtatttttacaagttataacgtgttataggtgtatagtgttctatatgcacatgcctttggtatttgaagtccagaacttattctactttgagtgtgcttaaatgaagcaaataattttgttaactaatctatccttagttcacaagtttagggcctttattattttagttcgtattttataatctagaggggttctatatggatgactttataaatatcaacctaggaattattattatatgagctatgttcttctaagtttaagttttggtggatggggatggaactatggctccactggtctaacaagttttatttggatttatttagagctaccatgcatatatatacatattcatatgtattgtttaactactattatgtgtttagagctatggtctgaacagagggtgttatatttcactctactaggttgaagtatattacttgctggttttatagaaatttggttcacttcatttagactaaagatgaatttacttcatttagactaaagatgaattttctgcaaattttacaaattaaaggttgctctatgttggttattaattacataaatatttagaggcttttattacacattaggtgtataattttattttatactccctccattccataatataaggcgcaaccactttttttaatattccataatataatatatgtatgcatatagacaattaactatgaccacttctcgaataaattattacttttttaaatcctactctcatgctctctaattctattggatgcatgtattgtatttattaggatgatccaaataattattatcgaataattattttttggtctttgggtaaggggtggttatgccttatattttagaatggagggagtaacatggaattatatgtttggttgattctacagaacttgggtttactaaaaaggatctaagatgaattttatataaacttgtaaagttcagcttatgtaaaactagttattttatagataatagttttagagacatttgatgtaaagtgtgtatatgttttattttactttgtttttagagaacatgttggtggatctgttgaaactaaattttctctaaaatgaggtgaaatgaattttataagtttgtgtatgctttatgtatgacttatccaattttagagacaaagtctttactgagggtgccaagttttatgtttccacattaaagttcatagttttgtgaaccaaaataaattttaatcatctcaaaataagttatatttgattttatatggattttacaagtttaggtgttttcctgttaaaaagtaaaggattttagtattatcttttacattttcagatttttaaactcatggggttcacctgtcggtctcaggataatattgaaaaaggcccctatcgtttcaggaaatcaacccgcagtcctaggtctataggtcattgagtggaaacattacataatgaaccttatagttgttcaaattcgcaaaatgaagtccctgtttcttctccattcgataagcagcaaagcagccatgggcctctggccctctgctcgccggtgtcggcgacaaatggtgactccgttggggttgcgaccagaatagaaaatgaagggcatgctattgcgattccattcctatacatttctcgcatagcggacatcggagtagcgccagcggtgagtccgagcagaggatgttttcgggtggttgtgcatgtcgtgctatagactggatgtacccaaagggatgcatgcatgtatgttctataggctgcagggtactcaccgaagctcggacgaggtacgggtaggcctggacagcgacgacgatgcagaggatgtcccgtcagcggtgcgcaactccgcgaaaacggcgacggctcgatccactcatcgaagtgacatgcatatgtgtccatgaggtcagtgaggtcacagggatggtgtacgagcaaagaattgatgcgaggctcaccggagaggaagaaatcgaagatgaagctcggcggccggagttggggaagatgaagtcgatctccatccacggtgcataaatcttggggattcttgaggggttttggtcgtggtgatgagacgataacgatggcgcgatgtctcagttatatttgctccacagcaaccggaatcggcgacgagatctcgtggcggcggtgcactgtgtgcgctccggagctcccgcgggcgaggtcgcgttcccaccaaaccacttgcatgatagaggctgagattagaggggatg

SEQ ID NO: 104797 - DNA, 661 bp, Oryza sativa
ccccgaagcccagcctgtcagaaagcttgaacagcaaagcaggacgaaccatttgcgcatatagcaatagccaaggcagacgacctgaatcgagcgcgcaacatagacagaccagtgcctacgcatgaaaccaatttgttcattgacgtagttgagcgtgcaagacaagaaagactgccaatagactaaaaagcaagaaccctgaaattctaaatcacagaatgctcacaaaccacgacataatatactagcactgaaaacatgtggaacaacagcacgcatgcaacgacatccattgaacagcgaactacacaagacactatctaacatagttccttcacaaaatttttgacagaacaaacacacattgtaactctatgtgagcgtgtatatgcagaaaaagggacacatcgtaaacgagcacccagggtgcatgaacacaaaacgcaccccggacaacacgatttttcatctatagacttcaggaatgctctgaatttgtggagttttctgcacctcagctgacgatcatgggggaggctgcaaccccagcgaggcaagaggatgttgtccaggtggatggccacgcctcgacgacagcatagatcacacatgggcagaggaagctggggatagcatgatgggtctgctagctgcaagg

SEQ ID NO: 104798 - DNA, 2763 bp, Oryza sativa
tatgtgtagttctattgattcggcttatgttctattgatttgtatgtgtatgaaactgtttgtagaaattgattttcacaagtggttgtcttaaggaactagactaaatttggagcaatcaatatatttttaagagaaaaatgtaataactctttcatatgaatgttatagctctcaacaaaatctacaattttatagttgaaagtctttttttagataatttagtggctaaaatatccgttataagctgttaaatctatttatagaaataactttcagtttttcagtctcaattctagagcttgatgagacctgttgaatattctttcagttgagattgtttgtgtgcccaagtatttgttacaagcttttacatctatgtttttgtaaatagggtaattctcgcatgtggtttgttaggaagtccaaactttgaaaattcatataaaattagttttaagtccaattgacatgaaccaaatattcttacaatattttctttgttatagtttttagtttctctgatgctaagttatataaggcaacttgacataactgaacaaacatatgaaaatattgtaggatcactgaaagaactttggttcaaatcaactaaacttaaaatgaattttctataattgtttggtcatctaaaaaagaatttcacaagcgaactgactacaaaattgcatgtgctatgttaatatttcaggcggcaggcggttctcctaacaatcctcctctaaaaatgtaaaaccattttaaagagtgtagattttgcttggttgagctatattagcatggtcgagaaaagactatagtatgctctttattaatgtggtttgcatgctcggctccatcggaggcttgcatggtcttttgggctagctgcccccaagctgcaccctagattggctacaggagtggcgatagaaaattgaggaagtgtcgtcgagaaaataaggagagagtagaaactccggtccaactgaaggagaaaatgataaaaaagaagaaacaataaagaagtctagtggaccccatatctaaagctacaatctttttggggcaaatcattatgctaaagtatactctttttgtaataatttggatctctgaataactttatttcaaatggttgttaaataaaaagtcgtaagatctatgaatatctagaacaaactttgatataaagtttatctttatttgaagtcatatatgaaaaatctaaaagtttattttctggtaatagatttataaggcatacatataggcatgtaaactatatatgcgaatgaaaaaagtcaccagctacaaaattatatcttatatatgttagagttaatgttattgtttaattattttagatgcatatttatggtgcatacatatgtatgacatgcacatgtatatgggtgagagaaacttttatctttagggaagtcagattaacttagaatccccatatgacatgtgtacgtgtatgccatatgcttgatatctaggtaccttagttgagtcctaggttgaattggtttgctagcaatgtatataaggtaatactgggtcaagtaattattaggtgatatggctaattagaagaatagaaaagcctgttgaaaatttgtgcctccccgagaaaatttgtcaagttattcttaatttgtttcatcatgacagcgtgcgtacattaattattgttcgggttgaatcaagctctaaatcttcgttccatatataagctctatcctttcttatgagatgtcccatttaagagtggctatatgtgagtaataagatgtcctatttaagtgtggatatatctaagtaccagttcagttcggttttcacgttttccgtgccagctgaagttacaaatatgggcctgctaatgcgcagatgggcgtgcgtttagtcgtctgcacagcacacactagtacttactgctacactgctactgctactataaaaatatatttttatatgtataaaaaaatatatacacgtatacaaagttcatatacgatgtatacatagtttatatgtgtggtatattaacatttgcatacgatgtatacaaactttatacacatgtactacatattaaaaatttgacaaaactagaaaatacatcacgtatacaaactttgtgtatatacgtatatatacacgtatacgaagtttgcatacgtatgcatacaaactttacatacacatatacaaactttatatcgtacgtataaaaaaagaaaaaaaagaaaaaccaaaaaaggtgaaaactaaagtaaaaaaaaaagaaaaaccgaaacggggacacgtgtcccctatcccagcgcgtcccgcccccgtctcgcgtgccacgtgccgcgccgcgctcgcgcggcggctgatcgctaaatagcgttcctgttacatgtaaaccatgtcgtgctggctggtctgatgagaaggccatgtctggttcatgatacgtgaccgaattacggccagcacgacatggccagttcgtatcatgatggccggttgtagtagtagtataattctccatatcgtgaccgaataaaaaaatcaattccccataagtcataactaatcaattaaaattgtcctgtattacattaattgcagaatgttgagctagctcacagtataatttcagtgagctatcaactaactcactaagggcttgcaattaacgctgggtttttttaatgcatacggacatttttgtgctagcatatatattagcgaaagattaataag

SEQ ID NO: 104799 - DNA, 1574 bp, Oryza sativa
tgtgaggactaagtgcctcttctgtaagtattttacgctttatttacgtttggaactgtttattacttgtcgttttgtgtaccctggctggtcctggacagggatttaatacacgaaatagtctggaaacttgggctaaatttctgggcgtgacaccggcctcccactgctggcgtcgcccatgcgccacggctcctcccaccggccgccgtcgcccgatccacggtctccaccaccgccgcctctctgcggtcgccatccccgccgtcatcggcctccgcagcccggcgcagctcgcccttaccgtcgccgtcgccatccccaccaccatcgccgtccccgtcgccagctgactcctcgccagatcaggcaggagcagcgcggatctagcaatcaccgtcgccaccgccctgagcggctccccagctgtctgagcacgaggtcagcgagaagcgagaagccccgccgccgctgtccttgcggccgcacggctttgccggcggccactcggggtggtggcgatgtggaggatgaaggtgggggagagggagcggtcgggtcgtcgcctcgcgagccacccctgggggagggcgacgtgagaggaaaatgtaggctcaagtgcgtaaaaagattttgtccagctctcaattaaccaggtaataaagagaacttgctccctgagcaattgtgtggcgtgatacatttctccagtctgatgacacccggattattaccctatctgcctatcaacccatagatcgaggcatgttaaaacattcgtggtatgttaataaataattgacaaaaaaggttatattttgttctaaggtttatcaagttaaaagaacttgttactattttctttatctttgatgagaatgtaaagtgagggtgtggtcatggtgcatgagtgacgaggggccgatcttggtttcaacgttgtagtaaagcattgcacattatggtaaagcattacacaaatataaagatttacaaatattcaagctaaaagttatagtaaagctttacacattagtaaaattggagtgaaaaaaataacatggtattaattttccatggcactatatgttcttaatttaattatttttagtaactataaaatataaaattgtgaaatatcgaggtcaagaacaatcaaaattgacaaactcaaaataaatggtagttgcaatggcatggatccaataaacccaaaaatatagggtcgatgcatcggctcaaatcgagccgatgcttcaagttgctccccggtgcacaaaaaatcatttgacaagaacaaaatcatccaaatcaaataccgatatcatttgattatgctatttaccataattttgaaacacaaaaatccaataaggacatcgactagaagaaatccccaaatcaactgctcactggaaaatccaatactcatctaggtcgttgccgtcgaggccaccaccggacccggtagccaaacactggcaggttgcccggaggaatatgtaggactgtggagggaatgtgttagcgaggcacagcttcgggcctccctgctttcaccgactggccgagga

SEQ ID NO: 104800 - DNA, 1882 bp, Oryza sativa
aaaaaaaattctccctgacaagtccgagtattaaatgcattgttaactggggttttctcctggttaaccaaagcaaatccttgatgccatttattagtgatttgaaacctaagggaagggaaaactccgggtgtgacaagcatgcacatattctcctatactacattaattatatttcgatgaaatccgtatccatgcagttatatgatgatcaatttgaaaaattctggactctattacatgatgttcaatttgggaaggaggaaatacctttttacatgccctaagtacaataatataagtggtctctggggcgatgaacattacaagttatgacaggacataaatgttggtggagttttcttaatctggtgagagcaactggaaggtatgactgcactacatcacccatatatattggggataactagggatcggtcgccccatccaaatcttcaaaaatcgggcgctgacgttatgctgacgtcaacgcccgatttatatgcaaaacaaattcaaactgatttttctcttaaattatttatccaaatcattatccgattgcaccattaaattcgttgcaattaaatcttcaaaacaagactacacatggatatattccgacaaaaatttttttagcttattattgattttttttcatgttgcacgatgttccaccaagtatatcggaattgtttcactgagtagatcgaaaatgtttcactcgtttaaatcgggtgttgtttcaccttatataaaaacattgtttcagcaaatagcgaaagaatatttcagttcactgcaacatttgatccatgcatagtgaaatattacgagtatactagatgaaacatttttcgatggaataaaaaataaaacgaattcacttaatagagggtttccaaaatatgtgggtttttttttgttgcaatggagtatctcaaaatcactgcaacattagatctataaatagtgaaacattgtacattaggtgaaatattttttgtggaacaaaaaataaacgaattctcttaatagggggtttccaaaatacgtgggtttttttgttgtaatggcgcgttccataatataaaaatccactacagcatttgatccatacatagtgaaacatcacgagtacactagctgaaacatcgtaaaactactggttggaaacattaaaagagaccatatgcaacattcaaaaaaatatcaataaaaaagctaaaaattttttttgtcgaaatataatcatgtgtggtcttgttgtaaagatttaattgtaacgaatttagtggtgcaatcggatcgtgaattagataaatagtttatgattaaaaaatcttttgaagaaatgagagatggaagcatgtagggaaagattctttgtatgcaaatggcagaccatgcagcgtctgatttttcttccctcccatcagacgcccgacaactagcattctccatatatattggcggttcacctagatcagacatttatgacagaaaaccttgatgtccaaaaaaactggtcaggcaccatctagactccgggtgaaacctctccatgggttggcctggtgctgcatcacccctagacggctagacctcggcagtggaacaaaccaatggttaggccattttggtggggagccgagatagctgtagtggactggatggtacgctactcgaaatagttctatgtgatgttacttttgcagttattgataatatattataaaaagaaattaacgatgaaagttttgaagaccgtgtaaaaaatcttagactttggacagagggagtaaaaggtttttttttttattgtgagctttatagacgaagcagaaaaaagattgttactaggatgacggcctcatcagat

SEQ ID NO: 104801 - DNA, 1980 bp, Oryza sativa
acaagagccacctggatttatattgatgttggacagcagattgcattttgtctctgcgaacaaaatatagaaagtgttggtaataacagggttgtaagttcttctattatttaatatatccaccctgttccgcaaaagaaaaataaacaaatataagaggtgttctatttttcacagggatggaggcagcccaaatatcagaaatgaaataaaattgaaaggaaatataggagaaaaatggctggcttgagaaaagccaataaaacggaagtataattatattgttcatgtttgtgccacgagagacaatatgccgtaaatgttgtgtacagataacagatagccaggtctaatattaatgaggatgccataatcaagccgatgtgtccagactatacatcatttttgtgcccaagacaaatacgcaacacatattcgtgtccagactatacatcatttttgtccagagtatacaaatacgtaagcagcataattgcttaaagcaacaaacctgattaattattattgattaaagactggacatatttgtgtccaatcatacatttatcatttttttgtttttgcttgtttcacgaggatttggatgtggtgagcattatatgtacgctgatatgtactttcagaacttctgcagatatgtacgcggccatttaaaaagtacatggtgtcagggtatagcacgtatatttcagttggcacaatgcatatatacgattagatcaacagctagcaacggttttgtatcactaccagaaactccattagccctgacgggccaaaatttttctgacgtgtatctattaggctgtcaggagtaaacaatttttttctgacgtgctttcggtaccgtcacgatatcatgaatttcgctggcgtggtttgcctgtcagaaaaaaattttaggttcagatggttctcctacagagaccacatacgttttcatacataaagactgaccggcctggttataagaaactatagcatatattattattattattattattattattattcaacatgcatcctatgatgcaagacctatgatgcacacaaccattacatgattaaatcaccaaatgcaaagcatgcacttactacaaggaaagttctgaaaggccgaaaaaaggcatgataaagaaatgaaatttccaatgctttggctgatctgcaaaaagaaaagccatagtgccaccaccaagactatcagtacatcagccatatatacaaactcaaataaactctactacgcaatcaactttcgcggacgagcccccgtccaaccttcaagtggaccgcatatcgtccgcctgtgataatagtgatcccaaagaaaaaataagacccatatgaaaaatcaatttttacagatgggcctattaagagacccatattcctccagcccactagtctggccccctcccttcttccttaaaatatctaagtcgtatcctcgcccctctctcctcatcctctccgccgcaccacctctactccactttttttttgagcaaaacctctcctccacttcaactacttctcctctcctctcacttcggaaggtggtggtaggctctcttgcagccaaggtggcacgtgtcgacgacgggcagtggtgatgaccaatgcgacagcggcggcaggaagagtccgctggatccaccggcagcaacgagggaaggtgcagatttggcaggctctttccctcccgcgtggatcacgccgcctcccctcccctctgcatggatccagaggtgcacttgatggcgacgagggggaatgatgactacaacaacgatgagtggagggtagatccgacgggctctcccccttccacgaggatctcgccacctcccctcccccacgcatggttctggtgatgcgctcgacgatcggttggggtaacgacgattccagtggcagcggggagagcccgccggatctgccggaaatagagga

SEQ ID NO: 104802 - DNA, 1586 bp, Oryza sativa
tgcatggatctgtcggtggcagcgatgggtggtgggacaccggggagggcgtcggccatggtgacaatgaacctagagcacgggaatgacagtagctgtgacggccgacatgcatgggagctaattagctgccgctttagccatcgtctccattcaccgttgccgccgtcaggatcgcaaggaggagcaaagcatgtcagccccatcgccaccgccgctcaccaccagaatgttgccgccgcccccgacccgaactgagccgccactccaaccttgccagcatctactattgcaccacccaccggtgagtcccctgcgccaatccgaacccaccatgccctagatcgccggccaccatctggtcccgtgccactcgcaaccagccatgaacccaacaccgccacatccgcgctgcttcagcctctgtctgccacgtcagccgcacatgtggtgaacccgatttagttcagccgttagatctaggatagatcggtcccttttaatctgagccgtcagatccatagactggctctgcgcacccggtctactgtggagccgatccatgtggatgcagtaatccgttttccaattcataaataattcattattgcgtcataaatgataaatattatctgacagtggtttaaatcctattgaacttaggaaatccataactaattaaccgtaactcggatttaggtggttcaagtctcgaaattcatctaaaatcgagatatatccaacaaaagtatccacatgtcatgtttatgctcgtttttgtactgttttgttgattgtattcatttgctttggctttcgacgttcccaaagaggctgtttatgctgaaggttcgaaagtcttcgcaggcctgcaaggtaagtcacacagatcctaaagctcccctttgggagggttgacctatatcctttgttatgaccctgttgacattccttacctttcctttgcaaatgggttaacaaattgattagctagaactctatgtggtttagctaaagctattaggatgcagtcctgcttagaaacattagcacactaatgggataacttatgttacactatcacttattcatgttcatttgacggtagctcacgatggtcagttgtgattggttaaaaactgaattttccaactaaaacctaataatggtgggttgtgagcacttggttttgatagtcatgctcatgacaattaaggaccggttcacaaggtactattgtgaatgtttaatcatactaaccacaagccagcgtgggaaacggctggacatgttgtatagcatggttcatcgtggagtgccagttagagaagtggccgagataagcccacgagggtcactggggaatccatacctgactaagggggtggctatgatccgggtatacggtgcaccactttgaattgtgttatgctagttttgttgtcaaagctcctttcaaggtactgtggtggtattgaggtgcatggcaacatgttgtgtggttctgtcttgtgtgtgcattggtacacctctgggcagagtaaaactattcgaatagccattcccgcggttatgggtgaacctaa

SEQ ID NO: 104803 - DNA, 644 bp, Oryza sativa
tttggatcaaagaccgcattatgtgcgtgtcggctatacacctcactagtagcaatcatgctgcctggctacacctagtccctctctcaagctcatgtgccgccttggctcagcctatatccactcctagctgtgcacaacctttcgctcccgcagcacctacgcgcatacaagcaagaggagatgccctcttcttttataggtgtttgctgctccatttcagttggcacttgcacatttgccaaaaagagatgtatcctacgtctctacagtattgtgccaacggatcacgccttcaagacacaaggttcttgcacccgaggtgtgtgcatgaccaaattgcttgcctgagttggcatggtcaaaataccttcctccggtacaatctgcatggagatggaggagaaatcgccaatcatatgtgaccatgccactgcctagagatttcaaaatatacatcatgctggaggtaagtacactcaggtatgtgaaagataaaataaggttcaccattccttttactcatacttatcttcatttgaatgagacttgatcatacatggttatgtttcttgtgtctatttgcatatgctctgttttagatgttcgtgcaagacatctataggctttttaaattaagcatg

SEQ ID NO: 104804 - DNA, 1308 bp, Oryza sativa
gcatgggaaatgaccaaaacaccctgcaaccaccataggggaggaatctaagccatccacgtggaagtagacggtgaacggccgcagaacgggttcggccgaacccaaaaagtgtcctcccggcctctcttttggccgataggttgcttaatgggcccccaataacctgcactatgttttggcccaattctaaatggtttttattgacttatggggcctccaattcatgtaaacatgtcctgaatgtagagaggtgcattttgtcgcatgacggatgtgttttccctcaaattacctgcatacacatatttcaccaacactagtggaaatgattagtaataatacctaccactaagttggataccatgttttatttcactatatgcaagcattgacggtcagatattatgatttaaggaccgtctacaatacccccacacttaacctttgctcgtcccgagtgaaggctatggactctacaatagagttatgacttccttactaataatcatgcaaacaaattattcaaagctatacctgtacttgtggatctttgtagtgtctaccatgcaatcctaagcaattaagaaatggaacaatcttgactcaagtcaccctaacttttcgtgaagaacaacttggggtttttcatgtaacacaaaattatagctttgctttgctcctccattgattctatcgatcactcaaggtgtatgattcctcacaaaggcatatgattgtgccttttcttttcctaccatctagtaaggcttatgtgaagctcagggtatggaaaagagtagagcattacttgcatcacatatattgcaaagtaaaataatggatccacggaaatacaagatatactttatggatcaagaatgtgcacgtgtatgtgtatggtgaatttgtgggtggaaaacggaaaataaaagtaactccttttgtatacctcctcctccatttattttctcttttgaaatttaggagagtacatggctatctttttttttctttttctttcttttttttttctcatcatcttgctccatacttgtatgagcacttcttttttcttttttcatagccatgcctcttatcttttttttaaagaactttggaggaagaggcataaatgatatggagtatttattttgtggaagatggatgaaatcgatgacaaatgaaagatgctaacttctagtgtagaagtcaagcattggtgggtgtatgtggaatttgtgtgatcttgaccatgaaagtatgaaaagtatttcactagggtcacaaaatttgacaacgctcaat

SEQ ID NO: 104805 - DNA, 677 bp, Oryza sativa
acgccataaccaaagcaagatcactccagaagtgacgagccatgacgaaccacacagggaaattgatgcggccaaacccaatgaatcgtcctctgttttatatagagcgtaggtttgcacaatttttactttggacatccattctatcttgagtttaatttgattaccaattctaaaatatcgaagataattgaactcaagctagggatggtacaattagaaatcatgatctccctgaaaaataacatgcatgcctattattcttagctcattacttgttgcttgtggtgatatttttaatagggatcccatgctatctaggtaattggtgaatgagatatagtctgatgatagaaatcctgctcttcatgttgcacacttgggaattttataaaaaaaaagaaaaaaaaataacgatgctaaactcctcattgatatttttattcccactagagccataggttgatcattcatgattagcttgctacatacgctgcttgtcattacattgagcgttgtcaagttttgtgaccctagtgaaatgcttttcatactctcatggtcaagatcacatacacttcacatacacgcacatatgcttgacttctacactggaagttagcatttctcatttaccattcatttcatccatagtccacaaaataaatacttcatgt

SEQ ID NO: 104806 - DNA, 1487 bp, Oryza sativa
ggaaaactttcatcttaccgccgatgcagtcccattattcaattctattgtttcatgattaaacaaacaataatagctagcacttgaagcttgctcactgcagagcacaaagataagttaggcaatatgatacatcatatcataggcatatgagacgaaacaccaatgaaataccaaggtatatacaagtctcattataaatacactggaaaaatgcacaacataattcatgaaaaaagatggataaaggacttaattcaaaaggatataattttaacaagattcaccctaacataattcatgaaaaatgagcagcatataaagtaccagatattagaactctctagagaaaacacagcttcattgcattagtgtatcgaggatatgtgcaaaagcttctcaaatttgagcaggatgaatcagactatccatcagactactcagatcagtagagccattacttggttagataaatctcagtgagtccatttattaggacagtttatgacctgcaagaaattaatatctcaatgaacttgcaatggtaaattactaaaaacaattgtagtggcaggttgggtcactagtacagatccttccatctgtgacggcccctaatatgactggaatgagtgggccgttataaggaagtaagctcaatagggccgaaaaagcacccgattaagatatggtcgcacagacatgctagatcggcataaaactagagcccgtcatgaatgacacttatctgtcacgggccatagtttaggcccgattgagatgatggttcaatatctcaatcgggctctaaaagtagcccgtcacagatgaccatcatctatgatgggcaccaactagaggcccgattgagataagtttaatgtccgtcacagatgacactcttttttgacgggcttttattaaggcccgatagagattacttatatgcccatcacggttgattgttttagggtcgttagagatatttgttgcatagtataaatacccccaaccacctaatgtaactgtatcctactgttcactattttggtgggaggatgtatggggcgattttttgtctttgtaccaaggaaaacagaaaattcccaaaagtaatcattaattcagcaatcaagtgagtaatactaatcattaattcagcaatttcatcacgtcttactttagcaatactgatcttataagatgtgtctctaatttatttttttattttgtagcaatggatcgaagttggatgtatgcgacaactatgaaacgtcattttccagagtatagaaatggcgtaataaattttatgaacgccgcggaggaggataggaaaagaagaaacaacgattacatgtgttgtccatgtgcagattgcaagaatgagaatatgtttgattcagcaggggttgtacacatccatctcagccaatgatcattcatggagggctgtacctgttgcgtgaagcaggcagagcaaccat

SEQ ID NO: 104807 - DNA, 765 bp, Oryza sativa
atataattgagtaacattcaaataaattaattaactagcttaactagtatacctgtcatccacaaactctatattgagagaactgtaccatccaggggttgattgatcggcctagatcgtcacacctcttgcatgtgcaactatagtacttgatttagggtcggggccatcatatatgggccaatcgtggacgacgatcagtccgaatgaagctggatgggttgatggtaccatattttcttggttgtggttctgtccagagtacacttggtccaagtacaactgcatggtaatctcgttttcacggagcacatgctttactaggttaacactgaaagaaaagctggccatattgttgggtgtaatggcaaggtgtaactaagaattgtgactctttcgattgtttgggctgtgtggagagatttgggggagggtcgggtatatttatagtgtggtagggctataatttattcattaattattaggggaggctaacaaagagcttcatcatttctcttacaagtatttaattcagaagaaaccactacgccagatcctcacacctctgacgggatacctgtgacgggcaaacgatttggtcactagtgaccattacctctgacgggtcagacgggataacgtcaccggtgagccatccggccgcggaccgtcacaggtatcccctcacctgtgacgggccgaaaggaaaacccgtcacaggtatactagtgacgagtttttcttccaacccgtcactggtatccc

SEQ ID NO: 104808 - DNA, 943 bp, Oryza sativa
tatagtgattattgtcggttggcgcccatggttttttcccgcaagggttttccatgtaaaattcgtgtctccgttgtgcatctattttcataacggtgagtcaagtgagaggtcgatccagaggcagcgaaccaaatgggagtggatctggcggcaacgactttcacgtgtggcggtggcgggatggcagcagatggagcactggcgtcagcgccctactcccctcccctcccggatctggccggaggggaggaactaggcagtggtggctaccctactccctccccttgcctccctctttctgatttgcccggaggggaggtggccggtggcggcgcgacaacaatagatgggagagcggcggcggtccctccacttctctaccagatctggccaaaggggaggaggcgaacaatggtggcagcagtagagggagcagtggcagtggtggcgactggcaggtggctccgacggtagcaacagagaggtagctctggcggcagctcattctccaagatccccggcaagcttgtccatggctgctagggttgctagatgtgaaattttttatgtgtttgtttttcgggttctcttacagatgatttgatccatttgatgcacatttcgtgtttgatatgtggaaatggatagctgcatgcgtgttaatatttacaattttttttccccaaaatccatcttagcgtggtgaacatcgccttaggtagatgcctatatatgaaaaccattatcactggcagctgggctaggtttcccgctagtaaaaatgatctgccgttggtagttggcatccgctagtgaaaatagtgcatattcactggccattagtcactgacagcaacgccggccgcttgagaaaacttaaaatgaccgtcaggaaaattctattttatagttatgttttacaccactactagaaaaacgg

SEQ ID NO: 104809 - DNA, 951 bp, Oryza sativa
gatgggcaaaagcaaaaaatttcagaggatgatccgaaatgctttttgtccacagtacacccaagtttcaaggaaaactaccaagaacaatattgttgtgttatatcgttctaggttggatgagttgaaatgctcattcagtactgttagctttcctttttctgtgacatatgacatttggatatccaagcaccaaagaacctcttatcttagtgttgtacttgatgtactacaagaattcaatttagaatctagggtggtttctattactcttgacaatgcatcagcaaatacaacggccatgacgattttggagacaaatttgtaaagctacattggaggttatgttatccatcatagatgcatctgccacatcatcaacctgactgtgcaagcatgtattaggagtcgttgagaatttattgatttttttagtgtaaataatttatcaattttaatgcatctatgacaaggaatttattgtctatgcaggattactgttgttactaatttactcaacaagatccattaagctgtttttattgttggggatcagctagtgatgaaggagatgttccaagactattgccgagcaaagaataaacttgtgaggatgtttggcattgatgtgaaacataggtggaacacaacatacctcatgctacatcaactgaaagggtatgagaaaataatttctgttttcatcgattcattgcactttagaagtaatgatactgatgaggatggtgatggtgagattttgtttcttactaagggagaatgggacatagcaacacgtctgcatatatttctaaagcctttttataaaactacagtcctactatctagaatttactatcctacttctttgtaaggtgcttgaatgtatttggaaattgtcctttgtgtttcaagaaaaccgacatgacagagttttagcttatgttgttc

SEQ ID NO: 104810 - DNA, 1780 bp, Oryza sativa
cagtgtagaagcttagcttaattttatatgtggaaatggaaagtggaaatgaaaatgaccccttgatcatgagagtatgaaagatatctaacacaagtcacacaaatttgacaaagttcaatataatgtcaagcagtcatatgcatgataaggttgatcaatgatatacttacatatggccttggtaggtataagataaagtcaattggaggatggagcttttaaaacaattttatttttgaaaataaattcccaagagtcataacaaagttgcaaggattcctttcatcttaatcatctctcataaagcaatcatttagatgtataaggttccctaatcatggatggttgttcacaagcagaagttcagctgagaataatgaatatacaagatcggtcacatgaagaatttcattagttggaaattttatcttacacttatgctcgaaccagttgttttctgaattttcagctctagtactataccatggtggagatatatagataaagaacgtgctcacctgcttacctgtgaaaattgagagggattggggccagctttggttcggctgaacctggtggtttggccgaaccactctggtgcctgatccctctgcaattttctgcagagttcagtgccttccaggttgttggtatttcttaacaacattactagaaatataattctcagcaatggtgcagaaatacttttggtatattatggttacagagttcatccgcaagcgtacggatataccattttagcatttcacccgagagtattccaagggtatcgtatttattttatctcatgggaagataatgcagagagaactcaactaataatttatatattacttgtgataatcatattctaagaaggggttaagataatccagggtagagtgacacacaagcatttctactcatcctcataataaataatctaagctaggtggaaagaaaagagaaaagaaatctatccctatacttctaatatacatagtatacatacattctagttaactgatatactagctaataccctctatccgatgccctcctggtacttcgagaagccacccctgactgccgagttccatacgacagctcgtcatgaccatccaaccggggctaaatacagaggaataccctccccaggaaattaacttaggattatatataggcgcggaggaatatccgtactgagctgtcaccatcagcggcccacctctcatccgcaatatataaccccaaataatgatatcccgtaatctagacaccacgtctaaactaccagatactactctaatatcatcgtcatgacatagagtaattgcataagcaaacactatacccgcaccaaagcatctcccagataagctagccgtatattcagtataacaagaacataatgtaaagtaggtactcatatactcggaaagtatttcaataccataaatgtatatataagagtatactaataaaagtacaaagcttacaaaagaggaaaggaaagctactagagccatacccgaactctttcgaaggcttctggactcttgattcctattctaattctattccaccagctagatactaccaaactaaacttgagaggaatgagagagctcttgcttaaggtgtgtgttgaagtgaagcgagtgaactccttttatagctgaactatgatggttgtgacggttggaatggtcggtaataccctccaacagtcattggggcttcatctcaaccgtccagccaaaacctggatccaacg

SEQ ID NO: 104811 - DNA, 1267 bp, Oryza sativa
aagaaagttttcaaattgacgagtgagtcctcaagttcaattcacaatggaggtagatcagggtcggaaacaaatcaattgctaacatacaaaggagacacatatcacctatcaaggtgcacggtgcgtatattactaattactcctttagcatgttcatgaaaatttacctccgccctgtatgagttgtgcttaaacgaaaatttggtgaataataaaaaaaaattgaaaaaaatatgtttcagaataaaaggattgtctctcgaaaaataaaataaaacgatggcaaatttgtgggatccacgcttcttatgttttgaatccgatttctttttagcatggatgtgaacaattaatcttgaggctacaataaaatcatttcaaatcttcacagtgcttcgagtatttgttgtccactaaccttttgcaggaaataaaaagacgatcaaggagcagtgtacagtaacttcaacacttatatcacgctccttattgttggtattccttacgaccacagataaatccgcaagcgcacagaataccgctgtagcacttcaccttcgggtgaccccaaaaggatatcgaacgcagggaacgtatgtaatctacctaaggctaagactatccaaggccaacaactgatgataggtaggctaggctagagaggactttctatatttcttaattatctaagctaagcaaaggtaatttcctatctattgcttcgggcacaaacccctgctggtctgcaagcgtggttccgattatagctctatgatgtatccgaacgtggaggattactgggacggaatttagggctgtcaccacctgtcgcctacctctgacaaatacgtgggatacacaacaaacaaaggtaatctctaacctagacaccacgtctaagttactaattactactctaatactcgtacaggaacttccttctttatccagagtcctagtactagagcacttagcatgaatactaaacaatgaacccgcaaagatggaaatatatcttactcagactaaataattaaataacataagaaaagaacacgaatgcttactttatagaagaagttctccgaacccggagcagagtgtaccgacagctccggtactcctccagaattcctcttaggaagctacactcgtcgagggagaagtcggatgagcgccaaacttccgggcactcctccagagcttcccctcactctctactttattcgaatgtacaaaagatacaatagagcctcttataatt

SEQ ID NO: 104812 - DNA, 591 bp, Oryza sativa
ttatcgcagaagtgcttaacatggtacgttactgcgaaatgtataagtcgttactacgaaatttataggtcgttactacactttttgcagtaacatcatgacgaattacagtaacagagaacatatgctagtaacgggtactactacagtaccactgcttgtgcatagctaaatttttaaatctcaatcttgtgcaaagtacaagtgctaaaaagtacttctctttgtccatacaaagatacatagtagcaagcttagtacaagtaaacttttagaattctaatctttaaacaataatatctctcacatcgcaattattttttagaaccgttttcaccataatgctttaaaacaacgttacaacgagacaatagtcctgttactacacgatgatcgagacaataatgcttttataacgttgttactgtggaaagtagttgtgttactgcacattgatcatcgcgttctacgccgttctaaagagacgagaagttaaaacaagtaaatctcaatctttagagagcaatatgtctcacgttatatagaatttttctaatccatctgcaccatgatgttcgtaaaaaaatgctt

SEQ ID NO: 104813 - DNA, 1380 bp, Oryza sativa
ccataatataaaaggaaacgtaatacccaaggcatgatctgttacatattccatagatataagctatcccctatgactagtcggataaccatgtcgtgtgggtatggggtacccataatctccacagtagcccctgagaccttcatagtcgaaaagataatcttctctcgaactagattactctaaagccgagtgcttcattcatcttcaccatgatctcccgagtaatttaccaaatccgaagactgtggagggctgagaaataaagtcaggtgcatcgactagatgcacctaataggtgtagcccctgactatatggttagctgaacaaactaagcatatagtcaaggaataaataatccaaccaaccgagtggttttgataattgtaatcgaccaagtgacttgatatcaatatatagcatatgcggtgtgaatccccgaataacatgatccaagtgatataccgactgcttggtaaaaattgatgcgagcaacctaaagttgactaaatcattgaaaatacacatagcaaaacagctataaaaaagcttggatgctgtgaataaagaaattttcaaagtattaggcatacgccatgcgcacaccgctttaacagatgtgcttaagtccctaaaagacacatggttccaccacacctggaaatatatggcatatgtggtataaaatccgagtaaataaactcataaaggatttaacaaccgcctggaaaatgaccaaaatatataatcagcctaagccataatattggtcaataaaaatgcacacttacatggcaaaaagcaatgatattgtatccaatcaattgcttggtaaacccaaacagcaccatgactatataaaaaagtctgcgtggcagctatataaagatttactgttcgacaccttttaagatgcattgtaccaactcctaaaaagttgagtaactacggtataaaaggattttaaggtattgggcacttgatcacacgcactttggcctaagcaaaaagtgcctaagtccctaaaagaacgtgacaagccacacctgaaaatgtgggctgcagacatattaggcctaggccaaaaaatatgccttcgacaccctttaaaggatgacgcatgtaacatgctcccgagtaattaatcttccgggtgatatagaccaagtgtagctcatatgaatagcttctgatctgagtgattatcccttatgggatattccaaaatagatataataattgaatcccgactggcgcaagtattctgttgataacccttatggggaataataaatagtgcagtctttgagcatagaaaataaactcatgactataaatccatgttgaatgtatccgaaacaagtccaaattaaaggtat

SEQ ID NO: 104814 - DNA, 646 bp, Oryza sativa
taaaacatatatgaacccgcttaaaaacatattcatgtattttataaaaaaatagcttatacttaattaatcatgtgtgaataaacccatcctttctctatgcagagggaatgagttcccgaccgacagaatcgaacgcatccaaacataggtgcctgcacggatgcacccttacgttgacaaggcgtcggtacagtgcagatatatcatcacacaaagcgaggatcaatttatttgatgttcttcataccgggtcccaatagaggcgtttattctgttgagcctacatgacgtgatgaccttggcatactaaaaacactgcaattatttttgctgcaaattatttggctgcacaaaggtctagaaattaaactgagacccatcatttgcactgatggaatctcggcgccgagctagacaatactttcatcagactacatttcctaaggctctatatatatatatatatatatatatatatatgtatatatatatatagaatcacctgtcttgaaacgacataaacgtcgaccctgatgtatatgattacgagtgtttaacaccctatacaaactacatagatgggtacaacccgtctacagccactatatatatatataagaggtacatccttggtttttatatg

SEQ ID NO: 104815 - DNA, 672 bp, Oryza sativa
acaaacatcacatagaggcctgccggaaccatatgtgccgatttgcttaacatcggagcctattaggtgtttcctgcttaccgaatcttttttttttctcgaacactctccttaccaaatccatttgggcgggatgcaattaaggccctgtttgggacagcttaagattctgattctgagaatctgctggttggtagccaatttctagagaagcttggtttttcaacttttgggttataattcatttccagattaagtaactacagattcctagaatctaggtgataatctggactgtttggtggagctagagattctgagagaagctgcagtagctagaaactcccccaaacaaacccttcaatacaaaagtagtatttgggcgggataaaaattaagaacctgcctgtaagatcccctccccaacagtcctcaattctcaataagtttcggataatatgtaagaatcggcacctagaacaaaactcctaataggtaccggctcataggtgccagctcatttaaagccggcacctattgatcatttcccacctccgcgggatggaaaaaaatatagaactagctccatggagcagatacagatgcttattctaaataaaaaccagtacctatagtatgagcgactacccgacgcctaccttatctacttga

SEQ ID NO: 104816 - DNA, 754 bp, Oryza sativa
catcattacaatctggcaggtgaagcgtgcacagggccgccaatgaaaaaaaaatggtgccgctatgaaaaatcgatttttagtagtgaaaggttccaagcacagttccatggcaaaagatttggtgatgcagaatatttcttatataaaacaatttaactctctggaagttccatgcatcaaatcttttctacccactaacatgcaaaatagtttgcatattgtcgtaaaaagatgttttcaagcatgcaaacgttaattatattgattaaaaatagaaaatatttgttatactacatgaatctgcccaaccaaacagcccataactaatctaacaacattggagaagcgatcatgaggctcaatctgctgatgttccaatctaaacggactactccctccatctacttttgatagttatatttccaaatctgaaaaatttatttatgataggcatatttcaatccaacaacctatcatcttaatgattttctcggatttaacatgtgactcttcattcttccacacatgattggctacatggacattgagaaatgtaaatattaatgaatcgcttgtttacgaggaatgactagtagcatgtttaaatagatgataagtagaattacttatccttgttctgtgtgccaagatgaaatatgaccatcaaaagtagatggagggagtactacaaaacccctgataggtactgattcatttaaaacaggtgggatggaacagtatagaaccggaa

SEQ ID NO: 104817 - DNA, 723 bp, Oryza sativa
cgccgatgaaccattcgaacttgcgaaacaattcgagcagatattctacataaacgatccttcaaacaagaagatgcacatcgtaagggatggcaagcgccgaattgtcggagttgacaacgtcgttgatgaagaagaatacaaccagaatcttcttgtaagacctcatatcgaccttaacgaagatccccaagaggctgtggaatatgctcgttcagatcaaacgtaaggcataaccttgtgaccgatgcctttgtacttatctattgtaatgaatggagtattttgttttattagaaagacttgatatgtgtaatcatttatatggccaatttagttgattattttgactaatatgatgaattattatactgtagtgaattattttgctacaggtgaagtaacaaatataaacatctcatatgaaaaatggaaaaatagtcaagcgggacgggctttggttaagctccgatagagacaaagtcatcacaaacgggcattcgtaaatcccgtaagtcatgagtcatctcaatcgggcattagcatagagcccgtcacgacatttacgtccgtcactgatgactcatctatgacgggcgttaaactaatgcccgattgagataaattaatctctatcgggctataactaacgccagtcacagatgacatttttttccatttttcgaatgaagtctttatattagttagtgccaaatgattagc

SEQ ID NO: 104818 - DNA, 645 bp, Oryza sativa
ttgtatatgcatgtatttctgtcatttttgcagtgggcatggctagcaaaggctagaggctagccaaaaaacaaaatttattttttgtgaattatactcatatgtgactggccataacttagtgccagattgagatgagggtcatctatgacgggatgtagttaatgcctgattgagatgatggtcatctgtggcgggctatagtttaggcccaattgagatgagtatcatatgtgacgtgctctagtttaggcccgattgagattagtagtcatctgtggcgggtgctatttgtggcccaattgagatagatcatccgtgacgggctatagtttaactggtagtctgggtcaaagctatcggtgacgggttttaattagggcccaattgagataggttcatccgtgacggccgtttgtccgattgagataactgttcacatctgtgacttctagcctctaacggacgccgtgcccgattgagatggggcttaccgcccgattgatatgatggtatccgttctagtgtgttaccgattttgtttgggaaaaaagatttcatagccaaagtgttgaaaggcttgaagagctcatattaagaaaactgagattgccgcagccatccatcaaatttgagatccaatag

SEQ ID NO: 104819 - DNA, 663 bp, Oryza sativa
cgcattctaaaagaggtatggaataatggcacaaccaaacaatggcagatgtctaattctttggcccccactggcattagccatgcagcatttgatggccctttatgggcactggtacacaacaagagatgccgctgccagatactagaaacggcgcgctgcatgtggcgcagggatggagtaggagttgacacagagatatccatggaggttagggattccaggtttagtccaccaaccggacgtgatatggatttgccgataaaaacaaatagtacagaccaaatgtgcacgatagaagacagggtgcatatgggagagtaaacattgatagatattttggagctgataatccatcgttactgtcgaggtgcttatttaaaatgattgataatgcgtttacagacagccatgcattatgcatacagctaatgctatcacagttggtttgtgtctaagttttacgaagttatacataagggagcagaagaatcagtgcatcgttcgagtcagataccgtgagacaatctgatgatgagggtcctcaactcttggaacaagatgatacattaccaacatgaacatgagattaacttcaagagacatctcgaatcattgggttgaacgagtatctatgcgtgataagattcttacatggcacat

SEQ ID NO: 104820 - DNA, 980 bp, Oryza sativa
gtcaaacatgtgagaaaaagtcaacggcgtcatttattaaaaaatggagggagtataatgtaggaggatggataatacttgcctatgtgggaagaaaggatgattgatcacgcttgtcttaaaaaatatagtagccaagtccttcaccttctttttgagaacaaaatagcagtcataattagtgatactggcgaaagggtctgtaacctattggttacaagagcctcagtagtacctgagatcctccccatggaagcgaattttctaggatttaacggcattgtgctttcagtggtaggcgacgtacccgtcgacagcgaggcgcctatggtgactttgtcaatctctccaggatttaccggcccagtattcgaagatactcataggggtagggtttgcatgtgtgtgttcataggggtgagtgcgcgtgcgttgtaagtgtgtgcgttgtactgtgtaattctaaaaaaaataattagtgatactgaatatagaatatgttctacatctttttttggctgtaaaagtgacaaattctccaattagtagttttttcatgcctactaagctatgctaatttgtcgcaattccattttaaatcactattacataaatcgattttgatagacaagaccctctccaggctgaagatggctgtaactgcatctgcatgcaaaaatggctctgttggatcggttcaaggctgcatgtgaaaatacattatcccaaacagccacttaagaggtctgcctccaagtcctaccgttctctcgtccttctcagcatgcatcttcaaaattttccaagtcctaattattatctcctcaccttctctctcaccccaatcctctcctcatctttatctctctcatctcccctctctcatttctcacctcctctctctcccttgtctacacctcccaagttgcagcctgctagcgggcgggtgcgggcagcggtgggctctagtgggagcgcgc

SEQ ID NO: 104821 - DNA, 982 bp, Oryza sativa
cagccccctaaaagttaaggccgcctcaactctacaactgaaatcacatttgccatttccatttaaagaatcctgttcatattttgttcgcttctctatctctacttctgatttatattcatgctcgaaattgaattgatagaagcaatttctattgatgttttcattgagcatcgatctgttatgcagaatctgcttcaaaatccctcgccaaggttaacaatttcagaaagctaaatttttttaagggaccactaaacctgaaataacccagcccctcagcggagctcatgtcagaaactttttgacgtatcaagaatattaatttgcatattcaacgactggacattctttggattaacctgtcctagccgatgaccattagcaagaacaatataagggcacattcaacggtttagcctgctatggactcttaaataggccatgtcagaaaaaaaaaacaattgttctacaaaggctggttttatgatcgtctctccactaatatgcagtaatatataattaaattcttgtagcaatggtgctgtgattttctgcattttggatctaaatacgtgacttttcttgaagatggaatatacaacggccgttgcttatcgtctgctcgtgttttcctcgttgtgagggccgatggcatgcaaaagatggatgcatctcccttctttttttctctctcatccacatcatcaaatctgcttacatggcaacaaatagagcccactaattaatactctctccttcccaaattaatcattagagcaagtttaatagtatagccaactactagctccaaatcatctatagccgatttaatagccaattcatacaatatttacccagaaaacctacaccacggcatcccgtggagacgggatcccctcctcctaccttactcctctccccaaaatcatccgaatcctctcctcctacctcactcctctcccccaaatacacgggactg

SEQ ID NO: 104822 - DNA, 1661 bp, Oryza sativa
tcgtcgcctcggggagggcagaagcgggagctccccttgtcctcgccctcggcctcggcgtcaccgtcgtccccgcttttgcacctccaggatggacgccggcagcctgcgtcgacctgcaacaggtatggccgtcaacctcctcctcggctcctcctcaagacttctcaaactctctggctcgggcctcgaccctcacctcgtcgtgcctcctcgacgtcatcctccgcagttgcggccctccctccctgacgtctcctcctctttttgacagtaccctctgataccccataagtaccaggctttataccttggtaccaaggtttgatacctaggtatcacctggtaccttaggtactgggcatcaggtatcggtcgatacctagtcggtaccaaaggtaccaggtaccaggtacgaaccggtacctaaggtaccaggtactaggggagcacacgtccctcaccttgccgtgcctcctcgacgccatcctccgccgttgcggcgctccctcccccacgtctcctcctcttttttgatggtaccctttgataccccacaagtatcaggcttgataccttggtaccaaggtctgatacctaggtaccacctggtaccttgggtaccgggcatcaggtatcggtcgatacctagtcgataccaaaggtactagttaccagataccgaccggtacctaaggtaccaggtatcaggtaccaggtactaggggagcacacgtggacagaggaaacgaaaagggagagtcagttaaaatatcccgttgcaacggtatcccgttgtgtagctgccctcatatttacctataaacatatactacactagtaatacttgatcccaactgtcatacatacattttgtcttatggtctgtgctgtagcttgctacaaatctgtagaccgctgctcttttctatcatcatttatcttcttgatatgtatttatagctggcttatagcctgctattgtacttgtcttatataagtttaagcaccaaaaccaaagacaatttaaatcacatcaatcaagacaacatgcacacattctcccacaatgcatgcattgattaaaaccccataccaattacaccctagcattgtcgcgcccagggattcgacaacccgaatcaccggctatctgtggatttaacctctgtctaggcatcaaccagagtacatagatgacaatttgacacagatccacgtcttacaaaaataacacaataaaacccatatgcagcggaaaaactagagaactaaacttaatcttcacagcaacgcgaagcttcctccataactccataggcaaactcttgatggctggcacaagcctaatcttcatagaactcaccatctgaaccaacttctgcttctgggagattgggaaaaagaagcaagactgagtacaaccaccataatcaacaagtcataccaaggggaaggtatgatgcaagggtaatcaaaggattggctcaaaggatattttgcagtaaaaacagcatttgtaaattataagttgaaagcaataaaacagtatataattaagtagtattaaccatcatcgcagtacaacgctaaatccacgttgaaataggcccaacccaaaaccacccgaactacaccagttcattaagacaaattattaa

SEQ ID NO: 104823 - DNA, 651 bp, Oryza sativa
cctctctcccttctcctttccccatctggccacgccgaggtaggccttctttctactactactcccgctaggactgctactttcctaatcgagtactcccctttgtaaggttccttctccagtttacgcttcttccgattcctagctttagacccaccctgcaccccgccgccgcctataccctgctccgccaccgtcgtctttaccatcaacgtacccaccgagtgccttcagtaccttaactcccagtttctttaatgtattcgctcctacaatcatcaatctaacaacctaagttgttcccctattagactccttctagcgtagtcgtcgatcccgggagttgccaccttaaccaccgccgctgatgctgacatctctccctgatttatgctccccgataataaatctctcctgttattaaggctctcttatcatgtgccgtatattagtacaagtcgtcactatgtcgttgccttagccgcccgcttgcaccgcctccgtcaggtcatgccctcctcacccacccttgctatatcatgcctacaccacttatgagccgtgcctacatttttgcgcccttttttcacaaccctgctgccgcttaatccatacccgttctttaaccccactagcctcggtatcacagcc

SEQ ID NO: 104824 - DNA, 533 bp, Oryza sativa
gggtctataattaccccccacctaacccttttctagggttacccaactcatttcattctcattcactttgggttgagcttggtgctaaggtgctttggatctttgagctctctctccatctctcaaatccctccttgttctttgtgtggtggatcttggtggttgtggatttggtgtttgagggcctagtgtgtgtttcactcgatcttgagcactaaggtttgaccaagagttgtgtggtgtttgttactcttggaggttgagaactcctagacggctaggtgtcactcccgagccaccgatctacgtgtggttggctgggagaagtttgtgaaggccggatctcacctccacaaggaaagagataccccttagtggaaggaggagtgcttagtgcaacctcttgaggaaagggttagcaaagacccggctcatagtgagctcctcaacggagagtagaatccctcaaggatttgaactccgggaataacttcgtgaacttcatcattggtgatcacccttcatcctccttt

SEQ ID NO: 104825 - DNA, 873 bp, Oryza sativa
ctaatgatggttgttaagttggtttcactcataaccggcatctggaaccaatgaggaagctccacgcggcggatgagagctaggggcccacatgtgtggttcaactgaaccacttccaccgcctccggtcacgttcttttgtgaggctcatatgtgggccctcatgatggtgcatggtgaattggccaaaattgtatcagtttgttatgatttgtgggcccttcagtccgtatgatcgtgtttgtttggatgtgtgtctctttgcatggcgggtgtgtgcaaatggtttgtaataaaccctaccactatgtccggtgtttctttttcttcctttccttacgctcgtcggcatagtggaggtgacgggaagagaagaaaggagaggagaagtaaaggaacaaggtgaagtagtgtcacgcccagaaattcccgaatagaatttcaagcagaatgtgcattaaaatccccgtccaggaccggccggggtacacaaacgacaatgttgacattcagatccacgtcttacaaacatcataaaagtcttacataaatgcagcggaagaaaaaaaaagacaacaggagctaagccttgactaaaactgcagcgggaacaccactccacaggcatcctcgacggcacggacaaagcctactcctcggagaaaccttcatctgacccgaactcgaactctggggttgggaaaagtagagcaagactgagtactacccactgtactcagcaagtcataccggaataggggtatgatgcagggaatcatcaaagaagagctgaagtggttcatttgcataaagcgagcatttataaacagaaattgaaagatttaaacagttgtaataattaattaatattaa

SEQ ID NO: 104826 - DNA, 614 bp, Oryza sativa
tggatcccccagttttaaaagagggaaaatctagggccaacaaaaggaagtgtacaactgaaggagtatcaggagttgctgctactacttcaaagaacagagctcccaggaagaaagctactgctacaaacaagtgatatgtgttagaccatatgtttgatggtcctttagtgctagtagtactttgttatgccaaaatttgaaccctgtatggatttcatgggcatgcttgcttgattttgtgttgccaaacttgtggctattttgtgatagaacatgggaattttgtgatgccagacatgtgttcactgaatgtagtactagaaatactactaaatgccagaaatttggtattgtgatgaatatgggaaattactgcctgtaatgcatgatgcatgtttgctatttccagatgacattttacaggacatttcataagctagaacaaaataacagttgtctgctgaaaaaaaaatagagatgtcgattttcagaacaaaatctcatatttcagcttcacataatagcatttagcatacatttttcatacatggttcagattcagcatacacaaaagatcactcaagtgccttattagctgacacaaaacacac

SEQ ID NO: 104827 - DNA, 727 bp, Oryza sativa
tacttctactgaaggaaacaccatgccaaccttaaaaactaggttcttaacatcctctgccatgaaagccttaaactttaatctcacttcaccatcatcatctgaatctgggagctgcaaatcttcatcatcagtggaaacttcctccacatcagaatttctaactactatttcttttcccttcaactaactgcccttagctttcttccaaaactttgccttgcagtcagataagtcttcaacacccacatcaacattgtcaacatacaagtcatcatctgcatctgatatatcagtcactatccataaaatatgggtcatcttctaagctaccatcactgtcactgtcatcttgtttgtttggcaccttcctatcagcagttgacatcttcctaggactaagcaccttaggcaattcactaataggattagctactacatcatcccaatctacacctgcaattgtgtcaccctgatcaaaatagataataaaattcttaaccttgtgcacaactgatttcatcacttcaaagtcagccctagtagatataaccctaaggccatcttcaagagtttttccagggagcaaccaataagccttaaaatctggattcatatcatacccaagcatagctaaaaattcatcaaaacaaacaatatcccatgttcttgcttcacagtggtcaatccaatttatcgttcgatctacatatgccctgttgctacc

SEQ ID NO: 104828 - DNA, 1911 bp, Oryza sativa
aaagtagcatttcatcctgtagacagagcgccagggaaggcctcccgggcggcgccgaaggcctcgccaggcgacgtcgcctcttcctccactggcctgctgccctatcctcctccccccgtcatcctcgccagccgccgccgcccggcgaggcctctggcgccacccgggcagccctccacggcgctcccctgatctcctctctctctccaaggatattttgggcacaaaaatcttcaaagtagcatttcatcctatacacaatgtattgtatctggtgcatgtattgagtggtattttatcccagcccaacctgtacagtggcatattgtccgttttctcactattagctcactattgtttatgctcttaccacttaaatactggggattcactgttatttcttgtcgtgtaaaagaatgggatgcccatattatgtgtatctataataataattgatagtaatactgatgctagtagatagatagatagatcgatcgatcgatcataaagccaaaatgtaaaatcaatattggtgtgcaacatttcttttatactacattaattaaagaaaggcaaaatacaatgccaatccttaaactaatcatagaatgtcatctagacccataacttaacaaaagctcatatagagcctattattttggcttaatgtaccacgtgagatcggtcaattagatgggccataaagctaacatgaccatccataatgatgggaccttatcatttaaccccttaatttccactacagtaacctctaaattaattgctcggctcaaaagggaaggaagagtatagaccgggtcattcgtatgtgcacaaacttaacgtctccctatcgcgtcatatatctcgctatggggacctttaatttgattgtggatgatcaatgtcgccctaatatatagctacttcttcgcctgctctcctattcaagtggtggcatgctgaattatgagagccgattttgatattattgtaacgaaaggggctgcataagaaacttcacccacggtagatggccacgtcagtacatagtttacaaaaccatgcggttactatgcagttatagcggttaccatgcacggtaactttttcagtttttaaaccacggtacgtctcgtggtttctcggtaatcgcgcggttaccgtagtaatcaccttatcgtgggggtgcggtaaccgcgcaaaaagaataaggggaaccctggtcagtactctagtcccgcaagcagcactttggacttgacgtggtatattaaacaaagattatgtatctaagatgtatgttatctaagtttatgaaactagatgacatcttaggataagtttaattaagggcaagcaatctattttactcataaaaaatcatggatttatgtaatcatttgtaaaaggacaatcatctccctctccttcagtctccccaattcaaaacagtattaaatggacatgttggtggttgcacttgttaatgttcttgttagctatcttgctctggagcataaattcgctgagtcttaggggttgtttagattgtagcaaaaataaacatttatcaaattttaaagattttagcaatattgtcaatttttagcataattttttatgtatttatcaaagtttaataaaaactaaatggattattttaccaaaaaataatatggtttaaaatgatatcaatctatacaaactagattaatttgtttgtactgcagctaatatggaccaaatatcaccaaagatgcgtaccaccccactttaaggcctcattgacaggcttaaatttctcggcccatccatcacactgggctttccctggaggccgagttacgaaaatttcaaagcagtgggctttcgatataaacattcgcgaacgcagggggatccact

SEQ ID NO: 104829 - DNA, 1050 bp, Oryza sativa
catgactcgtgaacttccaggtaatttcatcattctcgtgttgagagttttatatgtaaagttgaaagtttaggatttgagttggaagtttgaaaagttgaacagaaattttaattttttagttaaaagtatttagagattaaaaatcaagactccacatcttcgtttggtacacttttagcctcacaaaagcctagcgggccacgtgagaaaccagcctatgcttgtgggctcatgcgcgagcgacttctttaagttgcatgtctgtgcgaaaacgactcctctcgccactattttatacgtaaaatctaattcgagagcccctctcgttttagcgctattgcgcgatgctggcagagccgtccgatctccaaccacacgcacacgcaattcctgcttcaaagagagtcacagagagaaaggctacagttttctctcccatgtcatttttctcttcaaacaaagttttctctcaaattatttatccgatctacaatttgattacaccattgtgtttgttataattaaatcttcacaacaagatcttacatgattatattacgatgaaaaaatatttatatttgtaaattacttttattatatacgtaagttacttttatcatatatataagttacttatagatttcactaaattacttcttagacatataaaagtaaattcaataaagtctgcaagtaatttacatatattataaaagtaacttaaaacaaaacgtaagtaactttgtcacgacattagaagtaaattcgttgtagggataaaaatatactttatctagaaattaaatttaatcagcacagatcaacacacgtaagtttaacaatttttaaaagtaacttcaatgttaattggaagtaacttttgcatggttcaagttgaaaggagatgctagatagagtacaaactagctaccactagctgtgtagtcacgtccaatgaaaaaaatgtattaattagagttactttctttttgttataagttacttctataatatatgtaaattacttttaggctttatgggggatcc

SEQ ID NO: 104830 - DNA, 1071 bp, Oryza sativa
gtaagaattataaaaaaccatttaaatggctcaaaacttctaaaattcataactaattcatacgaactccaaaatgagccattcaacttgcaaaattcatctaaaattgagctctacatgtttgtttactttttatgtactgtttacttcatgttcattagggtttttcctcgtttgtgtgccggcgagtagatttcgccgtttcggaagtccgcggtcgcgaggaaaagaatccctagttctacttggacaagggaacatctatgggtataaatacaagaccccctagaaggcaaaggggcacgaaacagtcaaaatagacaccaatacccaccgccaaacatcgatatcagagataagcctaaacatacccaatttgtcgcctacggaggccgacaagagggatctagcgctatctctgatctcgccaagtccatattcgaggaggaagactaccccatcgtcgactacgcgttagtgttcatgccgccaagtcaatgacggctagatgggttatccaaatattgtacttgtgtgattcttttgaataagagcaacaccggcttcagccaataggagtagggctatttatctgattctgatgaataagaggcccgaacctgtacaaaaatatttgtctccgtctcttttatttcaatctcgcatataccggaggatcttgtaccaagatcccccgtaattttgctggtttctataatggtcacccataatttggcctaacttaggtggtgaaggtgaagatgatggtgcagttcatggaagtggacggctgtaggatctttggtttgcagaggtgttcaagggtcagctatgcatctgcactcctttcaccaatgtcttaactcctttcaccaatgtcttaacgtattaagcacatactaccatataagtattattagtgttgggatacgcgtaggctacgatagcataaatcaaaattttctatcgcgtaaactaggaaccatgcaagtattagatcatagatcgttaccactcgacgcgttgcgcagtggaataaggcgctaagaagtcgaaggaattctcgcgaag

SEQ ID NO: 104831 - DNA, 1631 bp, Oryza sativa
caagtgaataatcttcctaaaattattttaaaaatatctataaaataaaattcaaaattggtttcttccatttatctgttgggcggggtttacaaaaccgtatggttatcacgtgcaataaccttatcaatttttaaaactacgatataccttgcagttttcgcggtaaccgccaaaccgtggggtggcggtaaccccactccaaacggtttggtgaatcctgctgctggccctagaatcctcctgaaccatctagagctctgtatctgcttgtttcttcttcctcaatttctctgcccgtgtctgataatggcatctagctagagagagaattgggtttgatacttgatcgatcaagtttggccttccttggtaaagttagatgcccctaattgatgcaagcatgtatgtaaccactaattaacaaaagagttacaaaagcatttacatttaacttgagcaaaacccaagacaaatgagatcataagtacttctactagatttctaaatcataaaaatattttgtcctctttatattagcagtcaaatgtagccttttctgccttcaatttgaaagggctgaagcgtttcgattcattttctttctgaatattgggatacttaacttggagtaattttaccatcttcgagaaggtactaggaggttactttctcatttaacttaaggttctttcttgtatagtaaagcttggtgaatgaaatttgagaaggcatcaattaggagatggaggacaaaatgatgccttgtgcagaggagatgacgaatgcctctctctctaacctaatgatgctctctttgctgcagctgctggcttgggcaaagcttgctcgctttgctacctgctgcatgccctgcctccttgctctccgatcacccaaccgctccatgcacaaacctgcaaaacacctctctctctagatgtgtccctgtgtactggaccagccatgttgcttgcaagcaatgctgctgctgacaaattgggatcacaaggaaaagaattagtatattctagctagctagctgctgcatcagatattcagagatggtgagtgaatggtatcaatgccctttcagtgtcttgcatggtgtgctgcctgcagaaaaggatagcttgttgctagcagggcacacaattgtaaaggtatgcaacaacaaggtgctgcacatcatgccatttccctggcatgtggatgctgctaattgcctgacaagaattgggccaaacagcttttagctttcaagggagagagatcggtcgatcgatgagcgtgtcaacaaacgcactcgatcgatcatcagatggtccaattgacagatatatgttcaggcaacggtggacatgctgtgtgtgtcgatcgatcgtacgtccttcagatcgaaatgcatgaataattccttattcctgtcctaatttcagatgagagatgctgcaggtaacgttaactatgcaagctactagctacctgcaaatctgcaacttgctgccttcagaaaagttcagcgaataagccactacaaagttcagagatcaagcagctgacggtgtgagcacaatgcctgacgtaggatcaagctggctacgcatgtctagctcaaaagcttgggggat

SEQ ID NO: 104832 - DNA, 877 bp, Oryza sativa
taaaaatgatctttagtcccggttggtgttaccaaccggggctaaagatcaaaaagtttttaaccaggactaaaaataatctttagtcccggttcctattcgaatcgggactattgtggattttgggcgaccgagcaaagatgatttctccaccagtgtgtttgcattcaaaattaataaaagtatgagactaaattcagtgcacccggaattttggccttcctgaaattcaaaaccctagtgacatataatagtactacaaagcaatgactcgcttcacaaagagcttacaaattcatgggatcaaatctcttaaatgcaagagagaagtgaatactcaataatactgaatgtaacatccatattatcgatcaaataacaagcgcgacggtaggggataaatcagatgatactacagttgcctactgatttaattgcactaatttgatttaattgcattacttaccactaataataaattagtggagtagtagatattgcaaagctctaagggaattttgcacaatatagaaaatcaaacaactaacaaaggttaacccacgacaatgtctaaaagggaagaaaacaaacttgcatgataatatattgtagaacctgtgtctctcatcaatggcggcaaaccatagaattttctcttaattaattatatatgtacaatgttgaacaaaataatattgaaggtccattaactaacttgttagagtttcataattctagacaaagtatggtgttgcatgctatttttttaaaaaaataatccaatttcagggatgataatagtctttaacacggcaaattgcaacattaattgtaggcaaattcctgagaaaaggcacatcatattcaagagttgtca

SEQ ID NO: 104833 - DNA, 1424 bp, Oryza sativa
tactcccttcattttttagatgtttcctttttcagatgtttcctaatataaggcatacatgaatacatgctattaactagcacttctttctcactaaattattatttttttcaatgctctatccttaagatctttaattttattgggtgcatgcattatactccctccgtattttaatgtatgacgtcgttgaatttttgaccaacgtttgaccattcgttttattcaaaatttatgtgaaaatatgaaaatatttatgtcatgcttaaagaacatttgatgatgaatcaagtcacaataaaataaataataattacgtaatttttttaataagacgaatggtcaaacgttggacgaaaagtcaacggcgtcatatattaaaatatggaggtagcatatttattagggtgatccaaactatgaggtgataataactactctctctgtcccagaatatagggatttttagggccggatacgggtattaagaaagtaggcagaattaaatgggagaaggttgtgattggttgagaagtggaggtaggtgagaaaattgaatggtgaagggttgtgattgattgagaagagaacgttggtgaagaagttattatgttttggggcaaaacttgaatgctagaagtcgttatattttgggatagaaggagtatttcttggcctttatgggttaagtgtggttgcgccttatattttggaatgtagggagtaccataaagtaagacatcatttattacttattcacagctttaatagtacattgtggatatccttagagcgggtacaataagctgactaggcgggctccaaaattatgcactacagcatattcctacgtggagggaagagaactgatgggagagaaggaaatggatgacaaatttgtcgccgggcgatatctctcttctcaacgtgactgcagtccaactcgactattaaaaacacgcttggtaggtcccacacaccacaaccaatccccttccccaccgagcgagatcgatctctctttccccctccaccccagccgagcccgctcgatctccgcccgcccctcccgtgcgatcttgtgcgctcgactcccacgcgtgatttccgcctctccctcgcgcgcacaatctacctcctctctacttactacttcatccacgagcgtgaaaataaatttacatcttcctattttgccggccccaaaaatccggtggattgacgatgccgcctccactatccgccttccctcttctacctcgcttaatcgctcaccgaaaaccctagttctttaccaccaaggcactaacaaccttgtctcgccagaggaagagagaggttgcgccacctccatgtaccatcgcgagcttttcttaaactcccggtgtttcaaaaattgtgatatatgtgcccatatgcaataa

SEQ ID NO: 104834 - DNA, 522 bp, Oryza sativa
ttcgaatgggcaaagaaagagaacaccaatattcacgatgtgtacacatttgcgtaatgatcgaccttattatagttcaacgaaaatgagatttcctaccctctttcgtacttaatatagcaatgcagtattgaatatgatatatattaagtactacaaagttaggctcccatcggatggcctattcagccaaagaaaaagccaaaatttgaattttcaaacttaattttgatattgattttgagatattttcaacgtagtttttttttcagcattgacttttaagtcaccgagaacacatatataaaaattttactaacaaattcatttttattctctaataagccgttttggcttattacgaaaaaagccaaacgatgaggccctcaccgtattatagaatgaagggagtagctgatataagaaacaaatgacattttattctaccagagcgaaattgagaagggattgagacacacatcatcactacgatcgcttgggagtgaaggagcggaaccacca

SEQ ID NO: 104835 - DNA, 1037 bp, Oryza sativa
cagctggcaaatgtcagatcgtgaaatgaggttttgcaaagggtaggaatgtcaaaactatagctttcgcgtttatttcggttattagagcacccgcaatggtaaagtagggtgctctctataaaacatgtacatctcagcaatagactagattaatagtaaaccacctcaatagtatgtctacacaggtatctatagctctctcatgcattgcctcgtttttctctatagactatctctaatctagtagatagctttgctctctctcttcatttaatatcttccaagtaggaaaatatgctgacatggatctcttgtagatagcttatagataaccattgtgggtgcccttagtagtacttcctctctcttaaaatatacttatatcactaatcaattagtagatactaatcagtaatacaattctgaaaatttttaaactcatagtactataatcaagtattgatcattatatcttaaaactattttaaaacgaaagaagtaaagatatacataagtgcagtagcaaggacgtgtgttattcaactaactaatgaacgctctctagtttttaagttcgggcttttaaaagaaatgtttgtccctccattttctcataatcgaccctagcaccattcaaacctatttttttaagcatttattttatttgtggaaattttataaatacttaaaaatatattatatttgtcaaagtatatagctcaaaacggtaaaatatgttatattgtcaaaaaaattgttaacattcacgttaacaattaacatatgatacaacgtttgcatcataccgtcagattctttcccaaaaaggaaggggaaaaggttaattaagatgatttttttagatgaaaagatgatagttgtattttaaccaccaccactacaagatcgttgggaaaaaaagcacggcgtgaagccgtgatacgaaggaccattgtaatttacatcgaccccatgacattgttttgccagctgagaaaccaccaaaattcgacggtcgcttctcccgtcccaaa

SEQ ID NO: 104836 - DNA, 583 bp, Oryza sativa
ggatccccccattttttatctttaaccttaatcattcattcttcctattccatttaatcataatcattcattaatttttcaatcccaatcccacctctcatttcccattatccaaatactccatccgtttcaaaatgtttgacatcgttgactttttagtacgtgtttgaccattcgtcttatttaaaaaatttaagtaattatttattcttttcatatcatttgaatcattgttaaatatacttttatgtacacatatagttttacatatttcataaatttttttaataagacgaacggtcaaacttgctataagaagtcaacggtgtcaaacattttgaaatggagggagtatatcctaagctctacagcatcaccaaaatatggtgattcctcaaagaaaaataggaagacacggtaattaaataaagcagagtacgtacctggaagagcagtgagttgagatggagggaaggcacgatccaataaatccatggatagcggaatgtgaaaaacgcgaatattagggaatgactaatatcaaatgattataagggggtgaggcttcgaacctatgtcgtct

SEQ ID NO: 104837 - DNA, 1192 bp, Oryza sativa
ccaggttccaactgaagtcatgctttgtggtatgcatctcttgtttttaatctgtctgttgttggatataattcagcagattaacttggctctttaagtcagagctgtaaacataaagtcatgagtggatgtgaaacctggctcctctaactgctaggaaagagtacacaaaacagagttaaatatgccatttttatacagttcttttttgacttgtatctttattgacagttgttgttcaagcataatactgaagcttgcagcttgtcctagggatgttattgtcttaattctctcccattgtaacctttacaggtcatagcatggtcataagacaagatagcactcgcttcaatatccattgccccaaacttgtcatcttcaataagccatttacacaaactgtgtttttgttaacattgttgtcttggggttttacttatcaaagaaatagcagaaaatatttaatatcacttctcggtcccaatgaactatcacacattggatatgattttaattgaagctttactatggttctttcaccttgctcatgaatccatcatgtagtgatttatctgcattttgctgacgagcagtgctatgtttacttacaaaattcttactaacaaagttctcaaccatttgattcaagtagcaggaagttatagaaaagctagattcagtcatggtatgccacatcaccgttagtaagtttgtaacaattattttgtacgtgtagccttttcctttgctgaattacttcaaactatttaagaaggtttacagtttacaccagttgggatagtatttcatggacaggtttcacctttagattataaacagtggttacctttgttctgttgtggttgaaattttacctgccaaacactttgtgagcatcagaacaaaaatttatatctcgatttgctcatatgattctgtacatgttcacaatgtttctgaatatttatccggtgcaatagatgaatttattcatgtacggtactcaataatatctggataccacactgttgaatacttgaatggcctaggaatttgaactggtaagatcaaattatggcaaatgctctgatgcactatggttatcatagatggattatcgttagtcatcttgcttcatcaggcaaaagcatccatagtctgagttgtttctgaaattttttttgaaggg

SEQ ID NO: 104838 - DNA, 1708 bp, Oryza sativa
tttctaccataattgaatatatgtgccttttatgggtaagaatattcttatagcttctgatttctcttgaatatatcattgaaatctggtaatcagctatcaggggatgagctaaagattgtactggtggatgtgaatggtgatcacatatttttggagtcatccgtatgtaactacagtgttgcatattgtagaaggagctatgctttaccttccatttaaaaaggaaaattctggggtcaccctcacccatatagaactatagcatgtttactctataatactgatacaacaacatctactatataaagtttgaaagtttttaaagtataacaaatgattcgcttagctattttaagctccgaagttactcatttctgtaagaaagctgacgaatttatgacatcataaattggccaaactagttcatgctcttgtcttttcagaattaactagctttcttcacgtcgtacatgcctgcaaaaatagaggctgtgatgtgggggtagcattgtagcaaccatgcacgacaatctcatatttcttttatttttcctgtgactgttcttgtgcatctgcaattcacaccatgagctttgttggtaaagattacatgaataatactccctctgtttctttttatataacgttggttagttcaatcatatattttgggatggaggggggtattcatttggattatattgtatccagtaacctttcatgtgtagtcttttctgattgcttttatttatgggttacgttaaaggatggacacgaatattcgtttcatcatgcactacactgaactaattacagagagctttaacatgcattcttgattctagtgaccttcagaaagatggattctagtgaaagaacctttctttcctttggggttacccacaagtagttgtcaaattgctagaatttcgaattgccatatatgtgttgtgcgttaatgttgttacatatcccagttttgctggtttctgtgatggactgatggtcttccataatttggcctaactctccagtaatggcaggtggaggtggtgaaggtgaagatgctggtgcagttcatggaagtggacggctgtaggatctttggtttgcagaggtgttcaaggatcagctatgcatctgcactgctttcaccaatgtctaacgtattaagcacatactaccatataagtattattagctattctaacttatgttagatcacgcatgtttcagtcgtaaaaggccaatgtgtcagttgctctatgtttgagattacagctaatactccattgagcatatatttgctttatgcgaagatattatcagattatctttatgctccgtagttcttctgtaaacagaagatgatcttattctgtttgttctgtgataatccagcagctgctctagcctgtaggctcttctcagaagtagcagttaatatcttaaatggaaaattgatgattttctccatagttgcatgtgcttctacattttgtccaaagatattttttcttgatcttctgtaaacagatttgggacaaaaaacatgaagtacagtctgtacagacaacttcgtggcatatttgtcgaagcgcgtgcaactgtagagcgaacaataaaatttcccatttagaagtattctttgttgaaaagaattttaaaatcgtgaacacacggaattttgaatttcaatatttga

SEQ ID NO: 104839 - DNA, 632 bp, Oryza sativa
atcacccctcacaccatttgcacaatattttaacaaatcaatatattatttttataatatttaatatatttattaatatgttaagaaaatatattaagaattagtaattcccgcgttaaaacgtgagaagcgtagagttcagcacctggtatgcatgcagcatggttggattggcgtgtttgtgtgactcacgtctctcttctgacataactatacattgataaagactagggaatcattagttataaatgattgcgatatggcctctgtcagattgtgtacgtgagcctctcgatcttggatggaagatcaaatgcatgcggggtgttatttattgacatataagaaacgtgcaagttaattaattggattagtggtttctccaagcttaatgatgcatcgaaaatagtttcttttcagaactaaaaatttgtttgttcaactcctctttagttgagatgataacatcagtagtagtagatgagaacaggacatggcagctgacaaatcggatcaaactagatcagactattaagaattggtcacatttaaaaaatatagatttggccagttcattttgttgatttctatcaattctgaggctccgttcatttattatgagattcagattc

SEQ ID NO: 104840 - DNA, 1379 bp, Oryza sativa
ccactacatgtttcacaacatacccaaaaactacttttataactacccaattacggagtagcgtttagcagtccctaagtaagctactacacatgttggaaaccataataatctcaggtctaaggattcaacaccaacactaaatgagattactgatgacacaacacatatggctcttgcagtgtctcatgttgggtctatccaacaacatgttccccaacatatgtccacattattaatttggtatctctataccatgatccatgagacatgataatcaattaatacatgtgctgatcatctaaacatatttgtttcacatatgatatttgatcagggatcctttagaaatagtaacaaataacataaagagtctcatgaaagaatcacatattcattaaccaataatgagttatttatttcaatgaacaaagtcggataaatatgtaaatatagtatgtgatataattatctctatgattgcctctagggcatgtcactaacaattagctattctaacttatgtttgatcacgcatgtttcagtcgtgaaaggcaaatgtgacagttgctctatgtttgagattacagctagtactccattgagcacgtatttgtttatgcgaagatattatcagattatctttatgctctgtagatcttctgtttaattctgtttgatctgtgatgatccagcagctgctctagcctgtaggctcttctcagaagtagcatttacgtggtgtttggatccatgtacttaactttagtctttgtatttagatatcaatttagagtattaaatatagactacttacaaaactaattaaataaatgaaagttaatttgcgagacaaattttttaagcctaattaatctataattagagaatgtttactgtagcattacgtagactaatcatggattaattaggctcaatagattcgtctcgcgaattagttcaagattatggatgggttttattaatagtctacgtttaatatttataattagtatccaatcatccgatgtgatagggacttaaaagttttagtcccatctgaacagcgtcttaatatcttaaatggaaaatgatgattttcttcatagttgcatgtgcttctacatgttgtccaaagttattttctcttgatcttctgtaaacagatttgggacaaaaacatgaagagtctgtacaaataactttgtggcatatttgtcgaagcgcatgcaactatagaacgaaccatcaaatttcccatttagaagtgtttttttgttgaaaagaattttaaaatcgtgaacatacggaaaaacgtcagactttggctgccaaaatcggggattcttgcatcaaaacctgaagagggctgcaggaat

SEQ ID NO: 104841 - DNA, 1217 bp, Oryza sativa
gaaagtcatgcaaacagcaaagtaagcatgtaaaacaaaatgaagagcatacatgggcacttcatgtatattgtgcagactgtaaaaagtaagatcaaccatatagtactttccccactatgagccccacgcttcatggcgatagagccgaccttagtggcatcaagggcccatatgggtggtgtccataaaacaaagggcatccataacgacacttcagggttgtgcagaaggttcgtttgcctccgatatttggcggcaacggcggcagagccgtccattaagttgccatgccggtgcttcaggcatctacatcacctctagaatttgggcgataacggcggcagagccgccattgtgttatcgaatagtgctaagattatgtaccatctcaagcctttggacggtaacggcggcagagccgccatcatgttaccgagcgttgctgagaggatgtatcaactctagcaattggacgataacggcgggagagccgccatcatgttatcgtgtattgctgagaggatatcggaggatggtacttcaggtaccatgttcttctgcttatttcaactatagtagaagaatgatttgcatataaagagcaagatgatcagtagaaactgatttctcacctgtttacctttttagctcggaagagtctcgtgctgatgacatgttgagaaaccagtcgattctacttatcagcacacaagcaaaccaaacacagagttgtggaacacagaaagtatgagtgagtggaagctttatttcttctggatttgagtacaagctacaagaggagaagcaggagaccgaagatcggttgtcctcgccttggaccttctgggccctatttataggcggaggagggtggaggcttacgtcgtaagccttggaccttctggcttgtgtcgtaagccggcttacgccgtaagctggcttctcctgtaagctggcttcctttataagctggcttatgccgtaagctggctttctctgtaagctggcttgtgccgtaagctggcttcctctgtaagctggcttctagcgtaagctttcttatgtagtaagcttcccacttataatttaattcatccacaataagataggtttcataacaaaaatatccatattcagttaatctgccatgctcattttctgctggttgataagattgggctgagatccacatatatatggccagtgtgtcgagt

SEQ ID NO: 104842 - DNA, 1995 bp, Oryza sativa
gcaagctagcatgcatgctggcatgtagaaatggagagaaaaaatgtgtagtgcccatgatatcttaggtgctttgctcacttgtcaaccatgtccaaggtcacactggctattactccctccgttccaaaatataagtgattttggatggatgggacatttcctaatactacaaatctggatagcgatctctatccagattcatagtactaggtctcatccgttcaaaatcccttatattttaggacggggggagtctcatccgttcaaaatcccatatattttgggacggagggagtactatatagacgtcgtcgtacgtactctcatatatgtgcatatatggtttttaataatcttgaatatatactgagttagtcaatttatttaattttatactaggcatttgttagatatatattatttttctccaaggcttcaaaatcttgggatccaataatcacgcaaagtataaaattcaattgaatatggccagtgtgagaaattcaaattataattaatttgaagttgtaactataacttgaagaaattcaattcatgttaatatattacctccgtacataaatataaatataaagatatttggctataaacctatttgtagacagaggtcgtggtcgtatactgtagaacttctgaccagttcaaaaactaatatagatagtgttacccaagataatgagatctgttgagatattgccgagaaaaatgatttataggaatcacatgactggaaaggttgaaaaaatggaacttggatataacatggaaaacccttgcaggagaaaatagacgtactaaggcctaatcactactttgagaaagtagacattataagtaaaggtgggtacttctatgatgcattgtctacttaattcatttctccctttcaacttgggcgtgttgactttcaatttgatgtttttttttctttcaacttctcgctaatccattttagacttaactggttgtaaactaggacaacttagggtgagctcggctgcaagggctgcagcgctgctgcaacctgtacgaacagtgaagcaagaaaaaaaaaggcagctgctggctgcagccagctgctacacctgcttgccgtacaggcccttatacaatagcataggaactaactaaatagcataggaactaactaaacataaatattttcaacgaattagttcaactcatgtaaaaatatgtaaactaaaagtatattttagttctcgtatacattgaaatggtatgccatatataatcctcatcaaggtctcaaaacccatctagatacaatataatggagaggaatagataaaaaaaaacttagctagtgaaatctatatatcagtgtgatataggtgtacatgtacatgttttttattactttaatatacattaaatgttagtatcggtagtgatggtggttctatctgcagtcagccactacaactgtcatgtggggccccaaacaaaatttgttggtggatcatatttgtcaagctaaccactggaaaatatatagcatgaatgattttataaaatgtatgtcaagctaacatataatgttcgactgatttaagtagtattatctgataattagataatagaaaatagtctaatatcgaaaccatcacacgaggtcttttttaaaaggaaaaagtacgaattaccccttcaaactatcgcggtcgtctgaattaccccctgaatcacaaaaccggacattcttcacccccaactatgcaaaccgaatgaattacccccctcgacccaatccacggtggttttggtctacgtggcagtccagttaggaattctatttataaaatagttgtgggacccacctgccatacttctattctcactcttcctctctctcttatctatctcactcttcctctctctctctctcacgggtggcaggcgagggacagagcagcggcggcagcgcgagacgcggagacggcggcggcaggc

SEQ ID NO: 104843 - DNA, 4443 bp, Oryza sativa
gtttgggcatgtcgttctttgggagtaatttaatttgcagaaatttctctgaaaatatattgtagctagatgcatatgaataggtgaatatattattactcactccatcctaagaacttagtatttgatggaatacatcctagtacgtacttcgaatatgaaaagtcaatctagattcatataagcactaactaggacgatgatgtgtcttattcagtactaggttctaatatttttggatgaaaatgttactaaattggtttctagttaattaatcgatcatatcatgcacgcctatgttgccaaggcttaggataccatgcaagagagagcaatgcaagggcttgcatgcttgggttagggctctcatttgataacgtggaggggcctagattcccatcatttgggttgtaccaactctgtctccttcagttcagcaggcttcagagctcaagtcggcaaaattgtttgcctcacaaatttggcatgatgagtgtggttctacatgcaaaggtcagcctgcttgtctaccgactttataacccggccatatatatagttctcttttgaacaactagtagatcttacatatattgtttattttgagatatagcttaattaacatattcacctctgacaattaagaacacaaataattgagatgatctcaggttcatcacttgaaaggcacttccagtctcagatcacttttggtcatgtgtgctgatgacatgttttgaaagtttgcatgatgcgcacatatgcagccgcttgatgtcaattaggtccactaagttcatatcaagtcataactagtataggctatagcccagatacgaatatgctaaagttatactagcaattagtcagctctttctgagtgcatgtgactgaaaaacacaattgattctcacaaactgcgggtttggattgtaatttgtttgggttgcccggcccgcaggggccttgaggtaacttgagcataattaaactaagaattttttttcactgccaagaaaaaggcattaattaattaagtgtagtttcaaaatcagcatcaacggttgctctgtattgaaacaagcaatggtaaattaatgccagttgtgaaattaaagtgtgttttgattattaatttgcgatgaaaaaatggcatagtagataattggttttaatatttagagattattagagaactagttttgttgactgtgtggacaggtccactagctactacagaaaactaaatagggtgctggttggaaagcgtgcataggtgtcggtttccccaaccagcacctagaatgcggcactgatgagaaatataaaatgtgccggtcttagaaccggcacctttgaggtccctagaataaaaaaagaagcgctcgatcgatgcttcaagccaagaatttcatacaaaaattgaatcacaaaatcttagaaaattcatcacaaatctaaatcacacagaattcatcacggatctaaatcacaaatcaattcatcacaagaacaaaggttggagaagggtgtcgacaggaggatcacactgccgatgggagggcgtgccatggccaccgtgcgccgtgaggaggaggttgccgcgcgacgaaagggtgccaccgccgccaacgggaggaggccgccctgagatcgtgtcggtccggataagggagctgacgtaaggaggaggccgcccagagctcgtggcgtcaggagctcgcagtggccgccctttgggttggagaagaggactgccatgaggaggaggatcactgccaacggagggtgcgctgcagcgcactgtgtgcagtgaggaggaggccgtcgctgtcaccgtgaggaggccacctcgagcttgtggcgttcggatctggacgcccggagctcacggtggccaccccgagattagagaatggggccgccatgaggaggaggccaccgcaaacgggagggcgccgccgtgggagagagagagagggggcgggaggagggggaggggaggagaaggaggtcggagggcggcgcctccccattgtctccatgtgagagagagtgagagaggaggagggagaggagaacaagataagacggaggagataaggaagagcgagagaaagagagagagcgaattgataagatctacatagccctcccccgtgcggctcggcttataggtgtctttttttaattaatcagcacctataatatataataggtgtcaattctctcaaaaaaccgacatatataatattgacacctatatttgttcaaaggtgctggttattttttttttcaacttgtggggatgggaaaagcactatagttgccagttttagctattccgacacctatagagccgacctctatgtgcttttctgtaatagtggtcagaccgggtaggataggccggtcaaaccagcgtgtatcatgtgattagactggctagcttgacggtctaaccggtagagacctatttagtgtcggtttcaggttgtttatttgaatacttacgattatctcgtgattatgacttctagatgattttgatacgtgtgtaatactgtgtagagtcaagttaagaacttgtgttcggatatggttcttgtttagttcatgtgtagattattgaaggtcattaagtaacaacttgaaccgtcaactcctacataaaagatacaaaatataatatcaaatttaatggtcggggtttattactaactgttttcacaagtattggtaaatatttgtatgcgggtgattttagatgaatttacacccaccatgtaactaaatgtacctccgaccaatcaaacgagagaacaaagattggagggcccacatgacagtttaaaccaacttaaagtggggccaaaccaccgtgcaccaccttagaggcccacatgttagctcctggaagaaggtggtggagagagttggggcccacaggtctgctgaaccaggggtttggccgaaccaccatagccccacctcatctccaccttccacgtgaacgggcaagatcacctcccaatgatggttgtggatgcaccgacctccacaaccgtaattccaaccgttatatggcccaaaaaaggaggagctcaagccatttcacaatacacaacaaagtggagtacaagtcacttctcatactttaggcatcccttagtagtgtggagaaaataggtagagagtgaggggaaggcctggaggaattccgaagctatcggtactctcttcctctcttgtagctcagcgaatgcttctttaataaagtaagtgtttgagatttccttttggtatttaaattacttacttgagtgagatatattctcaccgttgcgagttcatcgcttagtatttatattaagtactccagtactaggactctggataaagaaggaagttcctgcgcgaagctagagtagtaatcaataacttagacgtgatgtctaggttagcggttatcttcatttgttgtgtgctccacggaaattgaggtagacagcagacggtgacagccatatgcgccttttgtatctttccacgtccgggtacaccatagagctacagggccgtctcagcttcgtagaccagaggagaatcggtgcccgaagtaatcgataaggttttacctttaacttaagtctaattaattaaaccataagaatcctatctaacataagtttagcattagatgttgttcttgattggattatgttcttaaataatatacacacacattccttgtgattaaataaacctataatactctaaggtgaaatgctacaacaatattcttatgcttgcgaatttatctgtgaccgtatcaaataccaacataggtgttgtcttgatgcctcggaagttaatctctatcaatatatacgaggttaaacttttaccatttttttaaaataaaatattaagttactaaaaaaggtagctagctagaaaaagttggttgtcaagggccgacatctccctcgtccactcgatccactatttatagtcatgttgtatcttaaagcttacttatggcacggatgtcttttttaagcgagtaacatgaaacaacaaagaagaaaagccggatcgaaccctataaataattacgacttggaataatataaaagaagggaatggaatatccacctaaaccgaccgtttgggctttcacgtgcaatcagattaagacagcaaaacaacacccaacaacaaacaacaacatgcatataattaaacaatctcttaattttctttggattgatataattctctctcagacgatgtggagacgatcgaactaaagcaaacggcaattaagcatcatgcagagacaagctagcagatgcgcgacccctgaccggattatatgtttactagtttaatcacgcaattattaacaagctggcacacattcgataagtgggggatcca

SEQ ID NO: 104844 - DNA, 1561 bp, Oryza sativa
gtcacaaaaaatacagaatgataattatataattttttaatgagatgaatagtcaaatatatcttaaaaaatcaatcacgtcatgtataggaaaacaaaaacagaggcagtatatttttggatgcagatactaatagaaaaatgacacatatttatgctggtttgcatgcagggatgggggggggttttgccttgccggtgcaggcgcggcgtctgccctgccggagtcggaagggaagacgaggagaaaagctctctgtctatctcgggagaggtgtgggtggtggtcgccgggcgctcgtgcggcgtggtagaccacgccggcggccggccaccgagagcgcgcgcgcgtatatatggcgggatgtatcgcgcccccgccaaattttctttttatactatacgattccccgtgtaatttataccaccagcagctatagcttctctctctctcgccatgcatgcacactacattatggtattttgcatgccactactgagctagctagagagacgtaaccgtccctaaataccctaaatatttgacgccgttaatttttgaaacatgtttcaccatttgttttattttaaaaatctaagttaattctattcctatcatttgattcagcataaaatatacttttatgtatacatatagttttacatatttcacaaaaatttttaaataagacaaacggtcaaacatatttaaaaaagtcaacaacgtcaaatagggaacggaaggaatatatctatagagatcttgctatatactcccttcgtttcgaaatatttgataccattgactttttagcatatgtttgaccgttcgtcttattcaaaaacttttgtaaaatatgtaaaattatatgcctacataaaaatatatttaacaatgaatcaaatgataggaaaataattaatataattacttaaattttttgaataagacaaacggtcaaacatgtgctaaaaaatcaacggcgtcaaacatttcgaaacggagggagtataattaattttgtatatactccctccggtttcattttaattgacgttttagacaatgacacggtctacaagatacatctttgaccttatttttctattataatatatataataaataaatgcatgtttacttttttatagtattttaaaagacaaatctatatatgttgttctagttcctttaaactaaatatttttaaagttattgatagtctaagttataaaagtttgacttcaaccttatctaaaacgttaattaaaccggagggagtactgctagaaaagcattggaacccatacagtgcaatccgaacaagacaaagacacaagaaatactctatatatcttgcatgcatgctgctgtacgcctgttcgatcgtcgtgatcaaatcgactaaacaattcgatcgtatactatatacagacgaacggacggatacatgtcaaattaaatgtcagctgcaattgttaggttgtagccagccctcaatcgtatacatatatactccatccgtttcgaaatatttgacgccgttgactttttagcaca

SEQ ID NO: 104845 - DNA, 625 bp, Oryza sativa
tccatctcgaattctcgatccggttgagacaacgacgaatatctatcatgtccggttgacacatatctgtgtcggtctgcccatcatctgcggactgcggtcgtcacatgaaacagccagagaatctattatatcccactgactttatcacgttctacaatataccatcgacttttgcttaacttctacgatttaccatatcgccgttcggttagtctttgttagtactgtacaaatttatcaaaatgaccaaaatatccctaggataaaaactttcaaaatctggataaaaattctgaaatgttagattttaagtttttttttctaaattttggatgtttacaatcttgtgttcataatacgatattttgataattttatccaaattttagaagtttttatcttaggggtattttggtcatttagacaaaattgtatagtgctaacggaggctaactggacggcgatggtaaatcgtagaagttaagcaaaagtcgatgatatattgtaaaacgtgacaagttagtggtaaagtgtagacatgtgacaaagtcagtgacatataatggattctctctttttattactccctcccgtctatattttttcagtttttatactatgt

SEQ ID NO: 104846 - DNA, 733 bp, Oryza sativa
attttacataatcatatgaagtcatattgtaccttacaagtatctcaaagcatgacaacataatagccaacaccaaaatagcaaagtttagttcatagcaagcaccaacataatcaagttcacatcataaccaacatagtatcacatattacaggttcaaatcatagccaacatagtaacaagtagctgtccagatcatgcattcaaacaaaagcactcataaagctattacatatgaggtccaaaccattgagctagcctccctcctcttcctccccttcctctctcaccaccaccaccactagcaacaccaccacctccacctccactaggggcagcaccagcgcctacacctacccctctccccgccgccacctagcgtgccgcttggccgccaccctctccccggctactctcctgcacacgccgggaggagcggcgcctagcctacgcccgctctcctccgccgccgcccgctcgccgccggctaggtctccagtttttttggacacgggctaggtctgtcgccgagaggagaaagactctttatggttaacatttcgtaggggtaaaaagtaaatcactaattcggaaattctttatttctgccataaacccggtctcactaacttctatccaaaccagaggtaaatatctgtttcagtgaaaaaaggtggggaaaaacgaaaaccctaaaagtagagacaaaatcaatattagagataaaattggg

SEQ ID NO: 104847 - DNA, 1442 bp, Oryza sativa
tatacatcactgatggggaaaaccatttacttgaccgaataagcacacctcgacatgaataaatcccatccgctccaaagcatcaaaccccccaaaatcccaaaagaaaaccgaccaaaaaccctaatcgacagcaaccaagggcacctagacacacacattcgcgatctcaccaccgcattttcaccatacccgaaccaagaacggcaggagcgcctcaaaaccccccgaaaatccaatctttcctttcaaaaaaacaatccaaaaggaagcgagcgaaatgcgctacctcaaaacggaaggccaaaccagcgggtttgatttgatctgggatgctttgggtccagcttgaatgatgctactgcagtgaagggctcgagaggaagaggaaccgaggaggagtcaggagcattcgaaataaagctcctcctctctctctgtctcctctctatcagaggaagttttttatggtctcttgtggttttccttccccatctcctcggggtttggaaaggattatttcgatgttactgttcattcagtgggggcctgtctgtttggtgcaggtcatcaacggtaaaaacgaattactgctactccattctctgtagttcgaattctttaatgatgagcagtagatgcacaactgatgcttccaacagtgtagagtgacaatgaagaacttcatttttttccttttggaaacttcaggtgtccaaatgaatcttcctacagtatatgaaggaaaaattatgggaaaactgtcggaggaatctttttgaacttcttgtagtttgtactcattggctttgtttgagaggcttatcacagctgtggattctttcagaatctctaccttcagaaacaatccaaatttccacttacgccgtgttcagttccaaaatatttcttcaaacttccaactttttcgtcacatcaaaactttcctacacacataaacttccaatttttccgtcacatagttccaatttcaatcaaactttcaattttgacgtgaactaaagacagccttactattagattttgagaaaccctactattagctatgtttagttctcactaaaattggaagtttggttgaaattggaacgatgtgatggaaaagttagaagtttgtgtgtgtaggaaagttttgatgtgatgaaaaaaattgaaagtttgaagaattattttggatctaaacacggcgtagtactccagtagtatttgcactgtacttgcccaaccaaagttatccagattccagagcaccccaagctgatggcttcatcagaaataaaggaaacctgaaagttcagacttggatttctttttaataatgaaactgtaaagtgggaacagcctttgtcattttctgaaaaagaaaaaacaacgagccagctttaacagaatgaacattcaggccaagggagagaggaaac

SEQ ID NO: 104848 - DNA, 1375 bp, Oryza sativa
ccattcatgttttatcatttaataacaataaaagtagtaaacatacaaaattttcaaataagataaacggtcaaacgttggatataaacagtgcaaaactgtacttattttgggacggaaagagtataccacatcctaatactacctagatatggtgtattacatactcgatttgttttttataagacggggagaggtatagagatgcaaccggtgtgggcaagcaagatttttttttgcccgcttatcgttctttcttcttaaatatgtactatcttaaaaaaaaaagaactagcaagcggggattttatgtgggcagtgggttttcttcttaaatgtgtacgttgagtgggcctttgttgtagtattttatttgtattttcacatttttagggagaaaatacattgtttttggaagaaaaggcaagagctttgcccttatgtatcgatagagcaggagttttaataatgattttagggtgggtggaaagattacacatgaaaatatgacaagaaaatatataagattgatgtttcttttctttactacaaattagttcaggaggaggagtcatggcaattggttatgcgtcttccgtgtaataaaaaggtttagcatatcaacattgaataataggctcattagctatatcagacaatcatcaccaggggaacttttagatgttctctacagtgccaggctcctagcagccttacaaatcaaagatgaaaagtcttgtctagttccttctatgagcacctaattaagattccaaactccaaattattctgccagtgcactgtattctggtgccacttttcattgttcagtttatttattctcttaagctcctctcctatctccatttgccacctgtagatgtcagtgttattagtccttaattaagttctcttaatattgatgtagaatctcgataatggagatggttaaggacaaatataaacattttgtcagtagcttgtcaagatatgaagatgaattgcatgtccagcatacttaacacaacatatgaaagggatctaagatgtactgaaaattatacagtctgaatatattttataaaaccttatattgttccaaaaactttgttcgcgtaaaaagtacttttcaaagttaaattctcaatctgaacagaaaagggacatgtcttgccatggcataaaatggattatgctatttcagtactagttccctgaaagagaatactcctatcttcccacaccatcacgatataaattgtttgcataaaaagaacttagaagttaaattctcagtcggaatggaaaggaacgtggcatggcattaaacggattatgcatttatgctattttaatactagttccctgaaagaga

SEQ ID NO: 104849 - DNA, 891 bp, Oryza sativa
gcgctgactgttgttttttttataggaagaacagaactttacgtcaaaagatcatcattacctctcgtgttagcttaacacaagagtgcaatcactctgtgtaagcaaccttgtagaggcttgtaattagtgcctctaacagccacttgcaaactaattatgagcctcacttagtacatgcatgcatgagctaccgttttattgttgtaacaactatgtatataaactcttgctgaccaacgcatgtggaaggtatggaacttaaaatacttttgagaaattaaaaacgcgaatattagggaagaatctaatatcaaataattagaaggggtgagcgttcgaacccagatcgtctaacccaccaccttatggagcttgccggaaaaccactgagtgtttctcagatacttttgaggaattgaactaaatcctattgatatcctataaaatttctgcattctaaattctgaagtagctagcccaagcttcctgacgcatgagaaggtcggtgtgttgaaaccaatcctgtaaaacctctgatttcttccatatatacatcatcaaccaaaccataacctaattaagtatacattaaccaaaatatttaaccgatgctaattacgagttatgtgcttcactgttattttaggcttgtcctaaatttagttgctcttttaaaccggtgtacaagtagcagatcatgtatatatggtgattaattagaagatccttgagagatgccaaataaaacggatataaatgaaacgtatcaagctaagaatcggcaggagaggcttaatctgtgccatatatagagggggatatgatcttatcccagaggtggttcacttgttgttttccaggaccatgaacagtatagcaacagccaat

SEQ ID NO: 104850 - DNA, 1382 bp, Oryza sativa
atatgatgagcagcaatgaaaccactttccaggacgacagacaaaccatgtgtggctgacaccttcctctatcttactactacgattacgatcgatctcattctctgctgccatgcacctttgatgacgatgatgataataaccaacttcacaattaattcacaaacaaaccaatcacaattaattaaagatcaatttgctgaagatcctgtcagggtgtggaggagacaggcgccaagacattgctctcaacttaatcacgttgcctgcgctgatggccaggccggtttggtgctatgtctccgataccccaaacccatcagggggcgccatcacgtatatgtttcatactgtacgtacgaatgcagtggcagtagcaagcagggcattgaagacggctgctggtacatgcacgcaggaacaatgtaccagtacaccagtagcagttggagatggacggaacagtgcatgcagtgtagaggtagtagtagctaagctaggtggtgggtgatcgttgtcatgaggcctggagaggctccaccgctgctgccgctgccacgccctacaccgcgggctccacgccgcaatccgctgtccccctcatgctggtgccgttgccgtctacctcgcgccatctctctccgctctcccacaccgcacagcgcacgccgtccgtcgatctgccggttgtccccgcgcgcgccactgtgatcaccggcacccgcgtacgcgacggatcgatcgatcgcacgacaccatgtataccacggttctccccggcgcgcaatcggacgggagacggataataatcgcgccgttgttcgtttgttgaatgtggtcttgataattgattcataagttcagttatgaggtattttctcggtgccatagaaaaccaatcaattattaaacatgatgtattttaatatcatttggatatgtctctctctaaatttgtaatacatgaatgtgccaccttcgatactaggttgatttttttataggacaaatagagtagaaaaagatattctgctattgataatagaggtagtataaataggtagggtaattttatcatccttgagaagataccaagatataccatattttctaatataaaactagcatggtggcccgcgcagattgcgcggctaacatcattatattttctctcatatagtagcatatatgttttctcattatattactaaaatatattaaattgacaacataactttaaatttcgcaataacattacaaaactaccaatactaccaatgtgtaatattgatattgtattttatatacgtgttatttattaattatttttaatatcaaattttagttatttgtaaattatatatattcctatatggactcta

SEQ ID NO: 104851 - DNA, 714 bp, Oryza sativa
ggatcccccaatattaaatatttacaatatttagaagtaatttacttaaatgctagaagtaactgaattctaaaatggaagtaactttttatagcattataagtaattacatatatgtgttaacagaaagatcttcgtatgtaatgtgtagattcacaagtaaatacataatattttttattcgaggtaagccatatatatagagagagagggagatttttgtttttcgataaaagcaatttatttcatctaggaagtgattctttagaaaatagatgtaactattcacagtattagaagtaactattgatattcgaagtaactttttgcactgtgtcagaaggaactgcactgctggagggaagtaacttaactaaaaattaatgtaactcttcatggtattaaaagtgactacactgctagaagaaactaacccttcatgctactaaaggtaactatgttgctagaggcaagtaactcatcgtggtattcgaagtaaaaacactgctaaaagagttaaaatcaaaaataaattttaaataatctgaatatatttaatattgtactcgttcgtcacatatattttaaatagagtacgatggctcaataagattaaaaaaatatacagttataaagatataagccataaaaggctctaaaaatactagtgcaatagtgctagacgatgtagcatataaactgcatggtgctaac

SEQ ID NO: 104852 - DNA, 1212 bp, Oryza sativa
aagtcgggggctacacctaattaggtgcatctactcgatgcaccatgttttattttcgcccttcacagtttttgatttttagtactcggcgaactggagcaagttgaattgaagcactcggactactgttttttgaaggctattttgtcaactgcgaaggtctcgggggctactgtggagattatggataccccatatctatatgacagttgtaatttagtcggatatacggtaccaaatatagatggaatatctctatgaagactcgggttaggttctaaacttgtatgtcaagaaaatacccgggattttagtaagttacgattgtattttatctataatcccatattccgttaggatatgggctgtattttgtaaagcggactccttcacctctataaggagggtccgtgtgcctcttggggggcgattctttttcccagtttatacaatcaataatacactcggcggaatcatccccggacaggagtaaggtattacttcttgaataagaaggcctgaacctgtataaaattccttgtttccaaacccatccactttcctagcttgatagccacccccttttattattgccgaaatcttgcttcgacacagggtcggcctagctagttcgcgattgatcgcgagaccttgtgacccacgatcatgtccataccacttcacacgcgtttttctttttcatagcactgtcctgttcgatatttttttttgctgtgaggttgcgagaatcctactgcacgatcaaagtttatacatcttaagtttatacacctattactttcctattttagtaaatttatgcacctaaagtttatacatcttaagtttacacatataaagtttatacacctaaacacaaagtttataagtcaaaagttgatatacccgattcaaatttgaatttgtattcaaatattttttatatgtagtatttctatacatctaaagtttatacacctaaagtttatagacccaaagtttataagtcaaaagtttatatacccggttcaaattgaatttgaattcaaatatttttttcaaatattttttatatgtagtatttctatacatctaaagtttatacacctaaagtttatagacccaaagtttataagtcaaaagtttatatagcagattcaaatttgaatttgaattcaaatatttttatatatagtatttctatacataaat

SEQ ID NO: 104853 - DNA, 646 bp, Oryza sativa
actagggcgacgacaacaggcgcttgacggcaggcacgagctagacaccaaacccttcaacttccaggaactcctcttttggtttgggaaaaattgagcaagactgagtacaaccaccgtattcaacaagacacacccacaagtgcagaataaatgcaagggtgtacaagggagccataatataggggttagggtttgcagtaaacagcattaaaagtcacctagttgctcaaagctactttgtaaacacgatcctagagctatgcaatattattaataaaggccgtgaacccgcacgaacctgccttaacctaagacctacgatgatttggaccgactggcaacccgaccctgagtcctagctcgtcccaagccaacccaggccaaccattccacattttagttgttaagcaggttttaagaattaaaacactaacttgggtacattgctcgggcttgcccataaccaagggcgcggctattcgaataggttatactctgatcagaggtgtacatctttacccacaagacacatcttcctcacgtgtaaccacgtgccacataccaccacggtatacggacggaagacatgacatagtttccaacccatcctagccatagacaagagtaccgacccaaccccacc

SEQ ID NO: 104854 - DNA, 830 bp, Oryza sativa
tcatgaactttcaagtgatatgtgtatgcatatgatacgtgcgattcaaacctaaaacctttgaacacatgcaaatcaatcttactatctcacatatagatcacaggacaatcggtcatcagatattattcttttaacttttcctctccaaatataaaacacaaatttgaaactccagatttttcatatgagaacgtaactacaaagttgcagatctcatcgatttctacaactttagtgtagggtatatctctatgcagggttgtttgagaaattcagaaatattttagaattagatcacatcacatataacacatattcgggtatttcaaatttttgattttttttctcatccgtgacggttcgtaactaccacccttcacggataacgttatccgtgaagggtggtaattaagacccgtcacggcttagtgctatcatctttgacgggtcatctcattacatccgtcacaagtgatttgttagctttgacggggtattgttgtgaccctttatagtttatctgtgacgtgttagaactacgacccgataaagatgaacttatatcggtaatgggtcattcccggtagttatattttaaaagggaaacttattgagccattagagatgagtcatccgagcgagtttgctacatctcagagcaagatgtgggagtctgggtgcagccggcttgccccgccagcccgctgtgcttgcccctgaaccccgggtggatcatgagctcacgtggcgacttggcaaactggttgcaagttcataaaaacatgggaatctaggagaactaggaaaaatattatgacatgtgtctg

SEQ ID NO: 104855 - DNA, 1105 bp, Oryza sativa
acttaattaggacctacgctctataaaagaagcaaatggtgttcgattcaaacattgttccaagccaactacatactacatgcttagtacagtggcggctaggccgacgtaagctggccggaccaaggtggggaagacacagaagccggcttagcccgtttcagggtttaggccaaaaagctctgtgagattaaataattggtttcagtattcaagaaattcaggagaatgttatggcataaaaagaagcaaaaagatcttaatagaacttaaaacatatgaaatctgacaagtttgaaattgaaacaagttatttgtgaaatgtgatggtgggtttaaagtttgaggtcaaaacaattttgttatgcttgaaatggaagaaaaatggaagagactccttttaaatcttgatgtgactatcttagatgaataaagtttcctttatcttaaaaaatgtgaggttttaagaaacttaatttagacgttatataacatctcttgctggttgtaatagctctaatttgtctcacaacacttagtaaatcctatatataaaatagttgtatggttgtaccaattgtacaaatcatatgaaattttccaaaaaggaacagttatataatgattgataaagtatgaattgtacagatcagatgagattaaaccatatttcattgctacaaatcaattccagtttgcacctctacttttgtgacatgcagcttttccactgcaacacgtggagttttcgcctggtgttttaccactgtgtcttaatgataacaacactactacttactccctaccctcaaatataagtatttttttaccaggtcaaaaaaaatataagtatttttacgacacaaaattttaagtatttatgatttcaatgcatgggaattaaaacatttttagccaattaggtgcgtaggagggaatccaagtaatattagaattgaaaatttgacaaataactggtgacagctaaaagatcattattagaaaacatattttttacaaagagttaaaataaatttttctaggcggctcttcaccccgcctacacttcaagacatgtgaaaatacactattttcacaggcacct

SEQ ID NO: 104856 - DNA, 3693 bp, Oryza sativa
attcctgcagcccataggatggaattaaattttatatgtaacggtgatagatgatcaaccatgggacaatatatatgcatggtgattgcattggaaatgagcggcgtcagaagaacacaatctcgtcagtgaatgagagcttgaagcatcttgttgagcaagaagatgggtgcctgtgagtgtatgatggtgctgtttaactcacagtatcgtcttgcacttattttcgctggcttaatggttctagctgtttctccctccatcgtaaaataagccaacctcatactaggtatgacacatcgatcctaacactataaatctggacgatgtatcacattctagtatacgatgttggtttattttgggatggagatgttagaaataatcttgttgtattaggtgatcatgtttattttgttgcatgtcatcatatataggagtagactataagttgtcagctgcatgcgttagtcgttatggcatagcgagctaatctcatgtgaagcacaaaatttggaagaatgcttaaagtagattggcagccaagtagtgcgtacgtgcatgttgggactagtctcaggattatgtggtgaattagtcttgcatgcattaaactattggagaaaccatctttgttggtcgtccaaaatccacaatagtcctggttcgaataggaaccggaactaaatattatttttagtcctggctaacaacattgttatctttaatccctgttgatgttaccaaccaagaataaatatcatttttagtctcggttcaagttatcaggtcgagtcagggccccaaatatctttagtctcggttgtttattatatcagccgggaccaaaattcaccccgagaacgcaggcctcattttgatctcggtcagtcgtcgatcttatcccctcccccttcctcattaaattaacagcctcagcccccatctcagtctcgcgttgatcttatccatctcagcctcagcctccatcgatctcagtcatatcccctctcccccttcctccccttcccctctcctccccctcccgctccccgcctcctcctctccaggcgaccgagcccaggcggcgactactggagcggcgggccgtgcggagggcggagggcggagggcggcgggtggcggcgtggccgcgctggcgggcggatgggagggcggcgggagctgccggccagcggcgccctcccctctgccgaaggggaggcgggaggcggcagcggcaactcgattttgttgttcttttttttttaagaatttgtgatatattggatttcagaatttttagaagttgtgattcgttggtctgagaacttttagatgttgtaattcattggatatgtgatgtatttcttttagaatttgagatgtattttttttaagaatttgtgatgtgaatctatgtttgtgttgatactttgattttgatttggggatatgattggggatatagggagcatcttgatttgtgccgttccaactcgatttgtgcagttacaactcgatttggaaagaaacaatgaaaaaaaaaagaaagaaatggtgaccaaccgggattggcgttgccatctttagacccggtttgtatcaccaaccgggactatagatggatgtttagtcctaggtatttcacccaggactaaagatacctatctttagtcccggattcgtacttctggttataaaactaggagtatagggggctacaaaccgagaggaaaaacgctttctctggtagtgttagttagttgcagatgcatgtgcatgcatgcatattatttggttggtgcaagcaacgacgtctgggaggactcatgttcgaatccaattaaaaccgtgaataaaattttggataaaagtggcacgcttttcaaactgctaaacagtgtgtttcgtgtaaaaactttatatatgaaagttgttctaaaatttcagattaatctattttcaagtttataataattaaaactcaattaatcacatgttattaccactcgctttgtgtgaacacttaatctttatttcaacatcatcttccgtagtggagatgcggcctgagtcaagcagttgcgatacttgtggagttttgcggccaagtaaaccggacgtgggcgtatgtgcgattagtagtatgcatggattgtaaatagctgctccttgtaatcgtttgttttgtgaagaaatagcaagagaaaaggcactagttgtatatgtgcggtgccacaaatatgctcggtactgtgttctcttcttccctgtgttcttcacgtgcaattgtgattcgtgtccactgtgttcgcgtgagttgctttgatttccaacaggagggaatatactgataggctgggatggaactgggatcatatcatacaaactaataggctggttgtacacgctatctccacttccctttgatagtaacttgtgaaacaaaatcaaacggccttgtcatgtccaacagtgcagactgaaaagcaacatatcgcatcaaattgtggaagggcctgtagccttgtggttaccagagcctcaaacctcagaagcatctgaggttctgggttcgactccccttagaaacgaattttctaggatatatcagcgttttactcatagtgattagggtccgtcctttgattattgaggtgtgtactcgttgatccgaacggccgaatgtcgaatgtaacgtcaagtagaattgcgcatgtctataaagtaattaagatattcagaaactaaaataaatatatatcatctatccatccaaatcaatagcaccattcaccaaatcaacaccttgttctattctgcaagtattaggttcagacacacgaatgtcaggcagcgattaatcgcaccagattggttaccttttacattctgttaaaaactgtaagatattcagagaaatcaaaataaaaggattcaaggaaagaaccaaaaataagagggggtggacaggatgatacatataactacacatgacaagttgctatgagattccaggtctagcattgtaaacaccagctggttggaacacgaaaacacaggaaagataaggaagggatgcatgtaagaatcgccagtgtaatacaatgcgactgtgcctaaattctgcactatcacctgatgacgctgttgtgaattaaaatagttggttctgataacaaagcaagcaaacaaaaacagttgataaagttgcccattttcatgtgatctcattacagcattgaacacccaaaccaaacaccacgtagattagttcgtacctatatatagctagagggatcaatggccttaattattttattgaatgaaaggtttgttgaaatattagctccattgatgtgttcatcgatcctgaagccttgctattttctgtttattcacatgattattttctgttgttttgaagaacaggaaggaggtcttcgtgtctttgattgagaaggaatgatggaatggacaacaaaaaaaaagagttgacattgtttacccttgctaaagaaaagttcatttagtaaatttgatgtatgaacacttgaaatcacgttagctagtaaaccatcatatactaggttgcaaaacgtactaatgattacgaattctcagagatttatctcttgaactcggtgactgaatagttttatattttcaagtatatattgacattcatca

SEQ ID NO: 104857 - DNA, 1888 bp, Oryza sativa
agctttgttaggctgcaaaagctgtttgggttgatttgagatgactggtttattaatagtcattcttttagcatgttatatgcttattttggttatggtaagggtcacagcctaggctattggactcattaattaccatgattttctatcctgtttggtgggtcattttatgagattcttactcggattcctatcaaacatgtttatttttggacctttgagtgtttatcactcggcccttcttgtattttttgtccttgatatattcaagttgagaagcagtcggctgggtatcttactaagtaccattcgtgcttcgctataaaaccactcggttcttgactatatgtttagtttttcaactaatcacatactcgggggctacacctaattaggtgcatctactcgatgcaccatgttttattttcgcccttcacagtttttaatttttagcactcggcaagctggagcaagttgaattgaagcactcggactactgtttttttgtttcgagaaggctattttgtcaactgcgaaggtctcgggggctactgtggagattatggataccccatatctacatgacggttgtaatttagtcggatatacggtactaaatatagatggaatatctctatgaagattcgggttaggttctaaacttgtatgtcaaggaaatacccgggatcttagtcggttacgattgtattttatctataatcccatattctattaggatatggactgtattttgtaaagcggactcctttccctatataagagggtccgtgtgcctcttggggggcgattccttttccattttatacaatcaataacacactcggcggaatcatccccggataggagtagggtattacttcttgaataagaaggcctgaacctgtataaaatttcttatctccaaacccatccactttcctagcttgatagccacccccttttattattgtcgaaatcttgcttcgacaaaagtaattaaggccatcgcagaaatatattagtctagcccatgctacattaattgatcacgttggttttacccaacagcacggtatagataaatcataaatggtctatataattatatagattatatgtatgcttgttatctcgttatatttgttcagctaaaagatttctagaaccgccaatcgtaatattatagcatcactggcagaattgaaataattcacccccaaaattttgtttttggcttcttaatctgaaaataggaagtgaaaaaaataatctcttcaagaaaaaactttaatttaatttgaaaaactaaaagtgagctattctgttaaactaccaaaaaaggctcgcttcccctcgtatcagacaatttcagggtagggaactccaaaaatcatgcaaaagaataaagtatctggtgaagtagttttttttaaactaaaatccctcaaattggttttagaaataaaataggagtactgttggtgatattcttagataatatcccatcctaaaactccgaagctacatttatggacagatatactagctattaatattctcgtagccacctagagatgctaacctcctgaaacaatcctacgacatgatctggtattagcgacatatcactgcatcagtgctacatacagttccagcaaggaaatcccagaaccatttcttcacgatgcacttgcagaatccaacgaatcagcattcttacatctcgcagtacctcccaatcccatgcaaagatagttaccaacaattagggccaacaaatgaactgactaaaggaaagagttctgaacttaattgtgattgatcttctcgtctgctagctggtaatgatatgtctgccaatcacccgaatcagaaatcgatgcatctg

SEQ ID NO: 104858 - DNA, 500 bp, Oryza sativa
ggtttaattgatcatatcaattaaacttaaggttttggtataccagtcctggtgatctgtcatgtgaattgcctgtcatttcgttcagcttttctatctctcacgcaatcccgcgtctccattcactcctctttcacctctcagccaatctattccccacatgccttcctgcgcttttccatcttcgttggttcttcctccaccggcgtatacggtatacctttgtctgagtcattcttgcttgtcgatcatctaggctccacaacgttattgttatgccatcgtgccgtttgtatatatcagcgtgtggcggtgtcctcatccatgcattttctagacaagtaaggatatttatgatgtggctttgcagtactggcagcaataaaagggtagcaatgtactagtactaccattttgaaggaccttccccctggaggaggaggggaggaggactgtgagtagcgcaccaacgacagggggaggggggcggggaggggggg

SEQ ID NO: 104859 - DNA, 1055 bp, Oryza sativa
tggagtaacgcattttcttatgattaattaagtatttactattttttaaaaatggattaatatgattttttaaagcatctttcctatagaaactttttgcaaaaaaatataccatgtagcagtttgaaaagaatgcgcacggaaaatgatggaggtgagttaggaaagttgggcaaagaactgaccaccttttgtcattaggggtgacaatgccgaatttggccacaatcgcataatattgtagatttattgtggcgattgtagatgcatccctaccttagtttccctgttttctggagtaattgcaattagtggacgttactatcctgaacctgtaacttcatagcaacaaatcttggagttcatcggtgccatcctctggcattttcttacctgatttcagtttgtaaactattttgcttcattgattcctttattttatttctctgaacaaatcttgtatttttctaaccaaaatatgaaagtaaccatttgtttctatcatattgtaatggaaaattttaaatcaaatctaaccaagataatatgaagcattgccaaaaaaacagagaaattttgagcatgcatatagagtgccagttgaagtgaatttatttaaattgaactttgcaatggatgaagctcgccatgtttctgtatcaggtttagcatataatttcactttaaactaggtgcatagaagtaagtttcactttaaggtcaatataaatcatcaaacatatggaaattttctcataaattctgattgaaacttcatgaaacaggtccaaattcgaaagttccaaaagatacactcttgatttataaaatttcccttccattatatggtgaacctctagcggaaagtggaaattattcagaacattgcaatttactcagaacattttgatctgcagtttaataaatgaagagagatcacagtctaattttgctagaatatcacattggcgggtcattatcgtacccagtgccaatggttacgatgaaaagacatgttttaattcttacgtagaacatagactttcttactaact

SEQ ID NO: 104860 - DNA, 1331 bp, Oryza sativa
gatggagggagtatagctgagacagtgagacaagagataatcaacatgacagggatgaaagactaatgacccacctacaagatatttttaaatatgattttttattataatacacacatgtatataataagtagatattttattttctcaaagtatttctaagacttatctatttgtttgaaaacataactactttattaaggtagaagcaaaggacatgcatggtttaaggtaacatccccaaaggggttggataataacatctccactgtaggacaagtcgatgaatgatgatagatatgagtgatattctggcatattttttaaaacctgtacattggcaacagttgcttttactttttttgataaataatctgccattttgtttagttttcttggaaccagccgaacattaagcgattgaccctgcagtagaaaattaagtaattttaagacttatctacacatcgtgttttactgtctccaaacaaaatattctgtaagttattaatggtcaaaagttctaatttttttatgttaaccttgtccaaaacagctagagcaggatataatactaattaacatggtgtttgctttgggtcttcaattaattctataatcagaatacatgaaaactaactttttttttaggtaaacgacggcaggagctctgccggaatttcattagaacaaaaacatgtaatattttgcaactggtttgtttgattatcagaacccactatatctggactcaccacttctgtcatcatcaggtgacaacgccaaattttcaccacagtcgcatagtatttcatatttatagtgccaattaatttatacatgcacccctgctcagcttaactgttttctcgagtaatggtaatcaccagtcgttatgaccctgaacctggcatttcataggaagcaggcaatcagcttcactcttttcttgagtccatcctctgtttttttcccagtgtggtttcaatctgtacactaattaagaacagaggaagtatgcaagtctgtaaaatgcaaatttggaatggtgcatattatgtactacttgacaattagattacttaaatatctgcttggatgttttcataataaatgcttatcataaacactaaccaaagagtacaaatcagaaccaccttgctagatcaaatccctctcatgagtcatgagaatatattatgttggaagatcttatggtcatgaacccttgacatgttaattagcgcgtactacgaaataatacatgaatataatccgggttttgtggatgatagtaaaatgttgcgacaaagccagataatactgatgag

SEQ ID NO: 104861 - DNA, 2340 bp, Oryza sativa
ttttggacctaaaatcaacgtacatgacagccccagaaattgttcaagttgggctgaagaacgttgtttagatgggtcatttctagaattacaatcccgagttgatcccaactaccaaaaagaaatatctcctggagtcgtgaagggctactccgctctccttgtggcttcatggaggccatcgcccgcaaggaagaatcgataaatcatcttattacagccttcacgattatgtcattacaaccatgagtccttatcaggaccttgccatggactgatggttgtaacgacatgaattgctgatgccactcattccaaagccggggctgtttctgttgtcccagtgggatgttcatcaacactgaaattataaaaaattcatctctcaagacttttgtgtgctctaattaacccccaagtctcttttgcagctgaggctatgttgtagccaaattgaagggaactgaaaaatgattgggaggggttcatatatagagctgagagacagtgagaccagaggcgatcaacattacagggatgagatcatgagagagcaatgacccaccctgtactattgcacgatcaactaagtgatgaatggagctaatatatcaacatgcttttcactgaaaaataattatgggtcttgatccactaggcactagatatatacatagctaggtagtaacatgttgttcgctttgggtcatataatgctgtaatcagatcgcagggaaatgtgtaacttttagcaactactacctccatctatctatctatctatacctatactaattgagcactttctcggagcttccacgttaatcagattaatctggccattgattaactagatcgtaaaatcatgaccatagattaaatattataaccactagccgtcaacctgtgcgttgcacgggttactgtgactaataattaaaatattattactttcactggataatgataaaatatgttactttgaatgaagctgatagttgccaaaatcttaattagtaatttcatatataatccattctaatatttcttctattactctattttttcaaaattacataatttaaaatttcaatattagaaatatagatttatactcgttttgttgctcttgttagcatttgctataaaataatttagcaattttgaattaataagtacagaaataaacttagtttggagttaagctttttcatgatttaatgattcctatattcataataattaaatatcaagttgtattctgtgtggagtctcaattataacatcttcataatttaattttaaaattgctaactaaaaatattatactcggtttgaaatcttaatttttgttttatcgtgatttaaaaattgttccaaattttcgaatcaatagcagttctttcatgatttaaaagtatcaaaatttgaaagtaagtaatatatatcgctacagtatcagttatttctatgatttaataattatgaatttaggaattaactggtacctatttgtccttgtgttggtctcctaatttggtgtactacactagatgcatgaattttagtggcacttttacatcatcggtgtgttgtaaaagtggcccacatcattacaatagacataattcagaccaaatagtccttaaaactgacaaaaggcataactcctagttagaaatcatgcaatctaactcctaattagtcagctaaattgaattttttatgaaatcatacattcactgaaacaaatgtatttggatgaagcatatatggagcagatttgttagtgatgtatgtttaacttatcttgtcatcttggtaattgggcactttctagaagcttccacgttaatcagattaatctggccatttattaaatagatcgtaaaatcatgaccatagattaaatattataaccatggacttttaattaaaggcccaacaagagaaacatgtatctgggctaccatttaatctatatcggcttccttcaaagtctacaaactgtgtccatgtcgatctcagccaccggactcaactccacacacggcaagatgacgatacgacaggacatacgtcgatctccttcacaccctgccgctgatgaactccatcgatcgatctccagttcactattttatcgatgcagatactattcagattgatctttgcagctatgattgctattttaaatactcaagtaagcaagatctaattcattatatttaagttttcattaagtattttttacatgttctcatctattctaaactatgtaaaaatttcagattttaaggtatcgcaatttgatagccataaatttggatggagttatca

SEQ ID NO: 104862 - DNA, 627 bp, Oryza sativa
cacctacgacacacatctaacttggatagagatactttctttgtaactaaccctagaggcatttggtaaccgatactaaaaaaaatatttagtaccagttagtaatataaaccgggactaaaatttctccagcattagtcttggttggtgtttctaactagtactaaagatgcttttttaagtatcggttggtaacaccaactggaactaaagatgtttcttggatttaaacttttagaatcggtattaaaacatctttaatatatgttcttaatctagtcgggatatttgtgttttgaggtttggaataaaaaatattttttctagtagtgtaacggccactgattgcaattactcccgaaagcaaggaaactaaggcatgatgcatgtacaatcaccattataatctacaatattttgcgattgtggtcaaattcagcatcgtcatctgatgacagaagtggtgcatctagatagtgggttctgataactaagcaatataacaaactacttcctctgtaaagctaatgcccactaaacatctaaaactcaacatgcaatcataatatttattagcactcttaaaacctacatacaagcatgccacatcaaccttttaagcacaca

SEQ ID NO: 104863 - DNA, 1189 bp, Oryza sativa
ctctaactccaccccctaatacttattacaactccaactccaatcgtaaccaaatagaactagtatattcgacacctattctaacaaactccagattactatgccgatccaccggtcctccagacttgggttgtcttctttgcagcttcaccacgagccacctgacaagcctacaccagactcaccgtcatcaagagacttcattatcactgtaattttcttcctttggactccacccgtaatagtgctccaccttctcacctatcatcccagtagttttgccatcacatcatagactcccgaagaccatgttcacctccatcttctatctttaatttgatttgatctaatacatggctagataatcgatgtcatcaccaaatagataaatcaaactcaccagacatgaagaaaaccctttcttccttgttttttttgaccggaaatactgccagggctttgcccaatagtgtaattttataaggaaagagaaaatttacaaggttacagagttacatgcgggtcacacaggaagactataaggtttgtaaccaattaaaaacagtttgctttaaaggatctttcattctgcacataagcagaagaacttctttgacaaaaaaaagatctccatgcttggaaggagggttgaacattctgaaatattaagcttttcctttgcttccagatgtgccaagctgccaaaaagaaaatttctaggaaacccctctgagcaaacttgagtcttgctagggtgatcatttggaaaaactccaaatcatgattccactcaattcccaggtattgccaacacctgatactgaatggacatgaggagaagggatgtagccttgtctctctgcaattcgcattgcacaaaacacatgtgagatcatcattttctttggcacaatgtcttctatccaacatatctcttgtactgagcctatcacagaacatgagctaggcaaaacctttgatcttcatgacacattttattttccataaccaaatcatgggcctggggtgttgcaatgcagaatagtttagcttataaaatttcttagctgtgtacttatctgaaccccagataaaattccaagcatctcccatccctgactgtaaattcaaactgtccagaacttcctgaagttgcaaatattcagaatatgcctcatctgagaggggt

SEQ ID NO: 104864 - DNA, 724 bp, Oryza sativa
tctgtctcaaaccatcatgatgctctgagagactgagaggctaccccaaaggagaccggcttttcctctcgcgagacccctttcccttctgtcttcggtcggtggccgacagctgtccacgaggggccgggagtgggggtccagagagtggtagggtctatcccatagtcgggttcatcccgttgttgtttcctccccctttcttgtatagattgaagaatatgtcttcctcatccgggcaaccgcgaattatctgccaaacagttgtagggttaagcttcgacgcctatagctgctgaaaggcgtactccaatcgaattttctccggcgaggttcctgctattcctctagtgcttcttcatgtctccggcgacagagctccaaggtttggctgaactttcttttgcttggcttgcttgttggccgggttcgtggcttggcatcctgcagcacccactgtacccatcgctagaagcatggagaacaccggttcggtttggaggaagaagaagcaagctcaaggactggattgcttttttgttttcttttggtgttcttgtatacatattgcacgagtgatatttttttaagaaacacagtacaaacgcaggcgctcacaacgtgcgcacactcactcctatgaacgtacacacgcacctataaataaaatgcacgaataattctcaaaaaaataaattgggatgtaaaccaaacacttccgtag

SEQ ID NO: 104865 - DNA, 1407 bp, Oryza sativa
aaacccacttaaattgcagagatagtcaagtttccagtctctgagcataaccattgaaatgctcaccccacggttaaacgcggcgacgcaaatgccggtggcgagcccaaggaggcagccgatgagcagcagtgcccactccggcggcgcccaatccccgagctcctccccgaccctctccctctgctgcggcgacgatgtcggggacggctcggagcgattgagctgctgcggcggctgctggcttcgacgcccggatccgcgcgcggagagggggaggtcgaggtgctgtaggaggccgcgcacgccgccgctgctccgcctcggggaggcggtgacggtggccccccgcgcgcgcgcgcccaccctcgccgcagccgctgtcgcccttgcagcggcggccgccgcctcgcgcacgccctccccgtcgccgccgcgccacgctctcgccgctatggtttcgcacgcacgcagggaccgacgcacgaggtggaggggacagattcaaccctatcctgtccattccctcaggggtacaatggtaatttcatattttctcaaacctttgttttattttcttttgtatttctttaacacaaaatgtgggacccgccagacagctgttacaagtgggggtagacagccggttcagattcaaaaggtggggataaaactgcaaacaaaacagcaattgactttgaaagtggagggcatggatgcaattgtccctatattatatagaaggacaagcaaatgtatatatagacttctgtagtagtagtagtagagcagagtacatgtatatatatgattaattatatattacatatataagtaatagtattacatgcgatgcgagcttaataatggagtgagtacgcacatgatagatacgtacgtacgctacagatatatatatatatatgcggaagatgagtaattaataggagagggatgagccgctgcagcagatgaattgaagatgcgtgcgtgcgagcgaggttgtcaggcggccggataaggaggaggagaagaggaagaggaggaggaggaagaagaggccttcttgtggtgcctgttgagctgctgatggttgatgcatttgtccttcctgaacctgagcacagtgctcatgtggtcgatctcccagatgtgctcctgcatgagcacgttgccgatgatggaggggccttgcgaaatccggttgaagccgaggcagacaacccccgggacgacctccggaacgacgatgctctttgcgtcggcggccagcctcgcatccccggccatctcgatgctgaaactgggtatcgtcacgttgtgagccgggtccaccccgtcaccggcgaaggtccagttgtagcagtactcgaagcccttgatttcggccttaggcaggtgcgccag

SEQ ID NO: 104866 - DNA, 557 bp, Oryza sativa
  unsure (1)..(557): unsure at all n locations
attcctgcagcccgtgcgctctccagtctactgtgtagctcgatcgtggccattttggcgttttgctgcaacattacctgtcgcggcaggattgaaataggtgcttgcatcgtcttgaaaaaagtctattttataattttttttattttttattataaaaaaattagctattcgagctaattttgtaccgttcttgaaatagctacttgcatcgtcttgcaacaagtctattttgtaatatattttattttttattattgttatggctgtgagaaatattaaacatcactatatattagtaatcaacatccatacaagatccatgggcaaaacagtcctttcactcctcctcctaccaaatctggagctggaccatatgtattattacccaaacaggtgctagctccaggagcctccacggtggaaaaaagaaatttctcttggtaggaagggaagccccttccaatttttttttnnttntttttttttgggcttcaagagtccagttttgtagacttgtagtgccgccatcgctgctgccggcgaatagctggagc

SEQ ID NO: 104867 - DNA, 1137 bp, Oryza sativa
agaatggaggatgacagtaatataaggtaaaatctacagtcgccactattactgtcattttaataaaaccttaagcaagtgtcctgtaaaattaataagcaatattacttacaacacagttattaatacagtcatcttcactgtattgtgtttcctactaccttgatttagtactggattccagtgaaacagttggcattcctgagtcaattcagtcaagatgaaggcatctactcaaccaagataaacggtatcagtcactgaaacagcagtgaccaatcaccattctactagagcatagccaaaaatcaagattatggcatatactcgcatgacaattggcagagttacgctggttaactaaagaaaatgtgatgaagggtatagagcccttagctccctgccgtcgctcttttgcatgccaaacatatggcaaaatgttaataataaatagaggaaagtcgttcaaggatgcaacagaagctatggatcagtaattcagtagttaaaaaaccagtacatagttgagctaagttatgccaatcatctagcaccacacgtaccttgaaaaaaggcgcagaatttcacaatgtaatctggaagttgagtacgcatacatccggaaatttgtctccacaactacaaaaccctacagcaccaacatcatacaatgtaattattaacagaaagtattttcatcttcatttgttgttgcttaggtgacgagtagattgaggttatgaaagatttggacgtcatgaataactgtaatagcaaggatataaaatgttctgaaacctctttgttagacgatgaatctgacaagcttgctgagagatttgtagccagttttgtaggtatgaaccagctgtcctttcgaccctgccatggcttaactcttgacatttgtattcatcaagttgactagggaaaagactaaatcaaagttttacctgctgaagtttgaccagtcccaactccgccagatccctaatagcatttctttggacatcggtcagagtattcaagctataagcctgaagcatgaataagttaaacagcatgttgaagcgaatttgcaacagatgaaccaggccacaaagcttggactccacaacagatgaaagataatgctta

SEQ ID NO: 104868 - DNA, 674 bp, Oryza sativa
acagaagctgcagaggcgacgagaagagaggcaatcgctccccgtcgtcttcccccttctcccctgctcgtcgtcgcgggcgcaatcgggtaggtcgccggcggccgcggttgggtgcgcgagagcggcggcggggtcgctctctttggcctggagtatcctcggttggaatcaggtaagcgcgctcgtctctgatggctctctcatctctattactgcacgcgatgcgtcgatcctagtgtggagcttgggactctgagactgtgactgccggcggcgggagcttgctgctcggaggaggtcggggggaaggagcggcggcggaggatctcgggcggagtcctcttatcgcgattccgattcagaaacgctctgaatttggtttcttctccatgttgagcttcatgagccctattagtattttgtcttgtttggtggtgaatggtataggtaggggagtttccagtgcttgctatctgcgcccccattactcttttaatgttgcctgctggttaatgcccaatggagtttccttctctatatatatattgagaaaattcatagttctgagttctgattgactggctcatatagcaatagcagatctgtttttgactgcttgaatgatggaattgcatattatgctagggcttctgttgcataatcaggcagag

SEQ ID NO: 104869 - DNA, 517 bp, Oryza sativa
aatctatcgacatacaaagcaaacattgcaaacaggctataagactactgaaacagagaacaaaaccatttttaatggattctacacattattcttgatttactgagacttgaatgggattaaacggagctcggatgaattacttatgaattttagaagattcactgtgtttattactataaaagaaatccttaaataatttattgcgcaatattaaccagggctgacgtcagcgagggggcgcggcgccgacaggcgggacccaccggtcagcgaccgggagagagagaaagggggtggcggcgcgcgggcccacgggtcagcggcgccacgtggcggccgaaccgacggccccgatctacccaagggtagatcggacggcggcgggacctcgcggccggggcgcgcgggcgcggcgcgagacggcggcgaccatggcgccggcggcgcggcgctcacactgcggcggcgcgcatgcggcagcggcgcaaggcggcgaccgacggcgaccgaccgg

SEQ ID NO: 104870 - DNA, 700 bp, Oryza sativa
attcctgcagcccggcgattgcaaggatcagcggtgctgaccagaagtatatatgtgtagcttgggaggcacaatatatagtagcaaaggaacgcaattgtactaatcagaaaatgcaaagttgaataatagttcaaagtactagtcaatgtgctggcctagtctagactcaactctagctcaagcaagcacccgacaaaactaatgactagatatgaatcaatgcacaactctgcactctgaaaacatactcaaaggatgatttttttttttctttctaggtacggcttttttaagcacctttctgcccttttttttgtgcggctttctgccttttctttgcacctttctgccttttctttctttttttattttttttacttttttttaacaagaactgaaccactgacttcaaacaaggactcaaatgtaaatatgaatattatagggactcaaatgcaaagtgcaaaactaaaattgggtcacctcaaaaatggattgctcatatcatgtaggttccgtttttataaaaatatctcaaattggctaaaggaatttcagtgtaacaatacttgattgaggaaaatacggagagaggtgctagaggaactcagtcacggtatggatgactcgaccgaacagaccaaaaagccaaacaaaattggttccacccttatccacaactctatatatctctccc

SEQ ID NO: 104871 - DNA, 800 bp, Oryza sativa
aaaagaaccgaacagaagagaaaccggaaaaaaaaagaaaaaccaaaccgaaaagaaacgagaaaaactcactactccctcctctcgcgcggcgcgtccgccgcccctctccgcgcgcgacatgtgtccagtcgcgcggggaggggtgcacgcgactgatcgcccaatagctttttcggtgcgcgcccacaagcacggcaacacataaaccctcctttcccctctgcgcgccaaaagcacggcaacacagaagcaatagcaataaatcaactctctaaccgctcgataaaattttttggaaactacgaaaacggaaacccaacgacgagacgattcaatttttcaaggtcctggcaacaaccaaccagatgaaaaactggacctaaaacaactcagacagacttgagtgatgaaccctaaacctaagtgatgaacagatgcaatactcaaaactaaaaattaaatctaaaattaaaccagcactcgacacgacgatgcaacatagaattcaacaaagcaaaatctaatagaacaatgcaacggctcaaattgtccaggtaaagaataaatatttttatgtggcaattttctggttatgggaacataaattaactaacgggcaactgcgctctgataccaactaatgagggagttaggtcccgatcttccgataggtactgataaacagtcgatttgggcggagttgcgacacaactcgatccggcttctgaacgaacacgctactgagcccgcaatcgcagcaccacgtctcctctggttatcaaccgtgccgaaacccg

SEQ ID NO: 104872 - DNA, 940 bp, Oryza sativa
ccccggttgagaagatgaataaacatgtagaacaacagaagttgagtgattactcttgtaagtatgaacaaaccttgagccctaagacgcctgcatttaataggctctctagtgcacttggattgagggcattctctggaacgaggcctccccaaaccctgtttgagaacagcagacaagtcaaaaaaggtcggaccatgaaacaagtttagatgcagaattactgttattatggtggatgagctgtttttacctcccttggttctctacttgctaatgtgcaatgatactgaaacgtgtaactattgcattgcaacttacctacatcaacatgtagtttatccttagctgcatccaactgataatcaagcacgtaatgtcagtgttgactaaagagaaagcaggtagtagcaatttgatgctttatatactgatattggtacgataaagaaacactgaccttcagcttgagagtttcttcagaaacagttgacgggtagctattaagaggcatgtccactaatgttgtaatgccacctgaaatgaacaaaccgtgaaactttgagcaaaaagtctgatctctttctgttattgaaaagaaaaagaaaattgattactccctactaactcggtctcatgtctcaatccaagaatacgaaaatgataaaacaacagtcccagtggcagtatagtattcagaacacatcccaccatatgcgagggatgttgccgtaccgaattcagaatgcatcccacatgagagggataagaactaagaaacgtgccttatttagagcatccccgacattagtacgcaaggattaactttatttagattgacaagccaacacgttaatgagggttaacttgatatagattgataatgactgataaaaagctgcacctgcagctgctgctcttgtaccagtggagaacccct

SEQ ID NO: 104873 - DNA, 794 bp, Oryza sativa
ggccacggcattggcaacccgctgatttctcagtgttacagaagttttcagaaatcgtgaaggggcagcgcatgcatatgcatggtttgaaacctacaggctttcatgaatggctgcagtcaattaacttttacacttctctagaaacccggcaaatgatcaggataggtctgtaaagagtatactcaataaattaaaggagtactcaaattaagtgtgcaagctagcttctgtgtgctggccgctgcagatgcgagtatcattagtacagagatgcacttaactgtgcttgttttgatcgagagctggatgcgcgctcctggacaagtctgttcagtgagtccaacagcttgaagtgtactgaagggttgtctgcaagtgagctatagctaagctaatcagtttagtagtcatgcaaaatactatagtatatatggatgcacatggtcagaggaatgtctgtttaatagctagctagttacagggtatgttgctgtgtgattaattaactataacatttatatgtcctattctgtggtgcaaatgagattattagagctagcgtgttgtgtgaggggatggtggttggttagagcggattttatattttatggatgctatatagtactgcaagcaccatatatagtactggggagatgtctttaataatcgtgtgggagggaatatggaatcaaatgcactgatcgcaacaggtatattttaatcgaacaattgtactggatatgcgtatgtcgttaggttgagaaagacaaatacgcctttagggctgcagg

SEQ ID NO: 104874 - DNA, 784 bp, Oryza sativa
gacttggccggcaagtggtgtgcatatggtagtagttgcgcaccgatagggggagtgttcgcctaggtcaattaaggactgaactacgtgtcaccaactaagattacagtgcaaccacatgtgttggttatggggcaaccttagcttattatgttgcttattgcttaaccttgcattgggaggccgttgtagtagggactagtctgagcaatggttcataggagctacacatgtgaccctctatgggaacggttgtgttcgccatatggcatgggcgtctgagcatatccaatattactgatagtgcctcgttgagggaacggatgtgttcgcctcacggcgttaggattaggttggggcccatctttcctagtggcattggttcatggccattgtggagaaacactctccgtgcgcatgcaaggttaatctttgagcaatgtagtggcttcgtcataggctagcaaaacaggtaccggtttggtatcgcgtggcatggtttacatgattgctagctcgtgtcatgtgcgtaaagtgcacaaactctgcagagtctaaactaattgattagccgtgctcacggtcatgagcgacttggtgaaatgatacaagtataatgttcgtgacttttgttaagtaaattctgaaatgggtatggtaaataatggtgatgatttatgcccagcatgggttaagaataaaattgttacttgttgccatggagggcacaaggatggcactatgataacattaatgttactattactgttgtttatcctttgat

SEQ ID NO: 104875 - DNA, 753 bp, Oryza sativa
attcctgcagcccgtaaataaataaagtaaactaatcttgcagataagttgaagcagttgaaaacaggatcacaaatttttgcacttttgaataacaagtttcaaaagaaataaaataaaagagagttataaaatcaacttgctaagtttattatattgcaacacgattaaataaaataatgttgtaaaacttttgctggtaaatggtacattagtacagtaatagatgtacaatactaataacacaggaataataaataaattttgaatgagaacaattaaagagattataatctgcatgtgccattagcttggtttaattaaaagagaaagagaggagaacaattctactttttcaacatttttagagggcttctataggtaaccatttggcataacctagggtcaaggaggctatgatacaaacttgtcacgtccgaacgcttacatgtgtgtaaaccctcgtccaggaatcagctgaggcacacaataacaaattgataatagactgcaattattactctaattgataagcgaatatacagtcattacagaggtagatagttcctctcaaacaataaagatctaagcagcggaaaataaaataaagagcgcaggcgacaccttcagcatcactgtagaactcctcctgtgatgaatgattgcaaggtgagtatatgatatactcaacaagccacgctgcgaatatgcaagtgcaggggataacaaaagatggcataatatagtctcatt

SEQ ID NO: 104876 - DNA, 891 bp, Oryza sativa
ccagcgagacttggcggaggggaccggtagacggggtagagctcgaccttgcggagccgatggaggtggcggcgcaggagggcgacggcctaggagacggcgcacggctgctgcagcggcggccggaggcggcgaagcttggattcttgtcggcgaggtacttccagaggtcttcgtcttcggggaagtggaggccggtcttcctctccttcttgcgaatccaacggcggcagcggcgaccgaaagcgacgacagacgacgacgaacggtgcggctggagcggcgccggcgcttggagagagaaggagagcgtggggagagcgattccggcggcggcggaagaagggacttgagaggataggtataggacgactagtgggtcctttatataggcacgggagctcgggtccgggcccaaatcgacgggaaaagtcgggaaagtctagggttctcgccggagtaaggaaagattgaaccgcgaaattggaaaagatttccatagaaacttttagtgatttcttggggaaaaggaagaggagattgagaggatcccattcccgcaactaatttggaaagaggagcaacggggaggtcggatttggaaggatatcggcggcagctgtgcacaggctggagagctcgggcgctgtccagaggtagaagaaggagcactgtagcgagagggacgaaaaacagacttttctgcgtctgagaggaagggagagaatgagctgaattcggcccaagctgaggggaaaattcttattacttttccaaataaattaaccaatgagatgatctttcaattgttaaaaatacttccaatgctcaaataattaaaagaaaaatcttgaacatacttggacactctaagtatttaataatattgaa

SEQ ID NO: 104877 - DNA, 727 bp, Oryza sativa
tttacaggaatcgtgaaaaccaagaagtgtacttaagcctttccatgtaagtgtgtactccttatggaaaaaacgaaaggaaatttcatcttctatttctttcatagtgcacagaaattgcaaagtaagcaaacgagaaccaagctcatctaccacaataaatctctgccaaccaaccgctttccaaatagaacgaaattcaacttcaatacctatctttttcagcagctccggtgagtattctcgcgtgtgagcatactcccggtcgctcagcatgtagtaggcttgtctcttccgatcactgacaaggtcgaggtcggtgtcgttcaggagtcgtcgcggagcttcggcgtcttccatcaaaacatctgctgatgaatgagtactagactcgtcatgacgacttgatgaagagccggaccccttgaacagacgagacagtcgcctcctcattctgcacaatggagcaagaacggagtaactcggcgggggttagagatgacaagaatttcacacgccggttagtttcaccaaagcaacttgtatacatgcaactaaatattttaatttgagggaaacaatcaaaacttgaatgaacttgagagcaaactttggagagggaatgaaaatgtgttgaaatggggtggagttccctctcccggctggctggcttttatagggtacccataacagtcagaaatgacatgtgggacccactagccgttac

SEQ ID NO: 104878 - DNA, 1310 bp, Oryza sativa
atagaaaaaaaaagagagaaaaaaaatctaaaatattagatcatgatgagcctatattataacggttgaggttgattggatacctataagtattaaggttagacaaaatatagagagaaattaattctactcaaacttggtaaaaaaaattgctaccctaaaaaaaatagaaatcatgttggaatcatatccggacacccattcggacaatgtctcacacctcactaccacgtactccatgtttttttagagtacatgtttttcttaataatactataaaaaaatatttatgcattgtaacgggtgaatgttattataatcttattattgttatataatttagttaagatgaaattcaatgtggaaattcacttgggtatatactttttagaaaatcataagctgcaattaagagcctgatcatctcaagttagcatgcgagttttttaaaaatatatcttatacgactccttccgtatttccaaaagcgaacctaaaacctggctcaaatatagatttgtatttttaaaatcaaacggatttaaaaaccgactcatacattgtatgaataacgtatcaagatacactatacgcagcatcaacatatggcctcatatgtatagttatacatgtctatgaataaatatatatggtgggttgagaatatatattattagtttggttgattgatggtcgatcaatccatcaaagttggcacgtatatagcagcctgctattgcacgggcaacaatttttgaccttataaaatctgtcaatatttaatgccattatgttagctttatttttttaacgaaccgccagttagatagcgtgaagtttcattgaatatagtagtaaaaagttaaaaagaaaaaaaaaactacaccatgcactggtatcgatgtcccacacaaccgaggaatgtttgctttacaagttgaaaataggaaataatccgaattacacccctaaactatagcagcggtgtaaattaccatcttaaaccataaaacagacatcattcagtctcaactttttaaaatgcttatattttaggatggagcgagtagtaatgatattttttaaaaaactaataaattataatggcatggagcccactaaaagaaaaactccaagtctaaagcaagccggtccaaccagccgtcgacctaaccaaatttcttcctcgtaatttcttcctacgccgccaacgccatctgtccgtacgctgctgctgccgccgtcttctccctacacaacggggagccgctttcctatccccttcacgacgctgtctccctctccgtcgg

SEQ ID NO: 104879 - DNA, 1735 bp, Oryza sativa
agatgctgtacgtgtcggcgccggtggccgctgcggccatggaggagtgggtgctcgacgagtacgccgccaagcacagggtcgccatcgataggctgctccaactgagggtatttgtcgaggtgcgcgatcggtaaggcctcatccatctccaccagcgctgggtgcttcaagtgcgccgcagacttgcaacttcctctatagatcagaagtcgatgaaccaactgtataatttcaatccagaatgtcagatttctggtgctaattttgccttagtggtttgccagcgctgtctttggcatgccggggggcctgatatgttatcatatatgtcaacttactgaaattttggtgtaactgtttggccctaaggatgctatgcaactagtaatgcttttatttattgtaaaaaggaaacagcaatatatttggcatgccacatttggtctgcaaagtgcaaactcttaaggtgaaatatgcaacagcattaagaattatgaatcaatgttggcatgagaagaaaccatcatgatgattatacccttggacgtgaacaagttttattcagctctagttggggtagtcgattatttttagctaattatactgctggaacatcaatttcatgtgtactttgtcacatgttctgtttcttgcatgtgcagaggcatagctaatatgaatcttatagcttactcagtttatgaattactttaattttactacatagtagactatgtttttctacagaagaaaggaggtgagctacaagatgaaccagaagttccagggcaacatgcaaaagtatttggttgatgggtaagttttagtaactactgagctacttttactgaaagccacatacttttctcatattttgagctaattgccttttccccgtcgaaactttatgatagtgtaagcatgtgctttatttccttatatatattatgtacaactcttaatattgtagagtaatccttactatatactccggcatacgttgcatgtatagaaaaatttctcctgcacacattacatgtagaaaatgaaaaagccacaatgtggtagcaatagggtggaaatagttcacaaatttaccgatgattgcactgaagaacagtaaaatcaaattgactaatttgtataaaaataaattactgtatgttacatgtttcatgttattcagttatttttcctgtgtgggcagcctgagctaataattaaagctttattgccatgtattttgttctgcgtgttgtagcatatcaaactagttgacgacattacagttttatttttctgcagtggaagtttaccaagggaacctataccatcgagtgtcactgcaaggttgcctacattggcagaattagagtcttttgctcttgagcagtgggaggtcaggatgacaaaagcttatgtttgcatgtatattttattttagggaaacactttctatctttttttgctcatcagatcgtactgtttgaatgctaccaatgttcactcccctagtaaaggaactcattcttttctctatgggaaaatagtgcttcttgctgcaattgatcaactcatctcaagtcgagagagggacaagtttcagctcatccatgatgagaacttttcagcgaggtcttctgagttcaaggtccatcttatttcctcccttgcttttggcagtgagttatgcataaaatacggacaatcaaattttgtaacaacaacaaag

SEQ ID NO: 104880 - DNA, 602 bp, Oryza sativa
tgaacaaaaggttcagttcatggtcgcaatttttgtcctcgtatgtacatcaacgaagcttagtactgggattaattgatgagaaattcgatgggtagatcagggggtggttggttgaggtgttcgcgaagaacccagagcacgtcgaggaagcggacgacgccgaccagctcgccgtcgtcgaagtccaccacccacacctgcgtcacgcggtgcgcgaccgcctgcgccatcaccgccaccagcgagctccccgggtggcacgcgatgatctgcctgttgttgtctcgccgcgcgcacggcgctggcgcatagtgtttgtacccgtcctccgcctcgtcgtcggaggaagacgagaaggaggataacgacgacgatgacgacgaggaggaggaagaggaggagggggaggggggccacgacgaagggtcgccggcgtacaggaggtcgaccatgccggggaggttgcggcggcaccggaggtcgctgcggtggaggaaggccgtgaggtcgccagccgagagcgcggcgatgggccgcgcgacggatacgtcgcaggagcagagcgccgacggcgacacctcgccggcgaggcggggggc

SEQ ID NO: 104881 - DNA, 520 bp, Oryza sativa
cacttggttcataactgggaatagttcccacgaacagacaactcggattcactttccactattctcttcaggttgtcctcagttagcattcaacgtattcctttacacctttaaccttgatgtgttctttccagatttctcttatcaatcacctttcgacctacttctttgcctgatcataaacacctttgctggtatcttctatcaataaccttttgaactttgtcaaccaagtactcttcactccgagagttgtggatgcttctggtgacaatgtggtcttttggtctgctgcctttcagtgaaaccttgaagtgtttcgccaaaagctgtactgactgtctttgcctttgatccgaaaaagacacatctgaaactcttagtccaaacaaatgtctctttggttaatcgcttgattttcttttccattatcaggttggttattaactcgaggttagaacatagttcctctgaaatgagaccctaggtctcctttgacagtgaacgattatacacataa

SEQ ID NO: 104882 - DNA, 1221 bp, Oryza sativa
atttaatacttttgttgcaatagaaaatgatatatcgccacaaaaaatcgtactgttgcaaaaaaacatgttctatcgccacaattttaatttttgtggcaatttatatagtacatggtacttttcactattttttttttgccacgatcaacaaattcattgcaataaaaaaattgtcgtctcataatttaaattaattttttcatatggacacggattgagacaaattttatatggaaattatagctctcgacgagatctacaattttataggtgataactttttcatttgaaatcttttagatattcaaatctatgattcaaatctcagttagctaggctcaaatggaacgatatgcattttccaacagaattgatgcgtagatgagttggtaaaggagagcacgcgtgaaggataggtcttgggttcgaatcctagccaagacacaaaatcaaaaaaataagtagataaatagataggatgatagattaatatttgaacttttaatttggtacgtaaaactaataccacatatggagtggtggcaataatttttattacaacgatgtgaagtgttgcaatatgactttttgccacatccattccgtggcaacatctaaatttattaccacaaaataaaaatcgttgcaataacctattaccacggctagcaacgattttacaattgtggcaagatgtatctattgccacaatttgagtattgatgccacgatttttttcgtggcaacaaatgatttttctagtagtgaatacccgtactgagctatcaccatcagcggcccacctctcatcggcagcatataaccccaaataatgatatcccgtaatctagacaccatgcctaaactaccagatactactctaatatcatcgtcatgacatagagtaattgcataagcaaacattatacccgtaccgatgcatctcccagataagctagcagtataatcagtataacatgaacataatactaagctggcattcatatactcggaaaatatttgaataccagaaatgtcggcacccggggattgaattcccgaatacctggagcgtacactgtactagtcccatgatcaatggctagtacacgcgtccacaacattgttatcacatccatacaatcatacttgacatataagtagataagtggttctcataacttaacggtgcataggtcttacatagtagttaggccg

SEQ ID NO: 104883 - DNA, 998 bp, Oryza sativa
atacctgtacctatgaacctttgccctatctaacttaccatcttgggaaattgatgaatggaacggtcatgattcaagtccttctttttcctcctatcaatctgttagggttttcatttattttcgcaaagtagctttactcctcaaatgaccttctctcagatcactcatgtggtttgatttgtggatcctcaccatgcatgtttgccgaattgtccctattctactaggttgtataggtggagctcggtagggatcaatcggggcatacctgcatcacatatatagcaaagccaagataccggacccaaggagatagcaagtcatactctctgatcaagaatgtgcatgtgtgtgatctgtgtatgggtatggagaattgtgtggatggaaaaaggaaaatagaagataacaactcctttgatatatctcctcctccaattttctctctttggaaatttgagagagtgcatggctatctttttttcttcccttttttttcatcatgccccatactttgtatgagcagatttttttattcatttttttctcttttgtttatcaatgctccatacttgtatgagcaagactttttttccttcttttgcatagccatgcctctctctatctctgtttttttttctttgaaagaattttggagaaaaaggcataaatgacatggagtatttattttgtggataatgggtaaaataaatgatggatgagggatgctaccttccagtgtagaagtttagcatagtgtgtgtatatggagtgtacgtgatcttgatcatgaaagtatgaaaagcatctcacacgggtcacaataatttgacaaagctcaatgtaatgcaagcagcctaaacatatatcaggattttgcaatgagaatcatatatggcctttgtaggtaataatatagtcagtgaggagtattgctctaaaacaattttttaattttcgcaaagacaaaatcccaagtatcatgacagttggac

SEQ ID NO: 104884 - DNA, 1816 bp, Oryza sativa
taggaggccttgatatgtcagttaccggattcatggccattgttccacaccctaggaattatttgaagggcaatatttttatgaagcttaaagattgaatttgaatccatctgccctggcttgaaggtgaacatgattttatttttaagattgcattttagttactcttaacatactccagttactcaatcatatacatatctgtttcacacatgatctatttatgcacttttgtcgcgtttagtctaaaacgatgctgtcaaattttaaaagggcattgctttactaaattgtggtgtatgtagtattagcatgtcaaattacatttatgcgtttcttgcttcccgaccatatgtcaaataactgaaagtgttagtacttgagttaacccttttttcatacttatgccatatagcaccctaattttgttcatgcgatcagaggataaaatattaagaggattctttagtatggctcattttattgtttctaagtttagggttattcagacagataacactttagctttctatataatattggttttacaactttgtctctcgaaggttttttttttttggaacgtattgatggttttcctcataatatgctcttgaaatccatcttgtccctgttcaatgcagtacaatccaaatattatggtatatcaacagcagcttcagtctgggacagagcaatacaaggtcctccctgtaagtttagtatgaacagtgcaatcaaatttataagtcttccctatcaaaatttcagtatagccccatttgtgctggtctgattaattatctttgaaatgatattctgctttgagattaaattacatgtaactaacttgctttgataccttcacaagtcgtgaaatggtttagctgtacttccatgtttgggttacttgtgtaatatttggtaggctataaacccatttgttgtgcctttttttttattatattgctcaataaagatagtcaatcaatgtgttgtaaataataagggaattggcttgtatcatttgtttcttctatgctcaagatcctgaactgttgtgcatgtatcatttgttgccactgagtcattatttggattcatcagagaacatccatcattttgattaccagactatggactgatttatgccatgcttgctaattgatagagggacatttgctacttctgcatataggacagataattaaactttttgtgcgctgaaatgctctttgtacggtgagtatatgacacgctaaagatgactgaaattaaacttaggatacttctgtttgcaactataagacatgagttcttttgctatatttctggataggtggagtaggttttatttttaagagtttggtctgtggattttcgtctgccgatgagtctccaatgtttgatacagtgtagcccatgagcagctgctgttttctgattttttttttcaaggtaatgtagctgctttgtgtatatgtgtttgtccaatagtgcctgccattccctttggatggtttgcattgcagatgaattacgattgccatctcatgttgctatggcactatgctaagtgaatcttgttcacttcctttattcaagcacaaggaatttatgtatgttcattatgaaatctgtaagttagataatgaacatacataaattcactagctgttgtgttatcacattgattgtaacatcaaaacaatcaactactagaaaatactaaagtttctaaatggttatcagaacacactggaatttttttatgggcttactgttccacactgcattccttcacaattgaagtttg

SEQ ID NO: 104885 - DNA, 965 bp, Oryza sativa
acttatgtggagaagccaatccatatcttggagacagataagagaagaaccaggaatcgagttatccgtttctgcaaggtccaatagagtaatcactcggaagaagaagctacttgggaacgagaagatgaattaaagtcagcccatccgcatcttttcgccagctcttctgaatctcgaggacgagattccgtttaagggggtaggtttgtcacaccctaaaaatcttaaattcataaattgttgtttaaatggaattattagaaatgattttaaaaccctagaagaaaagatctaattttaagtaataaattccaatataaaagtgggccagataaaattttattaaatacgtcacttgattctatagctcctagatttttctgggatttatttgagccaaggaagtatttttaataaatggaattgcatttcatgaataatttaaaaagaagaaggttttaaaatccttcttttggatttgggccgaaagtgggcccaagtctctctctctccccggcctgtgcacgcccggcccaagccggcccagtccgccctgctctccctcctctgttccactgacaggtggggcccacctgtcagggccgtgttcaacctctcgccgccagccgcgccctagccgtgcgcaagccgtcgccgcccttccaaattccatcgcccctttcccgatctgatcaaattgatagaggggaaatgatccctttgatctcctctatcttttctcctatagaaacttcatctaatttcgtttcgaaatcgttggattcgagctcgattcggattcgatttttccctccaaccctaaaccttccatcgccgccgtgggcctagccgtcgcctcctagcccctataaaaggacccccgagacctcttttcgtcgccaccttcgccttagctcgccgccgctcgtagcgccatagcctctagagcccgtgcgttgccg

SEQ ID NO: 104886 - DNA, 743 bp, Oryza sativa
ctcgacgaggcaaatccattcccctacttctcccttcctttccccctccgatttaagccaccaccgtcgccaccataaccgaccaaaccgagctcttccatccgccgttccgaccttctccctcactctctcggccagccaccgccctccccggctgcgcggtgctcgggaacaccacccgtcaccggcgtcgccgccttccgaccgccggaaagccgctgccccctctccctctctctctctctattggctcgggaaaaaagaagcagaaggaaggaagagaacgacgggaggaagaagaagagaaagaaaaagaaaaagaaaaggaaaaaaggtactgacaggtaggtccatcaacagtgactttttacaatttctctatttaattcaaatccaatctttagaagcccatatctcctaaaccgtagatccgattccagtcaaacttggacctaaatttatataaattcaaaatatacattttgataccaaatttgctattttaatattttatttgaatttccttaatttattcaaatactatttgaataaatatttgatttaatcttatatttgaattcccaatttaaacttagattttcctttcaaatatttcctttttacccaaaatactctttagccactaaaaaccgccggttggaactttacgccttccatggggacgttcgcgtggtctattggccccgacgtcgaaccgttggttgtaaagcccggcataaacc

SEQ ID NO: 104887 - DNA, 1291 bp, Oryza sativa
cagtagaaaagggttgatttccggggggctagtactgttccaaccgacataagactgcccaagtacttgtgaagaacgaacgagtacgaccgtagcttttagaatggggacagacctagatattatgttaattaacaatgtggtacctctgtacagtggtttcttttgtaagtcctcgcgcaggaggcaaatttacgccgcgaagggcgattgtaatatttaccgagccgcaggtaaatatttgagataaattatgatgactagtctgtttgtgaaccctgattgcgatgacatggtgtcatacaatcagttctctctaaagaccccgggagcgccagaactcctctcgctgctgataacgttacgtttagagcgcatggggactagagttcatggaacaggtgccacaattgttaataacgtaatactaggccatgactaagctaataaatattggcaactcgtggactgtgggtaaagcgtacatctactgtagtagaatatttatgaaactattcgaatagccatgctcacagaattgagtagcgggactcatatggtatttggttagaaaccaaattcaagattttactaaatactgttgcattaaagtcattacaggctttcttcttctacatcctctgctttctgcaattaaatctagccttactcaaatgctactatttcatacattattgaatataatagcttgctgagtacgttgtactcacccttgcttcaacctcacctttttcagagtcattttggagtttgtgcctaagctgggagttcaatcatataagttagtttcatttcaacctaattctcaagtctagattagatagatggtttaagtctatagccaaacattagagttaagtcattctatagcttctgttgtattagtttgccacaagtttgtaaatacccatatattttgtaataatatatcctttggagccttattcaaacgtatgcaatgaagatctagattgttgaacctatatcaatttactaatccagggcttgatacagtctaaacatgtcggtttcggaatcattagtttcgggacctgacataatcgtaggacaccccggatctttcttcttctccgggagcttgtcgagtatgacattgctgcactgctccgtcagcttgaccacctccgttggcgggagcggtcttttattgtcgaggatgtccttgagataatgtgcgtatgttggcacttgcatagcatccaacaatggcacgttgatgtggatttttcgggatcacttcaacaaaacg

SEQ ID NO: 104888 - DNA, 726 bp, Oryza sativa
aaaacaaattacagattccacctgtaaattgcgagatgaatttattaagcctaattaattcgtcattagcaaatgtttactgtagcacctcgttgtcaaattatggagcaattaggcttaaatgatttgtctcgtaatttacacgcaatgtgtctaattagttttatctttttgtgtatatttaatatttcatgcatgtgtctaaacattcgatatgacaggatgaaaagtttttgcgtaggaactaaaccgggcctctaaatgtagtcacagttgacatctagctagtatatttctgatcgcccgtatgttgcttgtgcgtgctgtactgcactttcctggatgcaatcactgtcttgtttgttaaattctctgcagatcacagggaaacttagcctgttctcatatgcaatggaaaagttaaggctagctagggatggggcttgtgtctgtactcaaggctgcgcaaagaagggaacaaactgagcgcagaacccgattgaaactgtatattctatcagatgatgaatacaagagctatatatatatatatgaatgtcttctggtatacatgttttttgttgggaagagaaaatgaaaacaaagagtagcatggagaaatgagaagggaatatgtactgtagagaatggaatccgtgcaagtactgctagctgcaggaatgcatcagaggaaatatatactagagagcatgttctgcatcatat

SEQ ID NO: 104889 - DNA, 730 bp, Oryza sativa
attcctgcagcccatcccttaactgagcatactatcgatcatccagcagcatcgctgaatcaccaaccaaagaaaaagcttacatttggttggtccgccactttgccaaagagttgagtagtcaccgctggtccaacgccaaatgaacttgtccttgatggtactatacataaatagtgaagctcgtgaaaaatgaatggccgctgccctcatggaatggcacctggttgcaagatggcatctttgaaaccttttgacttggtttttttgaggcagagaaaaaaaatcttatttcgttagtaaaagacgctatagattaaagaaaattatagatatcaaatgtcaacgacccatgacttaggcaaagtgttgtggcctcaggtactgcaggttgaatcaacatcagtcctctgctctttttcctgtaaaactgaagcatccaacttagtcgcatagtgctcgttgttctgtcaagtacctatcatccgtggatgcaggcaaaaccaaactaaactgcatctatctgcacatcgcgacgaacaataacgagtaatttatcctaagaaatgcagtactttttgactgaaccgtcgatttttttaaagataatgaaatagataatcgtttgatctagtcccataaactgtcatttgtcatgtcggaggacattgcgtggaagctgaacacaaggttcattctactcctactattgatacacctctctgaattt

SEQ ID NO: 104890 - DNA, 1699 bp, Oryza sativa
aaaattccttaatctttcttgatttaaaataaaataaaatggaattaaaagcagtgtctatacgtcactgtctactattttacaaacaagtggttttcaaacaacatgtatactatatctagaaataaatattttaaaatctttcccttgaaaaattattctagaattctatttgatttgcaaaaaaaaagctttatttacagccacattgaaattacattttttttactggtatcaaatggaaaggtagtcatctctttcgtcctgtcacacttgatatatcagctagctaagcacagaagcccaggatatgatgcactagggtgaaatagattttgccataaatcaattagtcacgcaagtgaaaaaaaaaacttgagcaagacataatgcgatgactgtgtgttgttatgtttggttgcctgccacttttcttcttttatttcctattggttctttcagtaaaaagagaaaacatcagagaatgcacctactgaaaagcttgcctacccctttgaaataataccttcctaccacccagtgtgtagaccgcattcaatatgtagagtgtggtggtaccgacaggtaccggacaaactagagtaaatcacattatgtgggtaaagctgtacaaactctgcagggtctaaaactaatcgattagccgtgctcacggtcatgagcgacttggtgaaatgatacaagtatagtgttggtgatttactaaatgaattgtgaaatgggtatggtgaatattggtgatggttttacccagtgtgggctaagaatgaatttgttacctgttgccatggagggcacaaggatgatactatgatggtacttatactgctactattatggtctattctttgttttaaaaattatgtttcaatctattattatttactattgcgaaacaaaatttgctttacgctaaaaatgaggcacaaatatagccatccttgatctcagcttgcaatagtcctaggtttcccaaggtttgggtaggacttgccaatacctcgtgtattgacccacctcttgttgtttttagtctcgtttgcaggaaacgggtgttccttctgttaccggagtttctaaggatggttctttctagggtgattcctagtcagttgcctgtgtggtttggtagatgggcatactgaagaacttatgtatctttatcttttccgctgcgtttaaactcttttatttggccagtcggcctaactactatgtaagaccattgcactgctaagttatgataaccatttcatctatttatatgtcaagtatgttgtatggatatgatagcaatgttgtggatgcgtgtgctagccactgatcatgggactagtacagtgtacgctccaggtattcgggaattccatcctttgttggatgactaaatatattgccgagctataggatgagtttttttaaaatgtatcgaagtttagatgggattgtttttaatttattttaggcccaagaactgcagccaattcagttaggtggacattacggacaactgaatttgtagtatagtttagtactaaatgggaaatatttgagaaggtattatccttatttgagaaggtagaaaacttgattgtcttagaacaaatacttatttgagtatcgttttgagaggacgactgtagatgggctcaagactgataccatatgtgggagtatc

SEQ ID NO: 104891 - DNA, 503 bp, Oryza sativa
tacccaagatggtgtgggctgacagcagatggtcattggttaattggtttggtttatctgtgttcagtttacctgtaagtgaaatggggctgattggtctcttagtaatcctaataatccatcttttagcaggttgctttttttatttggatagttcagatttgcaccacatttctggaattttaaaagctactagagtttttttgccctgctatatattctctagctttattgtatatgctttcctcattgcatattcaaacaacaactgaacgatagagttcctgatctgatatattctgcagagatggtgaagctccaagattaactgagaacgggttccagtttctggtgtgtcattggctatcagttgatccaattatctaacagactgcagacttctatatttgtttctcactcttttctatttaaccagctgatggagacaaatgctcaactttggtacatcatgagagaatacatctcatcagcagaggtatcgg

SEQ ID NO: 104892 - DNA, 1190 bp, Oryza sativa
  unsure (1)..(1190): unsure at all n locations
attattatattttataacggagtaagtagtgatttttttaattttttttatcaaagggacttcagtgggagtagcaattacttagtacgaggtaggaatagcaattagcatcagcaagaagacctgttnttnttcctcntcctcttcctcattcccagccgggtgctatctctcacctacatcttcttgatagtagtattattttgttccaactttttatttaggttttgtggcgtgctggtagctccttcttccctcgtaccattttcgctgttggtctttattgcagcagctgctgctgttgctcgtgctgagctgagctgaacctgccaatctgcaacactgcaatcgttagcaagttcgctcaactggccagctgctacagatatatctgctgataattgagccccaaccacctttctcttccccctttaaacttccctggtctccgtcctcttcgatctcctctgccgtcgatctcatcggaagagagcgccaagcaagaaaggtaaccatagtgttcaacgttttgtttttctttggtacttttctgctgctttctcgaagcatttcttgcctcttgttgtttttatcccctcgtgttcttgatttcctagttcttgggctttctcgcacactagttttagcctagagtttctccacctgatttctgatgatgcgtctggagtcctgacctgtgatgtggtgatgctctgggagtttgtgttcatcagatgacgatctgtcaagagtttttcttgagtggcaaagcatcattcggacagagattctgaaaataagtgatgccgtcgaatcatccgctgggatgcgaacaaaagaattcttggaattgtggtctgaataaacaagttggatgatccgttacttatgaggtgtttgaattgattggggaaaagaagtggatgataatggtttaagacatgctgatactcccatgaaaatatgcatatgtacaagcatacagattgaggcgagtggaccatggtgttagaagaaatcaccaaacttcagcttgctttggtgattgttcttggcagctatgccatctggccgtttgctttgcaaatcatgtgaactgttcagtggatgaggtgctaacctagtatttacatgtgccatacatggccattggatccagtggaacatctggtatattcacctgagattgg

SEQ ID NO: 104893 - DNA, 866 bp, Oryza sativa
caaaaaaccaggtaacaagcatttatttcaagcctactacccagtagtaagcattgtgggaagaggtagtagttaatacctgatatttgtgctattgccggtaacaaccaaataaaatatgaagattctgacaggatccaggtaatggagggttgggatggatggattttttcaggtggaccccaccttgtttaccactacactcatataagcattgtgagaagagttgcagcttactacctcctggtcatgggcccatcttatttactagttgggtaagatacattgcgcatgccctaacaagtaaagaacccaatgcttttgtagtttgggcctttttggtggaaaattttagacgagatgattttcatttgcgttcctcgacgttgatcttgacaagatacggttcgatttgccatgtactaagtgttatgtagacgttacaggatatgaagacaaagttaatatgttacgtaagataaactatcttgcagttaagcaagatactcaatttatactggttttgatggtcagcggatgctctgtatgttgaaattataagcacataatgatttaatttattccataaataaatcatgacattgcagatataaactagattgaacgcatcattagatctacacatgtaaactaagcagtaaaacatgaacagatcaaatatgcgtaacatgtcgaacatgtaccgaggtggcggaaaaaacggttgttcggcaggaactactcgtggttgcgagcgtcgacgaaggcgcgaagcacgcgagcgaagaggaaggcgagccatcgtgaacgaacaaggagcagtcgcgcgaagcgcttcccaaaaaccttatgccgccttctcccgg

SEQ ID NO: 104894 - DNA, 672 bp, Oryza sativa
cctgcagccccaaaggagaagagggaatttatttgcttttctttttaattaattgattacatgatctttgtgctgttaaaattattttttgagctccgaaaattcatgcgaaaatttcggagaatatttagggcacaaagagtattgcaaaatattctcggccaatgatttttaaaggaaaaattttaaattctcccattatttcacttgattgaattgacttaacttttatttaatttctaaaaaatatattatttaatgatttttaatcccgaaagaaaatcggggcgttacagatgccgctgtggatgaggaggtggcaccgacgtaccctagaatcactaccacgtgctcatgtggcaaatctgcaccgtggtcgtcgatgcagaccaagctcagccacaaccgcgtggctgccgttgtcgatgccgtgccgagctcggccatgtcagccacaactgcgccgccgccatcgtcaacgccgcgaagctcggccgcgtccatagaagagggagcgagagaagcgaggaagagggagagcgagataagaaacgagtggctgagaatgaggagcgcccgatatttttatttttatcgggcactcaggtaggaactttttcccataaacctgttttgggctgaaagcccatatgtgttttgccgaaaagggcg

SEQ ID NO: 104895 - DNA, 762 bp, Oryza sativa
  unsure (1)..(762): unsure at all n locations
aatgaagcngctatcgtattcctgcagccccttcctgatgaacccaatctccaaggccaggattgatctgccctaccactggcactgcgacgacgaggacgacgccatcctccccgactacggggaggagaaagagggacaacgaaccatgtgcttcggcgagaacgccgtgcggaagatcgccgtgtgctcgcctgatctctcgccgccgtcatcgccggctctggcgttttcttctaccggccgggaatgcactcaacctggctgtttgcctccggcggcccctgcttcgcgcgcgacatagcctactacaatggcaagctctactccattagcagtgacggggagcttttcgttcacgagttcagcgatagcatcagtgcagatatcgtgatcggcatagctcctcaagcctagagttgtcaaggctacagttggcggagcactttttacctcgtcatatcgtgcgctactggaaggctgatgatggttcgatggcggtggcatctccccatattttacaatgtacgccgttggggcgtcgacgagctgaggaaggagatcaagctggacgtgttcgaggcagatctggagaagcgcaggtggttggaggtgaaggaactaggtgaccaagctctcttcctcggcacctcctgctccagggcaattctttcatcggattatggcagctgtatattcttttcgagcttaaacataaccagattatgctctgatgggatcattaatggcattggtgactgg

SEQ ID NO: 104896 - DNA, 769 bp, Oryza sativa
  unsure (1)..(769): unsure at all n locations
attgaactgctatcgtattcctgcagcccataaagaatgactatacatgcctctgatctgacgaacggagaagcatataacaaagaagacaacggagcctggtattataaatcggagggagctctagtgttgcagcgtgaggagctgttacactcgtatatgttgtattggtccttgaagcaacctctcataaatagatgcctgtctctctctatcagaaatattctggatcaaataagagagactctgccgtgctgtggaaaccagatcactgctctaaccacttttattacaaatatggagagagtgagatgcatgagcacacgcgccgtcctctgaatccattatgactgctgctacttatttactagaaccttaagattgggtctacatgatagcttgattacttatgcaaatgaataaatactgctatggtctgatgcatgggctttggtgtggcctggggggattgcgagtctgtgacaatactcgctagtgctattggctactaagccaatgggaaactgataagatatccgcgctctggatacgtactatagtgcacgcatgctcatgtaatagatctctgacttgtataatgtctcagtgtcaccataagattgaagccatggttaatgttgctactttgaatggttccccgcatctaattaatcattcgcgcatcatgcatctcacattatatcgacanttaacaagctttcatgcttctgggaatcttttccttggatacatgaactctactctcacc

SEQ ID NO: 104897 - DNA, 692 bp, Oryza sativa
cctgcagcccgtgcttaccacaagccagcgtgggcaacggctgggcttgtagtgtagctttcctctagcttacgcatctaggcaagggtgggcgtgatggagtttggatgggccctgcgatggcctatgcggcttccggattcacctaggcacgagaggggactgcccgctgccttgcgaggagtgggggttaaacctgaggtgtggtgtgcttggttagagggggttatgcgaagggtcctttcacggcctctttccggtatgtcgtggtggcatgtcagcgcacggaaacatgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatgcactgtagttcaggtgggttggttgggtgtaacaccctgaaaattcgaccaacaaaatcaaaactctaaaaatacggattttcaaaaactttttaaataaattgcatcatgccgattttattgcctatttcattggattttgatttcggagttcattaatcgcgaataaagagtaactaattaggaataaaccctaaaattaatttggctaaataaatagttggaatacaatttaaaataaagattaggtgaggatagaaa

SEQ ID NO: 104898 - DNA, 782 bp, Oryza sativa
  unsure (1)..(782): unsure at all n locations
aggatgttannnatttagctgctatctaattcctgcagccctgaatttgggggcggaaattggaaattgatagtttcatacaccaccatttgtccatttcatattccggcttgaaatgggcactgaacttgtccagatttctaatttgctatgtttagcttttgaattggacagtgcatgcttgatatagatttgaattattgaacctgaacagttttaatctgcctacatccaattgaaacatataagctgatttcaagaatccaatatttgaacctgaacaagggttgcatttgccttcaatcaatttgaaaaacagtaccttagggtctgtgttggtgagcttaagaatctgagaagcacctgggtgtgtaccacaccccaccttatgagaatatgagaaagaggggttttccacagtctgtgttttatatatattctggggatcccacatctacagttttaatgtgaaccaaactctggtctgtataggagagtctgtgattctggtagaagctgtattatcttaaaaactcccccacacatcttctgaaatcaacttttgctattcaataatcgattgacaaccaactttctctacccagatcaaatataggagcagttgttgtaacagacaaaacttggcgttgttgcgttggcgcgaacacgtatccgctctggtgcacgtaagaatcccgggcgcatccggaaaacaccgcctctcgcngggccttcttgttgttccggaaaacgactgaaccccttgtcaccattgcgggagt

SEQ ID NO: 104899 - DNA, 765 bp, Oryza sativa
aatgagctgctatcgtgttcctgcagccctatctaggtcccttgccgcctctattggggcggcaaaggacccagatgaaaaagtacggccgcaagctctttatgggcggccaaaattacaattagccccttgccgccctctgtatgggcggcaagggcctaatcgcaattttggccaacgacggcagacggcgcggtcgacccaccgtctgccacgtcagcttgccgcccaccattagggcggtaggggctatttctgcaatttttttggtcgatagattatttctgtaaatattaaaaaaaataatctaaaaacgaaaaaaactcccgcctgcacgcctcctgccaccctaaccctgactcccctagggcgactgggctgtttttttctcgttgggccgtccgtcgccgggatgggccaaattcttgggtgttcccagacaacccattggaacggaaaaagtacaccgaaggtccctcaccttgtcgtcgggattaaaaaacatcctcgaacctcaaaaccagatatgtggggtctcttaactatacaaaaccggtcacccgagatccttcggtggttttgaccccggttttggtctacgtggcgctgaatcagcgtgggacccacgtggaccccacatgccaggtgtccacgtcaccctctgtttcccctcttttctccctttcctatctctctctaactctctgtttgtgtctctcacttatctgcagctggcccaagcgaagcgggagggcggctcctcct

SEQ ID NO: 104900 - DNA, 700 bp, Oryza sativa
ttactttaacctttctgacttccgacagtctccaaatcaaacgttaatcctttgcttttatgtgttacattaatatatgccaatcaaattatatgaaagcattataatgatatgacttccatattatgtattgacagccaaagttaagaaatttcaacagcatagattctaaagtgacaagttaaaaagagagtaaatatctggcgtacttctaaaggtgtagttttctgatagttttggtgattcaagtgtaaatttgtctaaagaaagaacagaggaaatataagcaagttgagtagaattagtcaaagaacatgtgatactatctttatgctgtacatgacctaaacaagcaggacacccctcaatggccctcatctagaacccattggtttttagacagaggtggcacaaaagtccagtggtgccaactgccaaggtccagggtatgtccactgtcaaaagggatgaaagaaagaaggattagtcagcaagatgaaaaggacagcaaggcaagaaaggtcaggagaatgtcatatcacatcacctccatcattctgttccagtattgtcaaatggacgagagagactaatcacctgcctgtccagctaagtatggttgtaacacagaagccgcctcttcatctgaatcctgtcaatagtggcctgtggccagcgattctgctttgtgcccaggttt

SEQ ID NO: 104901 - DNA, 693 bp, Oryza sativa
ctaaaacagcagtacctatagatcacctgtgaaatccaatcatctccaaaaccacttcgcaaataaattctaaataacaaaaccaataatctccgatgccaattgtttatcacagaataataatcaaacacacctttgattttacattatattcttcttaataacttagatagttgtgtccactcagaactagaatatttgatagtttgcatgttcaatcagaaataaggttagggatgctgttaaacaaagcacccaataaccaattttgcaggaatcccagaccagttctactgacgtttaaagatgacttctgtaatcttgtatgcaggacacagcacctcattcgttgatctctgcctgcctacactattcagtattcaccaccagtagtcagtagcaaagtgatgccatatgagtgtgaaagatttgacctaataccagggtttctacctgttgtttcgctagcctactatcaagtgttaacaaggttgcttcatccttcatgtggactaaatattgatcacaagcgtctaaaaagcaacagttgccatcttttgccatattcatttgtcatgtagacctaagaagtttataggtggacattggcgtatttacagtttaggatctgtgtgccgctgccattcggctaggcaattgagagacatacataataataaaaaaatggagaga

SEQ ID NO: 104902 - DNA, 781 bp, Oryza sativa
  unsure (1)..(781): unsure at all n locations
cggtcncaatgagctgctatcttattcctgcancccaaaatttgactaaaatggaaaaaggataaaattttggacgaaatagttgcgtgccggaggggttttcgaaatttcaatcactgcacccgtgtgctacttagggtggttgcatcatgataaaattactatataagctatgaatttgattcctacacggttatacggatgatatatgattacattagatacacacgcacgcagacataggttatcgaaacagaacagcctccctcaatctcaattctcaatattctcaaccgtgttctagattgagatcgaacataaaagttcttcaactgcccttttgttatttgtttttttgacaacatctacaatttaatcttatgaatgaataaactcaattgtcaaaagcttctttcgatatatactatttctggtaaaaaatagaaatcaacttctatatgtttggtttatgaatgaaacattggatatgacgataaatactttgctccaaaattatcacattcataccacaacttggcagacgtaggagtgtagagttagaacatgagttctcgcagaagtgactaaacactcacaatctaccatggtattagccttatattctgactntctacaagaaggtaacattgtagcctgcttacatgcactcaatgaaagcacggtttgcatctgcatatctaactattatcgttacaggtgatttattttttgattcctagtccacttggatgcttaagacaccttaaaatttatttaattg

SEQ ID NO: 104903 - DNA, 665 bp, Oryza sativa
ccagcatgtggcttctagtttattttttggattctacaactacagcttctcaaaatctggactaaaagctggactgttggggtgcttctaattctgagagaagctgcagcagctagaaactcccccaaacagactctatgtgtgtgcctcctctctgtgaaactagtgaagccaaacccatgccatgttctttattgcaactcataaagatttgttcagtgaaaaatgaaaccagatggtaccaaacgcctcacacggcacttataaaatcaatcttttgtttaactccatgtaccctccagaaattcatcctaattgaaaagtcaattctatagtaagttaaatttaatggttgggcccttcttagcgccacctactcctacagcagaagcacaaacgtcaaatttaatggtagagtggcatgtttgcaacttttggatgaaactaatggcgttatagccattggacaaaattacatagaaaatccaagtgcaatatgtgcaatttccccttctcagagaaggaagtgaaatggatcaacatggaaatgtcataaacaatgctacagtgtccatttagagagaaatgcatggagacatacgatcaataaacattttcagttccgttgatgccttccatgcatatgattaattattggaaaattg

SEQ ID NO: 104904 - DNA, 792 bp, Oryza sativa
accattttactgaattataataagaggagatattttttttagatagtgccaataagaagagagccaaaatgaaagaacgacccgttatggtatgaaggaagaaacattcatctgaaaccgagattatacgcaaaagaaacttaggccctatttatttcagcttaagattattgtaatctagattatcgagccagattagtataagctggattataataagccgacatataataagttgttatctgtttgtttctctggattagttagtttgcttcagtttactcctaataatctagattataataatcctaaactgaatcaaacagggccttaccgaagtaactcaaatggcctgataacaaacagagacaagtcactcaagagtaggaaaggtctcaatgttagttgatttatcggctaagtgccagtcagttagctgagaagggataaatcccacttatccatttcctaacaaaaattaaattaagagatagagttattttctgtgataggtaaatctaacttccaaccgtatatccttcaagccccatcaatgcagaggagagagggatgccaaactcttcgcactaaaccctaaaaccctaaattgcccgatcggcttagtgctggaaggggttcgtgaggtgatctcagtgaaacctctgttggcacatcaagaaaaagaagaaaaaaaccgaagaaacaaaagaatcaacaacgatggcttctcaagtaagttagtgagattaagattccgcatcaagcagaggtgattatgtacaagctaaatca

SEQ ID NO: 104905 - DNA, 665 bp, Oryza sativa
ggctcatccgtaaatccaaccccattgactgaaaactggggagatggtgatattgctgccaagaatatccaagcagtatacctgtatcagagaacagttttagagaacaaatatatcatgtttacttaatttacctgctcccagactcacagaggtcacctggagaaatgttccagacttgtggttagagctgcataaataaataaaaaatgctgatgtataaactcattcgagcaattagttaactcaataagtaacaataggcatgacaaacatcaacatcagaaatcatttctaaatgatattcggaggcataatacaaaagtaaaagaattctaagagaagcagaaacgcaaagcagacgaaagaaaaaactaccattttcatacgaaactagaatgtgccctgctgttcatgaattaacggatcaaaccaattttttcaatgctgcttccctgaattgaaggatgccgagaaacttgtgcaggttgtttgctatgaattaaaaggatgcttaaaaacattgtgcaggttggttgctgctagaggcagaagatatcacaatgttgcatgattccgtaaacacattagagcaggtacaatagcaggctataagccagctataaccacttttcgggaagaaaagagaagagagagaagaaagc

SEQ ID NO: 104906 - DNA, 765 bp, Oryza sativa
aattagctgctatcttattcctgcagcccaggattctacaatgattatactattctctgaacacacatacagctggtatgcaaaacttatgctacctaagcattagttcctttacggtgctcacatctagccatctagatctaggcattgatatgcacacttgagtaaagctccattttacatgcttatacttacatgattatgtacaggaatataaggataccacccatacaagatcctcatctgaggaatggtgcatggatggattattgccatatgaggaatggtgcgtggatggattattgccaagttgtacacagatgtgtcgatttttatgatcggcaatataatttatagggtgttctatatcaaggagagatggtgacacagacatttatactggttcaggccctcaatgcgaggtaataccctagtccagttgtatgtggattggatttgtgcccgatgagtatgaaagattgcgtaaccccttagggttcatgccagcgccccttatataatgctgggggatttgccggcatgtgtgatatggtatcccttataatcttggtgcataccattcatgtacagatacaggataggtttccctggctgctatccctttccatgtattacaaataaccgcatgggcctaggcaactcggcctaccccctgcgctgtagccgaaggcctcctataggacacccgggtagcatgttccccacaagctgcttaaaaaaggtgcactccataatagtccctgg

SEQ ID NO: 104907 - DNA, 809 bp, Oryza sativa
  unsure (1)..(809): unsure at all n locations
agatgatanaacctgaactcgtgctacannactgcacccccctcggcggcgtgccgcccgtacccctcgccgagttcacgctgggcggcgccgactggaaagactagtactacgtgagcctcgtgggcggcggccgacgggggagtccgcgcgccgctcctcctactgaagaacgcgctctattaatcgctaacataaaaccgactataccaaattatttcatctattcaaactaatcaataaactcatcaattaaatcaacggattgtattatagtatttattcataacaattaaagaatacatacaaactagcagacataagtcattttaattagaacataattcactataaaattaatatcagtaaataataataacatataaaacaattatatcaatctatttttcaaatagatcatatgagttaaacaaatatcaagaactaaataaattaaaaattcgaacgttaatatctatacaacattaacgaattaattaatgttatgacaccaattaaattatccatattatagaatttatctatttaaccattgaacttaactatcaaatcgaaaaaagtgaataaaattaatcaatccgaaaaatcgaacctacccgaattaatcgaaacgaatcgataaatacgataaataacgaaacaatgtaatgcaactaaataaatcgaaactaattgctattcactacaaaaaattgaattgaaattaaatcctaaccaattaaaaaaactctaaatcaattctatatacatactatcatattaaaatacttatgatccaaactgatacc

SEQ ID NO: 104908 - DNA, 765 bp, Oryza sativa
agtgagctgcaatcgtattcctgcagcccgataagtgcacgcatatacgtggcatgcatgaaaacacggtaatgcagctgaacacaatcacatatacatgcaaatccaattccaaatcatgactagcagctagggcagctctcaaacaccatacaaacaagcacgcattacaatttacataaggttgaaaattaggagtccagaagagtacaactattatatgtctaaagaaatttgacatacatgcaggaaaggccaacggattgacactagaaggaattcatcaaactcggtgagctggcacttgagataggacgaagatgacaaggattttatccacagatgcatcttgatttgaggataaattaatgaatcaatcaagtaatactctggatgtgtttgggagctgatgctgaggcagaggcagaggtcgaggcagcagaatcatctccatggccttgacggttatcaggatgcttcacatctggatggttgggagctgagactgaggcacaggttgaggcagcatcagcatccaagcttccagcagcgtctccctggccttgacggttaccatgatgctccaaatctggatggttggggtgatcttttagagcaatttccaccttatctgggttgcagtcaccatgaagctcaaatgatcgcaagctcggaagacgctcaattccagaaatggatttcatctccctgaaactccaaacaattttttccaacttaagattcttgctgaagctgatatcggcg

SEQ ID NO: 104909 - DNA, 774 bp, Oryza sativa
aatggagctgctatcttattcctgcagcccactaatggaataattactattgcatacacacatgtggacccatatgtcatatacagcgagtgacaaatcattaattgccacatcttaaaagtggcaaatagttaaatgtcccgcgatccgaatccccgggccccacagtactcccgcccagcgttctactccgcctccctgacacaagcccaaccatgagcaagaccggcccccgaagcttggtgtggttccgatcctacccaagccctctataagctctatcctccctcatgtgcttactactttcctactcgatcttggctaggatcggcaagcaggtatctccccaaataacccatacaatttatcgcccatttcaattcgttctcacgaccggcagtagcggattgatcaccgcggagcatgataggagaggaggatctagcatatcgtgaatggcagctcccctctcccacagtcggatctacccatgcagatgggctcacattgagggattgatgcagacatgttcctgccaacagcctacaattccaggcatgagaagaaatgctgagccactggcatggatggccgaggatctcaccttcttagcgctttctgttacccgctacaatgtctcgtgcttaccaagctagtttgtactctaaaaatagccaccctgtggaactaccgcaggagatcggatcatatgtgccttcttggtggtagttaaaacttctaactggatgatgaagggccaaggattttacaccc

SEQ ID NO: 104910 - DNA, 759 bp, Oryza sativa
agtgaactgcatcgtattcctgcagccctattaagttaactatagagatttggagctagcaattggctatactattaatcttgctctaattaggcagggatcatttacgtcgccgtctatagctactactgtgtatacgtttgatatattgtatttccagctcgcgcttgcacatgctgattaggaaactttctcacgtattttagtttcaaatcgctgaaatattaatccttgcactttgttgttaattttggagtaaattacactttgcatcgggtaaaacacacccaatttcactttttaccgagctgctttcaaataagtttcacttggcaccaggataaacataatcaaacctatagaaatttcatcaagttttacaaaatatggataaaactttgtgaaacttggtaaaaaaatatcacaagtttcacacgtggtttataagattttcctgcagttatatgatgcaatctagtgtaaaacacaaattattttgatataccctgatgcaaagtaaaaatatgtactaaacccagtgtaaagtgaaataacatatattttacctcgtgtgaagtgtaatcacttgtttgttgcccccccccccccatactcaaatcctggcttcgccactggccatattcattacattgcaaacaggttttctctttttcaaagaaaataaaacattggtttcttgaagataatccaattaccaatcttagttgtaatatggtccatgagcatccatgcatgtcg

SEQ ID NO: 104911 - DNA, 772 bp, Oryza sativa
ttaagtagctgctgccgtgttactgcaccccattattgagcatatctgctaagtgatgtcaaatgtctgggctatttgttgatttatgaaatataagataaaatagtaagttggttatgcatgagaacatctcaaacaagcattaggtgcgatactgcgaaattttgatgattgaatagggcatgaacaatgtaagcaacgggccctcaacctcaaggtgaaagagtgtgctacatacaattcaatatacttgatttatttttatttacactttcatccaaaattgcgtgcaactaccactctccatagaaaaaaaataaaaaggttgtatataaaataaactagtttaaaaaagatgggcaaaacctttgatgtcaatcagattcatgtcgaggtcatgctgaagttgaagttatcatcgagaatccatggcatgcttcctatacattaatatgatctgccattttactgcagtctcagatgaaccatgatatggtttcctgtttctgtcatgtcatttttcttggtggtaatggcctcatgtgtgggttcataccataccacaaagtgctcaccttgattctttttctagctggttaccttttgtaggagatttcctgatgaaactttaacggagcaaaaccacttttttttaattggtgcaaaatcacttgttcttaattgggtaagaaccattttcccaactattgcaatggattataaattttcatggttggagacctgctctttggatgcgaaaaaatctttagtc

SEQ ID NO: 104912 - DNA, 765 bp, Oryza sativa
agtgactgctgatcgtattcctgcagcccacgataggggtgctaaggcaaataaaaaataatttatgggttttctcgcgggggattgctagcgcgcgcaagaaaaagagttggcgagcactttctcccttttagtttaactacctatattatttattaatatactgacactaatgataataattaagaaaatattctcgagatttttttactgacagattgaaaaatttttaagttagatttgaaaactttcgatttaagttttaaattttatagtcaaattttaaaaactttcaacttgaaatttaaaaactttcaactcagatttgaaaactttcaactaaagaatcgagattcaaaaacttttaagtccagatttgaaaattttgaaaactttcaatttgagatttgaaaactttcaactcgagattcgaaaactttcaaatccagatttgaaaaaattgaaaattttcaaattgagattcgaaaactttcaactcgagatttgaaaactttctactcaaaatttaaaaacttttaaactcaaaacatgttaaaagataaaaaaaagtcagaaaaaaagcgaggaaaaaaaaacgaaaaaaacgaaaaaaaaaagcgtggagaggcgcgcgcgccggcgctgggccttctaggcataaaacgcgcgccggcagcgcgcacacgctaactagtgatttcgtttctcgttggaacccggcttgccgtatctaaatatagaggtggatccatccataaacccatt

SEQ ID NO: 104913 - DNA, 761 bp, Oryza sativa
agtgaactgctatcgtattcctgcagcccgttaggaagggaggaggagcgcggtaccgaggggaattgcggccggaggcggcaatggcggaggtggctcgggtacgtggtgaaggggtggtttcggtggtggcgaggagaaaggaagcggtggccgggcttgggattgctgcggtgaagccggtggtgacggtgacacatgcggcggcggttccagccacggggaacgacggccggagctcgcaaaggcgatggcggctcgggttgacagaggggagggcggctcggtgggggattggaggaacgaggcggtggccggtgctcggcttggagcggtgaagccgatggcgcaagcggagcgccgcggcgacggccagggctccggtggcgcgcagccggagtcggtggaggcggtggagagaggtggtgcgcgtggcggcggtgcttcggagacggggaggggaaatggagcggatgccggggtgcggtggggcgctgcgatgctataggtggcagcggcgcagtgcgggggcgacggaagcggcgacggcgcgcggctggagggtcgccggcgtgcggcggcgcacgggaacggcgtggggagctcgagagagcacgcgggagggggcgatgagttggggaaacggatgaggggaggccggggtgcatttttataagcccccggagagggagatcgtggccgaggtgggcggcaacccgccggcggaggagcttcggcgacgttggcgagtgaagcttcat

SEQ ID NO: 104914 - DNA, 783 bp, Oryza sativa
  unsure (1)..(783): unsure at all n locations
aggtggttannnaattagctgcattcttgttcctgcgccccaaacaagcatcgtactagtatgaacgcatcttagacttcttagttcaacgaatctaaatatatagtacaactaaatttgtaagatgtatcacataatattcaaggttagtttattttaggatggagagagtatgaatgaatccatcaataataacgttcaatttttaaatgtcagacatagagttaaggcgacaacaaacgaatggcagggattgtgacttgggatagggaccctttggagtttggagcacttttttttatttggtgctctttggagatgttgtgacagtgtcgaccgtacatttttcaaactagttaaactaatttaaattttatgtctaataaagtagtgaagaggtaaatatatgtgatatatctatccaagtataacagaaaatttcagcgaactatggttttgtttgatcctccggactattaaatagtctttcagaatcttactatctaggagtattaaacgtagattactgacaaaacccattctataacccctagactattttacgagacgaatctaacgaagcatattaatccaggatttgctacagtgatgctacagtaatcatccgctaagctatgtcgcaatcacctcactagtcacagagttgggataagcttgcctctctctcaagaaaaagttaatcgccggctaaatttattaagatttgcaaggccgtgtggagcaaggcacaaagccgtcactcttcacatgctttaatcaaaa

SEQ ID NO: 104915 - DNA, 737 bp, Oryza sativa
ccggcggtgtccctccacgtggatgcaccgtgcgcggcggccgcccgccacgtgggccggtgggccggctcgccacgtcggacgccacccaccgtagcgacgatctcctgctccatgcatataccggacgtgatgatcaactcgatcagttggactaattatctacgtcaaaggcagtcaaagcctgaaaatattcatgaggcagcattatttaatatatattttgttactaattttactttgggtgggtgtttcgttttaggccaccatttaaccattgtttttactttaaatcgggtaattttattttctttaacactttgggtcaccctcaactccttaatttatcaatctaaattcaacttgccatgtgtaaaaaaagatctacaaacagttgaggaagttttattgacgagtataagctgttgtaccattcatatgcttgagaagagagttgagttagtccaaaggctagattacccgatccaaagtgaaaacttgattaaatagtgatccaaagtaaaacaccggcaataaaagatgatccaaagtgaactttactgtggtgtataatatgattcgacaaaatgaagtcaccatgcaattatctaaaagagaacacttgcatgtcgtgaacattcaaaggcacatgtgctatatatatgcttgcgacaactatataattaactatgtgcatatatcttactatattatatatctatacatgcttagacttg

SEQ ID NO: 104916 - DNA, 764 bp, Oryza sativa
  unsure (1)..(764): unsure at all n locations
attgaactgctatcgtgttcctgcagcccattcatgagtcatgattcatcctcgtcttcctccacgctgatggcgacgatatatagatatcttctggcaccatatatatatatatataccatatatatatatatatatagtactagtacttgccaacgaaatttggtagttacatcttaaaatatagcatgcagttacatatgcgcatgttatcagataaagtattgaacaaatattttagaaatagattttttgttagattatggaaatgtcttcagagaaaaaaaaacatgttgcattattacatattaattgacagaaaaagtatgttgcattattacctattaattaattaactgcgggaaaccatacatattaacaacattaaccataactacaatcctatggagtacatgaggcaaataaaaatcagaggtcattacttttggctgtgtgcactaaattatatatacagagcgtggagatataatcatattccataaactaattaaataataataatcacgcaaatcgtcacagactcacaatccacacaggctagctgaagactgatgcatctgaagatagcagtattaattaatttgcaaaagttataattatctcatgtctagtcaaattttaaattttagtaattaagtagctgcagtcattatggataaaaataacttctagttttactatggatcatactctctccatactcgtaaaaaaagtcgttaggacagtggacacggnttccaaaa

SEQ ID NO: 104917 - DNA, 759 bp, Oryza sativa
ggtgagctgctatcttattcctgcagcccggggatattgtattggtctagcttattccatgttctcaggatgaccactggtgtcagaaggttgaagctagaattacataatcattataaacgagaggtaaaagctgaaactatacttggtttgtttatctgatgcagagttactaaggaagttacgagaagcaatttgtatttacatttcctgtcacactaggcttgatttgctattttgctacttgccctactctatatagtggtttgatactgatatatgtagtaaatgtgtgacatatgcatctcctatcggcaatactttggggcaacacaacaaggatttagaagatgatactaactggctatgcgttattgatattagaatacttaggacgtgcgtaaatttatactccgttttcacagaactttctcataggacagaggttggcttcaaactagtacccaagttgttattcttttgcagacttttttatgctggtttatctcgagttgttcaggcagcctgacagcttgaggcaagcttaatgttgctacactaatataccgctcttttcagttttgtggatcggattgtgtttgtgatcttccaccaaactggacatccgaggaacttgtgttgaactcccttcgtgaagtgcaaatcactaacctgagaggaactgagaacgaatttgctgttggggagcggctattcagttgggcagcagtgctgaaacagatgacaataaatttcctg

SEQ ID NO: 104918 - DNA, 753 bp, Oryza sativa
  unsure (1)..(753): unsure at all n locations
atggagctgctatcttattcctgcggcccccttgcgtcctcgccacttcacttcctctccacgagcaagaggagcaagaagaacgaggtcaggtcaggtcagctcagctcactgccatgatcactgtactccagttctttgcttcttcctcttctctcttttgattagcttttctgaattttcagtgaagtgtgacctgccggctgtcgaagaattgcggcgccatggatgcgggtgcaactgcaaggtcgtcgtcgtcgtcggcgatgatgatgaaccagaagaagcccttgctgtaatcaagatttttcgttttctttttcctttttctttttgatcttgtgttctgtgttgctatggttcttgatcgatgtaaagattggaggatttcgttctgtttgcttgcgtggcgtagctcggatggcgagctggtggagctcctgtggcaggacgggggcgtnnnnnnncncncncanacnnnnccccnnncnnnccncnccctccccccgaacgccncctcctgcgacgacgagacggctcgcccactgctcgctggcacgctgtcccacggccggcggccacaccactcgcattgatgcgtattggcttgcacgctcgcaccgtactgtggacttgaccgaatgagccgcgggaccgctcggttcgacacgcctggcacggtgcgcccgcacttcccggccgtgatccatggttcgcttacggtttcgccgctctaggactccgtgcgtcgcg

SEQ ID NO: 104919 - DNA, 782 bp, Oryza sativa
acgcgaaccgacgtggcaggaggagggcgctagccatgctggcgccgccccagggaggagggcgccagcatggctggcgccgccgcctccattcctgtttctctgtatggagttacaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcttttagtaaaaccctttgatcagcatgttaaacataatgcactctaccactatatgaaattacttaatctaattcaaaatataaccacatgaaatgacatatataagttaaacagtacatagagatgcaatttttttatttttattttatttttttgatatttttttcacacttaggagaacataggaaccaaccgtataaaaaataaactcaaacggacaaaatatatgacatgtagaattttccaaaactctaccgaaatggacaaaatatgtcatctattaaaataggcataactttctcatacggactcggaatcaggcaaataatatatgcacggacatctacagaaaaagttacatccgattctccctcgcttcgccgggttcggcgatattaaaacctccaaattctgcttgcaagattgtgttttcgaggagagaaatttttcggtagagctttggaaaattccacatgccacatatttcatccgtttg

SEQ ID NO: 104920 - DNA, 727 bp, Oryza sativa
atgtcttttgaccacgtaaaacaaaggccctcgtcaagaaaggaagccgtacgtaccctctatagattccctcgtcaagaaacagaggccctcgatcgtcaacattattacagggtttcttaatttaattcatatatttcccaaataccctaatctaaattttatagatgtaggtatcgtgaaggtatcacgaggtgtttttcttttttaatttctgatttatttggggtactttttaatgatttgtttctttttcatttgaaattctccgagattttccatgaatctctgtgatatattggtgataacgcttggatgatactatatattcactcattgtactggatgatatatatacctctatatgatatttcgaagagtcatggagatacaatacgcaaggcagaatcattgagttttattctataattataaaggtaatactaaaattttatagagatatacagtaccataaatattcgaggtatcatagatatcttgatttttttttataaaaaattcttccacggaagaagcatggtatcttgagtactagtgtagtatcactgggtcattgtataatcatacaaagataacagtacaatttgatagagatatagagatataatgatacttgataaaatattttaagtatcataaattcgtaatacctcgaggtattgtgctctctcatatccctttttgttttgtcagatctggccaggaa

SEQ ID NO: 104921 - DNA, 718 bp, Oryza sativa
taggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctctatcgaaccactggtatataaacagtatattggaaaaggcaaatctcagtgggattttgagatttggtgggggattgttggaattatgaatgggccttagcccactcgaagattaattctttggaaaatcacaaaagcccacctcatgggatggcatgcatgtggagtttagtaccaccttgcttattctaggagagggggacctccttaaaaggaaggatgccctcctagccacttgaagcatgtgtggtggagagaagaggggaaacacacgcgcgcgctcgctcgcctcgcctggccgggccgggccgggccgggccgggccgggcggcgcgcgtgcacgatgtacgcgtcgaatggtccgaaaaattggctcctcacccttgcgcagatgcagcctccttttgcagttttgttttgctgcagattcggattcgtttttggttttgaaacgttccgaaaaatcccgtgcgtgcaaacggcgtggagttcggataagttacacgccacttatacggttcggttacgcgcagtatagat

SEQ ID NO: 104922 - DNA, 1840 bp, Oryza sativa
tggccagatcggacctcctgtggccggtctgaccgcaccactgaccaccggtcagaccgggccatgggccggtcagaccggttccctaggagtttctccaggttttcataccacgactagcaatattgattttaattattattcatcacctgttaatactgttagtcatgctactccacaatccctgatgcttataatgatgttgctagggggtatcctcccgatactagacaaggccaatataatcatattgcgccgcaacaaccaccccttaggccatcaaatacaccaccagatctacataggcctaaaaatatgaaggagttgattagtgacattatcagggctacgtttggggttgaagcgaaggatcgggctagggagaaccaaaagccgtatccttatttttatgacgctgtcccatatcctcctaattataaaattcctgaatttaccaagtttagtggtgtggatagtaggactacatatgagcatgtagatcaattcttagcgcaatgtggtagggctagtagtatggatacatgtaagtgcgcttgttttctttatctttgtccgatactgctttgatatggtttaattctttactggcatattctattggtacttgggctcaattagaacaaaaatttcatgattattttcacactaatgaaactgagcttaagttgtctgatttaacatcggttaggcataaatacaatgaatctgttgctgattatattgaaaggttagagatattaaaagccgatgttttagtttgagaataactgacaaagatttggccaacattgcatatgatggattgcttgactctattaaagagaaattaaatggccaaatatttcttgatattgatcatgtgttgcatgaagctctggctcaggaaagccgatggatgacaatagtttaaattctagtttagatgaaagtgcaatatcatgtatagccgaaccaagcgacggttcgaattgtgttaataatttgtgcaatgatgccatatcgattatagccgaatcaaatgttggtccggattatcttgctaatttggataataatgcaacaatcattatagctgaaccaagcgacggttcggattgtgttactagtttagacaatgatggaatagccgaaccaagtaatggtttagattgtgttgctagcttagagagtaacatcattgaaaatatagccgaactaagtaacggttcgaattgtatcataagcgaaagtgaaatagcattgtcacctaagaccgaatcacaaatcggtcatgtggatattggaaaagatgatgacaatgtcttgcgggatagtggtgaaatagaatccaaagtagctatgcatacatatcaaaggccgtatcctgaacatgtagattcgatcccatacccgcaaggatttaaggtgcccaacttcacgaaattcacagatgagaatgctatgactacaatggagcatatcggccgctttattgatcaatgtggtaaggctggtagcgatgatttgctaaagttgaagttgtttcccctttctttgtcaaactttgcatctacatggtatagtttacttgctcctaattcaatttctacatggttacaaatgaagcatgagtttcatgattatgtcaaagatgcaagcttgatagagcaaagaccgattgatacttcatcggtcacttgtgaaacgatttcggttacatctatgcctaaaaccggaattggtagtaatcctctccctattagtcctattgatgttaacaaaaagaaagggaaaagtgttattattggggatcctccgcccaagactaggatcaataatg

SEQ ID NO: 104923 - DNA, 2530 bp, Oryza sativa
caaccactaacaaagaccgggggagagagagaaagataagggagagagagaggtacacactcacatgtgggtcccaccacgctgagtcagcttgtcaacgggtcaacaacgccacgtcggacaaaaccgccagcaaaaccactgagggaaatgatttgctctagttttcagagatgaaggaggcgttataccctgtctttcggttgagggatgttattcacacaagcgcaagagatgagggaggcaaaatggacctattccttctggcccaacccatgaattacataacaggccggcccattcagaaatcgatttgcttttccttatacttcacggtttaacttctggcccaaaaaaattgactaagaaaggttttataaaaaaaaagcaattctacggtatttgagaagataccataaggtaaaaaaacttagtgtaaaatttggtatctcaacttagacatcaagaagtaccaaatttactatagaaaaggtggtacctcctcaagaaccgtgaaattgcttaaaaaaattgtttatcaatttaaaaagtgtgagccgcaataatagtagcactttagaataaagcgacctacacgatatgatcatatgagtgctctaggttcatcagtacttcagcgtgcgatgtggaagtgaatgaaaatcaatgaaaagttgttgatgggtcatgcaattgtaggttggcatgccgagcccattcgtcacgtcaagaatcacctaccaaacagtgtcatgttttgattaagaaaaaaattaagtcactcatttgttgagtgatctgatctgtcttgttggcatgatgacatgacattcttaatagcacgtaagcctgatcttgcacgttggccttctgtaacctcagacttgataacagtcctccaattaatggagtcataaaggaatcaagttagaaactagtacagtattacttaacatttgtaaagcttcatgattaaatgaaatgagatatagtcacccttagcttgttccacaactttcactacaatagcttggccctgcttatatacagactactctgaatactcaaatctattttccttttgactccaagtcattgattgagttggatttattactaagtctccccagcacatgcatgccatttgtttggcactgttacacacacctttcttgtcacacaccctaggaactagttttgcccaaaacattggatcaataattatcactactctcttttttcttcttctaatagacgccattgagttttgacatgatgtttaaccattcgttctattaaaaaaaaatatataaatgttatatttattttattgtgacatgttttattattaaataaactttaagaatgacttatacttgcatattttcatgaattttataaataatgtgaaagatcaaaagttactttaaaagtcaacaacatcatcttttttataaaacaaatggaggtagtatatttttagtcttattggtgcatacaatgctagggtcttcgatcacttgggtaaaatcataattgaggttgtaagggaatctgtttgttggctttaatccatccaactgagaaatgttctcgcctacttgactaaatcacgtggagtatctactatagggtttatgaaatttgaacggatcgaactgggtcaaattgatgataaacgctcaaaattcaaggtaatgactcaaattttatcaaattatgttgaactcaacctagttgtaccaatttgagctgtcttgcataggttgataaccgcgatatatgtttgagtgcttatcttatcgtcgtgtttgcgagcctttatctatttgtcgttgtgtttgctctccaagtctaaaagacttccatgttaatagagagagaaaaaaaaatccatgttattgttgatcatgtgcatttggttgttctagattattatatagtgtaaattgacaattctctaccattataaaaattgaagatatttttgctggtactttggtacgtcatctgtgtatgagtcggtttttaaatccattcgcttttggaaatatagatccatatttaagtcgggttttaagttcgttcatttttggaatacaaaatgagtcgtataagaaatatctttaaaaactcgcatgctaatttgagatgatcggactcctaattgcagctcatgattttctagaaaaatatatatcaaagcaaattcccatattgaatttcaccttcactaaaccgtataacaataataagattaaaataacattcacccgttgcaatgcacgggcattttctagtgtatatatatacatgtacaaagttgttttgaaataataggaatagaagaagaattgtatatcaaatacactttaatcgatctagctcctagcagtttgtgcaggaaatttggctatttattttataccaatgccaaaccatataagtaatttgcattcaagctatactaatatgtaaaactgaaagcctcgcttcttcaaagcttgagtattctatagtgtcacctaaa

SEQ ID NO: 104924 - DNA, 690 bp, Oryza sativa
aaatcatgatctgcagttaggagtccaatcatctcaagttagcatacgagtttttttaaacagaattcttatatgattacttttgtattaccaaaagtgaacgatctttaaaactgactcaaatacggatatgtatttccaaaagcaaacgaacatagaaaccgactcatacacagatgacgtaccaaaataccggtaaaacatctttaatttttataatagtagagaagagatatatattaaaaccaaaacatcaaattataaccgattaaaacacagatgacggaccgcggaaacatcttcaatttttataaccgcctcaaacatggatgacggaccgcagaaatatcttcaacttttataatagtagagatatgtttctcacaagcataaattaaatggaaaaactaatatctgaaacggaggcatatacaaatttggttttgtggacaaataaaacatctttacttgtccaggatttaaatgaaaaaattaactagctaattaattaacttatcagtggagttcaagaattttttttcctacttcattttctaattataagcatatactccctctgtcccacaatataagggattttgagtttttgcttgcaacgtttgaccactcctcttattcaatttttttttttgcaaatataaaaaaacgaaaagttgtgcctaaagtact

SEQ ID NO: 104925 - DNA, 1629 bp, Oryza sativa
acggatggagtactaattaacctggctgaattatgcatgcaatatgcagctttccattacaacttgagctgcgccaacctgccaaaatgcacggaacatgcatgcgtagcggattgccaccgcagaggtttccaggttagtgtgggactagtacattgcatatatggacggcccaatcaatgttgctgcgtacatggcggccttcttcatcctgacgacaagttaacgaccaattaattaggcgatataagagcacccacaatggtaaagtaagatgctatctataaaacatgtacatctcatgcaatagactagattaatagtaaaccacctcaatagtatgtcttcatgggtatctatagttctctcatgcattgcctcgtttttctctatagactatctcgaagttagtagatagttttgctctctctcttcatttaatatcttctatgtaggaaaatatgctgacatggatttcttgtagagaacctagctatagataaccattgtgggtgctctaatggatggatttccgatatgagcaataatgtattactgtcaatgattatatatatgtgcaattgctgcaatgagctgatcgatctcttcgatctttttgctctttcatgcatgcatgtgtcgttcgatcgacctagctatatatttgatgccgactcaataaacaaagtttacatgggaagatttggggctctctacccagtaattaattggcttgatatatattgacttataaatatcattgtacattttcatactgttcatgtggagctatagcagcatctgaaagtgagtgaattagtgggtatgaaaaaaacaagacaagtgcagataaagatgactatgtatactttctctctagtcaagttaactattgaatgttgtatagttactctctcctgttaataaatactcttcacgggaataaatgggttgaatgggctagattaggctgggcacatcatgagagtttctagtgtgaactactatgatctcaattttgccttcaaacttttcatacacaagcaagggcacgccgaggactaatatactacttcccttggtgcctctgcactggtgggtttttgcggcccgacagagatgagtatctttaaaaaggtgtttacacgcaaatttggcacctagtatcgaaatagaaagaattgccaaagtttggatttctgctggttttcctccaggaggaccggtctgaccgccgtatgtagtccaaacgggttgcgtatatgtactaacaaatagatacataagatatgagaagggacatggtattctcatttatgttcttttcactgtatacaaaagcctctcctctcctcttttatatagacaattctcatatatggaaaagtagggtgaggcccattagtatattgggatggccttcatgggccaaaagcccaagtttcttgacagatctatttttttatattttctttgatgagacactaatgtcttaaaaccattaaatgaacgacatccaaattctgaagatacagtccaataaatgaaaatttgttttcctgtatagtacctggcaattaaatatcatagaatctataaaagcatttaatgcatatgtttaatttaatt

SEQ ID NO: 104926 - DNA, 884 bp, Oryza sativa
ttcagtcagggccgggattcatcagccgaagacttgaacaagcaggagtagcttctgctcatccatcacggtcaatctccaacagcagcatttgcagtcagaaatcactcgctatcatatactcctatatacgtacagcatttgggcaaatcctatgacgtacattttatggattcagaagtacagatagtcaaatacatgtaggcgattgcacttcaaagttgggtgttggaaactgacgaaagcatccatcaattatcctctcaagtctcgagtcaagataaaaccacacgatgattcatttgattggcttccaagttttgggttattaagaaattaaaaggaatcagttttactcgctcaaactatttcatctctgagaagacttcatcttatgttgctcctttaactatactaaaatctgatgcggcaaatacccctcatgtgtgcgtcgtcgcggtcaatttctccaacagcatataagccccttctatctctctctcaaagaattaattcaaggctggcttctctgactgaattaatcaaatgctctcaattcacaaattaactcgtatatatatatgatccatctgatttatttggcttcaggagtttggattactgcacccagtagttctgtatgttcctcacttaaatgcccctgatctgtccaaacaaccggtctttttggcccggaataagtccattttgcctccctcatctcttgcgcttccgtgaataacatctctcaaccggaaaaccgggtataacgcctccttcatctctgaaaactagagcaaatcacctccctcgtggttttgctggcggtttcgtccgacgtggcgttgttaacccagttgacaagctgactcagcgtggtggga

SEQ ID NO: 104927 - DNA, 742 bp, Oryza sativa
tcctgcagccctatctcttctccaggagccaacgctgcccgtctatctttccggcagtgtttatcccgtcatggcctgagatcatcacaacttggtacaatgtcatgggcattgggctggaaggctgaggcttataggcagcctataccaattaagttagagataagattattagttagtaagagataagataagattaagttagttagttagttagttagttagagataagataagattaagttcttacttaggggtcaagttgtatcatccatataaggatgtgattatatctaggtatatctattatcaattaggcaataaatatcaattagtctaatctctccctcccaacaatgtttttcttcctagcctaaatctacatcccttctccaagagccgatgctgcccggctatctttccggcggtgtttatcccgtcatggtctcaggtcatgacaacttggtacaatgtcatgggattgggccggaaggcagaggcctataggcagcccataccaattaagttagagataagattattagttagttggagataatataagattaagttaattagttagttagagataagataagattaagttcttacataggggtcaagttgtactatctatataaggatgggattgtatctattatcaattgggcaatgaatatcaattactctaatctctccctcccaacattggtcttcttcctagcctaaatctacatccctt

SEQ ID NO: 104928 - DNA, 1003 bp, Oryza sativa
atatatgattcaatcctttgtttgaaaagcgttagtagtaatttttttttctttgtaggaatgaaattctataagactttcaaacaatttaaaggggcctaaagtagctatcgttaaacctaattaataatatggcatcttttaccaattataacaacgaatgatttaatactatgccgacgaacctcctataactcatgggatgttagaatggacaacttcattatcatgaagtgtacaccattgacacgacatcaataagcattactgtacattatacgtagcgaacacacgtactataaaacgacactatagatcgaccacgacccttctctaatcaatcaggagtacgtgcgtcgatgatacatgtttccagaaagatcttccctaacaagtccatgatagcagggtgatttttgcccacttaaccacccaagtgttccgctaacatgatcaaccacgtcattttccaaggtgtcaaatgaactacacaccggctgatgtgttgtgtaggcagcaggtatgcaggatcagctcaaccaaaaaactcccaactgcccaactgtccggtggggcccacctccaaccgtcctctcgcggccgcccagcatgtgcgggatattttcctgcgtctttttctttttttttcctaccgtttggtgggttggccgacggccgatcgaattgaagcgcgtgtggtgtgtggggcccgcgggattctgtcggcgaagagggcggcaggcgaagattccgccacgtggcggcccggctgtgcaggtgagtgtggttcctccatttgggtgtttgagcttctggatttttcacattttggtccttttgaaaaacttatttcgcaagtagacccttagaaaaacttatcccaaaaatggtcctttttggggcgccagagtggctggcgccgtcgttcaacaggacggcgccagcctctttggcgccgtccccctgccgacgtggcggggcgatgctgagatggctaggggga

SEQ ID NO: 104929 - DNA, 696 bp, Oryza sativa
cctgcaccccgcgtgtgtcatctcatctgattggttccaatagactcaaaatgtagggcattgcacgcatttttcagtaacgcgtcctcgtggcatgtgagcatttgcgtattaaggggaaaggatataggcagaagcatgggaggcatatctggcagcagacgtgtgtatagcatgcgacagcacggcgcttggcagcagagaaatttcactctttgccatccaattcatatctaattatctaaagccggcggttttcgatcggtccatgtggcggaataatttgcgtgcaaatttgataatgcgctccgtcgcttgttcaatataagaaaggaaattaacccctcgaccaatccggggaacacatattaggcaagtgaaaaaaaaaggataaaacaggcgctccgaatctgtaaatgggtcgcacaacccagtcgtgggcttgctcgcctggtggctgtcacggtgttcaactacggtctgcattacaggatgagtaaacagaaatgctaggagataagcaaaagtagaggaagacataataggaaaaaaaacagaagtgaaaataaaatttataaaacccaaccattcatccatccatctatctatctatctatctatctatctatctatctatctatctatctggctatctatctactccccccgtccttaaatataagagattttggacgg

SEQ ID NO: 104930 - DNA, 694 bp, Oryza sativa
aagatatattttagtaaataaactattttacatgattaaatgataaattcagtagaaaacatttaatgcagatgactattaattatgcatccaaaggtgcattgattgtcctaccatattttttaaggaaaaaaaagatagccacaaccataattgatatgttttttaatagatgtagattttacctagattttcgttagatgttttcaaaccattaaaaggttcttatatataaattgcttgaaaataccaaataaatctattttttaaaaaaattaaataattaaaactctgttaaccgtacgctaatggttttctcgttctttgtgcacgcttaatcttctatcctaaccaaactggagggatgtagtagtatgatctctcagcatttgcccattgctttttcgtcgaactggtgatcgcccttgtcactctctttaatgatgctcagctttctcatcaatctaccttatgctctttttttcactgattaaccaattgaataatttcaccttgcaaaccaagcaaagagagcacttcatcataagcaagcgagaaaccttcgaaacctcctgcgattgggctgggccgggtgagattttcgtgggcctttggaagttggaaattttgggtttcggatccaaattccgaatcggacttacatcaatcaacttcaaaacaatcgccttccctc

SEQ ID NO: 104931 - DNA, 1467 bp, Oryza sativa
atcaataagtacaataacccagtcaaagtacaagatggaaaaatggattactgtgtttaaaacatggaaaaggtgcatatttcaacttaattttgtgttgtgttcatctttgtcatccactaattattgaatattccaatattttattttaaggataaaaatgttttaaataatgaagtaggaaaacactagctcccgacaaatctaaataccaacatggcatccccaactgtagttgagtcagaacaccgtggatcagtccaaaattctagttaggaatttgtattaagaacttaagatcctagcctagcacggaaaattcagctttccaaacaataaccaagatggaaaatcaagccaactattacctatgatcattcttatcttcttccttctcatctttccctatagttttgtggtttggtcaaattaagttacactttataaaatatatgagaaattattagtgttttaggcacaacacaaacaatgtgttggtaaaaatcgcacaagaattttttttaaagtcgaattggtcctttcttctatttctcgttgttgatcaagattgaatttaggtttgaaatttcatagtgttgtgatagaacattatatgatactgatttgtttctaaaaaaacactaataatatgtggcaaaaggagattgaactttaaagatattattttttatgggtatatatgttttgaaataggttgggagtgtggatgaagcataaattaagcatgatagctttttctttattaaatgatttccttttccggtccttatttttttgggttttctaggtatggagatttttctcaagtgctgggcacgtgctacacacaaggcgtggagaggggtcggatggatgactcccaatatttcgtaagaacctacatatatcttttgttggtttggaattttgtagatgttacaatctcaggttgtgcctattgcatgttttaggaagcaatgttatctgatcgtccgatcaatcacgattaattgtcctgattggtcccttgactctaatcaaggacattcattcgatcagctcgatcagaaatctgatcgtccgattaatcatcgataaggcgcgattgatcatctgatcagaacacctatcgatcacttttagaacaagtcttaggttttagcacatgtgaataatgtgctactactgctggttgctttatactatgattgctttctaaacatatgagagaaactacttggtatctacataccaaaacaaataggaacaattgcttatttgagcccattctaaagcctaactaccaatctgaccctgtattttcgagtatgctcatttcaccctctttttcaaaattgaacattccgtctgaccctatttctatacaccgttgggtttcatttagggaaaagaaatgaaatatatttactatttgaactgaccaaaataccctcgaagagggttgaa

SEQ ID NO: 104932 - DNA, 797 bp, Oryza sativa
gacatttgtgtacgtatctgactgtatgacattcaacgcatcctattctgtaaatttttttgacaaataaattaatattttgaaagcctgttatacaaccattgatgtcaatctatacctaattaaaaaaacataaggcttctatctataattatcgtccgttttccttttttttcctttttcctttttatttcttttctctgttttttccctctttctatcaccgtttttccggtttatttcttttttccctatcttttttttcgccctttttcgtcaggccaaaccctatttttccctatttcttgcggtttttattgtcgggccaaaccctagcgcggccgcaggtcgatttgcctcccccatgcgtttcctccttcaattgatggcaaaagccgactccccaccactctctcatcatttttcccttgaatttccctttcaatttgcttttaattcaccggatggaattttcctttcgtcgtattgaatctccttttaaccatagtcgtttttgaatctttatttaaccatcgtcgtttttatcccgaatttagcggattgcttcgattttaataaaaaacgaaaaagggagatcgagtagatcaaaatccctcaaaaattttggagatcgagaaagattcgatcggatttgatagagatgattaattccatcattgtacgggcacgggactggtcgagatgggcctatagcttcacttgtgggctgagctgaagagaggtaggccaagcagagggaggtttcgtcattgtacgagcacggactgggggtgcag

SEQ ID NO: 104933 - DNA, 587 bp, Oryza sativa
tattggttaatgtcaagggagcacctctagcctattcaaattaaagaacagattggtaaggggacataagagaatagtaaggttgcagctattgtagaagtacttaggtggatagcagtaaataaggattacaataacaatgattctgaatgtctataaattaatagatcagtaggcattaaagctgcaatggcattggataggaacttacagctaatttcatcctaaacattctgcggatcgcagactgattcttgtagtccttccatttgggaaacacaggcacatggttcctcactataatgttgcattcagttgcaaactttgcagcaacgacaggctgtagcggccttatgtccccttctttgatgaccacgggcagcttcccacgccgagatcgggacaacctctgcagagctgctcctttattattccccctgatccatggttcctcttctgggtgtacatgtacaaataattatagctagtgagctgaaagaaaccttgatttcacatttaataatacaataaactatattgaactgaaacaacatggctaagaggattagggtgaaataacatgcctt

SEQ ID NO: 104934 - DNA, 598 bp, Oryza sativa
gtcggttagcacgtatgtatcatgccttccacgcgtgtgtgatgcaactggaacaatagcttgttgatgtttgatgtttccgagggttactatctacgagaattaatggcacgtatttgagttgggattactatatgggataattaatttatatcgatatatatatagagcacgctttttgcgagacaacgtacggagaagttctttaaatattatcacagcatgataagttgtactagtacttagatagagtgtgttttatacttttctttttttaacttctactccctttttaaacagtgtgttttaaaaaaaatcttaaaatgttacttaataatatattttaatatattttttaaaaattttgagttaatacttaattaatcgtacgctaatctattgttatgttttatctgtcgtgagatgaagaattgtgagcctacgtgtgcttatagttttactagaaaaaagacacgtgcattgcaacgggtaaaacgtttttatcctatgcattatacttccttagttttggagcaaatgcttccttggttttggaccgaacgctcattccttacttccttttcacctctagtcctaa

SEQ ID NO: 104935 - DNA, 676 bp, Oryza sativa
agattcattaacatcaactagaaaggaagcccgcgcatatgcgccggcatctaatttaatgtgcttgaaatattactctacacatgtgaatataatgtttgtatatgcgtgattgttcctgattctattggcaacctatttttttgtcaatattttgtttgtgaatattttgaatgctaattatccttgcaacacataaattctaaactaaaattacttacaaacatgaaatctttaattatagaaaagtattatgtcgcaaaaataaagttggttcctatgaactgtcatctaaactatatgttatttttaatacatatcaaatctttgttttggagttctaaactttaagaaatttgtgttcttaagaatagttattgaactttaagcaaaaaaaaattcaattgatttcttcaatttatattgggctttggattcaacaaattttgtttaaatttagcccaaattttgtctgaattccagtcatcctttctgtttctttgggaatattggaggtctatgttctatcaattgttcttaaaatgcttttgatctcttaaaatttagatgtaaacataactatgttgagtgtataacttggtatgggataaatgtgtcctttctaatgcagcgagaatataaattaagatagagatattaatctccagttgaatca

SEQ ID NO: 104936 - DNA, 583 bp, Oryza sativa
  unsure (1)..(583): unsure at all n locations
acggagggagtatanagcttgtgattagttaagcactctggtactccctccgtcccagaaccagaatatagaaagttttatacactggtggagaaaccatctttcgtcggtcgggctaattccacaatagtcccggttgcaaaaaaaccgggactaaagatgatctttagtcccggttaaaaagggtaacgggcatatttgatctttagtcccggttggtaacaccaaccgggactaaagatcatctatagtcccggttcaaatgctgccagggcctgtcaggccccccccgggatctttagtcccggttaataacaccaaccgggactaaagatcgtaactttagtcccggttaccaaccgggactaaagatcccggcgatctttagccccggttcataacaccaaccgggacaaaagtcccacccctatatatatgtcttcttcctcctccagctcgaggaagcttcaaaatttcttcaaaaaagaggggaggtcatgccaaaatttctagtgaatttagtttggtaattatatacaaatcggaggtgcctaaaaggttagcaacttcatcctccaatgtt

SEQ ID NO: 104937 - DNA, 872 bp, Oryza sativa
gtaggatacaaattgggtctaatgggatgagtagttttgcctagttaatgtaatgacattttgcttctataggatctttactgtaatacatattagttaatagtgaccattctacagggagacaagtacaaagaccaggaacttgatgcagtggatatgttcaaggagtgccactacagtaaaaagaaaggctacacaccagatgtccagcttgctattgtaagttaacttttcacaaataaagcccaaccttaatttttgttgctgcgtctcatgaaccatgtattttttcttgcactactaggatgaaatggaaaacaagctgtctgaacatgcagaagatgaagaggccccttccatgaccgaggtagttgctggtgttcttgctgagaagaccaagaaacccacatttctgcagactgtggggattcagagcagaaagaaaggcacacttaaagagcaactagctgcagagaagttggcaaaggatgacctcaaatcacaagtgcaagagttggcgaagaagctacaagaatctgagcaagcaagggtggcggaacaacaggatatggcaaggaagcaagctgagactaatgcaaagcttgaccttctgttgagtaagattggacaccactagccaactgggtaagatggtctaggtcccttggccacattgttgcttttttgttgaatcatttctgctgctgttgctactgctgctgctgcttcgctatggtgctgtagtgggcaaagtgacatttctgctcttgttgctgctgagctagttattagctccttttgttgtgatgaaaactttgatgctggagtggcaatgccttggacttgtgctgtagtgggcaaagtgacatttc

SEQ ID NO: 104938 - DNA, 517 bp, Oryza sativa
ccccccccccccccccccccccacaaacccaatcgccgatttgccgtcgtctccaaggctctcctccccctcaaatacccctcctcctcccttccccttcatctcgccgccgccgcctcactcgtctcgtgccccccaccgcatctccccgcaaacggaggactcgggaaccctaggtttactcccccgccgccctatgtcctcctccgatcgccgccgcggcggcaacggcggcggcggcggaggccccgtcgcggtgcctcttcccgcgccgtatggcgaccccgctctaccgcccctgatattcccccaccgccccgcgccgccgcccccgcacccgatcgcatcggcccgatcctgccctcccccaatccggctcggaggatcgaccgcagcagcagcaacgtcgcccgcgccggaggaatcatgggggtggcggccagcgccgcggcccgccgcaggagaggccttccgctgcgccgcccccgccgccgccgcagcagcagcagcggcagca

SEQ ID NO: 104939 - DNA, 500 bp, Oryza sativa
cccaaataaaaagataaatacgtgggacccacatgtaagtgagaaaaagtgtgggatcaaccatcctactcagcaatcttcttctcttttcctttttatcttcttctgtttcggttttagagggggagcagtagcggcacgtggacggaggcaagcggagcggcggcgttagcggcggcgggaatggcatcagtggcggcggcggcgctgtgggcggaggcaatggatacgcatatggatttgtgccgcacacgtacagtgaccacggtaagcatctaaacagcccattatttcccttattcgtatgcttatcctaatggcttattactaatatttggcaaataaaaatgcatttgtaaataaaatttttatatatgtgttctcagtgacttaattaaaatcaaatgttgtagaataaattacgatgaaaaaaataaaaaaacttaagttcaaaaatttaaattttgacttataaatataagcataaggcaaacaataaa

SEQ ID NO: 104940 - DNA, 714 bp, Oryza sativa
attcctgcagcccgttgtagggccgctgatcatcacttgaccaacgcggcgctctacagtttcgctgttcaaacctatagatcgagaaccaaaattgataagtcagggggaacatatacttaaggaatggaacccagaatacgagaaaaataccctgaggagaaacccgggtcgcatcctccggccctgagtagtcaaaggctagatgggctcgagcctagagcggctggatccgtctaccgatgaagtcagcagcgacttcataccccgacaaccctcgcactcggaggtcatcgatgacatcgatgaaagactgaagggagggggtcaaggcgggcttggcagtccaagacgaaatattgttcggttgctcctcgggaacaaccaagaccggatccgaattttctaaccacctcacccgccatttactacgagaagaggggcactggaaggggatatagcgcgacttcaggccatccctaagtcgaaaaccaacgcatcctgacaccctgttggattccatccaacgcaactcatagtagaagcgaaagaggtcaagaaacggctctacccctgtcggtgatatgggaccgggagtatcatgaccagaggcttgaggcagacgcaatcgcccacgtggcctggcaccttcggggacgtcgggcccgagggtgaggtgtccgccctcctcctgatttccccgagggggggggg

SEQ ID NO: 104941 - DNA, 686 bp, Oryza sativa
attcctgcagcccctaaatatgttgatggaggatttttcttctctatgttatccaaattgtgtttcttgggtaaatatcgtgaaaaatcttaacagtatatgagattgttacatataaaaactggctggttatgcttgtttaaaaataaaaagctggctatttattaattggtgcaaaagactcagacagttattatgtgtgcaatcttttgtgtgtaacattatatcaccgtacttctcatgaaacttttggccaattttatttcatcatttgctttctggtcctttttgtaacaatgctctagtgtcctgtatacctgaaaatatctctgagaagttccagattttattatcaaatatcaaattatcctactgatgcccgtcgaacaaatatagttctatcttcatttcactaagtattgggacatttttattggaattgtatggaaggaataatgacttaatgtgcgagaaagctagctagtaagcttcctagatggttgctaggagcagactactggcctgcaaaaataattttgcagtatatctcatgtaagattaatgatgcgagagcagcactctagtactgtatggctaaatcataatagctactccctccatttcataatatagcaacctaggaccagatgtgacacttcatagtacaatgaatctaaacagtaagc

SEQ ID NO: 104942 - DNA, 628 bp, Oryza sativa
tgctaattcacgcgcgcgagctttgttgtcgtacagtactacagtcaaaagttcgcaacacgcaagtatgttcattttttaagacagcagacgccgctcgtccatccattttactaaaaatataaatatattttttatgacttgcttttattatcgaagaaattataatcttaacttatacttttacatatttgtaataaattttttaataaaacaaataatcaaacattataaaaaatcaacaatatcattaaaaaaataaaaagggtagtatattctactaccgagtagcctgtttagttactgcttttagcactgtgagccgagagttttggctttggccacttgatctgtactttggctttggctttcactgccttttctttgatcgacgaacgagttcgatggtcgcataaggtcgacttaatataaataagaaatatgtaatggacacaacctatagcataagatcgacctaatataaattcgaactttaaaggttcggccgagctgaaagattgaaaaaattacttgtttttcatgcgcatgttttccgcactattaaccgttgtaatttttttgaaaacaatatatatacaatattgttatttaaaagccacgttaatct

SEQ ID NO: 104943 - DNA, 761 bp, Oryza sativa
tcaccgccggcggcggcggcgatgccgaccgagctgtcgccgaagcacgacgactcccgtgtcgcctctggctttggtttttcttccggcgagattagctgctgcttgctgttgctgctactgcaataaaagagagagttgacgtgacacgctgacatgtggggtccacgtaggttccacgctgactcagccgccacgtaggctaaaatcggggtcaaaaccaccgagggatctaaagcgaatggttttattagttgagggacgtccggtatctggttttgcggtttgaggacgattttgtatctcgacgacaaagtgaaggaccttgggtgtactttttccttatatttgctcgtgaattgggccacatgtgaaccgtccgatcaatctatcgttcatgtgccgcgggggattaggtgggccatcgaagcaaggccttagatgggccatcctaacctgtggcccagcaatcatcatccccttctccctctctctctctctctcaaaaaaaacaaaagaaaagaaaagaaaaacatccctttctccttcctccgatccttgtcccccaccactcttcccggcgagagctccggttaatgcggcggtttgcgtccgccgccgcttttcgcctccgtctacagatgggtaagctgtcgtttcctcctgacatatgcgagagtgcgtgaccaagcctcgccgtcgcccgtaccggcatggcgcatctgttagagcaggttagcaaactagtcagctataaacat

SEQ ID NO: 104944 - DNA, 924 bp, Oryza sativa
cttgtggttcgcatattttgacttaaatttcattgtcaaagtaccctctcattctttagaaaattaataaaatttctgccaatatgaagttaattgtgcatcccatacttatggacaagtatcctctacatgccgttgtgcctagagagcgtcgccagccgttgtcattgcagtaaggaataacaagatattatcactctttgcctccttccattctcattcatcatattacataaaaaagatacatatacttttccgtaaaattttattttccgcacattataaataacattgtatatgaaatgtaataggctattatttgttatagaggggaagattttgtttcattaacatggattaaactaatttattgataaggtgagtacaaaattattaaaactttatagaattccaaataaaactactactaatttatttctttataggtccaccctgtcagatttccatcaatctagttctattgtgcctgaaaaagagaaacacataaaactgattttgccgcgggtttgctccaaatttttgtgtttgtacgcttttttcctccctcaatttgccgggttttcttctccactatcggaagcagttatgatcctaatagagaaaacaaaacccatctccttactcctgaacataccgatccaatctctccagtcatcgcagcttctccacagcagatcccggcgcccgccacggccgacgacgtcgtcggtgcggcggtgcctcagccctgtctgctcgtccccagggcaagatcacccgcctcaacgcgcttctccacgccgtcatcgagatcgaggtcaactccgacgcgctccagcagccggcgcgcgccgacaccgagcacgcctctggccacagctactgcgggccgctccacggcgtccccatcctcaaggacaacat

SEQ ID NO: 104945 - DNA, 724 bp, Oryza sativa
ccccctcgctactttctctaccgtatgtactagtaattattatagttatactctactttaaatttgatttcatgctggaactttcttaggagtaatatgcaacttgtgacctgtttttgctagcattattgttgttttgaatgaagaattgatggttgcaattggcagatttctgctaacccgtgaatcagtaattaagttatgaatggatgcaaattctgctaaatacatagctatttttattcaggatagagcttcgagctacgacatgaataatactcatgtacatgaatgtacatgttaatacatacattaggataaatataataaagaactgcatgattgggtagtgtgaactagcctagcaaaatgcttgtgtttcctattttgtcctaagaggagttctgatttcagttctgttttttaaatcgtttggtggaaaatctgtcagtttttttataaaaagatatgtggaatgatgtagacactcccagtcttatatacggtcctcatcaaggttgttcaagttgcttaggattttattcattcatccttatgtttttttttgtctaggagcaacatctttgtaccatgatctaagctgtcaacgtagtatgatcagccatctgtggcctttcaattattctaattatgcatgtgacaagattgtcattttttttattcaattcagcgatctccaaggttgcatgtggctgcaggaatt

SEQ ID NO: 104946 - DNA, 661 bp, Oryza sativa
aacatgaagagaatagcggaaagtaaactgaacataaagaaagtgaatctgagttgcttgttcgtgggagctattcccagttatgaaccaagtgatatgttcgaagatagtctgcagaggtcagtttaaaatcacatgtaacagtgaagcctcagatttggcgggataatgattagacaataacaaatccagcagtaaagctatttgggaagacgtcaaagtatgtcaagtgggataaattggttctcttgggaagcataacttatagttagagtggttgacccttgcatcaaatagcagaagtagctatcacccggagaccaggaaagctaatatgagacagttgatggcaagttagaagtgaatgacaagcatgatattcttatgatgacaaacatagtatcctagtaatgacaagcaggttacgacgcatgacacgaagttgataacttgtccgaggttgactccgaagatatgaatcatgagaagttctggaacggaagcatcactgcactaccgcaacctagtctgagtcagccaaaaggtgcaccctggtccaagtcaggtgaagagaagattccatccgcaacaggaggtcaagccaagcagttccgagtggtaaagttttgctggaagttcgtcaagacgcaacggaagaagt

SEQ ID NO: 104947 - DNA, 530 bp, Oryza sativa
ggggggaaacgggagagggaatcacgggggtgattttccccctctttaatgcgcgcggggacggcgggaaacggcgagattcgcggcggcggcggctctagggcacgggctggcggcggcgcggcgggagaaaggcgatgacaggtgggtcccacccgtcagcgagagtggcgggcgggcccgcctgtcagcggcgcgcgcgcgcgggggagctgatgggccgcggggagaggagagagagggagggagagttgggccgagccggcccaagagaggaaggggggggagaagacttttagggtttttcttttttataaaccttttcaactttgtttatttcttctcaattattatttgtgctctgaaaattccactaaaatttgagggctccttttagaccaaggagaatttaacaaaaattctccgggtcacatttgaatttttcttgtacgtattttaatgtttgccaatttcttttcgaattttaattaattctattattccttttagaagatgatttttattttggg

SEQ ID NO: 104948 - DNA, 637 bp, Oryza sativa
ttcgattgttgatggctaagttttcttaacccttggtaggtagtttatttcttctgcaatgcagtgccctatacattatggactgttagtgttcacttttcctgtactctgcaactgggacaaatatcatatcttctgtaggcaaagaggcattacattatgtataagttgtatgctgagaaaccaaccactaggtgcaaaatcaaacctgatggttctacatgagccagcacttcaatattttggcacccaagtgctagtggctgatgacaaatttaagatagaatacctgtgtcaacctaaaggagacacaaagaggcatactgatggaaataaagttgaatttgattcaccgacgcattgtttggcactgtggattgtagaatattaatttgttgaaaaaagcaatgaaatgacctttgcatttagtatttaaagaggcagtgctggaaacgtagttttctactgttttattattctattcatttgtcttgtgtttaatagataataacttgttatgttaggctgtgttcgttttcttgtgttgggaacttattccttccgcacagaaactgagtgactcattagcacttgattaattaagtattgattgtatttatttttcaaaaaataggtg

SEQ ID NO: 104949 - DNA, 581 bp, Oryza sativa
ccactcactatacatgcatatgggcaacactgcctatcttggaactctagcatggaaatgggtcaatttccatggtgcatttactaaggggattggtgtgagggaattgtggatttactagcttggaaactctagcatggaaatgggtcacaatttccatggtgctgaaaatgttacattggcaggggcagatcagatcagtccggaatgtcactagctagagcattgtattatagggggaaagcctctagttgtacctatataattgcaacttttgtagtaatctcgtttagctttctctcgcaaaaccggggtcaatttgggataggactatagtaaaaatgtctcttcaacaagggctaatcaacaggcctctgacccccttaattagtttgcctttgtgccaatgaccagattagcaattttaatgtactaatgtagcgattgctggcaagcaagcattcgcattggatgatctccctacatgtgacaccagcaacagtagtactccatgtaaattagaaaattaaatgtgtatctgcgtgcattaactgatgctagctacaacaacgtatgtactg

SEQ ID NO: 104950 - DNA, 874 bp, Oryza sativa
gaatgtaatcaaccaataaagctccaaatgcagtacatagtagtattagtaatcccttgttctttcaacaaatgtgttcagaatgtcaggttatgtttcatatcactaactaaaccgaatggagctttctaaaagaaatcatgtattcatggtttcaagcttttcagctacggttatcacttgaacacaaacagcaaccagaaaggcatgaaccaaagatttgcattaagactcctttacctattaaattgtctcttcaattataatgaatacatcatgaagatggcaattgcctacaaattgaacacagggtgttgggaacaaaatagaactgttggatacgcgaagttgagcaaactaacaatcgaaagagatatgataattgcatttgcttatagagaactgacagagtaatagataatggaaaaattacacttcaaataagattttgatatataaatggctcctacaatctgatatggacagataacaagcacaatgatacaatatgtaaccactttgtttctgtaatagtaatacgaagttgaagtaatatgatcccggatgaatcaagggtcttcttctcatcagtatcaccaaatttaggttaattaactctaatttggcactaattatcaatatgctcgtgtgattagacacggatcttgctcttcaactcgttcttactcctaacgctatagaatctagagattgaaggctccagaaagtgagatcactaggatggattagtatttattttacaagctaaatctaggagtctagttctcttttcctttcttttaaatcatttgaccaagcaaggtttaaactggaaatgttggcgatgttcaaactttgaaataactatatggac

SEQ ID NO: 104951 - DNA, 1134 bp, Oryza sativa
aggctcaggctatcgtccgagacaagcagctcctgcagccgcattctcctcgtcggactcatccccatcctgtaaacttttctctattctaagctgcgaaattcccttattttgttttattctgagatgaatttttttcctaattctgcactcgtacgccttggtgcagggagatgtgtagcttcgaattctccaccatcgaaaccttgcttctcttggacggcatagagctaccggaggaattgtacgggttctctggcaatgtcgtgtatgtcagcgccgctgtgatgaagaaagtttctgggatgcaatcagttgattcaactgaggcaatcgctatcattcacatgcctaagtatttccgcgaccttgacagcgaccagggtggagctgttcttgatgagtggctcggctctgcaaagaggattttggttctggatgggattcaggtaaaaagaagtgtgcaatattccgttattatccatagtaaatggatgtcattttgtgcataagacggcacataatatgttgtttattgtttattttaagtttgaactagtccatttgattcctcttaagcaagggttctaaatttttactgtgtccataatggttctatcctgcaggaccctggtaaccttggaacattgataagatccgcttgtgctttcagatgggtatgtcatttactactaattgttgaagcgtctctgattgcatttctcaaaacttgatgtttcatggtctcatggatcacaccatcctattgtttcatataaagtagttatcacagcttgttttacttctcaataataaggtagaacttaagtgataaaaaagctaatactactggtagtatgtagaattattaggtttgcacttgtttttacatctaaggatgatagtgtaatgctattaatgacattttgaaagcaaaaggttagtacattctgggttagaaggctagaaaccccatacgtgttctacatttccacaaaaaattatgctcctattatacagcatcagatgaagtttagttagcagttagcacatgccaatatgccatcacacaaaaatatctgcatggtgtgtagcctcccagaaatttatactaactcttcaaccgctttcagt

SEQ ID NO: 104952 - DNA, 843 bp, Oryza sativa
catttacattccattgaagggataggagttcaagcaatcaaaagaacctcaaggtggtctaaaggccgtctttcggaaatcttgctaagtcttgctttacaaaatgagctacttcacttgccgagcaaggggtgttttgaaaaatcctcctattcctttctagccaaacattccgccaagtagttagtaaagcaccccttatagcttgcttttcacacagtctcactgtcacaactcacaaggaaagccgacacaaatttgtgatgatgtgaaaataggtggacgtattaagtcccctctattaaggctacatgtatattatagagtgatccttatactgatcctttatatgatcccattagccctaaggatcactcgtaaaaaataaaaaaaatcactattatgtgctgcaacttaatttaattatctcatcttactaaaaggtgaaatggtaaaagatgggtgcggcttagcttaacacaccctccttgcattgtggaagaggtgttatatatacctcggtgaagctaacctgacttaaaacctattcaaatattatacgtcaaacatgtcctaaggttaacttgttctcacgagtttaatactttaacaatactctctccatcccaaaatataagggattatgaagggatgtgatactttaaatctggacaggcactttatccagattcataatactataaagtgtcacatccctccaaaatctcttatattatgggacagagagtatatagttaatatcccatctctgcttgctgccttaatctggaccgagcatactagatctaacggccactgtatccatcctctccctcccattta

SEQ ID NO: 104953 - DNA, 1749 bp, Oryza sativa
cagaaagagcgccattctggatgtgtacgtgcggaggaggagaaggttttataggttgttgtagcactgggtggagaagaacgaatgtgattggttcgttgatcagtcacgcactttttgttacgcacccaacaggccaacacctaccggcaagcaccggttaaaattttactacatatttcatagacatcactacacagctaatggtagctatacttcaaacacaattttctcttaaactactcatccaatctacgatccaattacaccgttgtgttcgtaataattaaatctttacaacaagatctcacatgattatattttgatgaaaaatcacaaattacttttatgatatgtcttaattacttttagatttcactaagttacttcttagacatacaaaagtaaattcagtaaagcttaaaagtaattcacatatattatagagttaacttataacaaaaagaaagtaaatttaattaatacattttttcattgaacaaattatcatatatataattatcatatataagttacttttagatttgattaaaatacttcctatacattcataatgctctgaggtgattactttcattattgttttttagttaattttataatttgtgctgattaatttaatttctagatagagtcatgtttttatctctacaacggatttatttcaaatgacatgccaaagttacatttgttttgttctaagttacttctataatatatgtaaattatttttagcctttactgaatttacttttgtatgtctaagaagtaacttagtggaatctaaaagtaatttagacatgttataaaagtaatttgtgatttttcatcaaaatataatcatgtgagatcttgttgtaaagatttaattgttacgaacacaacggtgtaatcggatcatagatcggataagtaatttaagagaaaatttcataagaagaaaaaaaatgtataacctaatagcaaaaactacttgcatgcatgtctgtagcgctattagtacttctcacgtaattgtccgcgtcgctcgttaagcctaaatcgagatgcctctcgaaatagattttgcgatattttatcgacagatttccttaaaaaaaagaatcaaatgtaaatatagtataactatagtgtaatataaacttgcatgtaacaacaatatgtaactgatatgtaacttgtgaataaaacttctatatatgtgttcttaacgatttaaatcaaaggttaaaaaataaacttcgataaaaaaaacctcaaaatcaactctaagtttaagattgacaattcaatttttgattgataatcacaagtaataataccttcattctcttttccttttccccttagtgtggccctctcctccatcgccaccgcacgcccccttgatccggccgcgatgaggagcccccacaccgttgtctttctcgtctcatgagagcatctccaacagtatagctatctcactctccaagctaaaatttggtaattttgaaaaaaaaaaacgagctccaacagactagctattccactctccaagctatttgactggctaaatgggctccctagctggccaaacttggccagccaaaactggttcgccaaccttgggattgtgggacccatgaccatacttttctctcccctctctttctcaacattctctctgcctcggcttccttggcgcgccaccgatgaggaggaggactgtatcacgaaggcgctatc

SEQ ID NO: 104954 - DNA, 1437 bp, Oryza sativa
tgtatcttactttacacttcatattttagcaaggtcattttcataaaatttaatggatttacatgtgaaaatggagagaaaaaagttacactaggcttgttggttgctttcaaaacctttcgacatgttcagcttgttgttttgtactaactgataacaataaagaagtattcttttcgaaaaaaaaaagtatataaatagaagtataaaaactgtaccctaaacttattttctttgtttcgatcacatgtgttcaactttacgcagttaaaaaaaaaagtcaatcagctgtacgttcccagatcctcattgatgggacgattatattgtttttattcttcactaccataattcggctgatctccggtgtactaaagaagttaggaatctgattcggatactcgtatgttattgtgccctagtacattctgggaaaaaaacatggtaaacactgatgagattcgagtttgcatgttaacctgttgtcattcttaaaagaacaaaaacattattgttcacttactcacgttggatcgggtcagaccatcagggtagcacaaaccatgtaatcacattattcttagattagatgaagattcatctcatattacatctctggagatccttttttttaaaaaaataaaagaatggccaataacaatggtagataggactttaactagatgtttcaactagtatcttagttttagtcaactatttgaatacggatcaattttgacaggcatgaacttctttcggtacctaaatttgcaccaccatgagcataataaaaaggctactagcccatccttcgatagttgtttattggttagctcagtggttgcctctttgatcagtcccaagagccgcctcctgtagtcctctgctggattctgtccttatttttctttcataggaggctggattacaatgtcgacactcgacagccaggtatgggcacccggcattgcacatgcaaaataatttcaacaaattaagcaaattgcgcatgtcagaccccagtttgttggtggtcagaagttgtaaccatcttctaatgtaaggtgctgtaacgaaatatctattggagacttacagttggaacaacagaaaataaattctaagtagggctgaagacaatttgtttgttagtttttcaatcttcttccttcaaagattagaataagtggaaatgacgcccttgatcagcaagtaagcgagcggtagttcagtctccgacaagtgaggccgaactagcccctagatcggctctcatggtgggggaatcagagtcaagttaggtgcaaaagaggtaagtttggaactgatccaatgcaaacatatgcaatttttttaacgaatcggcgagccgctaaacaaggaaggagtaaactgcacagtataaaagaaaaaacaggaccaaagctttggtcctaa

SEQ ID NO: 104955 - DNA, 578 bp, Oryza sativa
taagggggagagagtgtgaatcggtgattaatagttgcctactacacttccatgttgaggcgataatagtaacaacggattgttccttactgtcccatataattatggagtctacaaaattagcaaagtgtgaagaaaaaaataacagttataggcataacattaaaaaaaagactttggtaattgcgtgatggcaagcttgtagacttttgttgtacatgatatctgtttggtggagcagcactctatgtgtttgataggttttagagctgacggcttactcttctattgaaattgctcttaggccaatttcaatggtggttaatgtaacaaaaaatttctagtggtagttttatagagttttttctcaataaatgagatgccattcaaacaaatttgatgacatggcaatatcattatgaagagagattaaaagagtttcatatatatggaactggatgtacactgtttctaagactataaaactatttgaaactggcattgaggagctcgagtattccatttcatccaactgcattcaatcccatgcattattattaaatgttatgactaaccta

SEQ ID NO: 104956 - DNA, 1728 bp, Oryza sativa
agaacatgaagggctatagctagccttaggtttcctcacttcctctggccaatttcaatgtgccgctttcattgatgattattagatcatggttgtctcattggtgttcacagatggatcagcttccattgagtacaaattaatttgcatcatattatctcaaaatttttcaatacgaactgcccttctcaatttatatcagagaatcaagtttttttaaaaaaaaattgaagaagcaggagctcctctactaaattaggacgaataatttggtctagaaacgaagaggagacagcgcggtgaaaagaccggcagctgcctcacgcgcggcgcaccgggatatttaactttttgctacactttcataatagagtaaactatacccacaatacataatttggtagctgtgtgtaatttggtgcaagaacatgagaaatgagctagtgccttttataatagagtaaattgcacccacggtgcatagcttggtaggtttgtacaatttggtgaaaaacatgacaatgagcgttttagtgcaacgactcgacagatgggtataatttagtataagaagtttataagtgatcgtataaatacaacaactttcaaggtagatacgattttgatacaataagttaagaatttatatgataacttaattatttggtgtattttttatacatgtttaatttttaagtacttattttgacaatttactagtgtggatttgtttaagcatatttatatttttatcgtaacaactaataactgaaagtcaatataagtggatgtagaaattattatatatatttcggttgagatttaaaaaggtgaaggaaacaaacattattaaaggtaatgggatgtaaattggatgtgcaacgtaatttttaaagactaaaatcaatattatgatgtaatatccgtaggattgctgtgtaatggtatattgatatcgtgaaaaaaaaactcacctaagatatacttaactaatacttaactaagttgatgcaccaaaatactaataacttatcaagttcttgtactagaatacacctgcttttcaagttgttgcacttggacgttcaattctcaagttttgcactatatcacgcacacctgccaagttattgaatcgtatgtgcaatttatactctaataggtcctcatatgtgtgtggatctaatggtaaatttttaatggaagtagctatatttatggcgccatatttttcaccaaaagttagtcggcatgtatttatattgtaaggcactaaattacatatgtaattttagtgtatttacaatgtaagtcccaaaattacatatgtaagtactaaaattacatatgtaagtcacaaaattacatactaattacatatgtaagtagtgtgtaaatagggtgtaactactgtctaaatatactactaatatatactaattacatatttatactttaattacatatgtgtttcgctggtcggtacaaatactcatacttgatcgagtgcatgcagtgaagaaaaaaatagtagcaaaattctccagtagaccgctaattagcaacctgtaacctatgaagcacaactagttacgcgtaattaagtatgcgagcacgaatcctatgaccgatccaatggctcaacaagcgactgtaatcaaccagaaaatgtgtcggcaaaaatttatcaaaaccgtttttaattaccacgttaataaaaagtttaat

SEQ ID NO: 104957 - DNA, 506 bp, Oryza sativa
tccctccaagctagttggccagatgtgacaatcacacctatagactaacaagtggattagataggcaaaagtcttcgttccaattgtccctatgtctatctatgctcacttctacaccttgaagatgtagatctcataggtctgtatactcttattgataccttgaaactatagatcttttgagtctcatactcttcttgacactttgaagatgtagatcttgtaggtcttagtatgagccacaacgccccgaggggaacccctgttcccacttctccgataacactcaatagggatgtcacttgcaaaacttcatagtggaaatacactgcatttctaacatcacaggcaccttcttatatccttattcagtcccgaaattagtgaatcattgatatcccgggaaactttagtgtgtgtgaggaaaaaagaccaaaaccccttattaatagaaaactagtacattaaaaaggggtgatttgtggagaacctaggtaagaaagtag

SEQ ID NO: 104958 - DNA, 801 bp, Oryza sativa
tactattgagaaggttactagtttataagctaaaaaggtcaattgcacaccatgggatatggtttacaagtatatatgggccatattgttagtgaagcagtctttatgcaagagcacctatggtatcaagagacaaatgatccactggcaacgaacactagtgatggatcatcctacttcatgacatgcttaactggaactacacatcaccatttccacaaaatagtaaaggctaaccaagattttgcaccgatctccttttcagatgaccgtgtctgacattatgaacagaaaaggtttgaaatcatttcataaaaaactgtttatgcttgaggaactcacttgcttttggcttatttgggctattaagagaagaacattttatatcagagtagacctcaatcagtggttatggaaacacatagggttattgcagaatgtagaggtacttagggcctatcataaatccataatgccaccacaaaatattccaaatagggtaacctcaagtaatagtactgcttggctagagctatacctgtctaaataatacccatgcataacatgtatcatgaatcgtctctgtaatgcctagtatccgccaagttgattttaggagctccaggatttcttccacttcctggtagattgaagcaaaaatgttaagagaaatacctgcaactgatagtgtatctagacagaggaaaattacaaaagatgattttaagtactggcctctgtaagctttccctcatccaagatatcaaaaacactgccgagcatttactcatacagtgccac

SEQ ID NO: 104959 - DNA, 658 bp, Oryza sativa
actgttgcacttgtacacttatacaattgatgcttttgttttttgctttgttatgccagcgtgtttggagaaagatactcagtcataagaattgtttcagaacagctccatgaagagtgggaagcattaataaaccagcctgacattaatctgacaaaacaatggatatcaagcatgatgcttagaccatttcttttcttcgttactcaaccatcaagctggtacaagggacaacaggacaagactctaaactcgatttcggcatgcttcaaaatcatcttgaatagcataaactcaatgggtatgcctttttcataatcaaagtttgactttaccgacttccatcttgacctttttgtactttattttctcctccttaatgaaatgacacgcagctctcctgtgtagtttgaaaaaaaatgttttactttacccattccactagttgtggttaactcctataaaaatttatttatgtaatacttccttttgctgtaaggattataatcctttatattattcaatccttgtatggcgatgacctaattgttagttctagaatggaattatgtacttaacagaaaagaaattgcagtcgacgtgagataagcagatactccctccgtccctaaatataagggattttggttggatgtga

SEQ ID NO: 104960 - DNA, 561 bp, Oryza sativa
ttgctcaagaaattgtctcacatgaaggtttgccaaaagtacttcaagtacaaggccgttaacctacaagaattaaagatccgcacagttagcgcttcccgcaagcagtcaatgcacttaaagacttacaatacaacagtacaaaaattcgatgatggtgcaagcagtagtttcagtgaatcttagaactcaattgatgattcaccttctattgcagtagcacaatcttttacaaatagtacatgcccgcagatcatgaaaagctttcttgtaaataatatattttaatagataagaatcgactcctagtagaagatactaatcttcctgttcaaatgttgattgatgctggcatgctattgggatagaggcatgccgaaaatttcacaatcataatcaataattatgcagaatatctcatcgtagaacttaaattcaatgcacagttatcaactatgacatgatatcaactatcaagtatagagataagtgccataagttctgcctgaggttcaataactgaaaggtcccacagtttgcaaccttcattgtcccacagat

SEQ ID NO: 104961 - DNA, 995 bp, Oryza sativa
aggagcgatggacggcttgatcttgattgatgatcatatattcatattagctgaatgtccgtgctttgctatggataaaagaaaattttaacataatatttttttcacatcttttttttttctatgggaaatgttcaccttaattctattttatatgtggctatccatttagatttgtttgcttcttaatattaaagaagttcaaagagtaatttgtaaattatattaaaataggtgaggtggtagattccaataaatatttccatgcaggtctatggatcaagaaaatttccaactttgggtcggctgcactgagaaagtgagaaagggatatgggtatgaatgcaaattgcatcgtgtcatatattactatatgcttggaatcgaaggaagaactagtaatagatagctgtacatcaattaggccgacaaaataagtacaaataatattgtaattgtgtgtcaccatcacctaatgttgctcagactttgtagtaacagatcgatcgatctacacacaatcatttgcgtaagaaggaattagaaatgggcaaagatgtgtgtgtagattacttgtaaaacattcttaacccacttaaagacagaaagcttttggttgagagatcaatataataaaatttgacaaggtcgatggggtgaccgggacaaagtcgtgtgagtttggaggatgacgcatgatgtatatatacatatgtttagtaagtgtacatttcgttttcctaagtttaccttttgtccctgaagttaattacctggtcaaatgatatctcatgatcatctagcttaattagtctaccaagtagctgcagatatatatgtaataaattagatgcatggggatcatggcgtcatgcatccaagaaagtctccaaaggcaactagaaaagtattttagtagtgtgtatgcatgctctctgcaatagttagttagttcactaggtgatatacgtacagattattgtcgttgcacagtt

SEQ ID NO: 104962 - DNA, 1730 bp, Oryza sativa
aagttttcaaatctcgagttgaagttttcaaatccgaggtgagggttttcaaatctcgagttgaaagtttttgaatctcgagttgaaagtttttgaatctcgagttgaaattttttaaatctgagttgaaagttttcaaatatgagttgaaagttttcaagtcgaagttgaaagttttcagttgaaagttttcaagtcgaagttgaaagttttcaagtcggagttaaaagtattcaaatctgggttgaaagtttacacatgtatggaaaaatttggaaaaaagaaaaactaaccgtgtcttgccgcctattaggccgtgtgggccggcgcttacgcgccaattaggattcctgctcctagctagcgcgtgcgcgctactggcgcgcacctccccctcttaaggccttaactacctctattagttaacacttgatactaatgatagtaattaggtaagattctgaatatttttttagagattattttactaacagaattaaaattttttaagttagattaaaaaactttcgatttaagtttcatgttttaaagtcaaattttgaaaactttcaactcagatttgaaaactttcaactcgagaatcgagattcaaaaactttcaagttcagatttgaaaattttgaaaactttcaacttgagatttgaaaactttcagctcgagatttgaaaactttcaactcgagattcgaaaactttcaagtctagatttgaaaattatcaaaactttcaacttgagatttgaaaatttttaactcgagatttgaaaactttgtcctaatttaaaattttgaagttaagatttaaaaactttcaacacaaaacatttgaaaaacacgtgtcgttggaagattaaaaaagcgaaaaaaacacggaaaaaaagaaagcaaaaaaataaaataaaaagtaaccgaaaaaagtgaaaaacaaaaaggaaaaaatcacagaaaaaagaaagtgaaaaaaagagaaaaaacagcgcgaaaaaaaagaagattcgcgcgcgcgtgttgggccgtgtgggccagaatgcgcgccggcaacgtgcgcgtgcaagttaggattctcgctttgcactcttggatgggtaacactaccactaatgggcagttgactatcagagatggatttattttcagtgaaaatatataatttttttaataaatacgctctcttaactacttgtattccatttatgaacgggaagcatatagcaaatatttgctcgagggattagaattcaattccattgagtttattgtgctaattttacatagaaattttacggttttccagaggtaccaaaagaccaattttttttagcttaatatctaagatactgagagacatcaaattttacagtagaaataccttcatatcgctctttacataatgttttaaggcagctcaaacaaaggaatcccgggtagttcgatggtttggcgccaaacagaggcacacgaggatttgctagtccagtttctcactgtcattcatcatatcccaatcttcacagtgacaaactgacaattattaattagttggtactacttgttagcaaacatacaaaaaagaaaagcacacagatgagttctcttatcaagacaaagaacagccatacacagtgtaaagcatcctacattattctgaagaaagtgaatcactcaagtacagtctagagagagatacacacataaatacagttatgcaga

SEQ ID NO: 104963 - DNA, 552 bp, Oryza sativa
ccaaatacaactttacactactgtatctatatttcctaaacagttcaactgttgttggttgctctattaaaccacaataaaaattgaagtccacggtgagtagctgatagacaacgaaaaaactcaactaagcaacgaattgaaggttaaacttttatattcgtgttttaacgatttaaaaaccaatgcttaaaagataaattataatgagaaaaaacacaaaatcaactgtaaaatcaaataataaatttaaattttagttgtgaccgattagataataaccaggcaatgagagagaaaatatagccacgatggatttgttttaacagagaaaaaaaaagcttgtgtacatgtgcaatatatagtcgaaattgtgaataagttgagagaaaactaatgcgagatggattgtgcgtggatggggagattaattgctcgatcggtcgcgagccatctagtagttagatcgggaggcaagtcgcattgcaagtaagcgaagtctgaactctgaatttaacatggaaaattcttcagacatgctcatcagatttc

SEQ ID NO: 104964 - DNA, 773 bp, Oryza sativa
atatgttagagttacatgtgtacactattaaattggtattaaaataaaaggcgttgtataaatgttacccatatcatcttaccttcaactcttttgtaggttctattacagtaaatctccgtaatttctaagcatataacaaatatcatatcatgaaaatgttaaaatggcatttagaggatatgatcaatgtgtaacagtaatctccataaccatttaattatatatatcggttaccgcaatttaattaaaatgagcattttggacatcatgagtccatttcaactttgaatctgtatgacccgtttttgtgaaacttttttccttcacattctatcatatggtggtgcacaccctaataccattatcatctaaatgtttgacattgacctatccatacaagaaaggctctagaaatgcataaatgatctttaattaccaatatgttctcttgaggtatcggtctaagccttgtcagtcaacgtggatccttgatggcccaatctcctataatttgaccaattcaatattgttgttttgatagaagctaagtcaaaagtcggatgaatcaatcaaatgcattgaatctatccatgccacgtgtgtaaatcatgccataagaactgatataatttaattttatacctccctgatgtcaaattataccctagaaattttgaaccttctaaaccttcatattgttagattaatttttaccttaacataagccacgttagagtggaaccaacttttcagactcacgcaacgagctg

SEQ ID NO: 104965 - DNA, 720 bp, Oryza sativa
gttcaagcccaataagctcgaggccaatacttttttgggccatgagcccatgaccaacctgtactccgtatttggtttcaggcccgaacgttataaaaccatccagcccacagtatttcgaatttggcccgcatatgaattcatcttaaacatttgggccataatctcttcaaattggcccacaacggctgcctgtttcggtataaattcaggcccatctgaactcgctgaatttgtgcacaaaggaatcatcgaacaaattaaatttacatttttatttgataacagaaatggtcaacatcttcaatctttgttgttcggaacacagccaaaggaattataatttacatgcacaatatggagtgaagcaaactaggaaaatgactgaaactcagttctgcagaaaccagaaagtaaaatgttttgattgaatctgatcactgataaggctggtgaccaacttggtgcaaggcttcaagagttccaagactgttgggcctttcctacaattgggcctttccaggatcaatagaacggcccatcaaagcccaacggactcgagcccaataccttcctggcccagcatatttgatgaaaccatttggccagcaatctttcattctttcaaatctgttccatgatctaaatttttctgaacttttttggcacataatctctcaaatgtgaagatattcaactatcttccacttttagatatgg

SEQ ID NO: 104966 - DNA, 907 bp, Oryza sativa
ggtgtgtgtgcatgtcctgatcatatatgcaggtatttatagcatgacatcgactggaatgcagtgttaaccatgcatgggtgatgatggatggatcaatgattaggaggtaattaattaagctagctgcaacaaattattggtatagctgaatgagctaattaattaattaagctagctaggtatatagctgggttgacattgccacacacaagagggtacttgataattatcttgttcctatgggattagacaagagttatctggccggatatatgcaatgttggttagttagcatttgactctatggaggtatgaacactagttacaactgcaacagaaaatgttatcaaatctggctagctttggacaccaatatcctagctaattaagttgatgactttgagaacttttagctagctaccggcagttaagattaacagaatgaatagaacatagtactaattaacccgacccccaattatctaaaaaagcatggttaattttattttgtaggcctggaaatgtccctagctcctcaatttaattttggactcatgatgatcagttcacaagttgaattagtagggaaacgaattgaatcctgtattaaaaaaaacacaagacaatttattttaagagtaaatttaacaaaactacagatactttgatcaaactattacaaaactacagatttaagaatgtatttcacaaaactacagatttagcgtcaaacttttcacggaactacagatttaatgcaccatatcacaaaactacagatttagtgatgaagttatcaaagaattacatattttagagtttagatcatagcactattatttatttaaagttataaaatctgtagttttgtgataaaatagtttttaaatatgtagtttgtgat

SEQ ID NO: 104967 - DNA, 517 bp, Oryza sativa
tttttttcatttttatatatatatatatatatatatatatatatatatatatatatatatatatatatatatgagtatatatatatatatatgagtatatacctagttataagtattcgattcatacttacacctttcaacaaaacaactcaaaatttaactttatttcacaatccaatattacatacctaactaattatatgtttggatgctatatacctagaatcaaaatataacaaaaacatgtttaaactaagttcaaacttgttttgaactagttagtaaagtagttaatgttaatacctaaacatttaaaaaaatttcatactcatttgaattgagtatatactcaatttgaaccatggagcccgggcaccatggggcaccaaacaaatttaatatatatatatatatatatatatatatatatgagagatactactaacatgcgctttccatttttcttttaattttctacttttcctattcgttacttctttttctaatttagcccata

SEQ ID NO: 104968 - DNA, 1010 bp, Oryza sativa
tcagagagtttgttccaatcagaacacatgcatcgagctgatcgagctaccgatattttaaaacagcaagtgatgatcactcttgtgaatttactaccatatggtctcatgttctaagttgatccagcattgatcaagttggggggtgaaaagattcgcgtagaaaaggttggcgccaatatactgcagagttgtggtcgatcggccgggtcgtcctgctttgcttcagacttcagagttgaattttttttccattggaggctacatgcgactaagtacactactagtagagtagtggagtagtagattattaatctaatcgagctggtcaattgcatccagtgacactaaaattttgtctctcttccttgctgcatgcagatcccgatgcatatgccattaactttcagtgcagactgcagactgcagtttttgttactgttcagtagaagtttccatagcaattagtcatccccgttcacaaatctaacaatttctatttatttttagaaaaaatcaatacaggaaaatttcttacttagacgtaaaaatatattaacaaggatttcaaggttatttaaccaaaatttagattgacgagaaaaaaaaatctcaatgtctctgttatgcgataggtaggtgggagccaaaggatggtagagataagatataaaaaaaataaattagaggtgatcaatgagataagtagtactctatttttcttagataaactttaaatgtttagaatgcttatatacttttagataaattttaaacgtttagaatgcttatatctgtggggagagagggcgagagtttaagacagatggttttgttctccatccaacctgtagcccaatgctgtccctgcttgctctgactctgaatgtatatggactgaactggaactgcacttgtattttaaggcagaaatgttgagcagctggtgcccatattatttgcacatgcacccatgttagccctttggttgatcccatatgtgtaaagga

SEQ ID NO: 104969 - DNA, 661 bp, Oryza sativa
acattggatctgaattaagtcaccatgacagtgaagttgaaaaactgacgaaatcgatccaagatcactcttcaattaatttatggtgactgcatagcgtgctagatacctcttcatctgtacacacgccctgccaaattgactgaccgcatcctcgtcgtcgttttcatcagatgctgcgtcttctttcatcagcaattcagagatgatatgttcatccggtatccgaaatgtgcaagaaagttcagacatgttcagtccagatccatccatcccatcgccgccgacgacgacgacgaacactgctgcaggtcagcacccgtggcgccttgcaaattaacaagatctcaatttaccataagtccataactaacatgcacgctagctgcagcaagctgctgctaaactaatcgtcgccaattaattactcacctaaaccatgcactacacttgaacagacagtgtcagtgtgatcagcttcatcagcttagctcaagagaggcaggccggtcaacttgtgaccccatgttcttgtctcctcatgacacactggccatgttcccagttagcatcgatcaacacttgcatgcagctgctacctagcttagcttagcttaatcacccagtgcaggtcgtcactagctacgaatcactatcagat

SEQ ID NO: 104970 - DNA, 538 bp, Oryza sativa
ctataagcccatacggggagaggaacgaaattgaactattattcaatttgggcttaaaaagtaggtctaaattggacaattaatttaagcccaactttagagccaattttcatccattacagatttcaaaagctttgattttgtgaattttgccgcttgggcaaatctatgcctagattttcatgcatccgatctaaatctttaaagaactattaatattttaactttttttaatgtttgacttgaaagatgcgtgtctaaactccaaaataatactcactccgtttcatataacaagacgttttgtcttttttttttaaagttaatttttttgttttgactttgaccaagtttaaaaaaaaagcagcaacattttcaatccaaaacatatatagtatcaaaatatattcgacgttagatttaacaaaactaattttgtattgtaaatattgctacgtttttctataaacatagtcaaacttaaaaacgctcaacttagaaaaaaaacaaaagtgtcttataatatgaaactgaagga

SEQ ID NO: 104971 - DNA, 522 bp, Oryza sativa
catgtaaaccgtgcagtgtcaaactgtcaaatgtgcccatggccttggcgatttttctctgtcgcgttgtaactaaaaccatgcttccagacatccccgcggagaagggaccacaaagcttctcccagtggctgctgacccacacatcatcaaggacaatcaagaacctcttcccttcaattttcctcagtagagttctctgagttgcatcaagactaggcactctatgaaacttgggagtttcttggccaccatcgatcgaatctatcaaatctgctataactctgcgcacatcaagagtatcagaaacgcatgcccaggctctcacttgaaatgaatcaactactctttgatgattgtagacagactgggcaagagcagtcttaccaactccaccaatgccaacaatgggaagaacattgaagttattgtacctagactccatatctgttctaagcataaggtttatgatgttgttggtagactcatctctcccaaacaacttagtttcagtgggaaagg

SEQ ID NO: 104972 - DNA, 694 bp, Oryza sativa
tgtcgaagtttattttccagcctttgcttttagatcactaagaatacacatataaaaaaatattcacaaattatttccgtttacaaatatgccatttggcttattcccatgataagcaaaaacgatggcgccgcatttctcacaaacttctcagacttcaaccaatcttgcatgttgtttagttttgggcccaaaatttaggcccaattatggccttgttttggccgcccatgaacaacccaggcctgcctccgagggaagagaaaaaacgctacacagagtagtcaaccaacctgcactgtaccacacaggacacgttccaccgcagcagcacaaacaaatcattccgtgtgacactacgtgggacgtgccagacctgcacaaaacccaacccaaacccaaccaactccacccctctctctactgacacgtgggccctccacgtcagcctcacccccctcttgtggccagcaacgaagcgccccgaagtataaagaaacatccacatcgcgcacagcacagcgtcgcgtttcgcattcttattttctcttcgcttcgtcccccgcatcgacacgcacgcacaccagcagcacaagcacccaaaccctagctcgcggccgcggcgaatcctgcgcgcgcgagagagaccccggctgatggtttcgatgagcgcgacgcccaatccgatcgatgc

SEQ ID NO: 104973 - DNA, 711 bp, Oryza sativa
aaaatttcgctagtgctagtatcaggataaccgtgtgtataattcatgaaaaacattaaaaatagcaaaaaaggggggggggatttagccaccatgctataaatttgtgagtattaacccgtgagtattaacctttggaaaaaaatatgatttttttcataggccaaaaaatacgcttgtgaatttttcgaatattaacattgggacaaaaaaaattaataaaacttttctcgaggctataaattaatgagttatatagctttcacataaaacccatgggtattaaactttggataaaaagcatgaaatttttccagtccaaaatttcactagtaatagcatcaacgttacgcatgaatttttttattattaacatcaagaagaaaaatttcatgaaatttagcatccatgctataaattcatgagttataggcttctcgcaaaacccgcgagtattaacctttgaaaaaaaacaagtttttttccctcttgcccaaaattttgctaatattagcaccaggatcgttctatgtaaaatttatgcatattaaaattatgacagaaaatttcattaatttttgccctaaggttataaattcgtgagttatagcctttagccaaaacccatgactccgtgagtgttaatctttagaaaaaaaatacatgatttttttcgctgacccaaaatttcgctagtattatcatatgtat

SEQ ID NO: 104974 - DNA, 698 bp, Oryza sativa
acacaggatgtgacgcatcctagtaatactaatgtgaactgacgtcacatcttatactagatttgtttttttgggacagagggagtacattataacaaacaattcagttacaagagaagcaaagtaaggcattacgtcaaaaatatgacaacagataattgccacacgatacatacaaggatttacaggtgcatgaaagagaatgacttatgacatgctaggttgaggatttcgttctcgacgattctcttatggtactgtggaaattacgctatgtgcgtactattcctagaatgtataaacataaaaactaaggcatactattcctagaatgtacaaacataaaactaaaaggttgaattatactaccagttaaataagtgatactgatgcagtagcctaaactccactagaaaaccagaggtcaactgagatccagacaaaaaaactataacatgcaaaggtaaactaacttctatattgagttaccactgcgaagtttgcaaccatgtattcaggtacaaggataggtgcaaatgtgctacttactccttaaatcacctagggaccaaatcatggatagtgataatactaagttgaggtcaatactaaataaacagtactaaccaacaaatgacctaatgatattagattgcaggaggaggaaacaaccaatgtattcaggtacagggctgcag

SEQ ID NO: 104975 - DNA, 510 bp, Oryza sativa
taacacattctgtcatataaactctaattgtgaatttgtgagcaaagaaaaaaaatcgtggaggacttgtatattccataaggatttgatgctgatctgcactaatcttctgccatatttaagcaagtgctagtaccttcctcgcatgaactttgctgagagatgattcaagctgcagctgcagctggctgagctcatccactgtggacacagatgacaggtcttctccagtttgcctccttaaactggcttcgagctggtcgatctcattccttagccttgtgatctccatgaccatttgctgcaaggcagcatcacacatgtagattagttgtagaaatgaagctttgagtgattaggaatttggtgtgggacatgcaattgcctttcaaatgtaaaaaagaaaaaaataacatgtgttagattcagttcgcttacctcatcatcacggtttgtctcctgaagccgagtgtttctggtggtgatctcataacggtgaaacagctccat

SEQ ID NO: 104976 - DNA, 860 bp, Oryza sativa
ctgaccatatcacagttatgcaaccgaatcagctctaatatcccagaatcatatagttacagaaacacttttgtcttctaaaatgagaatccaggcatcgtcgacaggtatgtgctaaagtcattcttaaattagaatttagaaatgcataataattgatggctgaacattcaatacaacagaagctatagcaaagggtaaaagagagagttagcacagtaatggttgtactaaatgttaaacagtgaaataaaatgagcattataacttagggataatatgctggattatcttagttcagtttattcagtagactggtttggtgttatgatgtgtccatccttggaaaacatgtttgtaataagtttgccttggaatttcaaaaaatagtcaatatctttaagcatcaacctttgatcatattcaagcacagtttcagatgttttcttgagttaagacaccacatatactaacagcccaggaaaactgaagggaagatccccctatccaaatactactgttagtataactaatccatgcaacacttacataagattaataatttggaagctttagtggatacgctgttaatttattttagtacatacctaaacatccatctccgatgacctactagatttgcaaaaaaaaattataagatgctcaggtaacatacttacccagaatagagaagaatatcatgaaaccagctgatatctgcaccactcttcggctaccaacacgtgtcaaagctagcaatccagcattttcactacaggtaaggaaaagaatggttgcatcaaatgaaattagatgtattctaatgagaatggaagctgtaccaagatgaacataaagat

SEQ ID NO: 104977 - DNA, 1231 bp, Oryza sativa
ttccattgcatgtccttccgttctgtatataaacacgggtggtcgttagttgccattcgtgaagatcacatgaatatacattcttgctattttctgtacttgatgacagtgggttaccatgaatcacatattttcttcaaatgctgaatgcagaataaaattctacacaatcaactagaagctttgcacattagattagctgaaaaagaacgcaatattgctggtctttcatcgcaacgcattgattcacatggtgaagatgatttgcatagcgtcattggctacctgcgcagatcgaaagaaatagtgagtataagattcagtgtcctcttcttctttattattcctctacttggaatgggatgttatttatgtagtctgatggtaatttcactatttcaggcagaaaccgagatatctttgcttaaacaggagaagtcacggcttcagatagaagtatgatctgcttgctcttgcatattgttatttgttcaaatacccataattgtgccacgtcaactactgtactcctccatccacaaaagttacacattttacttttgtcaccaagaccatgaagaaattaaattatcttggatgctacaacatcaaggagtgaatgcaagcatgcaaccaatgagtatttagatgactacttgggttctcatcaaacatttaatttatctcttcatttaagtcttaaatacataaagattacaataggtacaacttatttggaaaaactcaaatgtgaaatatgtctaacttttgtggatggagtaaaacagaactctacctatgcttacttgaattgtatgtaattataaaggaactgttctgtttcttttgttttatgtagtatggtgactgcgaatattgaactgccacctgccagactttgttgttttgtcattttgttccatgctcccatttaatctgcccataggacaattccatgaagtttccactgtttgacccatcatatttggcatttggtatcatcatggaaccaatccatatggccttgtctcctttgtgtgattgcttgccaagcttgtctcatttaacttgatcctatggctccactctggtcttgtatgaacatgtcatgtgcctctgtactttcaacacataactgaaagttatgcattattgttcaatctgtttgtcttgcatgatttgagaacttgttttcactcctcattttgatatatgatttcctattatgtgt

SEQ ID NO: 104978 - DNA, 629 bp, Oryza sativa
aatatgtaaaaaagaaatagagatgcagaagaccgaaatagctaatctaaatcaaaagatttccgaggtatgttatttacccattatcattatgcaacgcatcatgaatataattggtttatttatatgcggttagcatttccttaaggtagctgacatttgatacatgaccttttctaataaataataaataagaattaaaatatagcactgtagcagctaatgttgtactagtacattagatagagaccatgccaggtcaaaaaatattttcttgaactggaggaagcaaaccctcaaatgctgatgctagttttttttaggaaacttacatctaagctaggcagcgcttgtgtggaaatgtgcgtttgtgtacatctgacttgatattcttggtgctacttgtgtcttcactttctgtcattggttttgttatgaatggagggactttaggattagttgcccagtgcatgtgcacagaaaagggtgtctgaacagcagaccggtgtgccggtgtgtacatcgagcaggggttcttgcattgtgtataaattcagtttatgttttacctcttcatcagttagtcttgaatagaatttgtctagtgtttcccaaagttctaacattat

SEQ ID NO: 104979 - DNA, 952 bp, Oryza sativa
tacactctaaacccctcccctcgtttttcacgtgtatgtttttcaaactgctaagcagtgcttttttttaaaaaaagtttttatataaaagttgcttaaaaaatcaaattaatacttaattaatcacgtgtgcggtccattttccatgtacactgtttgggtcgggaaaaagagtgtcgaacacagctatgtatgtatggattgagatgtacaacagcactggcaagaagtcaagaacaacccacgacttttcgaacacacgagcgaattattcgccgttgctctagtaatctaatactccatattaatatccctccacaccgtaacgacaaaaatatttttgtaattagcttagaggggtttctaggtccatcaaaaagatgattataattagagctagtgttgtatgttggtcaatttaacattgttgtaatgataaagttttaatggtaaataactatctaacccatacagcttatcttcatgtcttcctactggctccacttttgatttacgatgttaccacagaaagagcatgatactatgcacaatggtgcttgtcagggttacgggtcaggcatatcccctacccttcgatatacgatacgtatcgacatggcatacccacgcgcatgcggatatttcctttatgatctaaggaaacctttcacgaaatcaatatacgggaaaaagtccttttcggacaagaactgggttacctacgtatcgtgctaggtctgatatgttcgagtcctactcggagagtaccagacttgcgatataaaaggaccccccggggagggcatagatcatcgaatctcagaatccacacagcctacgaagccggagcctatgaggagccaagtcgtcgagagctagtcgaatcgactcgactacaatctcgccggatctgacaagttccatcttttcctttgtaacctgtgttttccac

SEQ ID NO: 104980 - DNA, 730 bp, Oryza sativa
  unsure (1)..(730): unsure at all n locations
tcccctatcctctctccaggtgcgacggagaggcagcggcgcacggcggccggcgggagagaagggagcggcgcggcggtggaggcacggctccggcagctgtgggcggaagaggaaggggcggtgggagttggccctggctgcggcagacggtaggacatgagctgcacaaccgaggccccgccggcgccgactccttattgatgtcaccggcgccgccaaggctgacgaggtggacgcggtggtggtggaggaggaggaggacggcggcgcggcgcggttccatgagcggaggctggtggtggtgtttgtgctgccgtcccagccgatgtgcgccacgtgctggcggtggtggtccgccgngccgccaccctcgccgccgccgcctagacacgtacacaacatcactaataccaaactcctaaatcaccccgcaaaaaacaatcgacaagatagagcagaagtgaagaataagcatccaagctccaaacaacgaaccttggggcttcttgccgctcttgccgccgccatcgacgacgtccacgctggatccattcggcaggtggagaaggggatcacgatgaaccggtccatccgccgctgctccttgccactattactcatggctagctagccactgctagctaagctgatactatcttggaatcaaattgcttgccgctttggctgaacctgtactggtacgatcatttttagtaaaagaaagggt

SEQ ID NO: 104981 - DNA, 1247 bp, Oryza sativa
taacagttcaggtaacctattagaattcctgacaagtatgatattggaagttcaaagcttgcaacaactctggccaatctgcttcacataaaggactgtttcaggatgaaaactgttatctgtcgcctgctaacaaaaatcatcaagtgatcccttgcatttggatctatcgagcaaaacaaccacactatatgcttattaacaggtgggtattctaacatttgatatcattgcatattgctctttcccttatttataaccttttcaatttctgtacaggttgtaccacctatatccctttatttcttttttggtttagccctacatggcattttgtagcacattttaacttccattaatacaatgtttatcaggtagagcgacctctatcatcccacataaaaaaggaagcaatgaaatgcttgttttaaactaccatcagatgctaattgagttcaggaaaaataaatattgtaaccctaacatgcaggaaattctataaccactggtacatttagataataccaacagcactcttcccaacattaaacccagcaacttggttcacaaatccaaggatcagaatatcataaacctccctactcctacagctacaacgagattgtacttcctccgtccaaaaataaaccaacttttgtaaatgaatatagacatagcctatgtccatattcacatacaaaagttggttcattttcagacggagggagtagacatgaaagaagcacgcctgtcaagctactggcccctactgaacgcatggattctagcaccgtaattcagttaaaagatcaatcgaaaatcaaaacatcatagtctacccaaaatgtgagacctagaaggtagtgcctcccaaccacgactgctcagctcaacagattcgaccacccaattcgacccagcaggctaaacctatcctcaattgaatacctcctccaaaaaagccgtctttcaaactacccagggttagcattcgcaggaggagcagatgcacaatcgcatccaaactccacaacgacacagacgccaccatacaagattaaaaaaaaaaagcagcacgaaagccgccaaactatccccaaccacggggggcgcgccgcgcgcgcgcagagataagagggagagcgagagacgggggcagaattgggggcactcacagctgcagcgcctcgaggaacttgtcgtgctcgggctccgtccagctctccctcgacttggtgatggtgtac

SEQ ID NO: 104982 - DNA, 684 bp, Oryza sativa
gcttcatgcatttgtttaaagattcaatgtgatttttttgggaaaaactttctagaaactacacagggcctcaggcatgtgcaccatcagaaacttttcttggttgtgcatgaacagtactactttgaacacagcggaatggcagaaagtttcagtggcactcctgttgttgctagacagtgccagaaagtttcaggcaaaattaagcctgaagcttcttctccccacacaaaatcaatgcggttgatagcacagctcgatcggtctgaaagcgttcatgtccactgatgactcagcgatttctgaatcacctgaaatcctgaatataccttatggtcagactgcacgtagcaacattttgctgtgagctcactgctgaaattgctgatgtaccgagtacgacagtagtagaagggaaggggcatggagacagaccggtagatgcaagtgggtgatgagcattgaagatcttcagaacagtgaaaggacaaaatacaccaaaatcgccgcccaaactcaaattatcttatttctgaattttttaaccgcaaaaaaaaaagaatctaattagtacagtactaagcagattttttttaaaaaaaagagagaaaaaggtgatggtgcttgtgcggtgagtgagataagcactgggaagaaaaatactgtgcctgcctgacgataact

SEQ ID NO: 104983 - DNA, 1589 bp, Oryza sativa
aaggacttcaggatacaggtcaggaggttgtgatttttatgaacatgaactccttcaggtttcttacataaacatatattaacagacattggaaaaagtcttggagaaagagagagatgataataagaaagaaaaagcattccgcagaaggaatgagaaagtatttactaccgccattcaaaatatgaatcaggtatttcttcctcaactagcctgagtacagtcttgtcttaaaatttttttgtttatcgtcagttgggtttagattgagcaccaaatttatcatggaactactgatttaatacagattgtcacaaagctacacattaagtagcaaatttgtcacaaagctactggtttattgccaatttaatcccaaaactacaacgtctatatcttcaacataactgtagtgctagggattgaaaatctaaaatctgtagtttttttataacttgagcaataaatctgtagttttgtgatacttctccctaaatctgtacctgatagctttgggggagtggattctaatcccttgaggggatgtcccgtcgtgtacctttttctttcaattcgatacaaatagttgtaaaaatttatgaaaaaaattcgacctactatttatatctctcgacgtgtgcgttgcgtttggacctaagattttatggagttgtatacttatgttgtatgagtgttgtcgatcttttccagaatttttcataaccatttggatggtttttaagcaaacaaggggacatccctcgagggatcaaaatagtttccctagttttggcactaaatgtatagttttgtgatttgtcttaaatccgtagtttgtgaaattttctccttttttttaaccgatgcagtagattttctaataagaaaagccaaggaagtagacattaagataatgaaagattgatatgttgacatgttcacagatgaacttagaaaaatgaaaaacttaatgtgttctgggatatacaagatgaaacttttaagtaggatgttttagtgtattctagagttggaaagttggcatcattatgaatgttctaaagaataagtgccattttaaaccttaccaaaaaattggcaagccaaattttggtaaagtttgagtgtttggtttataaccaagtttttgtcaatgttgcttgtgatgtattgattgtttttgccaaaatattggcaacacaaaatctatggcaacaaaccaaacacacacattttcttgcccttgccaatttttttgtatagtttgtttgggctataaaccaaatgctaagtgttcatgtccattgccaaaccaaccctgagtattaagcctatcattatgatctacacttttcgttacattttcttctattgaatgatttcttagaatatgaaatttcactgtttaaagcttgcaaatgtagcatcatttgagtttgctaatggttaatgtttagcatgatcacaggcaattatagtacactatagtaaattattgtctggggtttgcttattggcttttcaggccatgtcccattcctgtgatagcccttaatgatcagttagcatgcattgcagcttgctccaac

SEQ ID NO: 104984 - DNA, 622 bp, Oryza sativa
ttttgtgcgctctagctctgccgaattctctctcaaggttgcctgttgtatttaagaaatacatgtgataatcgtttatcacaaaactcaaccttacaaactcattaagttcagtcgtattgaccaaataatgaaatttaagccagccatccatgctaattaagggatgtacatcagtatcagtgttatatatcactaaggctgtgttcgttaatacaggttgagaacttatccctcctgcatggaaaactgggctactcattagagcatgattaattaagtattatttaaaaaaaaagttgaaaatcgatatatatgtttttttttcaaaaacacactgtttagcagtttgaaaagtgtgcgtgtggaaaacgagcgattagaagttgagaaaagtgggaaactaactcaactgccatcaataattagaaaacgagcagcatatgcgcatgaaagggcataacaagtccaataccagcgatagccgataataattagaaagtatgtttcgcttcaaaagttcttattccagactatattgtctgtcccctccctctaattgtctcaccaatggtcattttccctattctttaccgtagctatctgattccaagcttgaact

SEQ ID NO: 104985 - DNA, 652 bp, Oryza sativa
aagttagcaatttagcattacacgagtcaaaatttatgcggtgaacgttcgtaccagagtccagtgatagatatagatccatgtgtaacgaatttatgcataaagaatagcaccataacctgcccaactggacgaactcttatcccaggttaaattccgaagaaaggggcctaaacaagataccaagttgaaaaccctaatagacgtcaatagccctaatcgcaacttcgcaatgaactcacaacctaaccaccagcacagccgaaccagatcgcacaaaaacaaagaacaccatcaccatgtcacatatgcaatcgtgcaaccacgagcccgaacgcgattcgggtgtaattaaaggaatcgcaactaaattcaccttgggatcaccaaggggagagcgggggatcaacgaaatgggagaggatcaaggccgtagcggtcgcgatccctccgacccaaaccctaacccgtcccccaccaccaatcaatcaaacggtaaacgcaggaaccgccgcagcagcaccaccacgcctgaatcgcaaacaaaattcccccaccaacaaaattcaggaagaaccagacagacaaaaggctaggatttagggtttcgtcgagtcgccgaaagagcgtataccatacctcccacctcgga

SEQ ID NO: 104986 - DNA, 1850 bp, Oryza sativa
aacattaaaatacactccaagtggttaatacattgtacgatattacggtcctttgtttcagcttaaaattattataatctagattattaaatcagattactctaaactgaattataataagctagcataaaataagctacgagatgtttgtttatctaaattattgaaggcatctatagatagtgggtctttagccacctaataatctggaaaaagctcctctagaggagattattagattatagtaatctggcttacagattataataatctatcctaataacctacttgtttgtttcagcttactcctaataatccagattataataattttaagctgaatcaaacgagtctaataatctacttgtttatttcagcttactcctaataatctagattataataatcctaacctgaatcgaacgagtagtgccattcttttatccctatcactaattcgctatgttccattgttttatctaaacataacgacgactatctcatctcgagctattgtaagttcactatgctaatgctgtcttagtgctagattactgcaaggacgtccatgaaatccacgtccaccagccaccatgtaggctgtttcaattgacaagtcagcgatcctcaatctgcaaggagaagaataatgtgcaacagattagataactgatcagggctaattgtgcttggtggaatattaaccaaagtactccttgattacctaccagagccgcaggtcaggctggtcgccgtcgtgcggctgcggccacagctgcagcaacgtgcttgacgccgccacccccttctcctcctccgggaagaagcaattgaacgcctccgccgccgtcgtcgccgccgccgccggcggcagcatcgtcagcgcctccattgccgacgcctccccggaaccagggctctgccagttctcgctgtgccagttctcactcatctaaagccgaacaaattgagtattataatactcctaaattcaacgtccacatgttaaaaaaagaataaattaaattggaaatagttaacccgcattcacggttatatttgtcatttttgttgtaatttataaaagttgaatttaaacttgtatgtttatggagtgaaatattttcatattgatctatcttatcagttcttttaaaaaaatttgataactattttatactagttacatgcccgtgctaacgctacggcgaaacaacaaaaagatatacaatatattgtttgggctatcaagtatagattcaagacattaattaagacttacatatgagcgagtttagttaagaagcttattagaagttcctcagttattatatactcgaaagggataaacaagccaaataaactacatccaggacaaggttcaaaatttgcaaaacaagccataaggtcgacccattcagtcgacgatgtattatgtcttcaacgtcttttctccatgtcacagaaaaaccagtaagcaaagaacaaaagtttgattgatatattaagttctaaaccgattccaggacacattcagtcaattcagttcaaatacataatcatgcgtttcaacattaattaaagtatcacattcatatatcagtacatggcttggaaaccacaaagctgaggatgccttaatctaagctacaacaaaatttcttttttttttgcattttagaataaacaggtaaagagaatggatagatcacatgtcttggatctgtcaatatctacgaagtcctgagcagctcaattttggagagggtagtagtgttgttccatttatggttcatcttgatgcatgaagaaggcaagttcaatttctggttcagtaactcttgttgttc

SEQ ID NO: 104987 - DNA, 698 bp, Oryza sativa
ggcggcggcggggggaggtggtggaggtggaggtggggggaggaaggcggtgagggttgggaagggtgtcaaggagaaagctggatggcagcaaatgcgttctggagggagaaagggtatgtggattggtggatgaggctggagccgagggtgagagcaaggatcatgggagcattctttgggaagggcactacagcactggtaatatgcttacttgtactgcattttgaaataatttgcattcatggatttaggatactgcagtgcttccatttctcagttgtatcttctatggaagtcgaaagcatcgatgcttgtattttgggtagttagctttgccattttttgtgtgtaaaaggaacgattgtgagaaaggtggtgcggaaataaagcaaatatgtgatcaaagtaacatttgcaaagatactgatgcatagttatgctattctaaaatcagttgttggaaaacaagctgaatatgcgctccacaatctgtagaaacgtgtgctccctagttttcatggaatcatgggaaagaaagaagtgatgatttggtttgtgttaaactgttaatgctaacttttacaatgtaggtttgattttaagtcagtaagaagatttaatgggctattgaatagaagggaaaatctgtgaatctttccatggaaagatttcaaggttttgctatcatctaaaga

SEQ ID NO: 104988 - DNA, 634 bp, Oryza sativa
catgaaaaacatgccgtttccgtcggttggtgaactctatcatgtgtccctcctaattaataatagcacaaaatatatcgatgaaaatttcatattatttgcaacgcgctaggaatgtgaaatatatatatttttttctctagtacagctcgatgattttgacacgggttaattttggttgagttgtagagaccttgagtgattgatcagtgtgtgagagattcaatgaatcagcgcaaagccgtacacgaattaattaccacacagcggcaaaatcactttggaaatcaaacagtgcaggcagttagcgtacgtacaaacgtcatagcgtgtcgatattatccatgggtgaaaaccgcgtgctacacatgtaaatgcagcggaagggaggaatcagcatcaaatcgatcgccacaaatgtcaatgtggcggtgccaacaacaaagcatgtgtgtgcactgtgcatagagcctcgcgtttagtcgccggcggccatgcttttgtcgcggagacgatcgagacgattttgttgggaatcattgaggcgaaaagtcatttcttggaaactttctcgaccgcggagagatggatgcaggtgttgtgtccatagacgcggtgatctgatcgatcgatc

SEQ ID NO: 104989 - DNA, 1353 bp, Oryza sativa
tatctctggcctatctctagagctgtattgtctgtggtggtggtcccttcaaagttttgtgcaatcggagcatagctatcttcttttacctctaggttgtgttttagcagctgaacaagtgctgtaatcctttctctacttctttctgccccccccccccaaaaaaaaaaaagagagagagagaaagaaaagggaatgtcctatcttgctatgtttctttaagttggttctgttttccttccttccaaatgaaattggttcttgtgaatcaatgtagcgtccctttacacagtattgttttctcccagttgtcttgtctttttatttgacttttcatatatgtaagggaaagaagaaggccttagagaaaaaaacagtagaaaaaggaaaagaagataggggtaagctcatcctagaaccctagttggcttgcagtcaccttcttcctcaccgcaatggctggtgccttatctgctcgtcatgaggctggtgcctggtggagtacgatgcctcttagggcacagaagtatagaacacgtgggtatgaagacctatgttgggctttggtgggctggctgcctggcttagtgggccttttaccaaataccccctttcttcttcctaatttctctaccatgttctccactaatcacgcctcaaccatctcatatggcaaagcaacgccttatgcctcagcgctatggcgctaaggcagtggtgggtcgcgttaaactgccttaacaacactggtttcatatatgtaaattgggttgtacttgcactgaccttttcttttgcaccctgttgccttgcataaatttgttggtacatggctgatgttttactcactgttttgttaagattttacagtttgtttggaattttgttaattggtgggatttttgttgggatgcaaccgggcttggtctaccaacccagataccaatcctttgcttgctttaccactaatattgagtattgttcagaaaggcgctgtgtgagctgggtttctgcctaggagctaggttacctgttaatacttgtgcagcaggcgggaggatgccgcctagcgcctaccattgccctagtatgctgggtggaaccttgtcactggttataggtccatgtgcagaaagtgcggtaggtgggtcagtctacttgcatacctactttgcctcgtatgtttgtaagagtttcttggatgttctatcttgcttatctgtactgcatatagtctgccccgaaaaagaagatttttctgttgatatttgttatcctccataattaacttctcagtgcccttatcatagaattatctccagggaatgccctacgttgtttgctcttgtagtt

SEQ ID NO: 104990 - DNA, 845 bp, Oryza sativa
caggaactatagcaatgcttaatccaatgtgatatgagtcattttattattagctattattttggggaagaggatgctttccggaagatgaacatgagaagcacacattgtgattatggagtcgctaaaatcgtgtagagcacatgcatatggccaatgctttctctaaaaaacaaaaaccatttcaagcggccaatggccaatgctttgcatttttttttcttttctgaaaatcacattctctgtagaatattgtcacagtgtcgaggacagcagttgcgctccctagatgtagctgaaaggatttatggctcctgtcgtgatgttgcctgaaacacttaacagtacagatgtagaactgcagaagcaagttcagatgaactaacaatgtccctggagcattgtttttttgtgaaaatgtatatatagcagtgtagtaaatgtgtccgaggaggaaatgggggacaaaattgctcagagttccaactgagaatgtatcaacagttgtgagattagatagcaatatatcgtactgtatcaaatcatcaagtgcacacaaagaagaaaaccatgttcaagagaaaatgagaagtatatggctaatagtttaatcgttacaggaacaaagaacactgacctcctttctccatagtccatagaagttcgggaaaaggttgcatcatatagcttgtcagcttatagtgatgacctgctgagaaatcacagtcaaaaaagaactacagatcaacagctcgatggatcagaaacaaattgcatgacaaaacaagataacatcgatcagcaacctaccttaagacaattacgaacctgtgatcgaagactgg

SEQ ID NO: 104991 - DNA, 686 bp, Oryza sativa
tttgcttggatggcacaaggccttgttccaacacctggagaggatcagacattggaagatgtaggaaaggagtaccttaacgagttactcagttgctcattcttccatataatcgagagtggccactacatgatacctgggttgttacatgatcttgctcaacttgttgcagaaggggaattccaggcaactaatggtaaattccctatctcagttgaggcttgtcacttgtatatctctcattctgatcatgctcgtgatatgggcttatgtcatccactcgattgttctggtattcagatgaaacgccgcatccaaaagaactcatgggctggcttgctgcatctaaaaaatttgcggactataatgttctctgcctcttcatcaatttggtctccaggttctgaggtagtctttgtccagagcaattggcctagtactatcagactgttgtctctgccctgcactttccgaaaagagcaacttgcagcagttagtaacttcatacatttgcgttacctacacctcagatggtcacgccttgaagaattacctgaagccgtatgcaagctttacctactacaagttttgaacataaagcactgtccgtgccttcttcatttacctccaaggatagccaacttattaaactttgagcatctgattgctgatgaaagaaaacattt

SEQ ID NO: 104992 - DNA, 631 bp, Oryza sativa
gcaagatcttgggtttatacaatgctgcaatctacattctcttcccagtgaactgcacaaaatatacactctcaagcagctcgagattgattcatgcccatgtgttgagtcattgccaaataatgggctgccggaaaagcttgaaaaattgatcatcagaggctgcaacagaagattgtatacaggtgcatcaatgatgggttcaactagcaccaaagtgcacctagtagatagatgatataatagatttaggttcatattagtcggcgaccacgaatataaatagctcgtgcaagtgcacagtaatcaagtagtctacgtagtcgcttttggatgtcaggctatgcaacggtattaatcaaaagatttattcacctatttttatttctgaaaactgttatagatacaaccgtttcgtatggaacaaaaaggcaacccacacagatgttttcatctgacttgataattcctcttaacaatctaattaccatgacatgcatcctccatacattcttagatctcgataccagaatcctccaaataatagctttactttttgttctgatttgcacacaaaagtctcctccaaacgaactgcacaaatcttgacgcgcacacggggtgcaggaat

SEQ ID NO: 104993 - DNA, 790 bp, Oryza sativa
agtcagagctctccctggcgaggtgaaatttgcgtgacccagtttcagccctgcatcgtgctggttcccgcttgcatcacgccaacgtgcctccgtccaagtggagcggtgatccatcaggcggcagctgaacgacgcattcacgcctctcgcccctgcaggtccaaggaagacgagcctgaacgcaatacggtaatcgccatgtgtgatgaacacctttgggtagtagcggatctcccactcgtaaccacccacggtgagtcgcctggacgggaagtcgttttcaccgccggacttggtggcagagtagccgttcaccgtgatgtcgtgaatagccgatgtggcctcggtgaggttccacgatgaaaatgacattgctgccgatcgattgccttgtttgtggtgggttcgcactacggctactgcgagcgtgagatggcaaggctcaagcaactccttctacgagtaccctatatgtagatttgtagaggcaagtggagactggattaatatcggaacgagaggagcgcatgcgacgcccgggttgaatgtagaacgcgaatcgtttggtcactctcgagctaggcgtttcgttattctcaccgacgggttctttccaagggattaacacacgcctaagagcaggtacaatagcagactattagccagctataaacatattttaatgagataaaagatgagagagaagagcagtgggctacagatctgtagccagctgcaacacgaactccaagacgcagtgtgtgtatgacagtgagaccatatacta

SEQ ID NO: 104994 - DNA, 727 bp, Oryza sativa
gcatcgcatcagagaccaaacgccacacacttacacactggattcaagctagaaacagaaccagacgcacgcacccacgcacgcaagcgaaatcgtaaagggaagcactgaatccaaagcaaacgagcacgcacctgagtggatcggagcggggcgtggaggggagagggggggggggtgggccgaactaggaaggggagggaggagggagtggagtgtataaatagcccgacaccgacgaggagggtagcggcagattgatttttcctcctccgctcgcttggcctctctctctctctctccggtgcgcagttgcgtggggatttggggaggaagaggaggagagggggatgggggcgacgtggccgcctccgtgcccacagcgtcgataaggaagagatgagcccacttagacggaagccaaagcccatggagacgaagtgaaatatctctccgtcctggtgaaattggcaaatggctcgtattttttgcgtgccattttcgtagccagtggggttttcctccgatggcttgtagtgtcgtggctgctggactcacggctcacgcaagattggactgcttggaatcctggagatgtgaaggcgacacactggtcagagcatggcaatatgacatactaagttgctgccaacattagttattgggtaaacaaagccagagccgtccatttcccttgcacgacctgccgactgaatttttttcctcg

SEQ ID NO: 104995 - DNA, 524 bp, Oryza sativa
catcagacacatagtattatagtagtatagtactaggactaggactatgatagtagtagaagaaactgtaaagtgaaattacctgcgctgctgctgctgctgctgagactgcgagtggtgtgtgtatgaaggaactctcaagtggtggcagaatgacgacgaggcaccaaccgaattcaagtgagcttagtattcgcttggattggactgatgaacccggatgaaaatgaaatgaatcgacgaatacatactgtggaagatccagaggggaagttacctgcggttggttggttggggacgaacggggttgaggcggaggcggaagcgagtaatcggcggcggcggcggcggcggcgaaggcggaggaagaagaggagggaagggaggggatccgcgcggcgcgtatcgtgtgccgctccctccgctgctactgctactagatattggggagggcggtgacgtggaacaaatggaagtggggagcgccgctggtgggcccgcccctgagatcccacgaaatcaaa

SEQ ID NO: 104996 - DNA, 1414 bp, Oryza sativa
tcctgcagcccgattgatttgcacaactgcacaagcacagatgcggatgcagcccagctagctaagctaggttagctgctgctgttggtcttggaggcaaactagtgtaatatgtgccgtaccgcctgcctttcttcatcaaccaaacccctgccaccactcaacccggccaacctcttcgagtcaggctgatgatgggaaccgctcatcacaaccaaaccgccggctctgccctcggagtcggagtcggagatgccaacgacgccgtgcctggggctgggggtgggggctacagcgacccggatggcggaccaatctccggtgtgcagcggccaccgcaggtctgctgggagcgcttcatccagaagaagactatcaaagtcttgctagttgatagcgatgactccaccaggcaggtggtcagtgccctgcttcgtcactgcatgtatgaaggtctgtctcttctttcctccttctaccttctcacttctgtctatttatttatatgtttgcctttttcacaacatattttcctattattacttactatctgactctcaaactgttaatttttctgctcctcatctctgtttaatcacacgtaccgcctctgctttacaatttgctgtagtgattttatccggaaactatcttcttaaggattgtaccaaacacatttttcaccacaaattagacgattgtcaagttcagaacaagattttgaacacctacatcacaaggacgataagcaagcaacaagatcatttggtacataaatctgttgaatactttgttttgaaacataaagtatgctgttccaaagtcttgtttgagagactgacttgaaccctgcaaaatccatgcacactttgtcatgctagccgctaaagccaaatttaaactaggcctgattaggtcaactggaaactccttctgatttttttttgttgaaaaaaggggtgcagattgtggtactgataatcatctcaaggtcctcctttttttttctactgaaatcatgtcaaggtccttgaacggacacgttaccaaatcaatttgttgaagaagggagagataactttttaatccaagattaatctccacgttgtatgagaggccaccttgaattgatggtttctaatgattttgggttttcttttttatttcaatacttgtatgaatttctagtgccaatattttggaccaatgctcttgtattccttatctttaatttggatgcaacttttccattggatacatcaaacgagaatgaagtcatagggatagtttgttgttgttgtgttgtgttggatacctccttttggcacccagttcaccttcttcttgtaagccaatgggtaccacctagaatctccagccatctgtggacagcactatatattgcaggcttgtt

SEQ ID NO: 104997 - DNA, 1136 bp, Oryza sativa
cccgacggcagcaagactagacacccagcttgcgataggaattggaggttgtcggcctcttcttgtatgtggggtggcagatttactgccaccaccattagagtctgtttaaaagagtatatatacttggacatcaaaaagcacatgctagattacatgaaagtaggaaaagtctggtagctcaatgaaggttttgttataacatggtcaagtaagggtgtagggcctgattacagggcactcccaatttgattgatgagtacttctacagtgctctctgaatactacaagtattgttaccaatagaagcgatagaagtcagtgatttatgagttctactaccactagaaaaaaatttctgctaccagtagttgaggtggtagcataaatagatatggcccattggatgagaaaagatgacaggactagattgattttactaccagtaaaaaccaccgaataaagtttctaactattctttcctcacactattgagaagaaggcacttccattaaaaaggaaaacattttcgatatcaaggcatcaatttgtttttcattaaaaaggaaactgaatgaggggataaaaaccttccgttgggctttgcatgcgaatagtctaataaatactccctctgttttcttttatttgacacctttgactccacacacaaaactaggcaatcattgtactttctagagatgactattttactcttagagaaatttagtgttgttggtagggtatgctcacacaagaactttctagattagtgtggatgaatacatagttgtttcttataagggcaaaatgggaaaataaagattgagtttcgtgccgtgccaattatttgcaaacaactttggtcaaagttgtctaattaaaagagaactgagggagtaaagaattctagctcagcctaggaaagtagagccaacaacataagtcaatgagtccatgttgcttttgagccaactaattgagcaacaagtttggcatctactacaaaagagagaataaccatgtgagaagggtatatcatttagtaggaagggtatatcctggaatacctcgcttgacctctttcaaatgattgtcttggcttggcttcggtttagctggcacatttattagga

SEQ ID NO: 104998 - DNA, 1261 bp, Oryza sativa
tctgcccatgtttctggaaagagaatcatcgctccgattcttctctcttctaggctagtttgagcaattcccaggtcagctcataacaatgtgatatcagagctcgtcaatcctagagaagtcgtgattccgaacacgtatgcagcaacaggtcgaggatatggattttaggaaagtattccaaacacataagtgtgggcctttccttgctcggcccaacccatcggttgcttgacccatttcatcagttgacccaagaattgtatttctaggtgtatgtgggtccgctatacgtgagagtgaaatctagattttggaggcaccgaggcagggtgtgatatcaagattgtaatcctactcatgagtaatacaatgaacatatcttgattgttttaaaaaaaccgacaaggctgtgatgttcttttcacaaaaagaaagaaagaaaagaagacgccaatgttgtgctggtcttttggcctgtaatggctctttatggacgagaacattgttattaagctattgttgctggtgacttgtctagaacacactacacatacactctcctcggaaatttcattagccacaagtgttagcacctccaacctaatcccatcctgaaggacctagaacttgattttatccattatctaaaaagaaaggacctagaacttgccttcccacagaaaggaattacgagggtcttgtcatgttgctagccgatgataatatctgccaaatattcttgaagtgcaggaagttacccttgtaagcatcgaagaaacaggatcctaagtgcctcgcaagcttgtgcacaacatgacccaatggttggaatagtggcaaacaccggactaaaatttagtatagactagtccactggtttgacatatgcttgttctcagtctgactatattggggagtaaaggttttttttttcatatttcaacattagaaactttaaattgttggtctagtactcatacttggctgtgttcgcatatgtgggttgggaactcattccctccgcatggaaaacggagtggtccattagcacgtgattaattaagtattagctatttttttcaaaaatggattaatttgatttttttaagcaactttcgtatagaaactttttacaaaaacataccgtttagcaatttgaaaagcgtgcatgtggaaaacgagggagaagggttgggacaaggggatgccgaacacagccttaagtttgttggtcgcactgtacccaagcatgtggagc

SEQ ID NO: 104999 - DNA, 747 bp, Oryza sativa
  unsure (1)..(747): unsure at all n locations
gtttgtgtcaacaaatctattgttagagcaaatttaatagtatagcccattgttagctctaaatcatctatagctgtaatagtcaattcatacaatagttgcttgctatactattaatatctggtcctatctgtcatacatacattacgtcttggagtccgtgttgtagttagctacaaatatgtagcccgctgctcttctctctctttctttatctctttaaaatatgtttatagctggcttataggctgctattgtacctgctcttagtaatgcacctgcataaccaaaaaaaataactcttaaaattgtttgtattttgtatttctttgtacggctaaaacataattaatttaaagatagtactttgcacatatgtgttgtaacattggaagtacgtgtatatttttttaacaaaaaaaattgagatattttgcaccgaaagcttatgtaggcagaatatgttttctagatataacggtgaggtatacataactttgttgagagctacgtatgttttgattaaagtaacatttaatagaaatgcctctgaaagnnnnnnnnnnnnnncaacacctgtgaaaacacaaggactaaaaacaagaaaaacttaagagcagatgtaaaggtgaatatataatccaaatcagttttggttaatatttttatggagaagtatgaatttaaggccctgcttagttaccaaacaaaaaacttttcaccctatcacatcaaatgtttggacat

SEQ ID NO: 105000 - DNA, 3638 bp, Oryza sativa
ttacattgtgaaacggaggaagtagatgttaatgaatctatacacatatatgtccagattcgttaacatctatatgaatgtggataattctaaaaagtcttataatataaaacggtgaaagtagttcttttatatatataatgagaagaatttcattaaaaagatgaaattacagccttaatattatggattatggttgagaagggcacgataaatgtgatataggagtatatcaaagtccatggcggggggaaaaatgtgagtgcaagttagcagaagtgtatttacagttggagtatttactacaatcaagttagttaatccgtcgatgaaaaaaaaatatatacatggacagacacattgtggttatacttgtcaggtgagattcttccgatataattattgaagaaagctcaaatagtatacgaagaactcgaagctaagcaactgtgaagagaaattaagtagctacaattaggttataaataatttgatttctactctaactgtgacgtggggatgtagctcagatggtagagcgctcgcttagcatgcgagaggtacggggatcgataccccgcatctccatttttttatttttttttagaattctactttttctaaaattgaccctttaattttgtatttatatttcttttataatgtatatgcattctgcattttatttttcctttacattttttcttatataatgtaagttatgcattctgcattttcttttgtcttttttttttcttataagtggttggaaaattgacatttgaggatgaaaagctttaggcatgcgcatgcagccctcaatctttaaacttttgattcacccggaatgaagaatgaaaagcatcacaattaacacactacgcatcacaattaacacaagtatttttccagacaggtgaaatacatttttagaggcagataggtcctctatgaaaacgattgtgcaaatagttatttccataggtgaagacaaagccgtatgtaaaaaaaaaaaatctattgcggtagtgacatgtatcaggcatcattatcgcggtagtattgtcataactccgcctataaaaaaaattatacatattgatattcacatatatgttgtgtgtattataatgatatgatgttgaatactagacgcatgcgtaagactaaaaataaggaacccttgtcaatgaatatatatatccatgttcagattaattgttgtgcccgtacaataattataagctttttttccactcacaggctcacagcctcaaaagaaacacataaattaaggaagcgaataaatatttaagggatgtccaatagacactgattaataatcaccaagtaattcaattcatcagctagtatatgattaagctgtagcactacatatttctaaatttgtctagcagcaactcataaaagaacatcaaattctcctgatatgtaatgttgatagagtagcatgcagctgtgcaccgatatttctccacgcatgcctgtcacatgggagagtaactagataggttagtgtgttttggcacataaaaataaaattagagtttatttcattatgaaaaaaaaccgccccctcgtactgcatggtccataaaaacatccacaatgcaatgaaaaaacaagtaatagacattaaagtatttctaggacctagtaatcaatattgtggaagtaggtagtaagtttatgacctaggaataaaaaaaattaaaatctctctctctctctctcttttgtcttctctcttcaatattaggatttgcttgtactttatgctgagttggataaaaaaacaactaaggccaggtttagttcccaaaatttttccaccgaaaacatcacatcgaatctttggacacatgcatggagcattaaatatagataaaaaaattaattgcacagtttacatggaaatcgtgagacgaatcttttgagcctaattagtccatgattagccataagtgctacagtaaccacatgtgctaatgacggcttaattaggctcaaaagattcgtctcgcggtttacaggcgagttataaaattagttttttcattcgtatccaaaaaccccttccaacatccagtcaaacatctgatgtgacctaaaaaggtaaaaaaaattataatgggacccacattacaaaaacctactaccttagccctgctacttaccccctccgtcccaaaaaaaaaaaaaaacccaatcctagcaacgaacctggacacatgcgtgtccatattcattgctatgattggattctttttgggacggagtagtattgcctagttaggtaacatatattaggttgccctaagagcagatataataaggctaactcatcagctccaaaaattactgtcatcttattcctatgtggagggagagaagaaagcggacgactaattcttcgccgggcgttaacacaaattttgatgcactaccggcgttaacacaatttttgatgcactaccgcccatagcctaggttgtaaaagacacggtttgtgagatccacacaaatcaatcccatgtgatctgcgatctcccgttcttcgatccccttacatagactttcatcgagcgagtcacttgctgccgatttccccaccggcgactgcgacggtttctcttccgcccttgcgccatcccttctttgcgcgcttcctttttcctcccaatgtgcgcgaaaggttccgccacccctaaaattgccccctccccaattcccgccgcaaacctagttccccaccaccaaaagccatatctcaccggacgaagagaggtttgcgccgcctccttgtatcatcgcgagctcatctagtcctccagatattcctacgttgtcggaagcgctatatccgtatggtggtccttgattcccactgccagcttggtttgcttctccgtgatcacaagccatgctggagtttatttccatcatctatgatttcatcgtttcctttttattattttgtttgagcatcatgatatatttatccatgactatattttaggtggatgctaatgttctagatggtgatcaacatggtatgcagctagtcagtgaagatcaagaagtttaatctcattttagtagtcctttttgttaaatgttacttcctccgtttcatattataagatatatattgccaatagaacctatgtcgaatgttatcagtagatcaatgtcctttttgcacaatgaccgagtgctgctgcaccaaaatggtggaatggccaaaagaggagtggcagaattaatctcatagttgccatgctcatgcaaatattaaatgtctcaatgtcttatattgcagtcagcttatagctagcattttgtatgaattgactctaagttagctcttaatgatatggataaattttagagctagttattgactatatcattgaccttgctctaaggacgactgcatatgttttcatgatgcctcactttatatatactacatggagccatgcttaattgaccatttgaaaaagtatttctagatacggtctatataggctttttgattgattatgcatagtggatcattcgaatacgagtagtataaccagtcatgtgactagcatatacccctatgttgataa

SEQ ID NO: 105001 - DNA, 673 bp, Oryza sativa
tatcggttgcttgctctttctagagcttttgatgttacattgttgatttatttgttgtatttcctttgtgctgattgttttattactgttgaataggaacgtggtgtggaccccacggagttgatatcatttctattggaacttagttttcatacattaggagaggtaagttaaccacttttaaaagactgtggtgatgcttctttttttttcaaaaatcgttttaaaaagtgaccagctccagtttttcttttacagaaattaaaatataatttccctcaataatagtaggttatattgatataagaaataaacacggccacattttacgcagattatagtttatgagaggattgggtaaattgtagtggtatatgaaacggagcatctcaaagattttctattggtttctgatctatctaacagaatagggacatcaatctaacatgcctgcttaataatgcttactagttcagacagtaccagagatttagtgcttaaaaagaggttatcagtctgtagattaatgttattaactaagcattatctttcatctgttgtggagtccaagctttgtggcctggttcatctgttgcaaattcgcttcaacatgctgtttaacttattcatgcttcaggcttatagcttgaatactctgaccgatgtccaaaga

SEQ ID NO: 105002 - DNA, 2562 bp, Oryza sativa
tgtattcaactattagtgatctttacctgctgtacaggacatattcaagcatgaaggaacttattgctgattatgaaagtggcgatcttgactcttttgatgtcaagtggcacctgggaaaagcaataaatgacatattagaggtagctcttgtttattgaggcataaggttttataatctgtaatgactgtctttctttacaatcagatggtggggacaaggacaatatgaaaaaaaaaagaagtcagcccttaaaaaaacttaatttattcctttttatttattgtttttatcacttgtaaagttcaatcaattaattcttgtgatattatttgcatccttagtgactttttttactttctgtttcctgttataaatgtgcctaatcaattaagttaatttgccaaccaccttaattatgacaattacttttggacagtagtgtcattttgtaccacctaccttaattcttgtactgaatccaaatggacttatatttgaaattgaagggattttgtttgggcatcgaagttttccacccgtttctttaaaatccttcatattatgtttacattctattctgtggataattgtttaccacttggtctttcttcaagcttgtcagcgagtttttccgtagcaacgaggaagctcaagctcaaattgttccccacagggtacagttcttaacccatgactattattatttaccacaattatgtattccgatataacatacctatgatgactttgctcctgaattgactcattgtattttaaggtgaatttttctgtatatatataatcaagagaaatattcttttacacagtcatgtttaattaatgtgataaaattttgatcaagtttgcgaaatttatgccaatccactagtatccatgctagctaaatccgcatgatcacctaatgatgttgtttttgtgcgatgatgttacatttttgcctaggtctaacaagtgtcctagtgtgttctgctctgctgtccatggaacatatggctaaacgcagggtccgggatcttttattataactatatcacattagagaacatgcacagacaggagaacaataacttgcttctactataatcttcaactactctaccccaatgtgtccctaaaagattaaccaatgcagcatctataaatgcaccagataaaatcttcccaaaatgtgactagtttcatagagcctgaattcctggcactaagattgatttttcttgaataaataaacaatatatggaagtacttcaatgactcctctagtgtaggatctgaaaggaaaatagagtggtcaaccaaagataattttttagtgaagtgttctactgatcaggttgtgctattaggctgtgagatgcaacggccaggatgttatcccatttgactaaaaggcaccgaaattatccttttcacctgcataataactcttaccataaacaacagatcaggcaagtataatttaaaaaatttcgtgcacttgatatgagaattaccatacaagttgatcgaggtacacaaataaatagggtgtttggtttgtggatccggttgccgctagcaccatactacattagtaacataaattttaaaaatttatgtccgatgttcaattccttttcgactttcttttaactggatgtttccttttgacttcagttacaggatgaaattggggcagatatccagaagatccaattgcagaacgaggagatgtctggtcatgtaagtttacttagacatgtatttagacacctgcggcagaccagatttaactacgcagctaactaccggaatcgttttttttttttgcaagacatttattttctcattagttccttattttccagtgatgccacagctgaacgaggaagaaaaatacaatatatgtgttgccgatagaggagaaatctgggtttctttggacaaacttgtatatattgccgctagaggaggaaatgaataagataaacttgtttaaatgtttctgtaactgtaccaaacatacatcgatgtgacggaagttttcaaatatatgtaaattattattatttatatactagggtgaatttgtgagccgtgtataccatgtgcgcacgatcgagttggatttacatatatgcgcgtgcacgcagccagctaaccacgggccacggcattgtcgcatttaatttcctctcaggcagcagcggcaaaccggtagaccaaacaaacaagggggttaattaaatccgtaccactatgaatttataggttttaaaatataccattataatttataaaattaaaactatgtcattataacttaacattattttaatatgtcaccacttactcattcactacatttttctaatattttaaaccaaattggccttgtttttttcatccatcctcttctttcttcgcctctccttttcacctctcaccgatgagttcatgtagccgtccacggcacaggaaggttgtagtaggacaccccgatgagctcgtgcagcaggtggccatggtgtaggaagagctcgtgagtatagttatgt

SEQ ID NO: 105003 - DNA, 1078 bp, Oryza sativa
tggatcatgcagaaattcatactccaagtgatacctgttcagcggtaatcccattctcaaaagcaccataaagactttcttttgtaatagatcccacaattaggtttggaagttgatactccactctgcaaaaatatccttattgaacattcaatgaagaatggaggatgacagtaatataaggtaaaatctacagtcgccactattactgtcattttaataaaaccttaagcaagtgtcctgtaaaattaataagcaatattacttacaacacagttattaatacagtcatcttcactgtattgtgtttcctactaccttgatttagtactggattccagtgaaacagttggcattcctgagtcaattcagtcaagatgaaggcatctactcaaccaagataaacggtatcagtcactgaaacagcagtgaccaatcaccattctactagagcatagccaaaaatcaagattatggcatatactcgcatgacaattggcagagttacgctggttaactaaagaaaatgtgatgaagggtatagagcccttagctccctgccgtcgctcttttgcatgccaaacatatggcaaaatgttaataataaatagaggaaagtcgttcaaggatgcaacagaagctatggatcagtaattcagtagttaaaaaaccagtacatagttgagctaagttatgccaatcatctagcaccacacgtaccttgaaaaaaggcgcagaatttcacaatgtaatctggaagttgagtacgcatacatccggaaatttgtctccacaactacaaaaccctacagcaccaacatcatacaatgtaattattaacagaaagtattttcatcttcatttgttgttgcttaggtgacgagtagattgaggttatgaaagatttggacgtcatgaataactgtaatagcaaggatataaaatgttctgaaacctctttgttagacgatgaatctgacaagcttgctgagagatttgtagccagttttgtaggtatgaaccagctgtcctttcgaccctgccatggcttaactcttgacatttgggctgcaggaat

SEQ ID NO: 105004 - DNA, 753 bp, Oryza sativa
ttcctgcagcccatctctctatgaaggggttatactaatatactgtcaaaatgacccaaaatgaatatcatgatttaccacaaaatacatttaaaaggggtgaatgattcgactagtgaaatcaaaatataacgctttgagataaggctctcaaacagaaaatgacatttcagtttcctattaatctgcatctaaaagcaccatttttttttatcaaaaagcacttgagcactagcttattactacctccgttttttaatagatgacgccgttgaccttttatcacatgtttgatcatttatcttatttaaaaaatacgtaattataatttattttgttgtgagttgttttatcactcaaaatactttaagcatgatttatattttatatatttgtgtaaatttttttaataagacgaatgatcaaatatgtgttcaaaagtcaacagcgtctctattaaaaaacggaaggagtattatacaagcaatgagagaatagagaatttagacagtgaaaaattgacagcacatattctagaaaaaccttaggaggcaataaatatctttcttcctccatatttttaaatttataaaggatcttattgtaatttcacaataaccaatgatttgcaagctccaaaactcttggattgaaacagtttgagcaaatttatcatggaagttaaataagaatctaattatctgccgttgtgtgatgattacataagtacctcatcatctagcatgaagatag

SEQ ID NO: 105005 - DNA, 564 bp, Oryza sativa
ccgaatccgatttgatgaaaataatatgggatagaatacgagatgagtgatatattatccgtcactaaccgtacccgactccgagtttaaagaaaaatatgggttaggatatgggaatgccataatccgaccgtatccgcccgttttcacccctgtcgatatccaatcttagattgctgtattttgagacgaagaaagcagctcaggttctcttatcctgttttgccaccatgctcacgcggcaaagaactggcaccaatcaatgagaggagaggaagcagacatatactccctccatttatttttggctgctcctatttatctcaaaataagttcttttttagataaacattacatcggtatttgtgaaagtagaggccagataaatgcattgggagcagataaagtgcaaataattgaattagaatttgataaagtggatgtattctagtcttttcagttttatgttgatatgtgtgagattggtgaaaaatgaacttattctgagaaagtattatgtaagaagttgaagcaaacttatcagtttgacatcttcggcagcct

SEQ ID NO: 105006 - DNA, 703 bp, Oryza sativa
tagggtagattgtgagtttgtatgattcgttctccgcgtgacgtttcccgaactattaaatggtgtgttttttgcaaaactttttttataggaaagttactttaaaaaatcatattaatctatttttgaaatttaaaatagttaatactaaaaaaaagtctctttctttccccccacaaaagagtacttctatatttttttaccagcaatggcgctatattttcccaataaaaaacaatcaaatcgtttttatactgtgaattttaaatgttacaccgccgtaaatcactttacaaatttcaataattacaatctaaattttataatacaaattttataatgaaattaagactaaaagtaattgatcagaagaggagatagatgagatagaaacatgcttaattagatataacatacagagatactaatcactactacctccgtcccaaaataagtgcagccatgagttttcacgcctatctttgatcatctatcttatttgaaattttttcataattagcatttttgttgtatgaaatgataaaatatgaatagtactttactcatgacttatgttttaaaattttttcaaattttttttaaataagatgaacggttaaagttgggcgcgaaaaactatggctgcacttattttggaacggaggtagtaaaaaaaattgcctgaatcaagtaagatgtggcc

SEQ ID NO: 105007 - DNA, 883 bp, Oryza sativa
atttctccgacttgtcgcctgtcagagatgtaaacagaaaatgctaagtgttcaatctcatcgtacttgcaataaattaagaacttgcatccatgactatgcagtttgcatgatgatcatgatgggcttcaaagaaactaataaagcatcaagctatagatcagatggttccatgttcatcacgtaagattacacctgtcgacttgcttgctactaaaatatataatactagcaaaagtgcccgtatgttgcaacgggaagaaaaaagagaaaattgaattcaaacatattaaattctaattaattgaaatataaattttttggaatatttgggtatttttaagtaggtaggtatataattaaattaatttataagtaaactaagtgtgagaaataaaatgatatggttgcatttattttttattaaattctccatattaattacactctttgaaattttcttgaaatttacagagcttaattgttaattttgataatacaaactaaacatcattttagcatttatttaaataaaaaacattctttctctatgggccatttttagcccattttcttcttcagcccgcaaccgagccgtcccacttttctcaggccgcaaggtattaaagtctaactaacatctccatactcctctcagttccacgtttgtgatggactgtcggcccgcatgcggctcaagtgtcaccgtgtggtgatggaggcctgcccaacactcgatcgatctgagccgttcgtttcgatggacaacaaccccagtgcaaccctaaccctagaatcattctccccccacccttccccaccacaccatcggccgcctcctcccgcccgacgccgccttcccccgcccgacgcagcctccccc

SEQ ID NO: 105008 - DNA, 700 bp, Oryza sativa
cctcttagcatcgtcatcacatatgaatacaaaatcttaatgatatacaaataaaaacatagtgaaaggcaacacaagatcacacacatacatacaacgccttaatgatgacaaacaaccatggtgaaaaattaacacaagtgtacttgtacaaagcataggaaaggtaactctatttacgcagatgagcaacgatataaaccacatcagggtaccaatacaacaagataaggaacatctacaacaggcattaagaaatatgggaatcataatcatttgcaatacaaaaataatagttggatgcaagtcgcaaacccacagccatcctatatgtgcatgtgtgtcaagttaatcattgttttccctagaatctaaagcctacactctgataccaactgtaacaccccagaaattcccaaaagcctgggatgccactaaagaaccatacgaccatgtgaaaatgatgaaatttttacattagattctttttgttataaaaaattattgtggaagcttcgacatatagatacaaggatctaagatggcaacaatctgacacatatgaacaaactaagaatggtagataaaccatggtgaatatctatagtatttaataaatccactataacaacaaactctaattttaccccctaatcacaacatttataaactatgtgatatcataatgtgcagcggtgta

SEQ ID NO: 105009 - DNA, 1944 bp, Oryza sativa
cctttatatctcataaatataaaaaggctatgactgcaaaaaaaatacattttagaaatctacaaaacaagacctagttcttttatgtagaaagcacttttttgttctgccatttaaatggtctaattcacacttgaatgcaggcttcagaatctgtacagaatttcagaggatacatagaaaacaactattccggagttctacccatccgatcaaagtgtactttaccaacatggaaagctcacagaaaactctaaggggcctgattgattccactgtttaacctctccaaaaacagttcaatctacaactatctagattttgacaaaaaaaagcaatagtcatactcaaaaattcatatcgcttattccacttgagataaaatcattccctttggtcagaagatagatcacgatgttatctacaacgtttctgtggacactttgttcagaatatatcattttgaccatgtaattgatggaaaacagaggcactataaatctgcccagcctagctagaactaccaattcgattcacaatgtccaaactcttctctaaccgtctttaaccacgaattaaaccactaaattcaccccagaactgatgcacaaggggataaacctcacctagggttttccttttatatcccacgggaaacagcggggaaactccgatctaacccctccttctactcttctcctcctccacgttccatttttccactttgcttcttgatccaagctatgaaggtggagatctagggagagcaaggtctgctagagaggagaggaagcaaaactaagtataggaggtggaggagtcacaaccggcgtcatgggggaagggagggggggatggttcggttcctctcccctagggttttaggtgggggtaagggatttggctaggctcttgggccttgacccaagctaacttgcccacttacaaaggaactttattcaactaattgtggctatcttaataaaccaaaaacattatcttttatttttttaggggtattagaactatagagcgagactgcagatatatactttttatgttaaaccatagtcctcttaaatggtttaattttgatgaatatgattatttgaaatgatcataaatcgattggtaaaatctatccagtgcgtgtgcactgcatgttcttatctagtgacccttttgtgagccgtctgaatcagttgatgatggttgagatatatattcatgggtgttgtactaaccaagagacaaaaaggggaccacttgctagaatatgaggaccatatgctatctaccagttgtcatagcaattcacttgtattttttagatctgtttgaaccaccctactctacttaaagagaaaattccctgtgtacccctgaaagttcacctaatcccttctataccccctgagatttgctcattctctcccatgcccctaaatttcagtttggatcacttctataccccttccgtcaattgaccgttagttgaccgttaaattcacatcataaagtctattttaccctctagtatcaagaaaatataaatttataaagtatattgatggagtgtataaatttattgtatgcgactattatatttatgagtttatttcgtgaggtattatttgcgacggagcggcggcggcaggcgtcagaggggcggcggagcggcacggcggtgtggtcgtggcggcggtgcagggcgtttttagctggtgcgggagcgggcatgagaaggggaggcgcgagtgcggtcgtgagagggggaggcgcgggtgtggtgtctatacgtatgtttacgttggcttcaccatcaccactacgaattttttaagtagtaaagagtaaagatagtgaggaaaaaaataatctatactatatagtatgcatgttagcttagtcaatactcaatagttagcgatgctattaaacttg

SEQ ID NO: 105010 - DNA, 1374 bp, Oryza sativa
tgatgaatgcagaacctctaatttagttaagcaagtcaattcatgctgtacaatatgatctctgacaaaaaactgaattccttgtttctgcaaatgcaagtgcagtcataaataagaaagaatattcgtgaaagtttcatagaaactagataaaaaaaagaaagtgttttagataaaaaaaaagaatgtgtttattttcagaaatccacagttgctatattttcagatatcttcaaaactgaataatgttttaatccatttgccaacaaaaagaaaaagaggtgcagaaaacagcttacttgggggataccatggatcatgcttgatttgatcagctcaacggtgatttgatgctatctagattcatccttttttttttaagttcaacactgtacacatttgctggacataatgcatatatgttgttttcagcgtgacaaatacaatgaagaagaacctaatgcatttgatttgttcaaggagttccactacagcaagaaaaaaaatgctacaccactgctgtatagtaggctattgtaagataagtttcaaactttgctctttgtaatgcttatttttaattctctcatcaacaacaatgtttgctccttgcttgctagactcaaatggaaaacaagctgtctacaagttcgatgaagaggactcaatctgagatggaagcggaaacttaatcttttgatcagtcaagttcgatcaagttaattcatgcatgatgctatatcttttgctactacatgcattttgctgctattgctaacttgtgtcaagtcaatttttgactaagctaagctatacatgcttgcattttgctgccgcagcattcattaagctcctagacttgtatgcattgcttggaatctctatttgttgttggcttgagccatggtaaactgcaaggttgtatgcactttgaatgttgtaatctgatgttggatgaaaaatcatgtgatatgatattgaatggaaaaatgatatttctatttgatttgctgctgcaactattagttgcatgggctgtgtatatgggctttagttgtgaaattaagctgtatatatgggctgtaagcgatgtagtagtgggctgaaaagggcaccaaaaaatggtgacaaaattgggctgcaaagctgctgaaatgggttgtaaagctattgaaaatgggctgccaaaatggctgaaaaggagctgcgaaaatggatggaattgggctaaaaattggcccatctttgattttggcctgttaataaataggttgaggtagtgtctacgtcatcatccacgtaagcaaccatgtaagcatccatgatgatgtggcattcaatccgtgacggttatttttcgtcataggaaatgaa

SEQ ID NO: 105011 - DNA, 1832 bp, Oryza sativa
atgtggtgtgcctccatctctaagtgaatggtgctcaagttcctctcgttgggacttgggtgaaatcactaggagaatggacacccttgatgtgcagacaggggagatccagtacaacctcacggaacacatagctcaaacgtaagaatggcaacaatctgctgatgctcagttcaccaacatcaacatgatgcagcaacagcacgatgacctacaagcgtactttcgctttcaggggttcaatccttatcaaggaccctgagcgaaagccaagcttggggggatatacctctccctccactaaggtaacttgtatcacattgtatatttccctttccaattgcatatttgctttccacttgcatcttataaaacttgaaaacaatataaaaatttgcaaaatagaaaataccaaaaagataggataggtttaagtcatgctaggtaagacaagctagttctcttcgttgaaatgatgaatagttgctctgttctatatctctgatatatgggttcttggtaaatgctctctcaaaggttaaatattagtagccaacaattatccgggaacctgaggtaaatgagctgcagttgctgatctaagtctaagttgttgcgagatatgagatagtaaatatgagttgctatgatcctgatactagtttgactttcattcaggatgttttgtttttcaaaatgataaattgagagttcctcatttgatataaattcctaccagagccaaaaatgtgctatcatgattaaaccatatacattttggttgcttgtcattccattgaactttgtcaaactcttgtgagttgtgtagataattctcatgctctatgatcaagatcatacacccacatatatgcacatgctaaactcctacactgggagctaagcaatattccattccatttccatattaccaccaaaataaattctccatactttcatatgttttcttctcctaaaaaaatccttttgaaaaagaaaaaaaaaagagagagggaaaggcatggttatgaaaaaaataaataataaaaataaagttatgctccattagcatgagcatgacactgaaaaaaaaatgtagccatgccctctcctaatcaataaaagaatgattttttgggagaagaaagtaagcacaaaggagaagctttttctttattttcctttatataccatttccatcatataccacacacacatattgcatgatcttgatcttgagtatgtttagtcatttgctttagtctaagtttttatttagtaataaaggcgaatgcaagtatgccatgtttgatccctaccgagctccacatatcaagccttagagtaggaatcaaaaaggcaaagtggtgaggaattcattttgatacacttagagagactgagtgaatcatttgaggaactaggctttcttatgcaaaatcatttgaaaacttccggaataagagttgaataatgattgggtgattggtgctctaattgttgttctgtctttcaactgcccaaggcaaggagaagcagtgtctcgtgggaatcaggggtaagggtaagccaccgtaccaaagattatttaatctgagagagagtacatataccttgcacctatatctttgagatatgcagcatagtagcaactcctgatcaacaaccaagtctttgtttcctttcgtccttcacttgggacgagcaaaggttcaagcttggggggttttgttgacggttgttatcgatcagttttgaccgtcaatattgccaaaatatagaactagtaatgcttgcaacgcatatatctgttagaataataatattccact

SEQ ID NO: 105012 - DNA, 2212 bp, Oryza sativa
gaatacaccgttgccacactgttaacgaccaaatttggtagtccaaatatcggatgtaaaggaggaatcgagatcgaaatcgagatagagattgtcccgcccacagagtgaagatcggctaaagtccaaatcggtcacgactagcatcgacatagttcgagttgcacggggttagccgattaagccgaatccgacaatatcacacagcatatgttgtcggtctaggttcacgtgcttcatgatgattgccacgcatggatagagtcctgagaagtccattgtatctattaattagcatattctatataatttccttagatatatgtttgggcaacagtctaccgcaaagacctatggtatcttagagtttgttagatataagagtcgtgtccgatatgtacgtattttgtaattatctgggtataaatagacccgagccccatgtaatcaaacgaacacacgttcaatacaatctcggcgcatctccacccattttacattcgttttgtttcgacgagttctcacttgtgggttaactgcatcagttttgatttctacaagaggtaaaacttgttatggcggcttgcgttctccggattagtgcttctatctttatgacactctaatcttgtttatgtaattcgtcgagttatcatatatcttacgtaatctctagcaatatcgtcatataacctacaatcggccaacatctgctaatagaaggcagccgattaggttaaatactgatgttgatctagattatataggatatctaccactctataaaacatccaacgatttgattgtctagatactgcctttcttttcatacttatagctgcatcagttgagtttgatcttataagtcgtgattagaatttcaatctctagcctgtctttggttgccaattagggttgtattggggtttcagccgatcttatcttatttaactatatttatcttatatgctttattgacatgttaaatctgccctttatgttaagatctgttgcgctaaaagtatattaggctttctgtttgatatattctacttgcattaatatcttaatatagagtggtatcggagtattagccgatacatgctagatctatctgactggctatgctatgaacatagatagtcttttgttggtatatatttcgatctaagtgatttatactgtctcggcatggtgaccgatatgtcccaatcacttgatttaagtatatatcgacataaggattatatattgttaatatctacagccgattgagtagatttagttctttcttatttattcatgactgccgatcgatgcatatatgacatcggctcaaagataaatgatttgtcatcagcatccagccgatcggctatcttttatggatttaaccgtggtttctttgtctttatttcttgttgattgcaggatcaaatcaactggcacgctcacacacccaaaggcaagttttggacctgcactggagttaagcagatctcccaggcctcgtgtttttacatcaacaaacacacaagcatataaatactcctatagatttatactcatatttcaaatataatctacaaggtgcatgtgtgtcggagggtgcactcctcaagcgagggacagtgaggcccccccttgttagttcggccgggggcagtgggtgaaaatcaaagactcgatggaaggtgtgacatagagggggttgggcccctcaggaacgatgagacaaaagtggtttatacaagttcgggccgctgcaagcgtaataccctacttatgtgtctggctgattgagtgtaagttacaaatcacttaagtcgctcagactcgagtgtgagttcgcccaagaatcgatctctcccctcaccaggcctggacctccttttatatctcaaggggctgccacatgggcctagaaaactgcctaggggagagcgagggcattcacattaaatgcatgtcttgttgcttaacttggaagccactcgcacgggcgctacgacatggggcccgtcaatccaactgcctgacacggggggcatccgtgtcattcatcattaatgagtgaagacttctgggtctttacttgcacggggaaacggaaaccctgctttgactaggtgagatgtactgactccggctaagcctctcatcatcacgacgtgacagaggccgcatgacatgcaaccagtgcgtagacgca

SEQ ID NO: 105013 - DNA, 671 bp, Oryza sativa
aaccaagaagtaaaaggagaactgaagaagaaggcatcgcggacgcccgatgccaatggcatcttagatagtcagtagccatcaatttcgggaggaatctacccatgggagtgggacgcccaatgcctccaaaaaataggaggatgatcaaatattgcagttgaccaacaactgaaacattaagttatatatggtgaaacaaaaaaaatcagcaactaaaacatttaaatatcttataaaacatggtgaaaatacacgttaaaacatgtcgttatcacatattttttatataatggaatgaaacatcctagtctttactcaaagagttacagccaattattacataattcacatagaagaaaactcacaaagaaagttcacgatagcagaaacaaagctaagcaaacacaaactaatagactgtaatacccggtgttcttgagcatggttgggcgaattcgagggcgatttcgatttaaatgggggaagaatgtaatgccctgagtttcgaattagtatattttggggaatattagaacaaatgcgcaaaagtttaatttttaaaccattgttcgaataagcgatcaggaatcgtggatgcatagagttcgccgagtagtgcaaatagactataagttaaaacaatgtgggccggtagatcttttcagtct

SEQ ID NO: 105014 - DNA, 688 bp, Oryza sativa
tttcccagtgtaagttgttttagttgcactaactcttttctaaatgtaagtctttctttaagatcatcaactcttcttcaaaaacattaacttcaataagttaatgtgttcttgttctcacaagtaaatcagtagaatgaataaagggttacaaagttgtgttgtttcctcaattatcatgcataaatataagatgacttagggtgtgtttagttcacaccaaacttcactccaactcccaactttccatcacatcacatcacatcaaaactttccaacacatataaacttctaacttttttttttaaactaccaactttccccaaacttcttcctaatttcagaaaaacacagccttatacttgcaattagtgagagtacgcacgtgatatgttcctacactacttatgttagtatacaggtttgttagagtagtcattattgactttggctatagtcgtgtagtaccatgtgcttgacatctagaaccgtggaatatatttctagatttgaaaacttttgtgtagttgaataaaactataatagattaataagagcatatatatatatatatatatatagtaacttgtgctgtagctagcggtggctatttgctaatttagtccctatagttggatccttaaatttagatttatttagactgaattctacaaaactgcctacttaa

SEQ ID NO: 105015 - DNA, 781 bp, Oryza sativa
tcctaggttagtatattctgagacggagagaggatcggcatgggctcctaggttactatattctgagacggatagagtattaggttggattttttaggacggagtaaacggtttacgaagtgatgtgaaatcgttgtgatccatttgccagggccctgaaacaaacatggttaatgattgtccttgtcgaaagcattcgaggtcatacacgttcggctaggatgagcggttgtacggagtgccaggtgaaagctgttctactactcccaaatcaacatgaggctcgctaatcatacgaatttgaattccaaaacaacaacaaggctgtgtttagattttaaaaaaatttggcaaaaaacatcgcatcaaatatttagacacatgcatggatcattaaatgtggacgaaaaaaaccaactatacagtttgtatgtaaattgcgagacaaatattttgagcctaattgtgtcctgatttgacaatgtggtgctatagtaaacatttactaatggcagattaatcaagcttaataaatttgtatcgcagtttacaggcggaatctataatttgttttgtcattaatctacgtttaatacttcaaatatgtgtcagtatacataaaaaaaattggccaactaactgaacacggcctaaacttgaaagttcaatccatccaacacatcataccgtgtagacagacaaatcagtctgaggaaaaaaacgagacatattatttacgcatgatcaattccagtattatatttttcctttataaaaatac

SEQ ID NO: 105016 - DNA, 573 bp, Oryza sativa
agatttggataatcaccaagagctcttctgcctatgcctagcttcctcatgtttcactggcccaaagaaaagcctttttgcaaatgcagctagagtactttacttgactacctaaagcccctttgaaagcagagtcttcttcttcttcttcttcttcttcttcagttcatcttgtggatggatggatggaatctggattcccatccttgctccaagatgcttctttttcatcttttcccaactccacttttccattgtctttgacatcttcaagcaccttcccttaaaaccctttaaagctcaccacagtccacagcagcagcatagatccccctctaaccttatcccaatgcatgtgttttaattatagtactccctccgtttcaaaatatcaggatttctagtatttagtttttaatactcatataagcattccttctctgatttctacaattcccatcatttcaataattccaaagccaattagatgcttggaaagccaatctatgcaattcaaatttaaaaattgacaactaaaatgacaaaaaaaattgccctaaaattagtatttgg

SEQ ID NO: 105017 - DNA, 507 bp, Oryza sativa
agcttcagctcgttcttggctggcgagctatgcccacgagagctgcataatatatgtcacccgcgtatggatgtgaaattgtggatggaaacgtgcatgtacgcgtacaaatacgcaattttttttagatgatgacaaatacgcaatgataaacaagaagctcgtgtacagcgctgcatgcttcagtattcatttatttttgctgggtaaaaatgaaaattttgtgtggagggagcgtagcttaacacgttaggttttgtggtgtaactagcctatatggatgcaagtcttaggcttgatggtattcgcatttacggcaaattattctttaagagatagccaacgtaacctataccccttgacagcaacccggtactcgtatttacgactagttattctttgagtgatagatgacataccctgtacctctcgacgacacaggctcaatcttctgaagatactcattaaaggtaggatgagtgtgcgcgcattatgggctgcaggaat

SEQ ID NO: 105018 - DNA, 673 bp, Oryza sativa
ctagagcgatgtaccaaacaccttcaagatcttaaataatgtagagtggaatttgccgctttcctcctgataattatacggataggcatttccgctactcaaaaccgataaaaagttcttgtaaagttggattagatgacattccacccagcctgttttagaaacggttagaacctctagattattttggattactaaaccagtattttccatctactcggacggcattttatcctcctcactttatgaacgagaaatacatttttctccaggttataaacctataaagtcaagtggtaaactaaacaaaacagaatctgagaacctgttaaacctgtgatgatggttgcaacaactaagcattgtatttacctctgatcattctgatgaagatgcatatgactcttctcaaaaattcccatgtaggtgtagctatcattgtgaaagccctacaggatgcagtgttcttccaaactgaagatcagagagaaagatgcacattccctatctgataagaagaaaaatcaatgttcagagaagtaactgaacatctctgatcaggaaccaatgatctgttcacagatttgtgttgcaatcgatcgatcaaaccgtgtcatgggtatttttggacaggctggggaatctaagagccgtgcaaagactgaacatgcaa

SEQ ID NO: 105019 - DNA, 665 bp, Oryza sativa
aaaatgaccttttagaacgtaaggggacctagctagctagccaccaaatgcataatttcgatagatatgtagagcatcttctatcatgaaatatcatttgtccttttcctccggcacgatctccttgtcaagctaatccaattcatgtcacattccgctaaaaaaccagtcaattacttagtaacatatacagatatactatgaccgacatggggtttttctggatgcataaaaagaaaacctataaacgacaggccctgtataacatttttattctcaaattaatttagagaggaaaatatgaaagtttttttttctctgacacggatcctctacagtaccgcccctgttgtggaagcggcgagcaggtagatctatagtcccacatattaatgatacaactgtgcagtactatagataaccctcgtcgattttgtgtgtgtgttggggggtgggggggtacccatagcagagcagtgtgtgatgagctagcatgtcagtagcatatatcctcctggattcctttgtttgattggctagcctgctccatcttttgttacacatggttcaatcatggatgctacagcaggcatttatggagaaccatatggcagggcacagttaggggcccctctctttcaaacacccccttagtcagatcgacc

SEQ ID NO: 105020 - DNA, 1087 bp, Oryza sativa
agtagcagtatggtagcatggaaatgaaacgatggactaataaaccgagccatcatcatgtctagctactactggctactgatctcaaacggattcgtccacatcttgtctatgactttcaatgcaaatgatgctcagacagattatgatattatcctaacaacttttatccttcctaagcgatcgatcgacgattaatttcacatatcgtatttaggctaagatttgtcaattgaatcatgttccattttccggtgctttgtggtagcacaaaaggaaacaaaaggacattgctcatgggaccccatgctgaatgaaggagccacacaagggataagagtgatagatccagcttataccaacatgaaacactgtgtttggcttatgtggatgaatcagtggacactatctagtgtatggagaggatccacaaatggggtacttggcaaattgagcatggtgtttgcccccctggttcaatggacttgattgcgattgatgatgattttaattaattgctaatatatactaattagacatgtttcttaatttccccttgaaaaagatgaacatgcatgacatctataatacaggttattatcatggacagtccacttttaaacttttcattgggactctagatatatattacttactctatctctaaaataccttatatttagaggatgtttagatctagggtgtaaaattttgacgtgtcacattggatattatatagggtgtcgcatggagtgtttgggcattaataaaaaaactaattatagaatccatcagtaaactgtgagacgaatttattaagcctaattaatccgtcattagcaaatggttactgtagcaccacattatcaaatcatggagcaattaggcttaaaagattcgcttcgcaaattagtcgcaatctgtgtaattagttattttttagcctatatttaatactttatgcaggtgttcaaacgttcgatgtgacagggtgtaaattttttggcagggatctaaacaggcccttagtcaatctcagatatattaataaggatgtgaaaaaatgaatacgcctttcattaactgt

SEQ ID NO: 105021 - DNA, 544 bp, Oryza sativa
tgggttacaaaatttatgtgtaacaacatcaggaacatgaaaatagcattttgcaataagattgacgcatcatataccaagaaatggctagtttcaaatgagtaatcaccagaaaatgaacaggtattagctacggcctactacaaagggaagggaccattgccttcaaagtaattaatcatattgataataaaatgttgactttgaaattttacttgaattttaaagatgataatagctggagacaacatagtatgtattctacgagaaagtgttttgcattctgtaccttctaaaatgattaagacacatgttcttctataattgtgtgatatgatgcagcatgttttgtttggaaatatggggaaacatttgattttttttttaaaaaaaaatatccaccataacaagtttttcctacatagatgaattaggcattttcttcttttttttcaagagtgacatggaaagttcttgaatttggttttcaatgtttgtgtggaatttaaatccatttgctttaggcaaaaaactaaatcctttt

SEQ ID NO: 105022 - DNA, 616 bp, Oryza sativa
ctttattcatgatttatattccaaggtttgacttaaacattgtcctaaacggctttatttatgagtatgctttagagcacccgcaatggtaaagtaaggtgttatctataaaacatgtacatctcagcaatagactagattaatagtaaatcatctcaatagtatgtctacatgggtatctatagctctctaatacattgcctcgtttttctctatagactatctccaggttagtagatagctttgctctctctcttcatttaatctcttccaagtaggaaaatatgctgacatggatctcttatatagagcctatagataaccattgtgggtacccttatgagtatgcagggagtactcctgcatgagaggcgaacacaataatgattcactgcatgtctctgcatccattccaaggagggtagataacccaatactgtatcgggcattgtcattggattgcattgctttgctactagctagcatagcaagcccagccccagccctgcaacattcagatgttcagaacggcatctgcatctgcattacatgcatgatgcagctttccccagtgcaatggagttgatgatgcctctcgaccagccagctatcagca

SEQ ID NO: 105023 - DNA, 656 bp, Oryza sativa
  unsure (1)..(656): unsure at all n locations
tcttttgtcccccagagattcctttgatcatttcatcaccaacaattgtgtccgcacaaatgtccagccctaaaatcttggctagataaaaattagcaattcagaaatcttgccagaaccaaatgattcaaaggtagatcatgttgatgctgtaaaaatgataagccaaaataacattgtagggaaaattgaaaattgtcttgaatggatgggaattaagtgagccatttggttaaacagcttgatgaaaatattgagtaaatttcacaaaaccctaggttttataggacatgcgtaacccaaaccccatgtattgcaatttgtctcaaggaaccccatgcataataattgtaaaaaatagtatgtgatatatacatattagccgcacttccaacacatgtcaattatcgaaagtataaaccattttgtgtttatgtaactggttaatctgtcattaacagtgagcactgtgtttgtgttgagtttgtgcaatcatggagagcgagagtgaggaagaagaatgtacattttgtgcccattatatatgtgaatataactaaaaataccatatattattatgcaaatgaatattttataaaaatctggggttccttgaaacattntgcccccaaaacatgggggttttcgttatgcat

SEQ ID NO: 105024 - DNA, 667 bp, Oryza sativa
tttttcatctcctcatctccattttttttatcatcttttttcagacaacgatttgttgttatcttcttgcagagtaggcatgccaactaggctcgccagcgagtcgcgccactgtgatatatggcctgtatttttccgggcttcattatctaacactatccgtaaaccggaatccgcgtgtagtatttgtctaggctctagaaaattcctggatccgccacgcggagagtcgcgtggctggatttatatgcatgtagttgtagttcaggtgccatggtgaaagctagaggtatggaagggagctaggttggaacacttgtaaggaggaggtgcaaccatgtgtaaggcaagatggatatgggtgaaaaaccggatatatgatgatttctttgcaggttaatcttcgctttctgatctttactgaacctcatctggaaccaaccaatccgggcctgaatatatatataaaccttttaaaaaaatccacaatatggcactcgtacaaacgtgcaattaattactccctggaaaagatcatagtctcctaccattagtagcaagtagtagtagctatcccgtttttcgcatgaaggtgtttgtgccggattgggaatttggattgctgcttggtttcatggtgtgacaccacatggaggataacgatggc

SEQ ID NO: 105025 - DNA, 742 bp, Oryza sativa
caatctaatcctctcgatatgttaccaataattaatttctcagtctatcaaaaaaaataattagtttctcagtgttagtggtgaatgcgtacgtggcaaacatcgtcagataagagggatcatcaatcaatatcaaggaaacctccggccaggcgcataacacaacacgcaagtacgcaacataccaatattgaaaatttcaaactcaaaatcttccattgcacacaaattaaaaccaaatacaaaatcacgcacatgataaattaacagtacgactaactaggggcaaatctctttatttatttattactcacgcaaaacatattgtatggtacctgattaataattataataagcatctgtgatacatgcatatctatctaagagattttacggtcctcgagaaggtacggagggataccaaattttatatttccgatactatataaggtacgaagatttgtaaaaaatactcaagaactataaaatttctctatataattaaatttcctaattaataaccacttggaattgagcatgatggaatcatctcaattaattaaccgtcttcttggtcggtgtgcggccttgtagaggactgggcatgttgtgcaacgggttcgatccggtgggaaccagacgctccgtcacggccaccgtgggctcgtcggcggcggccggaggagtcggcgcgccgttgtgcacggggctcggcccgctgctggggacatcgtgcctcatc

SEQ ID NO: 105026 - DNA, 673 bp, Oryza sativa
cctgcagcttttgcaagaaccgaaagacacacacatcaaaaaccacacggatcacaccaaaaccaaaaaacatcaaatttcaaaaggccaaaagccaaagatatcatatttcccccgtattcttgctcacttgtcattgttgcttctacactcctactacacctatagccatctcaaaaaaaaaaaggatagagagagatgctcaagctagaatgaactccatggaagtgacaacacagagagatagccatgcatgaacactcttgcagagtagagtggagtaggcaattaggcaggaggaatagtggctaggatgaacagcataggcaaagcctgggagagagagggagagagagagagatggaaaagccatccatccatccatgcaggagcaggatgcagacgactgcaaagagattcacatgtctctctttcttcctcctcctcctctctttcttcctccatggctcagcatcatcagctgccaccacagctagctagccatagctcatcatcatcaagctcagatctcccctccttcctttgtcctatgggcaaatagctttgctgcttgtttgtttcccaatctctcatttctctctctcatcacacggacgcaatgcaaacagacacgcgcatacgcacaagccagtagtactaccaccaacctagc

SEQ ID NO: 105027 - DNA, 1793 bp, Oryza sativa
  unsure (1)..(1793): unsure at all n locations
ctacacacactcagagcagaagcagcagcatcaccaagtgtagaacacaacaaggatgctcaagagaagagagagagagaagcaagcagctggaagctagctagccaggcaagcagcagccatgagagagagggagagagagagatcaaaggattgggggagaggagcagtagcagtgtgttgcttggcaggcagcagctgaagtagccagaggggagagtggagaagcaaagctgagcaaatggaagaagagaagggcaccaaaaaccaaatcccttttcttcttcctcctctttatctgctcctgcctgctgatcctatactttactttcagggccctgtgtgagccagctaaaaagattaaaaagatttgtagagcagttcagactttcttcagactagcttcttcacttttcttgcttgcagaagaaacaaaaattgaacccctttttttttcacttgagtaattaccacagtgccaatagcttttttactacatgtgctctcactggttaattttgatcagtaagccaaggggttgtttatatcaatcttgaatagatatttcaattttaaaaaaaatcaagtcttgagaatgcatgactagtgtacatatcacaatatcacagtgagtgaactgttttatgcattctcaaggaagctgcatctgcatgaggcaagaacagtgtactggtagtagatgaaccagcactagctatagctagtagaattgtgtactacagagtagagatgaggagcaactgtttgggtttgtgcctgaatcacaaaatcacacaacactcctaacaatgctacactgatgttgagcttttctgtcttttcccttgtctccttacaagtgcagataccgtccgtccctgatgatcaactcttgcatttcttctttctttttatttatctaacctgttgtacacctacttggttggtacaccagagataagtatgcatcaatggaacaataagctagacaggtagattccaattttatcacatttgttttataaattccagggcctgcactcaatgtatatgatagcaacaatacatatgatatataatagtactcatacatgtacacaccaaccataatgctaattcacattnncatgnncantantgnncncnanantnantnantntntntntnntnttgntnaanccaantttngancctccaanttggnttgggntttggaaattttgttgttttgaattggnggccaatttttttngnngccttttnantngtntntnntntnntncncncatngcctctctctctctctctctctctctctctctcttttgatgagtcaccctgggccccatgcatatcatggatggtcgtaattcaaaaatagtagaaatcctatcctgtcatggaccagttatttgtccatgggattatatcttcagagttgctttggttttgcaagacccacagctgatcttgctgcagtagtactatcagtttttaattaattagtagtttatttctttgtcatttgttcatgaaagatggagcattaaataaacactcctttttctcttttgttctcttgaggtggaagtacatcatagaatgatgagtttccaattgacctgatgagggggagaaagagaacctagggaagttcaaggattgtctgtgcatgggaatttaatgcgacctaattaagcaagcaaatgtgctcatctgatacatccatcccagctactactaggccctatttgaaagattagcccagagctaatgtttagttatgaattgg

SEQ ID NO: 105028 - DNA, 2538 bp, Oryza sativa
tttggtagtactgctcctctcaaaaagatggagacgtattttccaaagttagctggtgactgcagcctaggagcttcatgtgacactcaaaagcatgcatactcttgtgcttgtgttgtgtagggtgccaccagcccaggtgtactttttactgcaggtaaaaaaacactttgcaggaacagaatcaagaaagagaattttgctattaatgtacagtgatgacactactaatcctgtaagattagtggtgagtactagtactagctagaagtagtacagtagtacaatctgaaactttttgcagtgatccatgcataaaatgactttaccttaaaaatcatgctttgtgatctgatggtttgatcccctagactagagaacctccaaaagattcatggacatgcataagattgagactgaagcatttcgacagccccaagaagacatttgggaggcatcttaaagcttataggagcataaaaaagaatgatgtagggtctctggttaaaaaaaggatttggacatttgacagtccaatgcaaagcatgcacatgcaaccactggcttaaacatttttagggtctctggtgggggtcaccacatatcacaatgtgaagaatgagagggtggggcccacaatgtcagctatagttttcacctgaaagagataaaaaaaaaagttaccaagcctcttttttttatgcatgttgttgcatgctactgtttttagggtggtgccagttatgtgatgcaacatgctccattgaacagtgtagtaggagtatatttttgcgcacactttttttttagatatggtgcatttatgtgtagatggggaatcttgacagaagcaaatactaggctacatgggcctacagtacgtagtgcaccgagtggagaaatggagtgtatttttcacaaaaatattaggggtgtttagattagggttgtaaagttttagcgtgtcacatcgggtattatatagaatgttgtatggtatgttcgggcactaataaaaaaactaattacagaatccaactacgagacaaatttgttaagcctaattaatccatcattaataaatgtttactgtaacaccatattgtcaaatcatggagaaattaggcttaaaagattcgtctcgtaaattagtcgtgatctatataattagttattttttagcctatatttaatacttcatacaggtgttcaaacgttcgatgtgatatgctataaaattttagggtgggatctaaaatttagtagtcgtttttgcgtcaactcagatgttccttttttttcatagtttctagtatcattgttttgggagttccaacgataaactttcgtccatcactgacgcgccgagattgtgagtgaagaacatagggggcgggtaagaagattcagtctaattgtctcgtgacctgaaacttgtaattgcacaagtatttagaactttaacatagagaaaataataataataaatcttccaacctctgcacaatttctatatgcgggggcggagccagccagaagctaagcctatggctcaactttgttattttatcctaattccttataaatttatgactagatttcacaaaactatatatatacttcaaccaaactatcataaaactacagatttaaggtgatgtgtcgaaaaactacatattcagtgctgaagttacgaaataactacaaatttaagatggaagatcaaaaaacaatatgttttgtacaaagttaagtgcataactacaacatttgtaactctcaacatgatagtagtggcatctgtgttttgtgataactccaatactcaagctgtagttttttatacttggccttaaatgtatggtttggtgataaatcttatattaaatatgtagttttatgatacaacactttaaatctatagtgttgtgataatttagtcaaagtaccaatagttttgtaaaatttactctaaatttatatgctcctataaaatttatatgaaatttacatagagtttgattcctagggctagggcttaagcctttatatgaaatttatagcctgaattcgcccatgtttatatgcatgggccaattctattttttagataagtcgtaaaaacaatatatattaggttattaccaattataattcctcttatgtaatcaaatgtttccgctacttaaaaaaacattttcacaggtgggtaaaatccgtttgcagaggtaggtcgatggactgtctctaacaaaatgccagtggagaaactgctatatgtgcgaatcaacttttggatagggttttagactacatgaccatcattgttattataagaggattttcttatagctcatcagtaaaaatgaaacccatgtgtttgtgaaaatagtttctagtgtccctctatgaaatataagtcatgctgtatatccatacaatcagttaataaaatgttagtcctttacatatgtgcacaggatttaagatatactgctagatgataccctgcacgttgttgtgaaaatctttatgaaa

SEQ ID NO: 105029 - DNA, 2484 bp, Oryza sativa
atgccattttcaaccttaccaaattttggtaaagttacaaaaaaagtggctacatttagtttgctgccaaattttagcaactatataagaaatcctaccaaaattttggcaagttaccaaaattttggcaatggtaaaatttggtaaggttttttttggcatcaaagtgaacaggccctatatgtagtactgggataataaaataaatgtttattctaaactgttccaggtcattgttgatatgcgaacatatatgtcagtactatctgtgactcaatgattgctttttttttcttttctagaagatgattgattagatcgatggttttaacttctctcgtgcttagctattaggaattctaggacattgtaacatgcatgttttttggcctgtaaatgtaggccctgttaggatgctacagatttaaagaactactctatgcaatacttccaagtttgttgcatccatgaatacgccagtctttgaatactacatttttcacactgtagcaaaaaccatagtttcttgttttggcaactgcagtatttaccacattactgttttttttttcaaaaaagaattgtttggctagttctatttagatatcttgggtgcatggaattagaagatgggtatgtgaagcatcaacgtgtactgacagatgtctctatgcatagcttttttaactcctatgtatcaatgtaccattgtgtcgtaggctcgtagccctagcttttacacatattaacgatcattagctaattcaatctgtaaacccagatttgctcacatataagagatggatttaaaactaccttacagacagtattataccccaagactttgcaatatttaaaactgctgtggaatcgcttcactttcttggtttacaaaagaaaaggagtccaggagtggaaaaaccatagcgttgagaaaactacagtattttctgttctcaaactaaatactatagtactttttggaaaccactgtattctacgaaaactccaaaactattacatcctcagacagagcccatattttttttcttttggtcttatatttttattagcattgtaccaatggatggcaaattatactataaactttataagtttctaggttaacaatatcaaaaaataattaccctcaaattttttaaaaaagattctacaatactcaattttacacgaatcaatcaacatcgacatatatactatacacgtactaaagttagtattttttagaaatgaaaatacacaaatagcacatggcacacatgcctgcatgtatatagccacaaaaaatattcaagagtgggtgggtgtagaacacgccatcaatacaacttctataagagtacctctttccttctcatgaccagatagtaaagtaggttcaacatgataaaagtaaattgtgattgaatctttttagaactttggtgacaatttctttcccatattgctgctgcttccctgtttttactcgtgcacatactggaagttttctttgttcatatacttttgcgactctatgaattatgatgccagtaacaactgtttattttgtgtgcatgtatttgtctgagttgtggagtgttattttggaggtttatgagttcaagggcagggtcatacattagccggtgcaaagtgcatgtgttcagggccccaaaaattaggggtccccaaataaatctatcattagtactaatcaactatacttaattaccagcaaattacaaggcctaataaatgaaaaaagaaaaaggcccacaaggactaccaggcccaaagactgtatcgttggctcctccattgctgcccacgcgctactcgatggcttggtgtcgcgcaggcatacaacagcaaatcacaattcctaatcttcattagtttgcagcagcaagaagccaacagtgcagcaaaagggagtatgcccgtgtgcatccatcagctcgtgagttcactgtgccatcacatttccctacaatttgttttcttctctaagtttcaaattcatgttataaacaagcaggaaattatttgtttatttcatcagtcctcatcgatcgtgtcttctgaaatgtatgattttggttatgaaataggagtttatttgttcatttcatcaatccatattaagtgaaggtatactttggttctacagtgtttttaaaaatttagggccccagtgttttgcacatgggcttctaattcctaggtggatcgttttgttgcttgttcctctataacataatcaactacgtagtcttcttttacaggttttaagtatgttcctcaataaaggtgactgttgaatacacctagttaccataaaataaaggtcaaaacacaattgtttcaatattattggattaaatgcataataggaaactcaaaaactagtgtgctcttactcttacgttaaatatgcatccaaatatcatgtacacttaaaaactgcaggcttgtaattgt

SEQ ID NO: 105030 - DNA, 859 bp, Oryza sativa
ctggctagtcatttggagcagcagggtttaggaaattatgggtctctaaacctctggagattggccaattgtcagtgccatctagctcatattgtactgtacatctctttcttgaatctgtaccggtgacagaacaatggcatcatcagtatattatcctaccaaaccacagttttccttggacagatttgcagctaaggttgctgtcaccaccctacattctcagttagaaacggagccaagcatccaagaacacctacaacttggcgacaacgacgaattcgattttctgtgaagcctgatcagtggcttgtcctcatgttcatcaaaaaataaataaatccaagcaagcaattatcatcaaggtgttatgcatttcataatatcctcctcctcctcctatcatcttcttatgtccatctcttgtactaacaaactaaccattcgtcctgccaattttgttgtgttcttgtttgccttgtggatcagaagatccagttttcaggggtccctgttgctgaatccttagcttttcttcttctccatgttggtgtgttttcagggtctccagattcaaaaactgcgactgcaagatggggaggagcatgtccttgtcctgatgcagactttgcttatattctggctcataattcgcgccttgaccgcattttttaaaaaaaatcatacatgaatagaaattcaagcatatcgatatcgatgtcgatatgggttggaaaaggaagaggggaaaagaaccaccatcttctgaagaaatttttggtaagtctgaatgaatgaaagaatgattgtgattgattggttgctaaatacacaattcttgcactcgtgtgatggcatg

SEQ ID NO: 105031 - DNA, 1979 bp, Oryza sativa
tcagctagccatgcatcacacttgccaccaccaccattgccttgctcttagctagggtcaggccatcactgcttttgctatactactctagtgcaaagatgccttttttgaaatgggtaaatctctctcatatttctcctctcctttttaaacatcttgtgtttatgatataatctcatgatcttggaagctaagcaagcaagtaaaagcagccatggcgaaggcatggatggatggatatgatacggtactgcaggcaatcagtcagggagtttgtaattttttgttcgtttggtaggaggagagaactgtataagctaagcacggatcaggtgaaggaaaaactaaagctatgtgacaatcaataataatacatgcacccatcatctcttttttgtatactctagtaatatatttcttcttatttttcaattgcacttcactagaaaacttacaattatatatcaccctctcagttgcattccaataatgtgatgtgatgcattcctttttgggagtaatatatgaactctatatagggatataggagtatgatgaatgaactgatcagtcattttctatatagatttttaagaaaatattagcttggagtagctaggaagatatcccatactaataattttgagatggatatgatgtgtggcctatggtgatatatatatgagtagtttattgtgtgatacacatgagtgtccgtgtactgtttgctgcaatcagtcgatgtactcgggagtgccgagtactgttcgcccgtgacaagtttttgtttggtaatggtcatgggcgggcattattccatgctggaaaggaaaaaaaaacaatgaaaaacttatatatatctgtgtgtggtgtgtagatgccttcttggaaactttattctagtttcaagataagacaatgtagttttttacctagacttcactagtgtgatgccactgtacctaatctaattttctggaactaaaaaaattgcaaatgtgtaagttgctactcctactagctagtttcttgatctcaccctcacgttgacagggtaaagaaaattgggtatatatatttaccttcaatctcctgaagttcgtgttatactcttatactcttctctcttttttttaacgaaaaccattataccatcatcgatctttctcttgtttgttttcttctaaaaggttttatgttagcaactcactattatcataataagtttcacgttggtttctagctgatgtgtttagttaatcctatgtatctataaggttcattctcactaaatcctatgtttcaggtaattcttaattctcttttctacaatgaagtcacatcatttcaattatttctctttagattaatcatcaagggtgtaaagttcatcgcttcttccaaaaaccacaccatacaatccaatcatttataacatttggataattgatcaagatgcaaaatatataagcacatgaaagaaaatcgtataggtatatatgtaagtaagaaaattctaactcatatatactattttatcgcttaaattttctcgtgggaacgagcaggatacctatctagtttacttacgactgctccaatttatatagaagaatagcataattcatgtacttaaaatgatgtgctctttgtttgaaatcctccagagattatttttgcagcattatcatcgcaaaatatcctttttattttgaaaaatcctacttatcatgattcacagattttatcggagaaatcacaggaaacgagagaaaacactaaaacaaatatgccggtatatatttaaccattttcttttgatcttcttgcctcttcattgcttacaaaagttccatatatatagcttgatatatatatatatatatatatatatatatatatatatatatatatatatatatatatatatatatatatatgcctatggccctctgtctttgctgctatagtattttctt

SEQ ID NO: 105032 - DNA, 1272 bp, Oryza sativa
aaaatattggtcaaagttactttttatatagaccgtgctcttgttaaaaaacgagtattattaacccagatagagtagctctatcgatccaaatatccaattgggtcaacgtacgacagaacgtcaaaacaaaaaggatcaactgatgtatacttaaccttctccaattaatagggacgatcgtgcacgagctatattaactcattgttccttatccacagtgcttatactgttgtttcgcgaaaacaaagaccttcacacaggcgtcctaattaatgtatatgcatgttaggccgtgacaaagacatgacaacgagcatatatatagcgtaatgcatgctctctgcagcaaattaaaatatattggacctagctagcttgacattccaaaccttagattaagggtgtatttagttaacgctaaaattggaactttcattgaaattggaacgatatgatggaaagttttaatgtgatgaaaaattaaaagtttgaagaaaaagttggggactaaacccgccctaaaggtaaaactttttccaataattaagatatattgctctgaccgcaccacttcgaggacatgataattaaattctggaaaaaaaaaagcttggtgccaatgatttttataaataagtaatattaataaaacgtcttcggtctgggttcgagcctcctcttctcgagaatctactagggttcaaatcttatatacgtacccatcaatattaagcattacgctagtatgcctttaataggctagtatgcttttaataggatttgcgaggcggaggattaatttgctattggtcttcttctctttaagagtggatgcccttttaataggatttcgtgatttggccttgtctattcgcaatctaattacccctataacatatctgaaacactgagctagcatatcttaaaattgacaaagtcacatgtgactgagccaacatatcttaatattaagaaagtcaccataaatgtctcgttgccaaggatacattggctacaatttaaatgatgattaaccataaatatgagcactatgccaattctaagacttgaacaggtcacaacaagaaacatatctaatcaattaactacactcactttgtatttttgccatatctaattttatacgtctagctctcatgataaaatgttataatctctttcattattttcctgttcatagacaaaagaaaaaaaaatacttatttattaattgagttccgcagagcattttggttgacaattttagtt

SEQ ID NO: 105033 - DNA, 1488 bp, Oryza sativa
tcgtactgagctccagggccaatggaaaacattattgatcacacatgcataagcatatgcatgcatgctgccgcacacgtgggacgtactgtgcttggctagttgcactgttgtacatgcatgcatttgccggacggttgggacttgggactttgggaccaaccccaacccaatgcatgggatccggccggttcacctgcagtcccagctctagccagtgcgactgcaagttaagcaatcacactaggatgtccagtttaaatccaatgattaaatcattcgagatatcgttgaaaaaaaaaaggtttttactgtagctttaaatctaaaccctccatagaaaagatagatagccaagattagatcttgtgcaatcgttatcttgcggtccctagtggaactgtatttgatctcaatcctaacgtatgtagttacacatatcattgaaagatgaattaatgtcgatcgttttctttattacaacttttttatttcttaaatttggagtgcacgctacagaaaattatttgtggaggtgtcttacatatttgtctacaagcatatcctaagatgcacccgtatgttgctaacgcagagggacctttaggctaaatgaacacctgctgtaatatgttatgcgaggcagatgatgaataaattcgtccaccgtgactagattatgaaaagtatgttgtatattgtattctcatgtatacgatcaaaacattaggttagcagatattataaatataggatcatttccttttcttcagtttgatagccacacgagggagcatggaggtgacttattgcaaatgtgaagccacggtggattgccatgtcaggggtcgtagccagtcagtcgtgctttagtttttagccctatgtaccatgatatattaagtcaagattacggctccaaatatatgattcacaagattatggatctaagtggtaccacgacacaattaaaagagtactagctactctaggtttacactttattttataatacacttgtgaatagagcgagagagaaagagaggtactccctccgtttcacgatgtagttcattttagcatttcccacatttatattgatgttaatgaatctataccacatttatattgattacaccgtgcatcaacagctgggccacaaagctgagccaaaattacaccgtgcatctagacatatagacataatataaatgtggtatagattcattaacatcaatataaatgtgagaaatactaaaatgaattacattgtgaaacggaggaagtatgttgggaggggggcatattaattctctcgaaaagaagagaagggatattaattggttgagtcctgttgaagacactatacatgaacaatagtatcagctgaccctaaaagtcggatatactagtaaaatgccttcagaaagccactaaaatacgtacggctatgtgtcagcattgacagtgctgcatgcacacacactt

SEQ ID NO: 105034 - DNA, 3828 bp, Oryza sativa
aatatggacagtgctagaaagtcttataacctgaaacgggggtagtaattagttccaaaacataaaactgataccaaaatacataagaaatagtgcacaatgatgtaagaaaagagagtaaattatgatttaggggatatatattcttgctaaagttttactttttcctccctccattttacaatgtaagtcattctagcattttccacattcatattgatgttaatgaatctagacatatttacatcaatatgaatgtggaaaatgatagaatgacttacattgtgaaacgtatatgtctagattcattaacattaatatgaatgtggaaaatgctagaatgacttacattgtgaaacggaggaagtaccactcttgaaatgttttttctttcactttggactagctacataaatattttttcacttgggactagtagctacgtattgttgccagtgttgcactttgtaccttatgtccaagtggcccatatataagtgagacacggacaccagagatggttagtctcattgatatattggtcatcggtttaaagtttaactttttgttgaaaatacctagtccaaagtaaaatagatacttttaaggtggtttgaagtgaaactttaatatggcaaagtgtaatttaattttaaagaagatgtgctaaaaaactgttgacatttttttcccaaaacattcagtttgtggactgttagatcgcgtggagattcatgcaagggaatgaacaattctttttacatcgccatgggtggaactaccactatgacatgctgtggcgcatgccatagctaaccttcttcgcgaatacccccacccccaacttcccagaggtgtttttttatcatcgccaggagcggacctaccactttggcatgctgtggcgcatgcgatagctaaccttcttcgcgaatacccccacccccagcttcccagatgaaccatcgcttcaatgaggtatttcgtgactgcaatgtgggcatttttacgttttttctttgattggaatgaagggggtgttcagattccggggtgtaaacttttggcgtgtcatatcaggtgttatatagggtgtcgcatgggatgctcaggtattaataaaaaaactaattacagaatccatcagtaaaccacgagacgaatttattaagcctaattaatccgtcattagcaaatatttaccgtagcaccacattgttaaatcatggagcaattaggcttaaaagattcatctcgcaaattagacgcaatctgtgcaattagttatttttttagtctatatttaatacatcgtgcaggtgttcaaacgttcgatgtgacagggtgaaaaattttggtgtgggatctaaatagggccaaaatgctttgaatcaactcgtttgtcttcgccatagctatatttttatcctgggtccgccactatacatcgctatgccggctggagagtgagagcccgcaacctcttgggtgaacgaaaattgcgttagccagcaaccaggtttttgttgatcttatagtagttacatacaaattataagtatgcaattacattctaactatgcatttaaagtttttcgacaaaaaaatgtcggatgtcatataagtactccaaaagaattcacagctacaagctacatagaaaacgcatctacacacaccacacctactgaccaacacaaacacgcacgagtacgtgcctttcaactgagtttaaagctttcacaagcaacccaataatggtaataatacaaaggttgctttaacttaatcccttgtgttagtttggtgtctccagaggaatgctctaattcgatttatgcaaaaaagaacccaacacttcgagcaagaacacctggaatcggagcatgtcatatatgccatcgatcaggaccttagtactacatggcacgacacgatggacatgacatgacacgacacgttgggtagactgtcccgaataatgcatttccatgtgatcgacgcaactacaataattccatcattccacgtccacgacgcactcatgcgccgaggaaaactgtcggtcggagcgccatcagcaatccagtcattatgtttcaacaaggaaggcataatttagctcacacttcagaaaaaaagaaagaagaaaggcacaattagctcactggtctggtcatgtccattctactatgattgctctcctagactccatccattgcattttacaaaactgatgagataatacacaacatatgtcaggtcaggttagcggctcaccctaaataaaggcaggcaagttggcatgtatgtaacctaatatcgctggcattagccagcttggtgctccacctgagtacctgatagaaagaactctagggtaccaaacagctgaagttctctttttgtgtggttagcagctcctagatcattcagtctgatggtgaaagcatcttggatcgatccgcaaaccatacttgcaacaccaacaatctgtggacagaatatttgaatgaatactagctgcaaaacaattttcggtatggtgtgcatcagatgcatgcaagtcacctgcagacacctcagcggaattcatcatgaaaatagtcttcgtcgtcgctaaggaagacgctgccataaaatgcatacgggttctcaatcatctcatccaaagttagtcttccatcatgatctttgtcagcctgcaatttttggattagccaattgaacatgtcatcctcggggaacaagagacacatcatgcatcagaggaaagcacataatacattgagatttttcacaggcaaacttttggacaaccttgtgcaaacaggaaccacgacagattatcgagtttttttttaactttttaatatatttgacaattgaactctaccgaaacattatttacatatctaaacctttagcttcttcattctcattagtgtggcagcacaatgctgaagcatgggttaaaaaccttggtgtggcaaagatttggtcatgccgctcatagagtcatactgatgtggtaaatcagggttgatatggcatgaaaagagtcggtacagtaccttatatatctccactattcatggagtagcaacatttgccctccacgtgtgacaaaaggtgtatttttcaaaataggttgtttttgaaattttaaataagaaggctcaaaataaaaaaaaatctcagattatctgtgattttttctatgcataaaaaactagatttattgaattctggatgatactataaaatgaaaagcaaatgatttgcggtggacgggcaacttatacacctatttaatagggtattcttatgtcccactatactgagattagatagttacagcctgtattaggttttgacaatatcaaatcaggacatgtcaaacctattaaagactaaaagttcatctactgctatgttcaggaaaactatagaaagctgtagacatgcatgacaaagggaaaatagatttcaagatatcaaagaacaatagaaaaaatgtagaaattccaggaaaacaatgagaatcaaacctctgaaatagcatgggcagcttgttgtctagcataataacgttctgaaagatggagcttatcaagaacaggttctagttcgtgctctgaaataaacctacataggcaaagagtttatcttaaaaatataaaatgaaaatacttcagtaaataattatatcagaggaagtcattaattaaagctccacttccatacccatcactgtctttgtcaagtttggaaaaccgctccttagctactgtattgttcccaatatgggaaatatctgcgttctcg

SEQ ID NO: 105035 - DNA, 1044 bp, Oryza sativa
ggtaaggatctacagggctaggcctcctggacgagctccttcgcagttgagccaacaagctcatgtattgcagcagaagttggtggtcggaacgaggggaataaaaggctcctacgtgcactgtgggtggggacgtggttgtggacggcaagcggcatgccggagggagcataaagcgagtgtaggagatattgcgcgcagagatgggggacatgatcctatccctaagattcatgtatagataatgactctatgctccactgtgcaaaatatggaagaataaatctaatatgcatatgtgttgccccgttaatgccgttgtcgagcatggtctggtgttgaggaacaagtggcatctacgactatggtgtaggtgcgcaccaggcttcgttggcctggaatctacggctgagccatgagaaggggaacaagctcctcgctggccgtacaatatcgtgtgtcatggatgtctccactatatgcatccattacagccacagcacactaaatatggagatccgtcatagcttttctgacgccaatgcatgtgccctatctcctgagtctgtttctcaatcgtgcgtcacagttctctcgtgtcttcatctatactaccgacgtctaaaagataatagtgatggtgctggtggttagcaagaccattgtgtaggtataaattgtaagtgtttggtcagcctttgtatatattttgtatatactatgcagtctttacttttactctgacaattctttaattttctattgatttgcctcttgttatcttgattaaaaaatcaaaaaaatttatgtttttattttaatttaaaacgagatagctagacaacgcaatttattgacaagtacatattttataattacaagcaaatacacttgtgtattacaacacgtgaagaaaattttcacgattaataaaaactctgtcaatttaaacaacaaaccaaaacaagacaaacaaaacaatagcaaacaaagtcaaaaatcatatataacattgaacccggttatactcgatgcatgcatcat

SEQ ID NO: 105036 - DNA, 716 bp, Oryza sativa
caggttatgcattcaaaatcatgtatggctaatgcacaagatactggagatatagaatataggattattatgctcaaaggagaggaataataacttgccttgctccaacgcaaataaatccgagataggcaacctgattatccgatccttgaaataccacaggttgccatccaaaatataacagactctacgtagaagagaaagaaccaaattcaataaaagtcacaaaataataagaaagcgataaagggcgagaaaggctgggtttggggtataaatatctcctttaaaaggtatagggattattggctaatatttctgggttctaaagggttggaggctaagatagaaaggggatcaagcaacaaatgtcacttatatttcatgtgtgggtcttggttgttcggagagtaagagatatgactggttaagcgagtatgtagctaatattggttggtggcaggtttaggtagtataatatctagggtttggttatatttaggccgattggggataggacagcatattggctaggctctatattttatgtataggttctaggtagttagagagtaggtgactgagagtagggtggataggcgatactggtgggtgtggaatttggatgacaactgggatttaactagcaaggtgtcagctagggtttggttgtgtgctagtcgatgctagtgttgaacagcataacgactagattt

SEQ ID NO: 105037 - DNA, 601 bp, Oryza sativa
caggcggggggagcaaaattgggcgctccccccggccccgctcccagcgcgcggccgtgcgcctgcatgccgctggcccaccacagtgtctggcccaccacagttgtcgggtcccaaaactaatgatttggaaaccgacatattaaaactgtatcaagccttggatcagtagattgatacaggtttaacaatttggatcctcattgcatacatttaaacatgactccgaaggatatgttattacaaaatatttatgggtgtttacaaatttgtggctaattaatacaacagaagctatagaatgactcaactctactattttgctatagacttaaaccatttatctagtctatacttgaggattaagttagaatggaactaacttatatgattgaactcccagcttcggtaagaacatcaattgactctgaaaaagggggttgaagcaagggtgagtacaacgtactcagcaagctattatattcaataatgaatgcatgaaatggtaatatctgagtagatctaggtttacttgcagaaatcaaagaatatagaggaataaagcctagaatgttttaaatgcaacaatatttaataaagt

SEQ ID NO: 105038 - DNA, 690 bp, Oryza sativa
tgttggcggctacactcactactagaaaaatgatttttcatggcgttggtctatgattttcgctggcagaaaaatgccaaaaccgccagcaaaattgtaacgagggggggtaaggggcaacgaccaccagcgaaaatagatctttgctggcggccgcgttataccagtcgccagcgaagatatgtctattttcgctagcggtcacttatgtgcaccgctagcgaagatggataattttcgctggcgattgtgttatacagaccgatagggataatacaattattttttctggcggccaacttaagcaaccgccagcgaaaggtagatgaaccaccatcgatctattaatatgaccacacggcccaccgccagtccaccacctacccgccccctctctccagctcccctccctcccttctctccctcgcgtctctcctccctctcttctccaccgccgtcggctgctctcctctactctatcctcctcccaccccacagtcggcggcggcgttttcggcgtggcgacgacgacaacgcgaggcaagcgcgcggcggtgacggtaggcgggcgggcgacggcagcgagaggcggcgtggcgagctcaggcgcggcggtggcagcggctctctggtgcgggcgcggcggcgctcgggaccgacggcggctcgcggggtggccgggtctgccgc

SEQ ID NO: 105039 - DNA, 948 bp, Oryza sativa
tgtcacgctcttttttttttcttttttcttccctttttcccctcttaatttctctcatgcaagacttgtgatccagaattttcgtactgctgtcctaatcgtgtctgttaattaatcttctttaaatctgggggctgcaattttgcagtgtattattcgcacgtctaattatgcgatactgggttaaattaatcttcttaacggacagcgattaattgagttcaagaacgagtaaaagtgtaaatttacttgtatgttttactcatcgatacaaagacttcgaagaaatcattttaattatacttgcggtagaacatcctagtatagatatccgcgatgtccatagcacacgcactacggcactacaatcctaatagtgtaatccattttttagaaaattgaggtgctagcggccgcatccgttaatcatttcgactaaattatgtgcatgacattgttttttttttggggtgtgaacatgatcttaaaatacaattagaggcttataggaatctagagatattgatggttgtgacaaattttatttatttgaatagaaccccttctccctctcacaagtcacacctccacctccattatgaacactagaggactattagaggtagaggagcacatcacaataatagcaaaagatggagttgcaaactggaagatgataatgctagtgaaacaaactactcaggtactcgcagctattacaatttagaaaaaaaggttcatcgcttatcctctctaatgatgctttgtaattacaggtcaactcaacgtttctacactctacactgtaggggtacgtaaggcctgacgatgacttctcaggtttattttacggattaagtataatattccccctgtcccataatataagggattttgaagggatacgacacttcctagactatgaatctaaataggctctctgaccag

SEQ ID NO: 105040 - DNA, 766 bp, Oryza sativa
tatgagtccatgtacaacacaattagagattaattgaaatttgaagtaaaaacaaaataaattccgaaattaaaaataaccataagagtttaagttgcaatactatttagaaataactgaaatccggaagaaaaattaggaaatattgaaagaataattcatgtagaatacagtgtgagattaattaaaatttagaataaaaataaaataaattatgaaacattaaaaagaaatataagagtttagatagtaatataatttataaataactaaaattcggacaaaaaagtaagaaacattaaattaagaggccaagtagaacatatttagagattaattaaatttggagtaaaaaataaaataaatttcgaatttaataaataaaaaagttcatgtaggaatacaatttagaaacaactgaaaatcgtaacaaaaaataagaaatattgaaagaatagttcatgttgaacacatacaagattaataaaaatttaaaataaaaaatagaagaaaataataaattagcaaaaaaatataatagttcagctaagaataaaatttttaaataactaaaatttgaataaaaataagaattattgaaataagagaaaatttaaaacacaaacaagattaattaaaagctataataaaaaataaaataaattccgaaactagaagaataaatatgagaattaagtagaaatacagtttagaaataactgaaatttaaaataaaagataaatattgaaaaaataatgtgtagga

SEQ ID NO: 105041 - DNA, 2147 bp, Oryza sativa
tttcacgaaaaccgtgactagtggtccttagtggcctagttttcatgagaactcccttactggcttagtttatcaaaaatttaaaattcagtttgatattttttttaaaaaaatgatggtttaccgagcgacttttatcttgagcaaaaaaacctttcagtattcgtgaaaactgagcggtttctatcgcctcttccagcaaggccatgcaagctaggtggcctgtgtccagctccaatggtacattagtacttatcaataactttaaaaaaatttagtttaaagacactagaataacttatatagatatgtcttacaaagtaaaaacatttctttattgtatataatagaaaaacataatcaacaatatattttggagatcgtgtcattatcaatagcgatcggagggaataaattttcagtgctcctatacgactagatgatggatatgggttaggattggatatccaatggctcaaaatccagctgaatactttggaacttgggaatgcacaaacagttaactgacatggacaaaccaaagaactcgaaacctaatttgctctactcgtgtaacttcgatgtaaatcgacagaatttacaacatagccaacattggcagccgacaatataggaactaatccgacaatatagccaaacaagtctgacagctttctaatctgcttgttacatgtgaagaaatgtaagttttgcaagcaccccatgagaagggcaaagtatcttacatcaaaattttacacactgtaaatttcaaatggccaatagcaggatcaactaagaacctgaaaaacaaaaaactgagggaaggctccactaccatcaattagggtttgccttgctagttacttcatgtcagcaccaggaggcctgtcaggcctccaatatagaattgtattagctccatctgcaatatccatgccaacaactgcactgatctatcctagaattatatagttttgggctcgtcgcagggaaaaggagccaaaagaaggacaatgaaccagccagaaatgctactgatgccactcctggaacacaaagcaccaggtaaaccaatgtaagaagtagcatatttaagactcaaccatgcttttgatttctcgaaataaatcaaggtacacacctcttttttgtggtgatgagaaaactggcaaacccattatgttacaaaatatgtgggcaacaataggagagacgatattccctgcagtattttttgaacgaagtgattgaacaaccatgttgtcagaacaatataaagcttcaatcaaacaattgaattaggtaagtgcagtggaaggatgaagaaaaggagactggtgtattcaggaccttgctttaaagttcagctcttctagaaacaggttacatacttcataatcagtggtaacaattgaacttactatgcaaatcctagaatcattcacaaaaagatgtcttctcaaatatagctacctaaactaatttgaataattggagaagtaattcccgcaacaagaatatgcatagctggaaacaacaaatgcacaatgtacacatgcaacacacaaaagaaagagtaaaacctgttcgggtgaacaaaaatactgcataccacccaaaaattacagtgtagcctaactggacacctgtgaatgaaaggcaaaaagttaaggcaagcccagcaaaatgaagcaaaagtgatatactttgagaaaaataatgtacaaaatatgacgaatatattgaaagatcaaacatttgtttatagtttaagaacgaatacaaaggaaccactaacaaatattgacacctgtagttgatgttgtacgaagtcaatactttattttaaaaagttaacagtgcaatataatgatgatgataaactaatatgctaaataccaatgactgtgattagatatgaaggtgttgctacatcactataggttgcaaatcaacacggtgttgaaataacttcataaacaaagatacaaaaaaaatcgctttaatttcacatattagaaataaagtaagttaaatatagatcaaacaactttactctaaaaatcattaaaaggaaggcgttacagtaaagaatagaactaaaaaaataagaaagaaaataccaacgatcaggagtgatctcg

SEQ ID NO: 105042 - DNA, 570 bp, Oryza sativa
tatctccggctcttcatagcctccgccgcacgaattcgccagcagccagagcctcgcgacgaacgagccagcgtacactagcgatgtaaggaggaggggaatcgccaccgcttgaagctgcagccaagcaccaacaatttcagaattgaagcatcaccaagctcaaacctgttagtattactgacatgttcagaaaggaaaaaaaaaaaacaagaacagtaagtgaggtcgcttaggctcaccaggtgatctctccgaatgccaaacacggcgagcacgacggacgaatctccgatgctccacacctaggaaggatggggaggagaagacgctagggacatgagattccgtttagggtttagggttcggaggggacaaggtggggggcacttacgcggaggagggaggcggtggcgaggagggaggccgaggaggagaaggcggcgcagaggaagcggcggtggaggaagacgtggagggaggtcgggggcgggaggcggaggagggccgtgggggcgtagagcaccgcgacgtaggagacggccatggcggcgcacgcggccaccgccg

SEQ ID NO: 105043 - DNA, 575 bp, Oryza sativa
tttttcattaattcagttcttgcagtcactgagaagctactactgtagctctctgaaccagtcaagtgaaagcaatagttcactcaaaaggagatactagtactaatcatagagtagtagtagattacagagtgtatagtaccaaagtagggactagaaaacagaataacacagcaacacataggatgaactaaaagaagggtgagtggctgataccttccctggcaacagctcaaatgctcaatcagtacagtcttcttttaaacaccagcattaatgtatggtcatgtttgggtccccatacagatcactaatgtagggtcatgttggatcccctctacagatcactaatgtaggaccatttcatatgtttggctcctctacagatcaatgacgaacacttttgtctgatagtcacaacaccacatagttctttggtgctctaagtacgtgtaacaagggttttgacataaaacattatgatgaacaaaattcactggtcgatctgaatgatgcccaataacagaactcattgatatctgagctgaaaatattttactgccatgttttgttaa

SEQ ID NO: 105044 - DNA, 675 bp, Oryza sativa
ttaaatgatgctaactttttattcattaatggggagggattatttttaaaatatatgattattttgtttttcttagcataagggtttcaattgcttctctagtatattatttatgtgatattaaagtataattatacgaaagtacttttgatgacgaatccctttgcctggcaaggcggcggcttcctcagaaaacgagaataacattgattttgcttcacatatgattgagatgtcacaccatgttgaattctacatgaattcctcaaaacatgtgtttggatgtactgcaggaaaacacaggaaattagaattatatgttgacatgttagagagaaaatagaaagagaaagagaaagagagaggatgcattggaagtcccaaaggaatttgaaaaatgaggttagacatcatgctaaaattcctcaaaatgtgaaggaactttccttttatacgtttttcctttgaagtaatcctacacaccaaatgacttatatagatattttgtcattgattggattcatctagatttcctttaatgaaaatcccttcaacctaaaggagtccttaccgttgaaagagcactgtgtgtgcataaatgtaggtggttggtggagttgcggggtggattaggggtgaaaattggataggtatttccgaccacccaccttactt

SEQ ID NO: 105045 - DNA, 937 bp, Oryza sativa
aaatacagtagcagcagcgaccatacaaacagtaagtagtggagtaatgacagtgagccagtgaccacagtgaatgtggatttacatgtacgcacctttcttttcttcttcctccgcacacagatcgagcaggcattgttgcatgtttggagctcgccattgatgggcacgacgcatacagctaagctagctgtctcctatgtgggcttgagatcttggaacatggactcccatcgcatgtcctcgccgtcgtcgtataggtcgtcttcgtcgtcgttgcagcggtggcagcggcggcggccatggcgacggcgcgcataggggaggaggaggtcgaggcggaggcggtgcgtccatgcgtgaggcggggtggcggcgctacgcaggtgagaagaggaggaggagggcggctagggttttggtgcggcgtggcgacatctgcgccgttcattcccgaaccgacgatcgcacggctgaggaagggtgggcacaattggacgcgtggacggtcagatcgatgttaggcgagatccaacggacgatgacggtggatagcagcgggaaccaatgcgtaattaacaaaactgtgggggcttttttgcaaaagagacatctgacgtggcacccctacctctccagcaatcccacggtgtctaagtaaaccaatatgcgggggcttttttgcaaaagcgacatctgacgtggcaccctacctctccagcaatcccacggtgtttaagtaaactaatatttgtgatattagttaagtggataaccattagcttataaagatatagaatcaaataagttagtttatctatttatgatatattcttaaaatacaatcaagccccgtttagtccctaaaatattttctcaaaaacatcacatcgaatctttggacaaatgcatgaagcattaaatataaataaaaaaa

SEQ ID NO: 105046 - DNA, 1093 bp, Oryza sativa
ttgttctagatttttttttaaaaaaaatcattttttaagaggaagaaacatcctatagctagctataagaaaacataagaaacaagaagtgcacattctagtagctcttttagtggcaaattaaaatgttgtgatttgttttccttttgttttggtcaattaccatatgtgtcaattgctgtgcagcaatgtagccttgatatgctgctaaaaaaggagaaagcagttagcattttatagtttttctagcctttttagatgctctaatgagatggcttacttgataaaacattacagtaaaccacactttgctccacctaattcactggtttctagctatagcttctcatgaccaccagaatagcagatcagtaacaatggcctcttcgtgttgtcgtgtagtagattctttacccgttccggtctaccacgatttctatttatacaccattgaacctttaaaaatcaaatcttatagttttttagagtttagtgatcacgttatgttcttttttatagtttttagaagcactatcaaatgccgccactatactcctttatggcttgcccgcagcatccctttttagtgttacttggatttgaaaaattaaacttgatcatatttggtttccttttttaaactctggaagtcccgccaatcgtcgcgaacctactcctttatggtctacccgccaccgttcctccttttaatcgtcattagaattctaaaaattgatcctaatcatcattggggtgatgtcccatcaaccgtcaccaccatacacctttgcagctcgtcttgccccttttctttttttgtcatttgtaactattatattctagatatatgcttttttaatattcattattttttattttgaatttttttatttctaaattgtattcctatctgatttttactctatatttaagtaatctcatattgtattttacgtggactcttctttcatcgctacttattctttttattctgtgtaactgcgtggctaatatctatacaaaattatatattttttacacatgattttctttgaatttcattttttttaaagaaccagtaggggaagcccca

SEQ ID NO: 105047 - DNA, 1512 bp, Oryza sativa
tgcgggcagccatcttgcacgacgcgaaggtagaagtggcttggccttcgcatggtagcggttctcaaccatgcaggaggcgacacacggcgcgagacttggggcccttggccttgcgctagtactcctcctccttggcgcactccatgcctccatgcggtcccaacggttagccgccgtgatcgcaagccacctttgccttggagttgacacccatcttctttggcatcgcggctgttcatggcggcagtggctggtggcacggtatggggcttgagcgaagtcggattggcatggtagatgctgaaacgatgacgacgaggtatatatatcccaacctacccatctcccttatctctgtcctctcctcctttgcagccatagatagccacggtcccatcctctccccacggcgagctcgagctcgccaactccctcgcctccctcctctctccactgtcacgggccaccagagcctcctcatcatcgacctcccactgctattgccacctcctgcaaacgagctcaccggccactacccctctccccctcgatgagctctggtggaagagaggggagaggtggagagatgggggaagagagaggataggtggtcggtgagctcttgtggaagtgaggggagatgtggagagatgggggaagagagaggataggtgggaagaggtaaaaatccacttacatgtactccctccgtaccaaaaaaagacaaactctgggtttccgtgttcaatgtttgaccatccgtcttattcgaaaaaattatgaaaaaaattaaaaagacaaatcacgcataaagtattaatcatgttttatcatctaacaacaatgaaaatactaattataaaaaaatttcatataagacagacaatcaaacgttggacacgaaaacccagagtttgtcttttttttgggacggagagagtagaactcacatgtttttaaatatttctttttattgactaggatgccacgtcaagacaaaacaaccattcataatgtcatgagacttgattggacggttttgctaagatgagtaaagatttctggtatcacgatttagcgatgttaattaaactctgaccgaaagatttaggagacaataagtggacttattcctttgagtaatgcaaattttataaggctagtattgggccttagggaccagaattcaactaagcccagagaaaacaaatagcatactgtttacgtgctttataaaattttcattctcaaaaaaaaatctaagtagggcaatggtacaccgtacaccacacctctcaacggaaccatatatggcgagtaacgcagtgctgggtgtgtttgtccgaggcgaaacaaacccttagaagagcagcttgattcagagttgatacatagtagtaatagcatagagccatagaccattccaacatgtacattgtacaaagcggagtctttgtcgaacgaaacaatacccaggagatgctgcaccacaaaaaatcgaagcaaaaa

SEQ ID NO: 105048 - DNA, 1233 bp, Oryza sativa
catcgagtttggtatatttaatttgttataattaatgactacttcatttgtgaggtcatcgactaagatctagaaagctaaggcgtgtctatcgagttgttgatgatcaaattagcgatgccgactcatagctaggtcgccgacttgttcagtggcgttagtttgtcaaggaacaaagacattctctcttgattgatactcattcatatgcttttatatgtgccgtagtttatcagcgttgtagtcgtgctcatctttcttgtgcgttttaagatgtggagcacttttttgatagattttctcaattatatttgtaatctcttctattttaatataatctaacctgtttttgctttgttttttttttcatgaaggaaaggaactagctaatctagtgcagtcgcttcctgttgattcgcatttactttctgaacccaagcaaaaacgtaaccaatgatatcatatcttcatattgtagaattaagctgccagatactagtacttttaacaactaatgataaattaaattcacgtcatgagttccttctttttcttccatgggccaaatggctagaaactgcattgacaattattttgcttatcactcagcagtacacaagtacactgtactgaaagaaaagaaagaaattaaagaaagacagaaaggacgaaggggaaaagttatctaatcattcataacttctcaaatacaccatccataatgttgaattgcaaatccatcacagagaatatggataattgacactttttccactcttctgtaccccataaaattctcagctagccattagggaggttttgtgcctccttcacaggattttgttaggtgcttgatttttccttgaaggacaatgcaaccagaaactcctatgactgaacaatctgccactcatttgcctcttccaaccaactcatgtatatattgttgaagtgtcactaggagagggaaaaaaagataaaaaggaaaattacaaataaagttgatgaacaggaaatatgggacagtcaaattcctgatgccctttgctccaaccaaaagatgagaacaaccattctgacatgaccgatataggggcatacctgaacctgatgttcagtatttataatgtccttttgggaattatgtgatggttgcacctctttccagctctctcttggcttagaatccaagaaaaagataagtttatcagcaattcagcattacttactgac

SEQ ID NO: 105049 - DNA, 634 bp, Oryza sativa
agagaaagttatggaaccatagacatccttattggttttcatagatgctttacttctaaaagcctcggggaggccatgaactgccttagactgctctaatacctctctctaatttcacatttaacactttcattaataatatgtagtacgggctaaggtcgctctacccctcacatacaattctgatccgctcccatctctactccactccatttcagatctgatggtgtttttggttcgactcgtgctactttggatgaggacttatgaatctacggcctaccaaacaaccatgaaatactccctttgtttcatattctaccaaatagccttgaaagttaaaagaagtttgactaaatttattaaaaaaaatcttagccatatgtacaacacccaacaaacatagtatcaaatgttagtctttaatgaaactaatttgatattataaatgttactatattcttatataaacttagtaatacttaaaaatgattaatctttactattaaaaaatcgaagatgttttcgctggaattttggtacgtcatccatgtttgtgttggttgtatgtcacccgtatccattcgtcgtgagtaaaataactattacacactccctcctagtccaatccaac

SEQ ID NO: 105050 - DNA, 1004 bp, Oryza sativa
attttatgaagtatgggttgttcaaagacacagactcaggaagactctgaattcaatcaatgcaatgaagagcgctccctgtgcttacactcattttctgacttgtcacatgtttctgcagctacttttatgtatcttttgaaggactgctacctatatggtatacctagttctttttcatgctattcgaaaactactccttccgtttcataataactgatactcatattttttgttgaatatttacaaacctagaaatgataccatgttactaaagtggggtttgccctaaatcaaaactttcgttcactttggtctaacaatttaagggcaattaattgtcaaagtttaattgggaaagtcaaaattgtcagttattaagaaagaggtagtatcatctatgtggcactgttataatttaatatctacatgattggtgtgctaaaatatttctttctgtaagcttcggtgcaactaattctgcttgattatgatatgaaaatgctgtcacacaatcttcccagaaataaacacgtgataggaaaataaataaagttacctacatagtaataattacaggttaaatccatagtagtttgtatggaaccttggttgaggtaaatatcatcaaatatgattttcaaattcggttaatgcaaaatgcaggctcttgaattccttgggtcttcaaactttttgcataaccaactctctgctatgaatttgctacaagcttgctttattattttattttatttgttttcgatatcaatttcatccttgatcttatgcacttattaattgtccatactctgatgttttacaatcttttttgaaaaatcaggaactgacaaagcaaccccaaagttcaagatccttcagctgcaggttaaaagggtattaaataatgatcctcagccaggcccattcacgtatgttgttcaatgcatgtatattgtgccactgctggggaaaacccatgctgaaggcttcagccatatgtt

SEQ ID NO: 105051 - DNA, 702 bp, Oryza sativa
taacctggtttttatttgacgtgccatttacatggaattattattaacaaatactccctccatcccaaaatgtttgacgctgttgacttttttaaaaatgtttgaccgttcgtcttattcaaaaaatttaagtaattattaattcttttcctattatttggtttattgttaaatatacttttatgtatacatatagttttacacatttcacaaaagtttttgaataagataaacggtcaaacatgttaaaaaaagtcaacggcgtcaaacatttagggaaggagggagtataaaactaaaatacgtggggcccactaacatgtgggcccatctctctttctcccatttgaccccttcatctttgtcttcaactgctgccgtcgtcaaaacttgcccgcttgttggcaccctccttatgttgatgttgatgctgatgccgagttgccgacatagcgggacttgacatacctggtgtagctgccgccatgcccaagggaaggggtctattggtttcccacgaccaccaccgtgggccttgaggatagggaggataccaagccactgtcgtcgcctcgatgatggtagttccaccccaagtcgccctcgatgatgatggtgtgctggagatggcgaaagctatcgatccggcgaaggctacaaaggtgtcgacgacaacgggggtggtgtagaggagcttgggca

SEQ ID NO: 105052 - DNA, 759 bp, Oryza sativa
aacgaatttatctttaaattcgttgtactagaatatgtcacatccagttctagatttgtttttctttgagacggaggaagtaattccgtaagaataggggatatcatataacctctagggaccaataagggtcacaaaatccacttcaaaatagcactcacatgtcccgtgatgaagggctttagatttggggagttttagattataataagcaaccggtgggaattcaaccaatgagaatctagagaagtttgaaaaaccgattttagtttacttattggattttgcactacagcctcttagaatatgtaagaaaaactggattgtttggggggacttgtctattctgtgagaagtcgtagttatcaaagctcccccaaatgattctgaaacataagccataattcatgtgtagttgtgtacaaagccaatggctgcagttgtaccaccagcacacgagggcatgttgaatgtgcttgggggaatattatcccaatcatctgaagcatacattttaatattaaccgttcgttcatcttatcccatttcatcccaaccatccattcgtcttctttttttattcccgcccttaataatccatataagttccaaaacatcctctgagataaaataaagagtgaattccactttggaccagtttttattaccttgtttgcatattggaccaggtataagcaaatttttttcacttagggctagattttgtgaccaattttgcattttgaactattggatcca

SEQ ID NO: 105053 - DNA, 1076 bp, Oryza sativa
cggaggagatccatggccgcgggcggcgccgggcggcggcggaggaggaggagcgcggcggcggctagggttttgggggtggagacggcgaggcgacgaggtggggggagggtggaagaggggaggagtgattagattagagatggaagaagaggggttaagttggtattggtaggggcaggagacttgtacgggaggcgatttaaacacgggggttagtttggcttttgccggcgcatttattgtcttgtttttagattttctttcagaaaaggcacaaatactacccctctgtcccataatataaaggattttaagattttacttgcactgtttaaccactcatcttattcaaaaaattttagaactattatttatttttttgatttacattattatccaaagtactttaagcacaacttttcgttttttatatttacataaatttttttaataaaacgagtggtcaaacactacgagcaaaaactcaaaattccttatattataggacggagggagtacttctttgtttgatattatattttgtttttttctaatcaagtttcattaagtttgattaagtttataaagaaaaccaaattagtttcactaaaactaatatttaatatattatgataatatatttgttttgttttgaaaatgttgctatatttttttataaacttgatcaaactcaaaaaggattggctataaaatatcaacacggcttataatagtaaccagggataaatatgtgaaacaaaatgatacatccatctatccctaatgattttttttcccaattacaccggggacttttttttttgcaaagtctgtgttcttccccagtatacccaactcacctctcccgttctccacgcgcacgcttttcaaactgctaaacagtgtattttaaaaaaaattatataagaaagctgttttaaaaaatcatattaatcatttttaaaaaaaagttaatacttaattaatcatacaataatacgtatttttcgttttgcctgttgaggatgaagggttcacaacccctcctgcccgaatacaaactaagaacagtt

SEQ ID NO: 105054 - DNA, 749 bp, Oryza sativa
tgaattggccatgctctttgtctaaattcgtagtattgtaaagtgtcacatttatctaaaatctcttatattataggacggagggagtatcacaagctaaaaaaaaatcctaaaggccattttggtttgatactaaaaacataccctaccaatttgttggcaaattaaatagtatatatgtattagtttggattgagactaaatgtttgttagtgcccctatcatatttagtcatattctaaaagtttctcaactataccgtgagaatttagctttatattggtagcgatctaaatgctagctaaataattttaccctaccaatattagaatttagctttatattggtagcgatctaaatgctagctaaataattttaccctaccaatattagaatttagctttatattggtagcgatctaaatgctagctaaataattttaccctattaatattttggtagtgccaaagtttaccaataaattggtagagtaaagaaccaaacaaaccctaaaatcaactctaaaattgtcagcactaaaattaagtttgaagattttttttcttttttgataagctgactagtctaggccctattgtttagattccaacttttttcttcaaacttataacttttctgtcacatcgaaattttctacacataaactttcaacttttccgttatatcgttccaatttctttaaacgtctaattttagcgtgtaactaaacacagcccctatgtctgatt

SEQ ID NO: 105055 - DNA, 7124 bp, Oryza sativa
atttaatttcccggttttgaccaatttcaatgtctcttatttaatttcgcatattttgttaatacaagtacaaaacaaatatgcaagtacaaaacaattgtacattagaaatgcggatattttgggaaggagggaccgagggagtagtactggtaattaaaatcttcgggttgcttgggctgtcatcgttgcgacccagctgctagttgtcatctgaagcaacccttttttcccagcattccgtgcctgtccagcttcagctttccaaccgccatgggcctcacgctgttcgatcgacaaacataatgtagatggagacgtacatatatctgtttgacgaagactaattaacactagttgacccaggcttaagctaatcaaccacccaatcagttcaaaacacgcaagccacatacgtgtggtgtctgatccgagcacgtagtagctgctgctgctgctgctgctgcaactttagacatattaatgctgacaatgctgggtaactgaagcttttgttcgatgtttttggtttgtccaacgctattagcatgtgcttaattaatcgtgtagtcagccagtaggctacgtgtccatgtcgttggctcgatctgcctgcgtgtgtgtaccaacactaggacaaaccaacactaggacgattaattctaaggtgtgttttggtcctttttgagacagcttcctttatgaggtccatctgaaggctgccaactgtagtcagccattgtttttttttctttttttttttaaaaaaacttgtagtcagtcgtgattcgaatttaagacctctaggcttgatatgcatctggctgacacaaaataattgcagttttcacgtcagctgtagtattgtattgaaatataagtgaattgctcgtcttttcttgtcatcttaatattcaagatgaactagatcggtacatgcaactctataatttgcaaactcattattgtgcagtcaccctgctagaaacaagtagagcagcaggtaggaaccactctagtatgtgtccattgcattgcatgcatgcagtgacctacagtatgatgcaagttcatctttttggaatttgtgtcagttccatttgtatgcatacactgttttctttctgccactgataagcactgctcgttgaaaagtacatcccaaattataagaatcttttttatacgtcttcaattatatattttgattattaatttattttattttatgctctccacgaatatgaaattagtatcacatgaaaatattttaaaatatgaatatagtgatataacattcataatacttagcctatatatgattagtatgcttactagttaaaagttgtcaaaaattatcaagtttgattttccttaaaaagagtgtcttataatttgggatggatggagtagtagtattgtgcagtactccctacatactcgtaaaagaagtcgtttaggacagcgacacgagtctccaaaacataactttgacttcttttttctataaaaatatttattgaaaagtgatatatgtatacttttatgaaagtatttttcaagacaaatctattcatataatttttatattttcaaactcaacaactttattcatgatttatattccaaggtttgacttaaacattgtcctaaacggctttatttatgagtatgctttagagcacccgcaatggtaaagtaaggtgttatctataaaacatgtacatctcagcaatagactagattaatagtaaatcatctcaatagtatgtctacatgggtatctatagctctctaatacattgcctcgtttttctctatagactatctccaggttagtagatagctttgctctctctcttcatttaatctcttccaagtaggaaaatatgctgacatggatctcttatatagagcctatagataaccattgtgggtacccttatgagtatgcagggagtactcctgcatgagaggcgaacacaataatgattcactgcatgtctctgcatccattccaaggagggtagataacccaatactgtatcgggcattgtcattggattgcattgctttgctactagctagcatagcaagcccagccccagccctgcaacattcagatgttcagaacggcatctgcatctgcattacatgcatgatgcagctttccccagtgcaatggagttgatgatgcctctcgaccagccagctatcagcagcagctgcagctagcagcatccggcactgttccttccatcgctaaccacctgactgttcatctatggatgatcatatccgatccccatcttgtttggaatgtacagtttgtatatctgaatctgatagattgatctggagccaaaaccaacatacagtagctgtagcattacacatcaacaccactgtccccctgcagtagcactgttgcttagcctaggctagctgcagctgccggtgccccccaacctgactgattaaacatcgatgatattatccctgtccctcccggccaacccttctgcagtgaaaaggccatgccatggattctagctagagtacctcgctagctaccaagatcaagccattcatgcatgctgtctgcattatggagtggattgaataatactattagttttcgaggatttttgtcggaatcgaactggttcatgtgaaaatcctgtaagattcctgaaggagaggctttagtctatcacatccttttgtttctttggagaggatcgatgttatcctgggaattaaacgctggaccaggttggtggatcaacattaatcagaagttcagaacagaggagcattatggagtggatcatcatgtatgcactcagcatatgccaattcagataatttcagagaccattacgcttttgccgtgctgggtgatcgatcgaaatcatggttgtgtgtgtcatctgccatatgatcgtgccagaaaaccctgatcctgggtggtcctctttggggtcgcagctcatcttgttcatggccaaaggtagaagaaagaggagagatctagagttattattactgcgtcgccattaactgcgcgtggtgattaagaagaaatcaatgtgcctcgtttgtcctcccgtcttaattgtgaaatttacggccgtatttacacaccggcaatgtgtatgtattgctgactgtcatggtcagtcacacacacacacacacaaagaacagtagacaacgacgatggcatcaaagtggcagcaacttcttttactgtttctgaaccaccatccttttacagcttgaaaaggagaataattcaacgtgaaaccatctctccctgtttcattccagctagcagtctgtctgccgttgtatttgcatcgtggtttttagtgagatgtcaaataccgctggacgatgcttgggagaggtcaaatcccagcctctgcatcgcgagatgcacataaccagccagtagttagattcgttcgggctctaaaagttatttttggctccgttatactaaagccaaccaatagatatcaaatacttaatgcagttagatttatctgggctctaaaagtttactcggttctgtcacgacaaccagcgtcatatcgtttcgatcgtttgtagttagatttatccgggctctaaaagttcactcggttttgccacaacaactagcgttatgtcgtttgtagttagatttgtccggactctaaaagtttactcggttttgccaccataactaacgttatatcatcttgtagttagatttgtccgggctctaaaatctttctaggttccgccacgacagccagtgccatgtcgtcgcgcctggctgtcgttggcggagtagagctcactccatctccagcatcctatcctacccttctactggttttgagctttgaggcagggttgagttgcgtgtgctcgaggcggccggccggccatcgttatcctccatgtggtgtcacaccatgaaaccaagcagcaatccaaattcccaatccggcacaaacaccttcatgcgaaaaacgggatagctactactacttgctactaatggtaggagactatgatcttttccagggagtaattaattgcacgtttgtacgagtgccatattgtggatttttttaaaaggtttatatatatattcaggcccggattggttggttccagatgaggttcagtaaagatcagaaagcgaagattaacctgcaaagaaatcatcatatatccggtttttcacccatatccatcttgccttacacatggttgcacctcctccttacaagtgttccaacctagctcccttccatacctctagctttcaccatggcacctgaactacaactacatgcatataaatccagccacgcgactctccgcgtggcggatccaggaattttctagagcctagacaaatactacacgcggattccggtttacggatagtgttagataatgaagcccggaaaaatacaggccatatatcacagtggcgcgactcgctggcgagcctagttggcatgcctactctgcaagaagataacaacaaatcgttgtctgaaaaaagatgataaaaaaaatggagatgaggagatgaaaaatgaggtggcaatggcaaaatgccgcgggcgccgtcggtgtccggggctccggctcgcccggccggcgtactgtggaggtcgcggtgcctgtccgggctccgggtagacagaaaggccccaatggagcccgccgtatctgctctgctacacctacccatccatgtcaccatccatagatagacgatggcgacgaagacggtgagctctttattatataattttatttatgttttcttgaggggagaagtttgattgatccaaatttgatcgaaaaccgacggttttttaatttctttgctgtgcagggatgcgtgcggatcaaaaataaaaaatcggtggcattaattcttggaattgattcactggacggacagtgaatattgcatgcaacaactgatcatcccctgcaatggcttaatattgccctgtgttcagtgacttggctgccgtgctgcatgccagctatggagggagagagatgaaatgaaatgatctcaatgggaggaagagaatgatgccgagaaattaaaatctctcttgtgttcatgcattcaatttgcttctgcacatgctcattcactcatccagtcagtcgctcactcactcactgggctcagtgacctagctttgctactactagctcactcatcattctctttgcttccttcaccaaacttcagatttccagtcccctggattggcttcctctgcaaccatcacataaatttcctctgcctccatgtctgtactgactgcctctctaactactcagcttttgtgtgtgtgatggagatagagatggcatctgatttggcattggcactagtagtactttgtactagatttgcttgcaagttgcagcctctgaaaatctgaatgttagttgaggaggcctggccctgtgtcctaactcctaatgcacatatgcatggcatcttctctggttttgcatcattcattcatgcatgcatgcatgcaaatgagggggtagtagtcagtagatcatagatgtgtccaggctgaaatgcaaaaagtaaaaagggatccctgcagagatctccaatttctttcactctttcagaacaaaaggggctcccttgtggccttgtgcttgcaggaaaagcccaaaccctgcatctttcaggctcttgccccacatgtattatgtacatgattcgtaaacacacagctagcacatagtgttcccggcataaaaaaaagaaaaaaaaagaaaaaaagaaaaaaaaagaagctagcacatagtgtagccctgtttcgaggagcttctcggagccatggcttctctcgaaatcttcgactccctcaaacagaatcctaattaattctttaacaaaattccaagaatttatagttgtaaaatctaaaaaaataaactagaaatcaggaaatacaaaatccagtttagttttactttttcagattcattcattcatacaaaatccagctagctactcatcttagctgcttctcagaatttcgagcttccctgaacatataaccatgtactatttcttgcttgttcttctcttcttctacatcttgcattgtatccgtgtggatcatgcatgcattgtctggcccatctggtttgttaacttgttgagagcatgcttgcttgcacaacagtacaaagccagatgtgtcctacaaagttgcagacttgtagctgcactagcttacacatccatggcctattccactgtaggaatataaatatacatacacacacacatctatacaaatacatgtctagctatactagctagtggttctcatcacttgcatatatacatacatgccagtacaggatcaggttcaattgcttaaattgtacaagttcctatcattgaccagcctggctatagcttagctcgagccaaaatgccaaacagattagtttaatcaattagatgcataactaactaataatcagtaacgacaagcttgcagcaacaaaacaaagcacttaatcagcagccagggtacaactagaagagacaacacagcatgtccttttcgttttcttttccttcttcttcgatcctcttctctcttgcttgaagatcttgattctttttctacatctagataaaattaagcctaaccaataattaattaaccacactttttttttcagttctgaaatcagaataataatcttaattattgcatgcttaattagattaattaattaattaattatctccatctagctgtctgcttctctgctcttgtaattcttgcagctgcagatgctagctttgcatgcatgcatgcaaaccattttgcatggaggaaaccttaaacacaagtaccaccattttctcttctttttttttttgctctattaattgtttctttttttttttgcgtgagatcgaggtagctagtagctatagcttatgcgtggacgtcggcggcggcggcgacgtcgtcgtgttcgtcggcggcggcggcggcgtcggtggagaccatcttgagggcggagccgccggtggc

SEQ ID NO: 105056 - DNA, 997 bp, Oryza sativa
aaaaccagatcgagctatatgaatcgataggaacatatttttgaataataatagaaatattatattagtccaaataaacatgagaaaaacaacttaattggtaaatgaaaatacacttgtctcaactcaatttgatttgcatcacacctcaatttacagtagtactactactttcttcttctcaagttatttttcttggaatctttttgggatatagtaaatgcaaaagatttcattaacaagtcaattatgttcttcacagcagaggggcatatatacatttttttttgcaactacaaattctaaccaactgcattgcgacagcaagccctgtcaccaaaccacagtacagcccgctaataatagaaaaatggacagggttgcatggcacttttggggtatcttttgtccaatattgagtgtagtagctagtagatcaccatgcacagagtactctagtcagtgcatcctatggactctctagccttaggacgacctcaatggttggagccatccagctgaaaagagaaggaatcttagcacaatggaatctgaaaaaaataaataaataataatcatatgaacagcagcactactcttaactctatcaattagtgatatgtttattgttcattcatcttggctggttagttattggacatatatagcagttgtctgtaataactgtcttatactatactatttccgttctaaatagctaggatgacgttctaaaacatcgacagagtcttcaatgttttatcatttttttcttgaactatatatttgtcaataatacttaaagtataactatatgaaaaagagggtcttttgtcaagaatctaccaatatattttttacatcttaaatcctgatattttttattaataatttaattttcgaagtttgactgcgctcatatttgagcgatatgtcatatccgctaataaagaactcgtatcgataattgtaacaatacgtttctattgcggtgtcc

SEQ ID NO: 105057 - DNA, 1727 bp, Oryza sativa
agctatagctagctagcaccagtagtgagagatcagagacagagagagagagagatagggggataaagcaaaggcatggtaacttcttgcaaagatcaaaggcacacaaaaacaaaaagaaaaaggttaattctgctcctcctctgcatgcaggaggtttcatgtactacgtaccaacaggggaatcaacatatctcctaacattacgaccagatgggtccatattgcatatattgcaccatgcattgcattctctctctagatctctctctctctctctctctctctctatatatatatatatatatatatatatatatatatatatatatatatatatatatatatatatatagatttctctctgctccattcaaatatgtactgcctgctttctgaatatctctgatcagtgtttgtacactgcatgcatgcagttttgtttttcagcatgcatgcgtgactgaaaaactgaaacttttgttagccacgtcttcttgtcctgttcaaattacactgttttagcctagctgatcagctgctatgatctcaatgtatctttctttgccattaatccttttttttttttacagatcaagatgctgcctgcctcatttctgtggtaagtttaactttacaacaaatctaagaatctaccgggcaaatgcagcagggaaaaaggggaaaactaaagcttaacgccggggtgcgtctgattcaagggatcgaattaaagatgagctcaaagctcaaagtagtccaaagagaaccttgcaagagtctaagagaacccagctaggtgtcttggggaatatttacattttacctaatattgggttttaaagcatattgcaatggggataatcaccagatatacctagctgtgggaatcacaccaccctctctctcccaactccccaacttgcattacaaaaaatcaaaagaaatctatattagtacctaaatttcaaccgggaattatcgataccgatattcatagattctcacatccaacagacaagggccaattaatcaacttttcttttctctctctctctctctctctctctctctctctttactggttgatgttctaatgggtgaagattctttacatgattaatcaaaggaggaaggaattaaatgggtaaagcagtactaaaagcatatatcacacataattcaagccaaagatatgaaaaaagatcgcatgccctaggtctctttgctttgaaaaggggtgagctgcatcccttcacacacaagctccaaaattcttctgtgctcttcttcttcacacatgcatgtgtttatgtacatgtatatgcatgttgtggcactgttatagcacatatggtagtctagtgagtgtgtgtagatagagagatagctagatagataggaggactggcacactttgcattcacaagggaatatatcagcatggctcaagcaaggaatatcttaaggctttggagggggatatgaagcacacgcacaaaaggacaccacaaaggaagacatggtgtcctttagagagagagaagagaggggtgaagggaaggagaatgtgagaatctccctgctgctactactcttggctttttaggaattggggaggaagctaagaagattctctctctcttgatttctctctctagctagttcatacacacaagaagaggtgggagaaaggtgttgtgtgtgtgtgtgtgtgtgttttagtg

SEQ ID NO: 105058 - DNA, 1324 bp, Oryza sativa
ttttcctcaatggaggcaagtgtagcactcgtacttacttccttagtgtgtgtgtgtgtgtatatatatatatatatatatatatatatatataaagacaaaccctacatttttgtgtcgttgaccatccgtcttattttaaaaaaactatgaaaaaaattaaaaagacaagtcacgcataaagtattaatcatgttttatcatctaacaataataaaattactaattataaaaaaaattcatataagacggatagccaaacgttggacatggaaacttagggtttgtctttttctggaacggagggagtagtgcactgcatccgtggctccgtgtcacaaaatttggtaaagtaacaaattaaataatttattatcattgacaccttagtaaattttggtattttcaaaaactttttcctataaaaaatactaccaaattttgatcaggctatcaactaaacttatccaacattatcgaaatttggtaccgttaaaatgtgccaaacatttaagaataaaaaatttaataatgttgattttgacatcctcctgaacaaatgttgtgtttagttacttttaaacttctaacttttccgtcactttaaatgtttggacacatgcatggagcattaattgtggatgaaaaaaaccaatcgcacagtttacatgtaaattgcgagacgaattttttagcctaattacgccatgatttgacaatgtggtgctacagtaaacatttgctaatgacgaattaattaggcttaatagattcgtctcgcagtttacaggcggaatctataatttgttttgttattagttacatttaattcttcaaatgtgtgtccttgtactttaaaaaaattaaaatggaactaaacacggccaaagtcataaacatagggttgccctgagttgggaacctttccctccaacataaaaaaacgaaacagctcattagcatataattaattaaggattaactaaagctaacttaaaaaaaataaagtaatatgattttaaaagtagcttttctatagattttttcaaaaaaaaatacacaccttttaaccgattaaaaaactcgcacggggaaaacatgggtaaaagttgggaaagctcactgccaaaggcagcctaatttccagccttcgagtgttttgtgagtgctgaaatttcccaaaattcatcatcattacgggtgtgttcggacctccaggttcccaacccaaatcactagtttttcacatgcatgtttttcaaactgctaaacggtgtattttttacaaaaagtttctatacaaagttgaataaaaatcaaatta

SEQ ID NO: 105059 - DNA, 657 bp, Oryza sativa
ctgctggtgtctggttggctggctgttctacttgtctgtccccgcccattttgatttgacggcgtggccgatcgagaggcagtgctgggcgacacgatcgcgcacatgccggggggccatttggcacggttggctgtcccctgcgccggcgacgcccacaccatgtctctgtcgccggccggggcccgggccctcccacatcggctggcggcggggcagcagccacctcatgccgtgcacacgccgctgtcagaatcgcaccccctctatctcatctcatctcatcttgggcccagctcatctctgtcttgggcctcctgtctcgtgctgcttcttgtcgcctgccttcttgcctacccatgcatccatgccttctccaaaccaaaagcgtatactcccttttcgtaaaattagacttcgtgcgacgttggaactcttgcccaattaaaaccttccgcttcacattgtccacaacctcaccacattgtaattctcacagcctcttcatcatggtaattccaatgagagtcactcgcctatacgtaattcgttggtgacgatgtcttctctgccaagggtagccgagtttggggataggtcgcacgcctcacattacacgtgctcaatgcaagccaccgacgcatttgcgatacacat

SEQ ID NO: 105060 - DNA, 761 bp, Oryza sativa
gacttcttaggggtagaaacgtcatatcgtgtgtgtgactggatcaagacggacggaaaacgatcgagaattgacggaagtgttaaaaatgggaacatggtaaactttgggtgctattaaagtgaaccggtaactttcggtgctataaaaccaaaaacgtgaactttcgatgctatataaccaattttgccttaaaagtaattcaataataagctaatttttttcatcggaatatatccatgtgtaatcttgttttgaagatttaattgcaacgaatttaatggtgcaatcggatcatgatttggataagtaatttaaaagaaaaatcagtttaaagtagttttacacgtaaatcggaggcgattttactccgaattgatcgggcgcccgagcctaggctgccccaaaataccgtttaggagtttagcaatttgctaacgaaaaacaagaaaattgtaagtcgtcgttggaggttagaatggggcctaagccgaagtgtcagatttggagcccatctggagaacgccgtgcatgatgggccgcggtctgtcatttatgggcctatctagagcggcccatagccccgataccgggccaggccaaagctgactatgtgggctgcatggcccactcgccgaatttcccccctctctctctctctctctctcacggcccatgtgctcgcaattaccaaaactttgcattgtggcctcgtcctgtaaatgacaagggatcagatcaagcgctgcacaaagcacatg

SEQ ID NO: 105061 - DNA, 765 bp, Oryza sativa
actcatatctagcctccagtctagcaaagatatggcttgcatatggataggagagtttggcgaccggtttgccagaaccaatttgattgaggtcgttgatgtgtaatgaagaagttgtttgggggtggttaaactataaaagcgataaaattcaatggtccaaagtaaaaagattggtttactggtgattcaaagaaaaactataataataaaatatagcctaaatttcaatacactatttttttatgaaggaagtagcagtatggtagcatggaaatgaaacgatggactaataaaccgagccatcatcatgtctagctactactggctactgatctcaaacggattcgtccacatcttgtctatgactttcaatgcaaatgatgctcagacagattatgatattatcctaacaacttttatccttcctaagcgatcgatcgacgattaatttcacatatcgtatttaggctaagatttgtcaattgaatcatgttccattttccggtgctttgtggtagcacaaaaggaaacaaaaggacattgctcatgggaccccatgctgaatgaaggagccacacaagggataagagtgatagatccagcttataccaacatgaaacactgtgtttggcttatgtggatgaatcagtggacactatctagtgtatggagaggatccacaaatggggtacttggcaaattgagcatggtgtttgcccccctggttcaatggacttgattgcgattgatgatgattttaat

SEQ ID NO: 105062 - DNA, 1449 bp, Oryza sativa
taatacttatgcaggtgttcaaacgttcgatgtgacagggtgtaaattttttggcagggatctaaacaggcccttagtcaatctcagatatattaataaggatgtgaaaaaatgaatacgcctttcattaactgtatgcttctcctaagctttgatgctcgactaaggctgtgttcgttaccggggttgggaacccatctcctccgcacgaaaaacggagcggtccaatagcacgtgattaattaagtattagctatttttttaaaaaaatagattaatttgattattaagcaactttttatatagaaactttttacaaaaaccgtaccgtttaacaatttgaaaagcatacctacggaaaacgagatgaaagggttcggaacaggctgaaacgaacgcaacctttaactcttcacatggccaagctctaattaatgatatttgcaacttactattggaggtggggacgacggtaatcaagggagataaaaacgaggataataaagtgggccaatcgacacacgcctaaaaataaggtcttttagggtgaagcgaatagatagtaggttgtcataagaaatttaatatgaattactagtgcatgttttaagaccataaaagttgtacgaaaatactagcaaatgacttacagtacatttgcaatcaaagtaaatattcattctgtttcaatttacttgtcgtattagataatttcacactaaactaggtggtgtggaaggggctaccctcattaattacatgctaaccatcgtacgtcttctcaaagccagcaataaaattagaaaatgctacacgtacgtccgaaatgtccgactcctgtacgactgcaacgtccgtccatggcttgatccccgcgctgtttaatcctccaactcattgagcctcacgccgttgtgcatttgctgttttgacgtttagtcgtacgtcggtgggacaagaaagtcggatgtatagcagtctctccaagttaaaatttagaaattttagcaaaaaaatctcattccaacagcctctctacttgaatggctaaactagatggatggccaaacttcacctcccactagccaaacttggccagccaaactgactggccaattgtgggccccacgcctttccccccactctatcgatctatccccgtccctctccgcattgctcgtctctgcccgtcatgccaggttgcgaggagggaagagggcgcgtcggtagggcaacacgactatgagcgtcgcctcggcctctggctcgccgttgtcacgacgacgagcgtcgcctccggcctctagcggaattttctccgccacgagatccgcacgtggctgtgcagaggaaaaacccagggaaaagggcgacgacagggcggcacaacggcaagcctcgccgtcggcctccagcgccgatttctgccgccttgccactgtcctctgg

SEQ ID NO: 105063 - DNA, 2441 bp, Oryza sativa
agttaattgaaacggagggagtaacgaatatgaattggcaaaattaaatcttgtgtgcacctacagtatattttgaactatacagtaacattttgtattaccaaatgtccatgtccaagtacctttgactaatctctcctacagatgcaaaaggaggtcaaggaaatgaagaaacttctgcatcgacgatcatgataaccggcatattttcataaagatattctaactgctttctttcacaacgatcacttcacaatttcaaccaacagtcctgtctttgatcgatggtgcttgagaaactacaaagccggtctcctcttttttgtttacctaagggatctatctatcctagctatccaaaaagctaattagctagtgtatgttgtacatgtgccatgtcctacacatgaacggttttaatttagtacccaaacaattaggtttccccagtgctgaattaaattcttgtatagcaatagcattgttcatacatgctgcacatatatatgcatctccactgagctatcagtgctggtcgtcttgtcaactaagatacactacactccatccattcccctattctcctttgtggctaccaaccagcaccctcacagcctcaccaaaggacatcacattacacccctcaacacccaccaccctcacacaacatgttgtcctaatgtttcctagtgttgacaccctaagtgtgtgcaggtgcatcagtatgtacacaaaaaatgcttccattggtgggagtttgtcccatggaccatgatttttgtaccattccgtatagatgcggccaatcccatatatatacacatgcatgcatcatgtgtgtgataagcattttcattttatcatcgagttgcatgcaccgaccggttggattacttgatcgcgttgctagatggcaatatatgcatgccatatgtgtaatggtggagccagcggtattatcgagcatggatagttaatagtattttttgacaaccagctagtttttacgggcatcgatggtaattgtagtggtaacagtagagcttgggtggacatccgacatgccaagaactgccttctgcgccattgcatatgtttatgttgacgtgtacgcgcctcctcggttgttcatactttcgattgactatgcttttgcactgtaattttaggtaggtgttaccccacatcatgtgacattcacatggtagacaagagtctcctaacttcaattcatcttgtcatatttggccagccctggcctgacaatgtccctagacaatatgtgttgggggtttggaataaatgccgacatggtgagcctccatttagaactcatttggttaatttgtgtactatttatatagcaatgtgttttagttttcttttatttgatagtaaaactacacatacttcctctattccaaaaaaaataaagaatatgatacattacagtacaacaaatttataaaaaaaacttgtacaaattcattgcattaaaataggtcgcatcatatcatattctagtcttagttttttttccttatacaaggagtatatagctgggtcgatctgactaagggggtgtttggaagagaggggcccctaactgtgccctgccatatggttctccataaatgcctgctgtagcatccatgattgaaccatgtgtaacaaaagatggagcaggctagccaatcaaacaaaggaatccaggaggatatatgctactgacatgctagctcatcacacactgctctgctatgggtacccccccaccccccaacacacacacaaaatcgacgagggttatctatagtactgcacagttgtatcattaatatgtgggactatagatctacctgctcgccgcttccacaacaggggcggtactgtagaggatccgtgtcagagaaaaaaaaactttcatattttcctctctaaattaatttgagaataaaaatgttatacagggcctgtcgtttataggttttctttttatgcatccagaaaaaccccatgtcggtcatagtatatctgtatatgttactaagtaattgactggtatttttagcggaatgtgacatgaattggattagcttgacaaggagatcgtgccggaggaaaaggacaaatgatatttcatgatagaagatgctctacatatctatcgaaattatgcatttggtggctagctagctaggtccccttacgttctaaaaggtcatttttactcgttttccttttcctttaagttgcgtttctttcttgacctgaaaattatcagcagagatagcccaatgcaggaattttgcctgattattgtgaggaatgaattatttcctatgaaatttcttcaaaaattctgaatacgtgatatatatattataaatttatataccaaatgagtcaaaataaaagaaatgaaactgttttcgttatat

SEQ ID NO: 105064 - DNA, 580 bp, Oryza sativa
ggtgaataggcgttttttgaaattcatactttgcagggaagtaaataatctgaaacttccggtctgaatctggaacttctggtctgaaccgaaacgccacacgtagagttagatatagagataaagacagagaagtgtgcaaagttttctacacgcccttcaacataataatattattataagacacttttaaatacaaatataatcatatatgacatacagtaaatagaggagtaatttgacatcctttggaaataccgtcgcacccactgcacggcaacgtgtgggggtgctaatcctagttatttccgaaacatggagctaaactctgaattcagataattaatattgcagcaatctaatgagttactaagaaaaacataatctaattgaaccgtctccacagcatgcatatataaatgcggatggcggtgcgtaggcttagttagtggccgtcctccggcggcggcggcggctgggcttgctgctgcttctgccggatggcggcgatctcggccttgacgctggcgagctcctgctggaggttccgtatcacgccgtaggcgccgtgcacggggtc

SEQ ID NO: 105065 - DNA, 624 bp, Oryza sativa
aaaaaaaccagcaaaagcaaaagcaaagtaaagccctcacattatccatcgatccatagttccatacatatgcatcacatcaacgagtgagacaagctcaagctcctgctccttctctggtcggctcggctcggctcggctcccgttctccgcgcgcgcgcgccaacaaaaaatcacttttccctttttccaggtgacgctaattaatctcccggattagcgcgattaattaagctactagctagtattattactaatgagtaattaattacgacgcgtggtgatttgattggttggtttggttgattaattagtagttaatcgctcccgcgctcgtggtggtggtggtgttgatctcgtcgttgtcgtcgtcgccgtcgacggcgtgggcgttgttggtcgccgccatctcgtcgtcgtcgtcgtcgtcctcccgctcctcgccctcgccttcctcctcgatgctctcggacatgtcccttccggctccggaggcggcggcgccgccgccgccgccgctgccacggccgtcggagtccggggacccgagcctcgccgacgccgacgacttggcgctgtagggaggggccagctgctgctgaggcggcagcggcgggggcgggg

SEQ ID NO: 105066 - DNA, 1156 bp, Oryza sativa
tgattgttagtggttttatacttaggcccttgttctttttctcaactccaaacttcaactttctcattttccattaacacgttttcaaactgttaaaatgatgtatttttgacgaaaagtttctatttagaagttgtttaaaaaataaataaatcattttttcaaatttataatagttaatacttaattaatcatgtgctaatgagttttcttgttttgcgtgtgcagaaaatattcctcaaactggatgcaccgaacaggtctactaatccgtccaaaaaaaaagactactactccattaaaaaaaaaaacaaatcctagctacaaatctgaacacacatatgttcaggttcctaggtaggaattggtgtttttagacggaggagataactagctaacaatagatgtctaattgtgatggtctatacctatcaatagatatattatacagttttattaaaaaaaacatggtaattagtggatacccagtacttgatgggcatggacatgggttatcttttacgccagatttaactattaggtatgggtgtacgaggagtttaagatcttggattggacatgttcttacttctcctgaagctgatccacccatttccacctctacctcaaacaggggtctcctgcaatggacacggtgacccatgatatcgacaacctagaacggaagcttatgctagtgtgctacgcatgcaaagaggaatcatggattggcagccaaagaacaagaatttcaccaaaagagacacatcggagctgctgaatagccagcatgggctgcataagacatgggtcaagttgcccaactttgatgcaggaaacattaaactttctacaaaatttcttatctaagggtagatcctgtttaaattgttcgagggggtgaactctcggggtgtaacggggtatgtagtggtgtatgtgtgcacgtcttctatataaccggggaaaaatatcctgaaagtagggatgaaaacgactcggaaacgaacggaaaaccacttctaccttttcctttttcataccttttggaatcgaaatcgaaatcagaaatcctagatacggaaacataatcgatatatgaaaacagagtgaattcagtggcggacccagcctaaaattatagctatggtggagt

SEQ ID NO: 105067 - DNA, 720 bp, Oryza sativa
atccctatttaccagagtagcaacatcatctcatatatttttggttgcgtatggtggacttaattagttacacaactgcacaaccaacaccatgacttctccagttctcctccccctgtccttcctcttccctcatgatgagagttttaacacctaattgaataagctagcccaaaaatttgaaacacaacaaattaggtgcagaactaaaacactagtccataaagcttagatccatgcaaggaactgtccaaatttagtaggcaattatggacagggaaccttagttcattttcttttggcaatgaatcattaaccgggatcattttctaaatatgaaaaaaaacttaccttttatccttgagtaggataaaaaaacaaaggtttgaatccaaccaacaacttcttgccaagaacaacaatgatttttaggcgacctggatctgtggcagggctagatccttgtctgttagagccagagccaaaccaagcactactagatcctcaattttttaaaatgtaaagtgtgtcgatctgctccacaaaattcatagagaggctggagctaccatttttcgaactcagaactccagctccatatcatatatggaactcaaccaaccggacctaactgtacttagatctagaaaacgtcataattaatctgaccaactgtagagaacctttaatttacagagtccaaaaacatcaatgcttgca

SEQ ID NO: 105068 - DNA, 1159 bp, Oryza sativa
acaggtgcacatccctgtctatctgtctgtctgaaactctgaacatcaacaaagttgctaaagctgaaaaggaataaagcacaagggtttggaagtttccttcagtgggaatttctgtctcaggtcacattcagtggcatgttttgtgtaatccattacctccattagtgcatgaaaaaaaacattgtctttggactaagaggaagtgtgtttgtgccgtttatgaaatgaggagtttgagttcctataccgatcaactgaattataataacaggagtttccaagagatgttattgcgaaatcaataccagtccatctgtccctctttgcttcttcttttgggggatatgcaaaaggagttgtgttgcatcatgtccaactttgctgctcggttttgcaaagaaggcttcttgattcaacaccctctacagtccaaaatttgtggttgttatgatgtgttcattttctaagatgatacatagcattgggtaaccatacacaaagaaggaattgtgccattttgcaactggaataataaaaaagaacaccaaatagtaggcgaggtaatcccatttggaatccaattattagttattttaaacaaaactcgcaactctaaactatctgctaaaaaaatcccttaataaatactccatccgtttcaggttataaaacattttgactttggtcaaagtcaaactgctttaatttgaccaagtttatagaaaaaagtagtagtattttcaacccaacacaaatttattatgaaaatatattcaattattgatttgatgacactaatttagtattataaatattactatatttgtctataaatttagtcaaacttaaaacagtttgactttgaccaaagtcaaaacgttttgtaacctgaaacggagggagtagtggttttccaattgatgtactgttaaatttaatcttatgttctagagcacataatttgggataatcagctaaccaaacagtcaaacaccaacatgcccaacgggtagtccaaccaaacaagagtacgataatccttcgtaattccattccaaacaggattttgggcatgtttggtacagctccaggtctagaagaggtggatctaggtggagctctcttacaaaatgaaatagactggtggagctgtgtt

SEQ ID NO: 105069 - DNA, 1701 bp, Oryza sativa
cataaatttcagactcggccgattctagtggcaacttaactttgtggtcacaaaaaatgtcatggtggcaaacattggtcatcacaaatgttatgcaatttttcattagaagtttgggctaacacatggtgagaaagtattttgtcatagaacttggtagccatggtctcatgggtccaccgtagccgatcccatttgtaagtatgagattctatgacaaaatcgtcataaaaaggcattattcatcacaagagtcaaacctgcacatgacagcgaagtattttggtcatagaactctagcaatagttgtcaggaagacccacatgtaaatataaaaaaaaaacataaaggaggagacgatttgtccaatgttcacatgaactgtgtgcctttgcccgatatttgtttttccaaataagtatagtctgtcgtatggccgtatccctctttgagctgatggagctagaggaaggtgatcgagataaatgatttgagccaatgccatggctctgagctagacaagacaacgccaaacttgagaaggccaagtccaagatcgttgagctagagaagaaggccgaaatagagtagaactccgggttagtttgattaatattgtaatatgttatactaataatattgtaccaatcattttaatatgtatctactagactgtttttttctactgagtatctactagactgtcgattcaataaattgtttgctcaatattatacaatatttgtgaattttactagacaatctagcattcatatatttttctactattaaaaaacaaaggatttggtaataaaattatcacataggtacaagcatagcaccaagttaaatgtaatactaccgcatttataacttcaatataccagtagcgttagggatttaaacattaaaatctatggttttgcgataattttaatatgaaataagtagttattgttatacattgtcttaaatctatagcgacctacagcgttgtggtcaattgcgtgtaaatagtatggtactaagggtggcctacctgatagatggcgcgaaaacaagaccatgagctgggccttacaaaaaaaggtcatgtgaaaaccatagaggagaaggtagaagccccacaatgtgggccttttggaccaataggccaaaccatgcccatgtacgacactacttgctttctttcattcagtaccatatcgtctatcaaactagagcatgaccaattaaatagtttctactagcctctctgttgtaatgaacattacaacatgtacaaattaaatagggcaaagtcatttatcaatatagatatatcaaatatatgctcatttattagattgtatctttcctttgaggtagctacaattgttgcgaggtcactttaattagtttgtgaataataaacaactctataggtacgaaaaaggacaaaaccatttatcattatacattgtatagtatatcaaaattatcaaatatacggatactgtgagatatgacagctaacttttgtgccagtgaattatatatttgcaatatctctgcactataattatgtgcattcttggtccattttcctcaataacagttcaagataactctatgccaaaagtttgcaatgtcgtccccccatgtgcttgtgttggatggtacccatgttgatcgacatgttgtttccatggccttaatgca

SEQ ID NO: 105070 - DNA, 672 bp, Oryza sativa
ggatccccctaccctcacccctctttggaacctgacttagcttgtcgattacaattagaacatcatgttcaagcagttataccattgttcgttaaacattgttgtttgctatttaaatccgccccttcaatcagggccagtcacgggctgctagcgggggagccagcgcacaatgaagtgacgcttactgcttcttcattcacgcagggaatatcagcaatagtgaaaagagtctacaatattatttttctgtcataattgagatttattgcgttgattttgattcggcatcacgagtgaatgtaatattttgtcaatgtataatagagctattcatcacaataacagattttagccttaaagagaatgttgagttctggggagaggtgaaaaatgatttattagcgttttcattggtatgatgcaagtgtgaaagaacatcagagaaaaaatgtaccctgaaaagcatggctcttcaaatgccttcatattctaaatgtgacatttatcaatttacaaatgaggaccacatttttatgcaacagtccttggttgctatttttaccaagactgggccaaatttctaatcattttgctgattctagaaccttgcagtacacaacaatacttatatgctacatgattaactttccagatcgattccacgccgtt

SEQ ID NO: 105071 - DNA, 508 bp, Oryza sativa
gatgaaattaaaagcgctttgggacttgaaggcttgaggctatcattattactctctagtaatgaaacagtaggcacgtttctcgcaatagtcatctagagtataataataataatactatgacaagtttatatagcgcttgtgacaaaagtttcaaagcgctgtacatgtacacaaatcaaaattacttcaaacaaaaatcaatattactaatagaattaacattactcaaattaccaagaaaacaaaatattactaacataacttaacaaattatcattacttaaattaaccagaagatcaaatatttctaacataacttaacaaattaacattacttaaattaccaagaagatcaaacattactaacattactaaagaaattaacaaaacatgtaaattccctggaaattaacacattatatcagtaatagcaataatttaaaaagacataatgaaggcatggtaatatttattcgaacttattattgaacttaacttttggtat

SEQ ID NO: 105072 - DNA, 542 bp, Oryza sativa
atatatgattcgacaaccttagcaccgttgatgatacctgatcttgtgatgttcttacctgttgttgggtatggcaggcagtcgatctcgtctttgacggccaccaggacgccatccatggcagagagaggagctcctgcagttaattagcatcaagaacagtcaaacacttgacataatccaagaacaattaacagttaacagaagccaagaaatgaaatggtgcatgcaatcgatcaggtaaaagctgcatgaatgcaaagagtaaacgatgagatactgcaacaacagatgcatcagcacaacgagatgccttcaattgcaacagatcagcaggccaggccctgcaaggaatgtagtattggcctctgcgtgcaaccacatgcagtggcaactaaccgtccctatgagctatcaatgctggatcaggaccatgcaatgctttcagattcgatcaagcaagcaaagagctagtctagtcaatgcatgatcattaggggatgatgccgatgccatttctatggaatctttcatcagaaagc

SEQ ID NO: 105073 - DNA, 3168 bp, Oryza sativa
tggggatgtcgacagtgtgctccggcgatcttcggcgcgctccagcagggtggcatcacgatggcgcagaggagatgggcaccggcaccggcaccggcaccggcaaagaggagatggtcgttgtcgccggaggaggggaaggggaagggtggcgacggcggcatggcgcgaggcggcgacggtggaggctggggcgctgggcagcggcagcggcacagccgccgcctccaccgaccgcacccgcacctccgtcgtcgaccggagcagccgccacaatgccgccgtgttccgtgcttggtcgcggaacggcaccgtctccctcctttgcgccctcggccggagcagccgccacagcgccggccgtcgccggcaaccggacctcctcctttcccgcctcgccccaccggcctccctgtcggtcggccgtcggcccgcgcagactccctgacaagaaagtgatggagaggagaaagggagagaagatgggaaagagagagatgacgtggactgacatgtggggcccacgtgggtcccacgctgactcagccgccacatgtactaaaaccggggtcaaaaccaccgaaggatctcgggtgacctgttttgtatagttaagagaccccgcatatctggttttacggttcgaggatgttttttaatcccgataacaagttgagagaccttcggtgtactttttcctatatatgacccactgcgagcgtcagtctaggactctgatgtgccgaagccacgaattttttttcattttaatttttttatttttttaatatatatataaatattgtaccggcgaaaatatttacagaagtagagggtaacgtgaggaacggacaagatgaaaataaaaactagaaaaatgtatttttggcatggcgaaaattgtatttacctccttgcagcccttgcagaaggcgataagagatctcagtgcaaaatgcgcacaccttgccgccctccacctaggtggcaggggccatttctataaatattttggatggtttaatatttctgtaaatattattagaaaataaaaatttaaaaatgaaaaaaaaaactccccaacccaccgtgcacggcccttcttctagccccattttacctgctgcctcttccatgtctcttctgtttctagatcgagtactgcagtgagcaggggcgccaggcctttatccggattggtcccagttgaaagtagcctttatccgaaaaaaaatagcatttcagcgggttggtctcagttgaaagtagtatttggacgcatcctaattatagcatgatattttagcgaagcctcgttttaactatggtataatatggtataatgcctattttctcgaaggccttagactcacaatgcggctgctaagcagatctgtacgacttgctaaattcataggccataggccacgtatccccaataataatcaactcgtactactatgactatgtactcagtgatggaccacaacaatgggtcagacacacaggacatcattttgtcgtatgaattaacgacaaatgaatataacatataacgtgcatggtgactttatcatcttaaaggcgtcgctctcccctggggcagctcgcaaggccacgacccgtccgccccctctctcccacccctctcctccgcctcgccgtcgcccgagcggccgccgccgtgccgcgcggctgcaaggacggcggcggcggggcttctcgcttcctgaagctcaggcggtcaggggatccgtccgggcggcggcgaccgccgatccgcgccgctcggccggatttgacgagatggcgacagcagctagcaacggggacggcgacgctggcggggtttgcgatgacgatgatcgaggtaagcggttccgggcggggatgtggccgatggtggtggggatggtgatggtggagtcaacggatccagtagtggcgtgcccggttccgacggcggcgtggcggctggcgacctgcaggcggcctgcctcacgtctggcgcttggccggcattggtggtgaggaggacagccggttcaggctaggtccagatccggcgcgtccttagtcgggtcgggggtggcatggaatccggtcgttgtgcaggtggtgtgcatagtgcagatatcttcggtgtgcaggtgatatttggtggcttccgctgtggatgctatgattgagggggactccgaggtgaaagccttgctctagcaacggcgacgccctcgggcgccgttcaccttgttgaaggcgttgctattggagccctcgttcaacgccacttcaaggggattctccgggtgaaaaccttagactcgttaggatcggacgatatcgttgttctgtcggtgtacactactacaaagatggtttttgcatacgggcgagaagggttttcacatgcggttgcgccaaccgcatgcgccaaattgtctgcgaagatcgcgatttttgcatgcggcccgtatcgaagattaaatttttcaaattttattttcgcatacggctccttaagacgcccgcatggaaaaatcgggcgcttaagtgagccgcatgtaaaaatgaggtcatctttacatgtggacctcttaagaggcccgtatgggaaaatcgatttttccatacgggcgtcttaaggagccatctgcgaaaatgccgctcgatctttgtagacgccactagttatggtccgtttgcaaaaattaaggggtcccgtacagaaaaatcacttttgtagcagtggtaaccttcttgaagacttcattttagaagctttctcccttgttgggtgtaacgctccgcttttcgtgagacgttaaaaactaattcggcaaaaatcctaattgcgaaaatttcgttccttgagtgttgagtctgagttgtgccaaagatctcaatttaaatccctcccttgtctcgataccctgttatcaaagatcgtctcctcaaaattaccatcccaatgtagtcccgaagctcgattccttctattcggaatcccctcctggaaccccatccgtgaactttgtcgaatgtccgaacccttctattcagacttctctccaaaatccttacccacatatctcgttgaatagtcaaactcaaactcccaagttacactctcttactctaaattatccatgcccttttgactcgtct

SEQ ID NO: 105074 - DNA, 512 bp, Oryza sativa
attactcagcaaatcagccctgcaagcatgccatgtcgacattcttgtaacattgaatccgcagcataaattgcatccttgaatgcagaaaggctggatcttggcagattggataactacataattgagcagaaaaggacatggcaacaatttcggtttcagattggcacattttcttgggaaattaaaaagatcccaaggaaaatagccccagaaggaggcaacaagaaaatgattccacaagatgcaacctgtctcctcaccagtaaacaaaaatactgcaatttaaggaacccctaacattgggcaccgagaagaaagaaatgacaaagcaagcatttctgcaaatcagaggcaaccccgagaaatcccacatggcaggagaagcgcccaagacgattcgagcaaacccaaccgatccaagcacgatgcaacccaggaaacacaaacaggccagtcaatcgagcaagaacttacggccatttcggcagggaagctccaagaacagcagc

SEQ ID NO: 105075 - DNA, 526 bp, Oryza sativa
tcacagaagacacgagatttaacgtggaaaaccctccaaaaacaggagagaaaaaaccacgtgtgccagccagcaaaatatctttactatatctgaggtgaggttacatcgccgtaaggcggcttacaagaggtatatatatggtggaactctaaaagggatgacgggcaggcctcccggcgacgctccagcccaagcctcccgacgacgggcctccgctccgctacggcagaagctggcatttattaagtgcaaataaatttggaccacaactcaacaacaccaaacagaagatcgactttagtggagtttatcttgagaaaaggtaggtaggtaatacattctaccatgagatacaatcacacaattaataacccaacaattgcagattcggtaacgatcctacaaggaagtcacaccatatagagagtaagcataaggatagtggctagaatttcattcgaaatcaatcatcaagcacgcgttaccaaccatgatgacaactctcatttggccctgaaactgc

SEQ ID NO: 105076 - DNA, 528 bp, Oryza sativa
aggatccaaatccttacgacaaaggctaaattttaaccaaatcatgaaaatccaggccactttcaaaaaagtaaaaaaaatgtatgaatttcctttttcttctttggaaatgtaaatgctgaatctgaacaagcacggcacctgacatgaaaaaatcaggttcgtctatcagaaaattcagagtaattgcctgaactaacattagtttgcagcgcatacagtatgggcttagatgggccatgatgggctgggccacgtaatgttacattgttttgcattgttttgaatttgttgcagtaggccatctgaggtgttgggagatctttcggcactatggctttctgaactttagttcagcaatagcatttacagagctgaggatttttttttcttttaccttgcaaatcccaacggttttgtcgacaacaattctgatagttacgcacatgtttcaacttgagtaacgacagttcatttttcagcagcttgtaccagtctttccattttttttccacaatgggaaattca

SEQ ID NO: 105077 - DNA, 729 bp, Oryza sativa
aaacatgtccacagagccaacgcacttgggtaagagaataaaaggttgcagccagttaagtccataagttccaggggagatttatgattccatttctcatcctcaatcaccattcactcgatcatgttgcttggccaccggtgctgtttctgtgtcatcagttgacaaatgcaggtggagactggacaatgaagtaatatatctgctggctgcctgtagggatatttgctgattgacttcatatatgtttaagtctctcagctttggtgcttcaggtagagtagtcaactctgggcaccgtctaatatctaatttgtaaagctgaggaaatgttacctcctcccttggagttccatcgactgcctcccatttctgaaagatatccaaaccatataattccatttccttcaatgctggaaatgcagaatgacacacggtgctaactccgccagacaattctgaaatcacatttgacgcttttggtaaggcagttagcctaggacaacttttgattatcagcttttcaacctcaggaaatatcagctcttctccttttacctcatttgtgtcccaccatgtctcaaaatttctcatactggccaaggtaagctccttcagtctgcaaaatgtaaaggaggtgtatatgtcacagttgaacaagcaatttaaaccatccagtccttcaaggcaaagaacttctagagctggcagctgccacagtggaggaag

SEQ ID NO: 105078 - DNA, 576 bp, Oryza sativa
tgtatcggaaatggtatttttgaaccagtgaaatagtactacataaatattgaataattataagcaagattggctagctactgccttttaaacaaacgagacaaaaaaatgcaggattttttggtaacaaatttatcctattgaaatgcaaactaattgtttctgcaatatccaagactaattgtgcgcctgattctgtatatgaagctacacactgtattttgctttggagaattgtaccaattattatcaagttacagatcaaaagatatgcaacaaccatgagttacctttgttttgaaattaaactactagcctacaaatagttagcggagaaaacacctttatattaacaaaagcgtgagtccgggtgacaaaacaaagtgggggaatcactaaataagagcatatttttactaagtgttgcatatcatgtattcatgttatataaactgtatcatagccattgttttcacttgtttgacaccactaaaagttgtttaagagtaaaactcaagtgtgacatagttccctgatgccagaatgtaacagaactttgtaagcttgcatagatac

SEQ ID NO: 105079 - DNA, 1082 bp, Oryza sativa
catgaatttacagacatttattttctccatgttttttccccatgtatctatattcacactgctgaactttgcattctattttgcagttgcaagatcttggcagcacacttattgagttgtggaacctaatggacacaccaactgctgaacagaaatgctttgaccatgttacgtctttgatttcagtctcaccaaatacaaaaatgccccaaggatgccttgcacgtgaacttattgagaagtttacaattgatcgaccattttatgttcttttgctttatttggattgtcattgaagctaacttaatttttctgtaaaatccggttgaggttaagaggttgaattcttctgatcattgtcaatacaactatagcgattcattgagggtaagagctcacataacttttatgtgctttactaatctttttcgttataccttccatatttgattactatgcagtagtaattatttttctgatcattgtcaacacgactacaaatatattttatagtagaacctctcatgaattacactgaaaaacaaaggccgaatcatcgcctgcacaattgatctttaataaattgaacctgcccacactacctgtatgtgccacagttctatatagaaatttcgtgattagctacgttatgtaatacctacaccaaccatcctataatactatcactataatttcattgtaccaatatctactattaacaccactattcgcttttatcaccggcaccttccacacataaaaatacttatagacaaattttcatacaggtggacattcaacgaattatgtttctgcgcaaaaaatgtacaagccacacctgatctaaaaaattacatcaatgttattaagcgtttcctacagcattcgagcaaattctatgctgagactgttaacaggacattccttatgcagaatagagttgtaagttcgtacacctcctgttcattccttcaaatttataatacatactgctcgttttttctgcgcaccacagaaaactaacataacatcccagttgcagtactttgctaaagaattttcagaggtacatcgaaccactg

SEQ ID NO: 105080 - DNA, 746 bp, Oryza sativa
tctaattagttctgcgccttatgtgcttatcacatagtttatgctcttctgcagatgtcaggctccatctatatatatctacttattactattagaggccagtacaatgcctgtatcaacactcctgtgctaactggtagatacttttgatgcacctgtttacaagtgtttatatactactctatgaaatgaacttatgcaccgcaagtggttaaattctgaccatgtttcgtcagatctgtttacattgtttctttaccttcacttgctccagctgcttacgtacagaaatcaccactgtttcctgcttcgtttctttgttggccgttcaggcggcgcgcaaaggcgcgccccaggctctagtacctctaatacgtgagactagtgtggtaaccgactacaccacccaaacttgccgatttagacttggcaaagaatttacatatacattttttctactcgtttcttaagtttagtaagggtatctactcatctgccatggcatgttgtttctgcttcttaagctcctgacctaacttaattcgcagagagcaattcagggaaaacatctatgaaacaattcatggcacgtttaatttagattattaccatgaactgtctactagattataaggctacattaaatattttaagaaaaaaaattaacaacaaaaataaaacaaatgatttaagcaaatacaacagaaacttttttaaaatttttttaaagcatgtaacaaataata

SEQ ID NO: 105081 - DNA, 1273 bp, Oryza sativa
atgatcgaaatgtcctccgagataaagcaatatgtttttttttcctttcttatatttgaactattgttgcttgtgggtctatttagttgctttataaaaaaaaggactataacactgagaatcgatatgtttaataccattttggttgaaatttacttcacacatttgatcaatgcatacacggtaaggaggtgtttttagaaagaaacatagaataatctatgtaaaaacataatacaaagtggtgatatgtctattatttataaaatgttcaacaaaaattacgtataaaatcgtaaatcgccgagtaatgtgggcattgcaagtacacgtaacggaggaaacacaaaatatacagtaaatataagtatagcaagccacggacatcaaacgtatggagaaggtattagatcaaactagtggatacccctcacgttgcagtggggaatttacaaatacttcaaataaaattcgaagagaataatttgtaatccgtatactcgtaatgcctaaaaggcattattttgagctccttaatagttgatgtggaattttggacgtgtatatcctttatagatatagaggccagattaataaaaaatacattatctaaaaaaatagttgatgtggaattgcaattgcacatcacataggaatggttatgtattgggaatgtgaggatccaatggttattgctttccgcgttatacggttaaaatgcacattaagatttatagcaataaatcaataactacagtaagtaaatttatagtgtattataaatgcatatgacatatagatggttaagattaaattatgaaaaggaaccaaacactactattttctagatattttgatgtaccataccctaaaagttcgaaatcgcaatcctaattactaaataggttggactcatgctcctttatataatgcagcaaatttgcagaatttttttttcacatgatttagttcagtttctcccgaaatatctaaaaaatcatccattcagagaagacataagtggcatctttcaaacgccaccggtataaccgctggttctacgtaaggcagtactagaccataaaatatctgtccataatcaaatgatgcatgttttatccaagataaccaggaactagaattggccaaaaactccgtgcagaggggagggacacaccaaacttattgatgaccgcagtcaacacgcagcaccactcacatgtatggccttgcttggtataagtactcggcatcgaatcgaagtgtaacgcat

SEQ ID NO: 105082 - DNA, 676 bp, Oryza sativa
atatgtttatctagataaaaagatgctaatactatcttaacatggatgtcacaagtgtcaggtgcacttaaggtttgaatttttttttcaagtgctagcatgagacatccaagagagaatttatgtaactttcaagtgttaggaatgttgtacaccatgaaagagaggaagatacactgttgatcatcatcatgcaccagcactagcaaagcagcaatgacaaaattaacaaatccaaaggcaatcaaagagtacatgatacatgtacaatcccctctagtaggtcctaaacaaagataatctggatcacaaatctcaaactgaggataccataccatactctaccacgtacagatctctgtctgtctctactttctctctgtccttctctctcaccaaacctcaactttccccttctttcaggcctccccctctatataagctgccaatcatgcatccttggcaacaaagccaaaaacccaagaaaggagacactgatcattcttgccatatattctaccatatatacatacatatacacacaatttctgtatatatttcttgctaaccattgttgctgctagttgcttcttcttcttctcctctaccttgtcatcgtccgtagtagaagtaatcaagaattcaagatttctcattggctgctgctgccatgaag

SEQ ID NO: 105083 - DNA, 685 bp, Oryza sativa
actaattattattctatgatagataatacactcgttaatagatctcaaaacatatcagccattctttcaaatgtgcacacgctcaaaacgtccttgtgataaatttatcaatctcataggttgaatcttctctcgaagatgagcttatttatactcttccacaatataagggattttgagtttttgcttgcaacgtttgaccactcgtcttattcaaattttttttccaaatataaaaaatgaaaagttgtgtttaaagtactgtagataataaaataagttacaaataaaataaataataattttaaaaaattttaaataagacgagtggtcaaatattgtaagaaaaacctcaaaatcccttatattataggacagagagaatatgtttttgtattgagttttttcttaaaagaagatattaatgaccgttgatggcactggtatgcaaaaggcaaatgacaatcccacgtgggcagtttggtcattgcatcatctccatgtggtaggcctgcgattcgcaccttgcagagctcactgcacggtcttctggctccagtacatttctttttcttctgagcggtcaaagtgagcggttttcaagctagccctcgtcgatttcaccgagacgatggagaaagatgataaggcaatgcggcaaaaggaggaagcctttcgtgcagag

SEQ ID NO: 105084 - DNA, 3706 bp, Oryza sativa
gactggtagtgtccatgtatctcatctatctagatagtttgtctgagcattcagtcctgtggaaaaggcactagtttaagcggtaccattagttagattagctgttttctgtagcttaagcaaatgagaaatcctattccattagattttccttcagttatcatgccacatgatatcacaaatatggtaccatcaatgatgctcatgtaatttctccctccaactactgccaagcatgttctggggtgtcagttgtatctgagttaataattattgggtatgactggtagtataggatatgtcagcattttatatgatcgcttatgaaactactaccatgtacttttgcaaaatttaattaaagcttttctaaaaatcaataactgaatctagatcatgtcctagtgtcgtaaataaggtgagcagacaataccttttttttaatatatatatatatatatatatatatatatataactttaaatgcttgatttttttagagtatgcaggagaatatatgcttgttttttatgatgacttgctgaataaatacactacacaaagctttaaggttgattgccctgatctagcatatactgccatatgtacggtcgtccactagttctcatttggcatgcattgccctttctttttgacccgatctagcatatactgtaatatatacagtagtccactagttctcatttgccatgcattgtcctttctttttgagtaaagctctcatggtattgtttgatgtcagatgggagagggtacttggccaatgcaaagatgtatgtttgcccttcatgtagaggtgcaggaagagtaagtatttgcttttatattcaattttccctttctaacatgaatgctggatatgctttctaaacatatccactggtggtttgtgcaggtttccattaacccattcacatccatttgtacttcttgcagaggcttgggaaagtaattaaggtaagggttctgtgagtaacatgtcagatttttctttttttaccctatctcatttgtgactattttcacaggattactgcctgacatgcaaaggttcaggggtggtagatggcatgaaatatgtaaatgtgaccattccagcaggtgctgtgcagctaaccttaaattatcgttgttagccagctcctttccctgaaacggctacaattgtcaaaatgatttacattttttctattccacttaaaaaaacttcaaataaatttcacaaaaccccaggtttgcgggtatgcataacacgacttttaccagtcattgtagctatattacagacacacgtcaggctaacacatgccaaaacctagctctattactgcgccttatccacatatattgcacatgcattctcgtgaaaaatgtaaaatctaagttagcttgcatatatattgctccatctctttgcgttgacaggttcattcaaggaacatctggcatctgggctgctatgttgtcattctagtttctagttttttcttttctcaattgtaaaaaggatgttgcttcctagtttgctaaggttgttttgaaactctttataggtatgacatgttgcttacaattaaacttaagttgagactgtgaattgtgttttcatgttaattactccttgtttcactcaacataggggttgattctggcgatacaattcatgtaccagaggctggacatagtggtggacgtggaaccctacctggaagtttgtacattaagcttcaagtgagaaaacacctacatgaatgcttgacctttttttttatgaacttacaagttctgtgaatatattggtgcacatagttatttattattgctgacataagccttatttgacttgtcaatgttaaaagtttgttgcttagtactgaggtgctaatgaggataaggaagataggaaaacatgaggattacaatatttcgatttgtcttggcgtatttgaagtttagaatgaaaataatatattaatcagtttaaacaattgtgcttgtagattttactcattccatttttgttcggtactatgttgaaggaaaagaacaatattttctataaatattgtagcaaagtcatgaaatcatgcattagctgagatgattcataggtatagagagtcttgcatttctatgtaagcaccttaagtccttaacagggttttcatgatttttgctgcaaattacggggtcctggctctcactatgtagcttgttatggattagtttgcatgtatatgtattaggacagactagtttccatcctttggttcatccaaatatgtgcgttaaagaatctatgactctgaccaaaatataatggccacttgttgcactataggattcctcatctttatgcaagtttgacaccatgggacttcataagtctctctatgttgtttcattgtctttcagtcatggtcatgttctctgttattccggatgaccctccaagtagtttgttttgccgtttatcctggttagttagatctatgtagtataaatacatgcaatgtactggcttgtgccatgtgtgagcagtacgctattagcctcagcttatctcaattctcaagcaacccagctgctgattcttccatcaactatgtatatcataggtagcaagtgatccagtgtttgttcgtgatggtgctgatatccatgtagacaaaaagattagcttcacacaggtagtaacaaatattccttctgttattaatatttaatatagagtaagcatttgtaagaaatacactacttttcaggaatattttcctactgctaacatatgtacttcgtagcttgcttccctcctaatatagactgcaagttatgcgaatcatcattctaattacaattcaagaaaaatctagtccattcaggcaataaaaactctccatttttcactataaatactatcttgagagatgtagaagccttcagaggttgacgatgctgtcttggtgaacctatagaggtggtgaaatcagatgtgatagtttgttagatttggggaacactattattgtgattattctctgttgaaaactcttgtatcaaactgcacttgatgaatatctgtgcctctgtggaggcccttcgaatttgtgctattaattaatggtgattgtgaattgtgatgatattgttgcttattgttttcttccttgaaaaaaatgacaggcaatgcttggtggaaaagttgaagtgccgactttagatggcacagcagaagttaaggtaacaaattagcaatcctcatatactactactaaagattaggcacttctgtcatagtaacattttatataattttgactatttgctaatcttgtctatatacatgtacacacgtataaagaactagtaggataaaaaacaccatccttcaatttaagggctcgaagttccaactgtaaatcctaaaatggaacatagatgttacaatctctccttattgagatataaatatataaagagagagatgatgagagagaaggatataaacggcttatttttggttgggggctggttataccggttgacataattgatggattagatactagaactttacagttgtataacaaatacaactattgtagttttccataaagaccttgatattgtataacaaatacgacaggaaaaggtccatcttttgtcccttaactctcatcagagt

SEQ ID NO: 105085 - DNA, 2025 bp, Oryza sativa
taatatcataagatttatagatttattattttaaaaagctatgaatttaagccattgttttgggatacaattttgtcagtaaatcgatgctccatcattagtggcatctttctttttttataaaactaaagatagacaatttattcacaaaactacatattttaaaaatctatcgtggtaataggtgtacggatagcatatctaaaatctatagttttgtagaaaaaaaaagacaacaccaaatccatagttttgatgtacagtaacttaaatatgtaattttgtaatattatagcttagatatgtagttttaggatgattttgttaaagtgtatgtagttttataaaatttactttgttttttatgataggaaggaaagaaaaaaggaaggatgcgtctaatacagcttaatactatgccttacaatcattatgtatattatctgtaaggtcaaatcagtaattatgtgaagtgatcgaacacgggtcaaatatggattttctcgtaggttttttatgatgaaactagtccacctaagtttaagtcttagacttgatacgtacgctcgtatttacggctaattattatttcggtgatagataacatacccatcgatacgagatagtcatgatgacttcgtgaattttaagatatatcgattcagtttttattttaaaagtcttgtcgtgttcgtaacagtgtcaaataaaatcgcagaactataaaaactttcttgatgaaattcttttgcatatacaacaagtatagtgggaaagaaaaggaaaattaggagataaaagatgaaagagggatctcggactatttttttccttgaagggcggatcctttgtaagcacggcatttgttcgtgttttgtgcgtgtcttgtggtaaacttgttcaatatactagcgtgcttactttgttccaaaatattgatgtaggttacatgtgtattagtgcacagtattcgtgtttaatagtactgcttgtgaacaaagaatccagtctcagcatgcatcgttggcactttccggccaaaaagacttgcaatttattgtactactctttaccggcaacctgcaaagcaattaaaatggattaataggtaggctttgaccaagcgtgctagggatctatttggcacacatctgcagtttcatttttttagctgaagcccaactaaattattccgatattttatagaaagagtgaaacttgttagagtgttcttacaaaataaattaaagaggtagagttggttttagagtttagacagttccacaactccacttcaaatccaacttttaatgttaaatttagaagttggagaccttccaaataggccttagggtgttgaagacaaaaggatcgaaattcatgtaaatttcaaaggaatttgaattgtcttaaaaataattgttgcaaaagttctataagttccaaaaaaagtggacttaacattagctcactagtcactactcactacctatgaagaagaaaatgagaaaaataaataaaaataggtcaccaagttgaagctgtagtttaattctccctttatcccaaaatataccccctcaaccagagtttgatcatcactaattaagcaagagacaccgagaccaaacaccaaagcatccatcattctaaaatcaatcctcatcaatcaaggtgcttcttcgctgtgtatccaactgaaattaatttacactttaaatattgcatgggttgaaccaatagaaaaaaattggttggttgtatgcttgcatgatatttcacaatgcacatttacagtttgcacaaataaaaaaaacatattgtatatgatgatcattttgagaaaacctaaaaaatcttaggtgatgatataacttagataaaaataaatgagacaaaaccaccactaacacaaataccaataaataattataaccacatcaaatatcatctggatcacctcaataaatacaatacatgtacccgatagaattaagatactaaagggtgggaatttaaaaacaa

SEQ ID NO: 105086 - DNA, 1273 bp, Oryza sativa
gctttatctcaagtcgggcatcaattgatgacggacggaatcaacaacttcgatcatcgtttatttcaattggcatgctcttttcgaccgtaaaattgattcttatggattattgtaacggtatccctggtagtacgtacgagcatgtgtggagattgacttgaaatatgctagcgtacatgtcctagtaatcgtgtcgtgtaatacgaatagaatcggatgatttgagcaacgatgtacgtgatatccatacggaccctgcgagtttcattcgctcagtatccacatcacacgaactctctttcgcagttcgctcgaaagtcctgacttttcaatgaatattacgcgtgacaggaaacggatacagatgacgtaccatagttttgacaaaaacatcttcaatttttaaatcgcgggagaggacgacgcaatcctaattgaacatgaggcaaaggcaaatcacgcacgcgagggcatcgcgggctcaaattggcatgaagaaaatcactcgcgcgagggcgtagcgtgcggcaagggacacgtgaaaagtgcgggcccaattaatttacgtgcatcttagatatgagggacactttggcataagataaaaggaaagtatttgatagaaacttaaaattaaaaccgaaacataaaattaaaacagattcaaacatggatgatgtaccaaaattttagtggatactttttaaatttctataatagtagatatcttaactacttaaaagattcgtatttttccattcgccacccctctattcgttcgtatttttgtccgtccctcaaatcccaatccgattttgattttttgaatgatcaaaaaaattgaaaaaaaaagagaaacccaaacttcaacacctgaaaaacgcaaatatatcgacccaaaacaccaaatacatcgagtccgttgccgccgctcgggattggttgggcgccgccgccgctgctgcctgccggtgatgggggagggcgctgccgcgccgctagtggtggggggggagccgccgtcgccgctcacggggggaggccgtctccgctcagggggagaggcggcgccaccgccgccattgcttggggggaaggcgccgccgccgtcgtcgctcggggggagaggcgctgccaccgccgccgctgctcggggagagatgcactgccgccgccgcttgggcttggaggggggaagaggcgccgccgcttgggggaaggatgccgtttcgagagagcggtaaaagaggggggagggggttaggtttga

SEQ ID NO: 105087 - DNA, 740 bp, Oryza sativa
ttcctgcagccctgcttttgtctgggtttcatgatactacacttcctagaccgagcaaaacctacatgaaggagagggacgattagacatcgaatgagatcatggactttctattgggcttagatggatttttctctgactgattggtaagtttagtacttgaagaaatttttagactttgggaccccaatatattggcggcccagtaggtaggctcaatggcactgtgtttttttatctgaaacagtgggtggacaccaggcttaagttgaaaccggttgcatttgttctctatttcggagaaatgcccacaatacgtgttcgatgatttgcccgagagcagtaggaggaatgggctggcttcggggtgacccactagaagtgaggattgttgtggtgtggagaggtcaaaatgagtaagaagttaagtgcggttgttgaatccttgtgaaaagaatgagggtgtaatgatgaacactatgacagcatatgcattggtagaagagttagggttttaccgtggtaaaatgacaaggttaggtgttttgtttcaattgcaggtttttaataatttgattgatttaactgaggcacctggagttgatacaatcatgcaatataaaacatatccaaagcttaattttaataccctactcggctaatatttgaacttggctcattatcatgttctagtttggcccatatgtgatgtagtttggtcccatgtgtcagatgtgttc

SEQ ID NO: 105088 - DNA, 1532 bp, Oryza sativa
attttgtacagctagcgttgctgttgatgggcatatcagtccttaggattacatacatccgggcggttgacgggcacattgattccttacaactaaagtaattagggtgaatagctaaagtggtcctccaagttttatccgaggctcagtttagtccttgatgtttgaatctatctatattagtccttcaagtttttattttacttcacgcttatccttgaagccacttagaagccacattgctaaacataaccaacaacttccttgataaatgacacttataccccctcattcacatatataagagaaaaaattgcatgcaatgaattttttatagataatgaatagtaatttatgtataacgaaaataaattatgtacttgcaagtgtatcgatagccattgcttaagtttcatgtgcacatgctgaaataataagaaatacatctgcaatgctgtttgttcatcttgattttctcttttctattgtatagttgtatagaaattaaaggcaaataggacattttccaacaaaaatattgactagggatggccatatggcatatatattaagtggctcatggatgattgccaaaacaaatacttaggggatctatgtggataaaataaaacctggcggaccaaattgatcattcggtgaagtttgaggaactaaatttgctattcacccaaacaattacatgtaaatacaagtgcatatgatgagtcaagtactcgactctcatgaacatataccaccgtaagaaacctaacatgatgtattttctgattttcgatggtacattaaatccatttctctatttatttgattactgatacaagggttttagcaactctatgggctggttgtatatttgtgggttagctggttgtacattctctcttttttagaaacactttttctatctttgcaatatcagtatcgacaaatgtagagtaacgtggtcggaaaataaataaaataaattgtgctcttagtctacgacaacagttccacgtgcataatgtgttccattgcatcatcaatatttttaatatacgtacagaagctataaatatttataaaagtaagaacttctcaaatacagtaggtcatttctctttgcaatatcaacaattattgggaaatcacattggttgcacacaatgaatactttatttgccatttttggcactaaagtttggattttgctcgctctaccaatatgtgtcacctagttgcaatggaattaacaattcacatttaacatttcaaattagccactttaccatttaacctaagcatcacgtatgatatcctaataattcggacgccatattctttcaagttgacttccgatccatcagcgaaaacgctttctcaaggcatcaagacacacctacgcatgaatcaaacaagaaacgatatgcgtacacaagttctttctcaacttaactcaacattatcacacaacagtattacatacatatatatataagtcataaacatgagataatcacgagtgtccaaat

SEQ ID NO: 105089 - DNA, 1279 bp, Oryza sativa
accattcatccttaatgctgacatatttaggtttatcccatggcatggcaaaaaggatctaatggtttttaattaattactgcccactgcaaaaaaatcacacagaaaaaattaatgacattgccagcttgattaataatgcaattatcatgcatggaataattaatctacccgacatcggcatcaatactctcatttcctagaacctataaccggatgagacatttcctagggttagggtttagggtacgaatccggatgggaccgcacccattggaatatttatttccagttcgatagaagagagaaaccgcgtgaaagttttaaaataccattagccccacttgtcaggtctccatctccgctctctctctctctctttcttggccagtgagcacacaacgcatatggagttggctccaccagaaagcaccgaggcaacgtagattcactatgcgagtggtgagaccgggtctggtgctgcacgagcaccaaggcattttgccgcagctattctcaggaggcaaacacaccaacgacaatgacactcgatagcacagtgtgcttgacggctggatccctagatacatataatcatcgtgacgagcttgatcaaggctggcgcagacttaggcggcaagctccttggctagccagtagtcaccgtggatccagtcggcgagcttgcatgaagtgagtacgggtctaagtggggagcttcgagtcttgcgccagccagctctgtgggcatcacctctcctctctcctctactccgcatcggctatcttgagccttcttctccagctcgtagattaaggtggttctgtcgggaagcatcgaggcatccaggagaaggagatagagacctgactttgtatattctttcaagtggtatttcataactttcaagtgctttctctcttctattgaaccaggaatggatattttattgggtgtggtgtacagcagcaaatttttacattttgagagtgtttttcctaaaagtcacttcgtgtgttgtcttacaactaaaaccgtgaaatcagaatgttctttataaaccagccacatttgtatcgatgttaaccaaaaagcgatagaagatacaccaatgtgggcgaaaattatttggctttttcgtaggggttaattcttatttaattacactcttgtctcttagaaagagctctaatcaatcggataagacagatggaggtaccttgactcttccaagataaacagatggttgcatataaattataatgcaatgcaaataaa

SEQ ID NO: 105090 - DNA, 780 bp, Oryza sativa
gggctaaagatgttctttagtcccggttcaaaagggcaacgggcatatttgatctttagtcccggtgcgcgtccccaaccgggactaaagatcaactaaagatgatctttagtcccggttcgaatgctgtcagggcatgtcaggccctccccgtatctttagtcccggttgataacaccaaccgggactaaagatggtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagttttaagaattatttggtgtaatattttatgatttttgtatgaataaagatatcttataattattgta

SEQ ID NO: 105091 - DNA, 3546 bp, Oryza sativa
ttgcatggggtttccatcccatttctaagtattctccagtgccttccattcatgcaacaagcatcgatcacacctgtagtgattttacaaaattttccatgttcaacaccctgatcccactgtgcattcttggcatgaatatttttatccaattgactttttattttccccaataaggtctctggatcacactcactggaagtatttcctttgtttgtccaacgcctccagccaaggattcctctgtgactttcaacgcggtgaagaggtagacaagttgtgagtaaaggactgacttgaacaaagttgtttgttcagggctgtcttaggggcctaggccagttgtgcgactgcctagggcccatgccattacagggcccatcaccagccaacccagccaacaaaatgccagttgcatctatttagtctgaaaattatattagaattttgttttgttctcgtttattaatgtgcattgtaattttaagtgtttataatgtttattagcatcatttttgatgatataggataactttcttcaaactttcaacttttttcaggaactaaacacaacctatataacaagaatgagcatgattgcaccataaatacccacacctaataagcatgaaaaagtttaaactatcatggtggatagtgaggagagcagacgattcctacattctatagacatccgatgcacgaatgaaggattaactcaagagctgccaccatcttgagttaagtctcacggaataatagaattgtgacctgtcaccgttttgaaagaaggtttatatcgagcagaataatatatcactacaaacaaagattgtgaggccgtcttccacttttgtcagtgaaaccccatactagctaggctgtcatctgcatgtcactgtttcgcaattttgctccatatcgagctctgtgctgaacatttgggtattctcttgtcgttctgacgagcaaagcatccattttttctagcattcaagctttttttctgccatacactctgattgctttaactctcactttagctgtgtataacgtcatatgatgtcctcctggcaagacaatcactgctatctagcctactcttgtctggtttcagttgtatgctaccaacatgttccgagatcagttcaatgagaaatcattggggtctctttaaagatatatgtgttgcaaaatagtctggaaaacacacgttgttcttggaagcatatgattcagagctggtttaatatgtccaatagaataaacacgaccgtatgtgttattacttctaagttacatgcagtgacgtacgtatggccatatgctttgatattatttggactgcaggactaacggatatttgagatttcatgccctttctgttccttcagttggccatatcttttgaacatatatacaaggatggatcgctcactaaacaattctgtttctcaaatgcaaactagctactcatatatagattttgaaagacatgttctattttgatgcaccatactacactgacattattggttaatgcatgcaatttttgagagttaacttctgccatgcaaatgaaatccacgagcatactctctccgtcccaaaaaaagacaaaccctggtttccgtgtccaatgtttgaccgtctgtcttatttgaaaaaattatgaaaaaaattaaaaagacaagtcacgcataaaatattaatcatgttttatcatctaacaacaatgaaaatacgaattataaaaaaatttcatataagacggacagtcaaagttgaacacggaaacccatggtttacctctttttgggacggagggagtacttctcaaagattatgtttggtaaatgtgccattctatgaatttccatattattggtcataaattactatcattgacattatcatgtatacgacatgtcaagaataattcattgtaccctcgtggttcttatctactcatgctagggcaatatcatttgacaaagagtaacatcgtttgacaaagatatttctaaaagagtgtgttcggtaaatgtgccattcaatcattttccgcgttattggtgacaaaattattatcgttcactttatgtatgtgcatgacacgtcaagaattattcctcatgtgctccgggttcttgtccgcttagtaatgcgcacgatcttgatccactacatgcaatggttgtctattatgaacggcaacacaatcatgttttactactttgcatgggtatagatatgctttacttgtgaggtatcccttattaattctaacaatattatttctcttcatcattttttcaaacactactactttcttcctaactactgagcaaaacatgtatggtgccgtttcaattttatatcctacggttcaaattggggaagaggggaaccaagatgcttctatataaggcatcgtgcaagttgaaactgatattgttcttcttgttttctaatttcatgacttaactcattgttcattttgtttttcttgaggactcagtatactgcaaaaaaggaaggtttgtagagagctatcataggttattcatcatatatgttgccagctccctgatcatcatgcatggtaggtatcactaaaatggatttcatcgcatggctttgataccagttgtatgatatataattaataagaacctttctcactgcaacaactagcttataaggtgagtagcccccaagttttaagcttggtgtttttttgttcaattcacaacaaagttggaccattccatggaatggtgatttttgtgataattagctattagcataatgaggatgttacagaacttatctggattttttttattatgaatggaaatggtggtcattatgattaaacatttcaagtatgattactgattgtgttctacacttgcacaaaactgagggaaaggataaaagctagccgctgtttgtctctagctagttttgttccgcaaagtgtcataatttcctagtacgcacacgatacattgaaactataatatataataccttttagcataacataataaaaaattcagtcaattctcatgcataattgagaaatcatacctcttatccgtggatgatttgttaatagtagagccaacttgttggttataacttcatgatgagcaatataaatagaaaggttcagtttaacagtgcaacaaaaacatgataaacttaatagttcattctcatatatatattttatttattttggagaaactggtagtaatttatttccgagctccattatgacaaataatttttcaatagaattaaaagcataattttccattttccatcggcaacatgcaaaatatttgtatatcacaataattatttccttttaaactaactcaccgtggaaacaaagaattgaccctgtgtcactaaattgaaatcatatataataagcccccccccccaccccaccacaccccttcccccctctcgtccttctccgtgcacacagtaaggctaggtgatctataaatacacaagatttgattccct

SEQ ID NO: 105092 - DNA, 750 bp, Oryza sativa
tgtgctaagttgagaagaatgtgatggataatattaatctcattacatttttaaagattttgcatcaaaaatgtttaaaggagtgtattttttcgtaagaagccatggatatttgtaatctctttatttgtgaggtattattgatggagtcgctagacagttagagtttgacctttattcaaggtattcatattagctccattttgatgttctttggttatatatagaagatgttcaatgtttattttatcagaagatatatggtttaaaaatatataaatagaaaacacatcttaagggcctacaccatcaagctcgccctagggcccttgaaataccccttagttgccaaagctgtgaatgcaaaaaaaaaagggctttctcacaatctcaccaacggcaaaaactgatcttgcgctaaattttttgaagatggcatgataacattctattgccatccggccaacactttgatgacataacgcattataaactcttcacagcaaagacgtgacctaggacaccccatcatagtcatcacaagtgagtggaatgtatttatgtaatgtaaattaggattattcattcatgctttgaagctataaatatagccattgtgatgttaaacattcagaccatacctccttcagagcatctgctaaggtgagtttctatgtattagagattctgctacatacccttccttgttttcatgttccctttgtaccacttaataagggctgcaggaat

SEQ ID NO: 105093 - DNA, 558 bp, Oryza sativa
tatgtttgcatgatattatgaatctcttggatatatgttgtggattacggattatagtcggtaaaagtaaaatcacaaacgttcttatctgacactattggctatatgtttaatcaaacagacattgcaagtgatgtcgatgccgagcaactcctggactccaagcctccaattctgtccagtccatacaagtgtatggcagcaaacagcaggtccagcttgaagacatatggttattctgaattattcttagaaataagataggaatcatttcactctaaaaaggacaacttgaacttgaagtgtgaacactagaaattgcagaccatgagaacacataacaaaaagtgtaaatttagctaaaaaagttaatatcacctattttatgtcattgggctggtggttaaagttaaaaacacggtgcagatcttttcttctgctggttatttggatcctaacttcatgttcttttgtagttaagtcaaattggccaatgtactgcttaagctttgcatatggtatggtttgatggcatttgatcgttaaatgcttcatgaa

SEQ ID NO: 105094 - DNA, 1363 bp, Oryza sativa
tcaccgtcttccacaaaggctcccgctgtgccccctgcagcttctttacctcactcatgctcatgctgctcctccacgtcctctacctgtcctaatccccttcgtcgctgcattgggttcctccaacccacttgctctcttttgcatgcctctaacaattggtcaacccaacccttccttccatttcaccttattgggttggtgggcaacgctgaccacctcctcctgagtcattgttgccgttgtggagctttgagggaggagagcgttcgatggcggcgatgagcttttttcaccgtcagctgcataggaagaaaagtccttgtcatccccggatcccagcaggggtggagcttgagctagccagccactgtgtccatgggaaggtgcttaagtgctaattaactgcatcggcgagggcggcggcgtgtggagaaagcgccatcggccaatctttcctcgccaaatctggaggttctggcaaagaggagtgcgggtctgcatgctagtagtgcggttaagatgagctccgaggctagcacacccacgccgccagctttagggagaagcatgtggtgacggatgagatgctgatgagggaagaggagttacagtgataaggtgtgactctggacaacatgtgatgttaagtggggcttcaatagacagcagcagagtaggtgttgtacgtcaaatccatctcgctcacactcctcatcggtgccttcctcccaccgatctagcattcacacttctcactagcaacccggatgtctgagtttgccaagctcctctcaacgaggtctcaattccggatgtggacaccctccacgctgccctacggtggccatcccccttcgcgagcctttaattgccatcgccatcactcggcctagttaggccaatgggagttcgtaagatgagggaagtggaaaaaccgattgggagggtttaactgacttgttttgtctaaatataataggttgtaagcgctatgtatgtgccatgtcagtatagatgcaccaagtcattgtgccacgtcgggtgaaactgcacgcaaaaccattgggggtgcatttacattggatttaatacttggggatacaatatactcagttttacagttgatgatacaaattttaatggacttggtcccgttcttttctccaataagagttggataaagattaagagtttcgtgctacgcttttcaaactgttaaacggtacgtttattgcgaaaatttctatataaaagttgctctaaaatatcatattaatctaatttccaagtttgtaataattaaaactcattcaatcatacgttaataccaccctgttttatgtaaaaaacttaatcttca

SEQ ID NO: 105095 - DNA, 743 bp, Oryza sativa
gcgcgccttttggcgcgctatgtttctagtatgacagagttgatgtgcacatctctttcatgaaaagatgtacagagaatgtggatgttactagtagctactagtatctgctattcaaacaggtgcaattgcatatggcaaaatcaagactgttcattacagatcatgtttcaggcctactgtcaacagctgggcagttaagtatttaactatttgctgcttttagatgtgacgtttaacaatttgttacaatttgctactaatacgtttataacatgtgggtccttgtgtctataatatgttaaatatctcgtcagcaaaaggcaggccatgtatgtgttgtttgcaatccaggaatgcaggtgataaaaacctcttgtttccccatattgattgatgctattcctgcattgccatcccaataattcatcaagatatgctccttttagcctcaattagctgattctgttacgatccatgctataactgcacctaggcatcccagcctcatctttacattacctgtaaatgtaaaatatatcttcctagtaagtatcatgtatgtacatgcagcccataccagaagttcatgaaagttgcataataggagcatctggatttggagtctttcgcaaaatacggcgaaatctaaagtcacaactgaatcaatcctgcaaaatgtcgacaagattaggggaatatttttccatcacatgctgtgatccggtggatgcgggctgcag

SEQ ID NO: 105096 - DNA, 1484 bp, Oryza sativa
ctgcagccctaataggtttatagctcaagctttgccatatttggtttatttgatctgataaagaatgaaatagagatgggtgcctcagaaagaaccttaatgtttgtcttcagatgcatgatttgtatttcagaactgctcagctaaaatgtgccttggcatgtgttcaaaactttcaagtagtggctttaggcacaagtaggccgaaactctgttgaattttcctatatctgcaatgctaacacagcgataatatcctaatcaacacatttgttcaatgttcgtgagttatcaccttttggtctacattgtctcaagtagtactaacgcagtgattcattatcagaaataatacgtatgctatacgagagccgtgacccgcgtgagattcggtgaccgggttgaggcggagcgagggaaagaaaagaaaagcaatagcgccgtcggactcggcgatcgacggctcacattcgtgtgcgtcaggattggcttcaccgccaccactacgaacttttttaagtagtagagataataagtgctttgggtaagcacatgaatagacgaaaaaaatggacagtgattatttatccaccgacacatatgtacaaattaaattggctctaaccgttgcaacgcacgggcatcttttcccgtaaagagaaaaacgtacccacgacatcagtttcctaatataagaatggttgtatctagttgggactctaggtcatgccataaaacacaagacaacgttgcgactgagtcctactctctctggtcgaatatatatggaaaccgtgtgtacccggtacccagattctgcacaaatcttgttcttaagactggatagaaagagactcttgtatacagtcatcaactggtaaataagatctgcatgcatatttctgtgggatgctaaccgcggcgagccgccgccgatttccttccctttcagtagaaagagttattatttaattaattttcaatcgttaatacacctaagaactacagtccaggcaataagacaaacaaccgaagatgctaatgcaatacagtaatacgttttgcacgcgttttccattaaacttcgatcctattggaccattcgctatgaagcaatcaactaatccaccaatccacacggtcggctgcccgcctaagtgcattaaattaattaagatcatttcaacggattagcaacgtacgggcgccttcatataattaattttacgcgcattccatcgcctatatatagtcgtattcatgtaaacactccagcaaacgccatgttagctacaccgtacacacagcctgctcgctaacacacaaggtttggtaaatttttttaccattttcattccagtggcgtgcaatcaccctgccaacgcaatgtcgccatttcttttttttttcttttttttagagatgagtatttcttacccagcctatatatccaaacttagcttttgaaacaaaccaatcaaaaa

SEQ ID NO: 105097 - DNA, 516 bp, Oryza sativa
tatatatatatatatatatatatatatatatatatatatatatatatatatatatatatatatatatatatatatatatacaaacacacatatatatgtatgtatacatatatatatatatatatatatgtatatatatatatatatatgtatatatatatgtatatatggttcaacacatatgtatatacatgcataatatatatgtatttatacatatatatgttatgcaaatgcatatgtatatagatatatatatgaccaaaatatatttacattatagaaaatgtgtacacatgcatgtagaaacatatgtagtcatgtattaattacaatccattatatgtcctagctagttacgatttgacgtagtagtagtcgctgctagctcagaagctaaggaccggtgaattgtgtttccgtcgtagtagaattcacccttgggatcaaggatttcttcgttgatgaatcccatgagttgttcttgaaccgctgcgataaattccttgtgtgtgg

SEQ ID NO: 105098 - DNA, 4961 bp, Oryza sativa
tgcagcaatcattggaaattaacaacctagacaccgcctctatacaattaattactacttttgtgtttgtaactcaccaaagtaatcactatttataaatgagcaatagttaacaatgatctagtacgctaataggaactaacttagaggtaattctcacaagtatatcttaattactcagaaaagatatttctattaaagtagagtaattaacaaggtacaaaaagcaaagaggaaaataccgacaactccagaatttctctgactatttctccttactctcttcctaatctagtgtacgtaaaaatacaatagagccccttgtaattcatctcgaatttggtgtgtgtcagaatggagaacgagagctccgtttataggctgataatgtggcttgtagcggttggaattgttctaaatgcaccgtaaccatcattgggaggtaatcctggacgtccacgtggaagcagatggcgaggaggcatgatggcggtttggctgatcctagggtttggccgaaccctcgcgtacccctcagcctgtgggcttcctcctgggcctagatgtttgtctcctaagcccaatggtgtgttgattgggcccactttctgatgtctcgatgagttgatgagcccaaatcatcgatggatttttgtttgtattttctctcaactttggtggtttattacatgcatacaattattcaacaacactcgtggaaattgttcgaattaagtcgtaccactatattggatgttttataacttctgatttatgcacgtattgacggcataaaaatggcatttaacagccgccaacaaaccaagagaggagacatgtgatttgtttcccgaagttcggatccacggattctacgtctctgttgaggggccacaaaggctaggtctatttcaaccctttcctcacgaggttgcacaaatgcacttctcgatttcactcttgatttcttcctttgcggaaacgaaatcaaaacattcacaaactttctgagtcacaccacaatcttgggtgctcaccggcgaagcctagccatctaggaaaactcagttcccaaaaataacaaacacaatcgaacatttgcttgctatgaaatcgagtgctcaaagtatggagtaaagctcaatagctctcaatttctcaatctttcaatccaactctctcctcttctcaaatccctctcacaaagtgacaccacaaaggtaaggaaatgatgaaggctatttggttttggatgtgtctaatgtttcgcaagaacatcagccactcaataaggggatgaaggggtttatatacctgagcacctcaaaattagccgtttgagacaaaaattccattactggaagttccgagatgcattttcagacaagtctataaccttttgagacaaagattccattttttgcaagttccgaaattacaaaaaaccccagagagcgaaacacccataactttttgctcggaagtccgtttttgatgatcctgaactctatgaaaagcttactcagataactatccaactcatccaaaaggaaggtctataaccactcaaaggataggttaaaacttgggtttcactcaaggtagcagtaggataggtcactttgagtaccgagtcaaacacaaacacattgaagttgcttccctattaataatacgacattcctatacacaaatataaacaggaaacaaattataccaataagaatgccttcatgccatcttcctttatttgtcttaagagataccaacgtcaaaacagtttcatcatatattcttcaaagattgatgagggctccttgtagctttatatggcctcgcacggtccatcacgactaatatgatccgttgtcaaacgcagcctattgttgacgttttttatggccaacacgagatcacctaacgatttgcggtgtaatcaatagagtcgccagaatcgatagatcaaaatcggctagtggaaccgatttcgagattaattcactttcgtggaatcacatgactaatttacgagcaaattagtaaagaagataatatcgtacttacataacgacgaacgactagtttccgagcaaactagcaaaggataacctcctcgctttcgtggagaagcatgaccgtttttcagcgcaaaacagcaaagattaaccaaattctagggttcctgaactcagccatgaaagtaaaatagaaaataacggaaaagtaaagaacaagaagaatagtagattgaaattgtgttcggggttctaatatgatctaataccctggtatatatatagagagaagacctaagcaccggacctacaagccccacgtatgggaactcaagtgaattaactaatacgatttaatctaaattaattaactaccaaaatatcctctcttccttcgccgcaacagacgctgtgcatggcaacgtgtcctcgactcggtcatccggttctctgcagcgtgggtcatgcgccagcctcccatggcacggcttctgcaagcaagaagggataaaattccagcaggctaggcagcagccaatcagctgctccaccacgatacatcaagcttcacaccaaatttcttctccacactgaaattcctcgactgcagcaaaatccagcaaaacagaacagcacatggtttcttttactgcagtgacatgaaactcagatgatccaatcccagctgatatttccagtaaaccaatcaaaaatacaccagctattccaaataattggcctatgcaaataaaactagctataagccaaattataatgcaaacaccaacatgatccgttcttaaacgcagcctacgataaatgctcgcgtgatgcatgggctaccatacttgtttatcctaacattgttaatcagacctcaaaagtcatcgtcttgtcaatcatttttggtgagaagtaggatttgcacggtttggagaaagtaactcatgattttttttcaggaaacatagaatcgtcaactggcttggatcgacaaatatcccgtggcacgacctaaagtagatttattatcagtactactatgttttttttccaatcacgtgggagacatggaattttctaattaatccatgcaaatcgtacaaaaaaagttgtagccaagttagaatacctgtttttttctttttacgatttacatggatttattagctcgtgtggtattctaactctttctgatgatgtttgaactccctcgtagagcatagtatatggttactatgtattacggttcaatttcaactcagtgacttgatagttatcagaaaaataaattgtacatctcaaagtgaggcggaagagactaccgattgggcgcccgatccaggcgtggaaaaatagggcgttgacgttagcatgcatgcatacgtgcaaaaccactttaaactattttttctcttaaattacttatccaaatcatgatctgattgcaccattaaattcattgcaattaaatctttaaacaagaccacacatggatatattccgtcgaaatttttttagcttattattgaattatttttaaatgttgcacgatgttccaccaagtatatcggaattgtttcgctaagtagatcgaaaatatttcaatcgtttaaatcaggtgttgtttcaccttatataaaaacaatatttcagcaaatagtgaaagaatgttttagttcactgcaacattatatctgtatataatgaaacattgtgagtacactaggtgaaacatttttggtgggaaaaaaataaaaagaattcccttaatagagggttttcaaaatatgtgggtgatctgttgcaaaagaatatttcagttcactgcaatattagatatatacatagtgaaacattatgagtaggtgaaacatttttgctggaacaaacaaatgaaacggattctcttaatagagggtttccaaatatgtgggtgatttgttgcaacggcacgttacataatatcgcaatccactgcaacatttgatccgtacatagtgaaacatcataagtacactagctgaaacatcataaaactactggttgtaacatcaaaagagaccatatgcaacattcaaaaaatatcaataaaaaagctaaaatatttttttgtcgaaatataattatgtgtggtcttgttataaagatttaattataacaaatttagtggtgtaattatatcgtagattagataaatagtttacgagaaaaaatcttttgaagaaataagagatgggagcatgtgaggagagattctttgcatgcagtggcaggtacacccatcgtctgattttactcccctcccgtcgggtgcccgacgaccagcattatcgaagtgaggctgacaaaatatataccactcctatttgtcggctaacaagagcaaaacccaggacgacggcgatctaatgttggtccacgagtaccacctctggctcctcccctccttcctccacatcggctgcccgtgctcctcgttcttcactgcaatggagagatggaaaagtatgaagataagggagggtggaaggaagaaaataaatctgacgggtgggtctctcatacagatggagaagaagatggaaaccgtgacggtgatagcaatagttctaattttacgtataatcaaatagtatggatacgaatagacgtatgtaataatatttatctaaaatgacacatttcgaatgacactgattaaattaacccaacaattgaaacacaccggccacttctatttgttggttggagaagataaatatttcgttgtcaacattcgcagtcaacaatttgaatgaagaccccgttaattcagaccaggcatcatacgatcctcactagcttaactatctctgtcaatcgtttactacacagctactgcctccgtcccaatgtaaatatatagttgtggattttcgtgtcaacgtttgactgtcggtttta

SEQ ID NO: 105099 - DNA, 733 bp, Oryza sativa
catatcttgagttattttgataatgttggtgcttaccaagcactacaggaaacagatattacgattatgatgcagtatgaatatgtatcaattatgcggatacatagattgaaatagctacataattaaaacatgtgaaccaatgatcacttcagtatttccaaatacttgtactggtagtgatatggtagtgatcacttttaactaggaattgtgccgtctatagggcttctgatttattctccatttagattgaagccaatttgaatattgaatatccattagcaagaaagggggtagcatgtgaatcagggattgagcttggctgcagtaccatatatagctatgtgtatgcttgtaagagccactataattagcccacgcactgatgctataagaataactgacatacttcaattctacatgcttaactccagtagacaatgcaaagacaccaaacaaggctggaattctcttgtggagcatcaaagtggcgtcctagtcctaacactgacaccaccaatgtagaaacaacctaaattgcttagagtaatcatttcaataatcatcatttcaacaggacataatcgcttttaccatcaaaaccaacagcatttctagaccaccgtcgccctacctagcatcaaaagcgaggcactagcttaattaaattgcagatgcacccggtaggtggacttactaccaaactaagaaaatgaatatgcagcagcag

SEQ ID NO: 105100 - DNA, 791 bp, Oryza sativa
cgaggtgtgtgcatgactaaactacttgcctgagtttgcatggtcaaagcaccttcctccggtacaatctgcatggagatggaggagaaatcgacaatcatatgtgaccatgccactgcccccgagatttcaaaatatacatcatgctggcggcaagtacacttaggtatgtgaaagataagacaaggttcaccattccttttactcatacttatcttcatttgaatgagacttgatcctacatggttatgtttcttttgtctatttgcatatgctctattttgggtgttcgtgcaagacatctataggctttttaaattaagcatggtgcttaggtcaaaatagtctactttaatcaaattggacataaagtttagtttgactaatgaatttcagagttaatatgttcatggacattggatatatatcttctgtggactaatccctacaggaaagtttttgttggtatttcttacaaccacagataagtccggaaacccacggaataccgctgtagcacttcaccttcgggtgacccctaaaggatatcgaactcagggaacgtgtgtaatctacctaaggctaagacgatccaaggacaacaactataggtaggcaggctacagagaactttctatgtattttaattacctaagctaagttgaaggtaatttcctatctgttgcttcgggcaccgacctctgctggtctaccagcgtggttccggctatagctctatgatgcatccgaacgtggaggatttctgggacagaattcagggctgtcaccac

SEQ ID NO: 105101 - DNA, 2189 bp, Oryza sativa
tgttcttttgctgaaatatctatgaaatgcctgaactgatttggcctatgtcatattgagctgaaatttgctgagttttgttgatttggcctatgtcattgagctgaaatttgctgagtttttttcaacaaaattggcacctgctatgttggtctgaaaatattgccttacaatgatgtcagattaattggttcattctacaattttatcatatgtggcctattgcacaattgatttgctcaaatttgtatcaaactaatcatttctttattacctacccattttcataatctaccatttcagagttcaaataacacacaaaatttgattcagaccatttcatcattcagctgcacaaatcctactcaaaattgcatcaccctattccatccattataccatttgttttcaacatccaactttccacaattcatccaacaaaaaccacaaacttagcacaattccattctagattccattacacaataccaaccaagttccattccataactgacaacattacattccactgcgactaaaaagatgccagattcatttcctacccatcaacatagcaaacacaacaacaaccagtcctaaatctaccaacaacatcacacatatctcaaactttaacctactattcctatccttcaacacccctaccacagcttccttctcaccaacaaccttcctcgatgtggccaactcattcctagctaaaaccagctctgattgcacacatcttccttcttcaacagcagccgaaaaatctcccttctccctcctcagcttccacacttcgtcgcgcaaatcgttcaacacttctctaacgaaactgttcgacggaccatcaacccaagcaaaataatcgcaacatccactctgcaacagtgaaccaatttaaccctagaactcagctcaacaaaatcatggaccccttgaaccctagaacttagctcaaaaaactcacccttgcattcacacatttgaagtaccggcacccgggattgtctgggatccacgaaatccacctcgccgccttgttgctgtacctgcataccaccgctggctcatactccaaagggccaacccgatacgggatgggggaggcagatgtgcgcctagaagacgccgacgagccctcactcctcgagctcgccattcaccgccactcatcgcgctagaaacttcgccgccgtcaaccgcgccgccactgtaaccccccgcgtcgtacccctctccgccgccgccacaacctactcgtagcaacaatggggaacgaacgagcgacagagataactctagaagagcccccgctatttattcccaactaccgtcgctgagtcagcgatgttgaccaagtcaagcagccacgtcagcgaaaactgcacgcaaaacagccatgggagtcagtttgctcgggatttcaaagtttaggggtcaagatatctggttttgcggcaaagggtcacgatttagatccggatcacttttgagggtcacgaatgaacttattcctactagaaaatctgtgcgcctattatcacacccactatatagcctgtttatttgtttatccatgtgcctattagtttattgcatatactttcccaccatttagtacataggattccatatttaaaatatatttttgaccttcatgaggccaaacaaaaatgatcatccccttattttctctcaacttgggtgattgtatgattttgcagatattttctctgtagtaagtcgtgccatactccttgctcaatgatcaatttaagaagacatttgcttaacattctggatttctatattatgcaccccaagtccatcatggtcattttcaataaatctatgcatagtagtttgacacaacttcagatctacatcatgctagtcttgatgactgaatgttaaattataggggtttgaaattttatatttaatttaacacagaaaaatgattcatataaatgttattaacatatccatatatttgtgagcctaaaagtacctacctttgatcgagttgtgtcaaacaagacctaagtaaactctgtcgacgggggatacccgtagaccggatatagagggtattggggtccgttggtacgaggatctacgtagtacgacattcaagcaaacagaagacaaggattatactggttcaggccccttagtactta

SEQ ID NO: 105102 - DNA, 745 bp, Oryza sativa
tcttgaaccccatctggtctagttgtctctcgatcccgcctatcaaagggcacgttgctcttcgctttcattgtgtacctctttaggatgtagacagcgggtatcttctcaacttgtacatgaacaaatgcccggagcatgtgtgtgcagaacatgcctaaattacatccaaaaaaaggagagagcatttaaaccaaagtattgcgatgtgtgataacggaatgctgaaaatgttaaacgtacataaaacatcgatatcgagtttatactataaaaatacctgtatgctcccactgtttgcacttgcatgtaaataccccttcatcgacatctgcaataaccttgaattgcttctgacactagttgtgtttttcggaatgtttggtgtgtgacactgctgtcagggttatggataccacatacctagcagtagttgactaaatctcggcaggacccaccacataccatgtcttatacggaaacaaccttcggatataggaggagttccgcataaggaaggatgactagagttctacatggaaacgataaggactactcggattgtatccatattggtttccctagttctacttggacaaggggacacctaggggtataaatacaaggccccctaggaggagaggggacacggaacaatagatcaataaacaagaacaacatacaagccaacatatgccaagacaagacgcggatatcgattccagagataagcctaggaaaaccc

SEQ ID NO: 105103 - DNA, 638 bp, Oryza sativa
atgggcgaaactatgtcattcttattgacacaagggggttaattattataccaattttaaataagaaataaccataaatatatccatatatccatcacgaccataaacaggtccataaaaccaaacacatgaactctatcatgtgtaccacccgctcacatgcggtgtcaacaattcttagcatatagccataaatagttccataagcatgttttcataagcaataataatatccatattaaatcaatagcatgttaaataattaacagtttgtttaagtgtttctcaaatcttgtcctaagcttatttgactctaaggctcattaaggtatttataacaacaacagaaaatataatgcaataatagcaatataattaacttaaaagaattcgtgcagtctatcgtactccaaagggcaagtacgctactaaaataactctctatctactgggattaaattgttcaagtgagggtgcatgtcttgcaaccttcgagctcgatgtagtcgtacaaatcgtcttctcctagcgcgaagatttcacttgctccaacgtcagcgttttctatttacgcaacaatcatcaccacaataaataaagaaaaacaaagattacccaaaggaaatattatcacaaag

SEQ ID NO: 105104 - DNA, 1539 bp, Oryza sativa
ttttgagatgggtgaccgaccgggaagatgtaagcctccatatttagccccggttccttggtaattcatatttagccccggttccctggtaattccctgggttctactctcaggtgaaatgctacaatggtatatccattgctgggaattatatttctagtaatgtgatagaaaatagggggttctactctcaggtgaaatgctacaatggtatatccattgctgggaattatatttctagtaatgtgatagaaaatagggaaaaaggttgtgtgccactctacccttggattatcttaacccctacttagaatatgattatcacaagcaatgtataaattattagtccagttctctctacatgatcttcccatatatccgtgcgcttgtatttctgcgccattgctgggaattatatttctagtaatatgacgcgtcacgtggagtcacagaaaatagggaaaaaggtgcagaatctgtgagtcgaactcaaaacctcctggtttccgcgagagcctcaaccaccaggctatgccacaagctgtgaaacacatgtaactcacatctatttgaaccgtttttaaccggcggtttgaccggtccaactaataaaccagtgaaccgagtgccttaacggttcaatcaccagtctggtcttaataactatgaacagaacttgttgtagcagtggctggtgccttccttttttttgctctacacaaaactctatggagtgtttgatagtgtcgaaacaatattttggcaatattaaaagggggtggcaatcaagctagaaaagtggatgggttagaagacacaagatttatacaggttcataccttctagatgaaaagtaataccctactcctgtccggggattgattcgccgagtgtattattgatcgtatgatcagagagaaaagttatgcctctagaggctcccggacccctccttatatagggggaggagccggaattacaagatacaacccatgttcctaacggactaggcatgtaaagataaattataatcgtaaccgatcaggactatcgggtatttccttgatacacaagttaacataacaatcgagtcctttactagatatattctatctgtatatggtacccccatacctaatcgaatatccacgccatgtgggtatggggtatccataatctccacagatagcaccaagttgttatcttgctgtggggctgtgttggtactacctcttgcaactgcatggtgcctattacaagaggttttgttgtgaccaacttgtttgcatttcttgcatctcattacagtgcccatcctagatgcctttgttggttttgcaggttcattggcctctcttcttgtctctgtccttggtcttccaggcattttgacatagccaggagctttcaaagcctctctgtcatcttcagggcagctgttcatgccctcaactggcagtaggcaatgctcatatgtcttctagaatgcatctactgaatagcattcagctatgtatgcatccagtgaattggtcttga

SEQ ID NO: 105105 - DNA, 1132 bp, Oryza sativa
gaatgcaagaccaaaactccaaatgcacaaagaactcgagcctaggcatgcattatgtacatgtatgcttgatgacatttctagtctaatgttgggaatgaaaagattttattttgttctcaaattataatcatgcaatggtttaagttggtcatcacctaaattaaaacggaaatttttggctctaaaaattggagaagttaacctctaactattttgacaagaaatttttaagtcctaaaatttcgggtatgttacagtctatcccccttaaaataaatctcgtccccgagatttgggtagggttggcttaagttatgactatctccagaggattgacattgacagcagataataatttcttttaagttgtatgacagacttgctaccataaaacatttggaaacttttatttcgcgggtgagtggcaagttctactcagttgtgggtttatggaagcttagatagttagttaaattgacactagagaagttagttccaacaagataaatgttggttcatattaacaggagcttataaccagatttctaacttagatgaacttatgtttacagattttccaaagttctggacagcaagcacagaggtttctaaattaaggacaaacgagttcttagttactattacatccatccaacaagttcttacataaatggagtacatggcagccatattacatatattacataccatgattttcttccagaatgggccaccacatacctagactattccttaagcttgtccttaagtcatgccaccgtggcagtagaggttagataggactattgattaatctctcatccttagctttaagactcgaccataccattggacatactctggcggtccatacggtccagtagttccgagtggaggataagcagtcctgacatcgacgcgcgaaggtgggtttctttcaatatacattccaacaggtggtggtatatcttctgctggtgcaagcatggcatcctcaccaaacatgaactccggtgtataatgtccttggcgataccttggcataatgcttctttctaaagtggctaccccggtgcggacgcgttgcagctcagcaaaggttgagcgataaagcatatctagtgagcgc

SEQ ID NO: 105106 - DNA, 769 bp, Oryza sativa
tggatccccccatttttgcgcacccaccaaatggtcacccatcctgaaattgctccaggacaagcacgcttaacctcagtgttctttcgagatcgatttccggaaaagaagttgcaacttgttgatatgagtattctattaatcctattaagccctaggccgggatgtcacatcctcaccccgggatgtcacatggtgccccacgaatacgtaactgcccaggatgttgatgttcagttacgcatcaaatgatataaaagcataaacttcgattatacaatacttaagtcacttagttcataacacaacataaatacaaaccattatatatatggcttataaagccttatttctacaaacagataaactgctagactccaccacaggaactgcctgagcgtaggatgacctagaaaccatagctgtcccactctaacggatcaacaggttctccacaagcatcttcctcctcatgatctgaacccatttatgagtacaaaaggtactcagcaagacatgcttatgataataaatacaataattgcaatataaaacatgcagtatcgagagctggaaggtttaaaccctaaccttaacagttatttcatatagcctaacataataaacatttgatctaaacaacactattgaacatttaatttaaacaataataacgagcataacaatataaatgttacttataaataacttgaatagaacattaaacaataaataagttaaccatattaattaatagccatttagttta

SEQ ID NO: 105107 - DNA, 688 bp, Oryza sativa
tatcggatgaactcgagtgatttgatcaagtatgtaagttgaaaaataacttcggttttggtgtcgctcgtgcgcaaagacgctatgggtttttaattttagtttctagaaccacattgatcaaactgaacatacgacgatggatagtgagaatggatataattaaataaggatggaactagtcactgttgaatttaaaatacagattcatagatgaaaaaaaaagacaagtatcatatagactgtgttatataaaattggagtgtctatactgtaatcgtgcggaaccgttttcataactcccgaaatcatcgtctgcatttgtttgatcgtcatctgtatacccagcagattcagctgcatcttcagctcactcgtcgtctaaacatcttcgcagtgatggacccttcctgcttgatctccttgttgttctagggactgcagtactaactttgcatccaacattggtaccacgtcctctacccctgccggatccgcgtggcctgcccctctttcccttacccctattagcagccttcatcaccttgtcgaaatttgctgggtttgtcgggcatgtatttgcgtaatgcccatccctcagatggcaccacccacattcccgtgtgcacaactttttgcccttggctccaagttgaacttcctcatccgggtcataggtccttccttt

SEQ ID NO: 105108 - DNA, 667 bp, Oryza sativa
tcatagcatattggaatgatgagaacttttgattcaaaacggaacttccggtatgggattcgaagttccggtctcaaccgaaaagttaggcggataacggaataaaacactagctataaacttgtacctcaaacaaagaaaatgtatatgaattaaaaggtgacaaataaggtatctaaggaagatataaagttaccaactaaatcaattaagcatgcaagtagatcgggtaaaaacaacctcaagcataatgtgagagaatgcaagaatgggcaaatcaagagaggagacgcgtgatttgtttcccaaagtttggatccacggatcctacgtctctgttgaggagccacaagggccgggcctatttcaaccctttcctcacgaggttgcacaaatgcattcctcggtttcactcttgatttctttccttgcagaggcgaaatcgaagccttcacagactttctgtggcacaccacaaccttgggtgctcaccggcaacgcctagccgtctaggagaccttagtccccaagagtaacaaacacaatcgaagatttgcctgctatgaacttgagtgctcaaagtatggagtgaaactcactagctctcaacttctcaatctctcaatccaactctctccccttctcaaatccctttcacaaagaggca

SEQ ID NO: 105109 - DNA, 686 bp, Oryza sativa
catttggcccctttcaagtcttgcaaaaattggcactgtggcctatggctgcaattaccagcttctgctcggatccatcctatatttcatgtttcccaactgaagggcgccaagggtttttctcatccggttcagactgagttgccgactgacttcactcggtttcagattccccagcaattccttaattacagagtgactaaaaaacataattctgctactattcaattactaacccattggtcagggggtgcagtggaggacgcaacctgggaggacatgcaggatatacactacaggtttccacaggcacaggcttgggggcaagccggttttcaagattgagggcttgtcaggcctacctcgatgctgccaagggactccaagagcaagaagcctgacgtccgtgtacaagatggagaaatccacaaggaagcggaggtagctgatcgggagcgcgacgccaagatgatggaaggagatgctgatgaagcagagaagaatggtggcgctgagaagagggtgccggattccttggcccaaaaaccagaaggcccaactcacgtttcgtcggcgagcaatggaccaagtgaagcccagtagcttagctccagctggcatgttgctagcgagagagagagagagagagaactgcgtgatctgctataatatactccgtataacag

SEQ ID NO: 105110 - DNA, 1528 bp, Oryza sativa
tgaacaggacatgtaaatatctattccagatccaccttccttcatattctgcacaagaaattcagataaaaatttttagaacattgatgttcagatctttctagttccagatttcatatcagtataggtaatggccctttcccaaatcaccaagaaagacttctccagaaaattatatcacttttctggactcgatttagtcaaatttacttatcactataaaacagaattgttatctattactagttaccatctaccaaaattaggacaccccgtagctagaattttccttcaacctgacacatatagcatttttagaacacaagatacatataaatcttttccggaataggaacaagttagtatagcaaatccaaatcaacatgatccatcaaatactatacatacactaggtcaataagtgaagcatggtaatttctgacattgcttaaaaaatatgtggattggaatttaaacaaaactaatatttattttcatgagaacatgcatgttttcatatttcagatttctaaacatgctcagtgctaacaaataaattatcatctttaacaaatgtaaaaaaactatagtataagactaaaataagaacttcaaatgccagcctgaccaaataatatagatgaaatatgtctgaattaagactttgtagtacctaaccaaaggaagatcagccagacaaaaactaattcatattttagaaggttacaaaactaatagaactattttaggaggttacaaaactaattaagttgaacatattagtgaacattttagaatatatgagctaacagtgtggtgacaaaactaagtacttttagcttacaaaacaaaacaaagcaaaataaacaaaaggataaaataatgcagctcctaaatattacacacaaaacgaacaaaagtgtgcttttagtactcaaaagacaagaagtttgcagctagactatgactaggccagcaagcaaccgtcgagctaacctacaaagcaaccatcgggcaaaataccaaactacaaatgggacacacaaccttctcgttgcaactttaaaaaaaacacaaaaatgttgcataactacatcaattaaatttggtgaccaaaacaaagagaatagtgaaaggagaaaattacaaacaatgcattctaataaaacagggtactattagtaggcttgctaacaaattacacaaaactaagtataattagtaggttaatcagtaggaggtactgtccatttacacaaaacaaagtacaattggtagcaaacaaaactgtcttattagtatcttcattgctaacaaaattgacaaaactaggtacacttcaccaactacctaaaaagccataaattagaattgacgaccattctttagaacttcgtttctatattatgattagtacaaaaggaaaaatataagataaaaattcagagaagatgtcaggacctataaaatttagagaagctgaaatgtggggtatatattctgcaaaccatgagatgcaagccgtgca

SEQ ID NO: 105111 - DNA, 717 bp, Oryza sativa
attcctgcagcccttgttatcttttataatatatgttgcaacgcacggcctttagcaagtttcctaaatgaatttacgtgtcacccgtattattgatggcatttcatcatgcgttgcacaagtagcagcataagtcggttgcaacctgtactgcagctatcggcctattcgcatttgttgaccaagtgggcatgcaaaatttcgcgttgctttctgggtgttttacagcgcggctccgtgtaccgcgcgaggaaagaaaaggtgggtgtgttccacttggtctgcaagggaggcagccgattggcagccaaaaggcgccacatgcgaccacagctgcacccacacacccaccttgctctttctcgcaagtgctggatcctctacaaccaccaccagaatgtgcagcaaccccagggtcaaacggcaatgtcaaaggctatgtgaactagaactacacgtcctgagatatttgatgacctcatgtgggattaatcttcgactgtttgttcgcggtaattgagagagtaaaggccatttgacgcagcttgtagtagaaaggaatgtataaaaatgttcatgtttttctcacttactctttccctccacgagattacggtagagaaacaacatgtttttaaaagattacgatagagaaacaacacggtttaaaagaaaaaatgaaaaaaaaaacttaaaaagaaaacgtgaccacaggtc

SEQ ID NO: 105112 - DNA, 651 bp, Oryza sativa
cactcaagacaagcgttgtccatcccaatacccaacttggatcgtcgtagcggtgtcggaaagcaaaagcgtagcacataaaaacgacactgccgctatgccacgatgttgttgctccgtgtatcattcatgttcatcaatatacttaaaaagcaagttgtggatactgttttcaaatcgggttgccgtcctcgacgacactgatggtgttgcatcaaggaaaccggaaaagtttccaagagcaaataattgtctgattgtctgctgctttctgggctttgcatcaggcatcatcaagtgaatagaagaactgatagtcgtagtagtatcctctatctcagaatatagcaacctaaaatcagatggaacgtattctaatactataaatctcgttttgtccgattctaaatttctataatctggaacggaggtaataatattttttcctctcttttccccgctttgggaaggttcaggctagatggagcccagcgaatttggcccggcaattccttctctaacaagcacgaatcatcatcgccatcatcgtccatcggctacgattagcgtcaggtcattagggcagaccggcagaatggaatctttggtctcttcccaatgcaatgctgctgctagctcccatggccatga

SEQ ID NO: 105113 - DNA, 1698 bp, Oryza sativa
ctttttcgtattataagtcattttgatttttctagttaaaattctttaggtttgatcaattttatataaaatttaataacatttacaacaccaaattagtttaattaaatattaaattgaataaattttgataatatgattgttttgtgttgaaaatattgctatatttttctataaacttgtcaaactataaaacttttttggttatcgtaatctaacaatttaaaaattattagtgctatttacttattgcctattagctctaggatacttagaccatgttttttttggaggattagttgcacgtaaaacgagaaaggtaattaactattaattattaaaaacttaaaaaaataaatttatttgatttttttaaaagtatcctctgtgtagaaagatttcgcatgaaacatattgtttagcagtttgaaaagagtagcagctaagctcagatagctctttagaacatggccttaaaaggcactcattttgtagagcatattttacctactaaaatatcatttccacttgagttttattgagaaaaaaactatagataatcttgaatttagtatagataagttggttatatatcttggggtggaacctgtttccttgggtggtttaagtctttgatcagtatttgtgcttgtatttatggcaaatattcttatagtgataaacgtgatgactttgtcaatttaagatatatggctaagtctcgagattttcataaagacaataatagtagggttcttggcaatgatgacccaagtaggacctcgccctttgagtttttgctttagcgtggggtagcaaacttgttggtcggcaaggcttccctgaccctggcgtttcctagaagatgcggttgcccatgatggtgtgatgacgataacattgcttatctacccatgcgggtgagccttatttgatcttctagcttgctacttggttttgcaaatcttgtagtgaatagcgtttgctaaatgttgaacctgactgttctgtttttttcgtagccttctagtttaggtttgcagttttttatccgttgtagtcatggttttttataattaactatgcgaaattgaacaacttcttctttatacaaaacatcgcaacaacctaaccattaaaaaaaacaataacgttagggtgcacgcgcgcatgtgtataattgtatgtttgtgctgtgtttgaacgaaatataaataggcgtttaactttggttcaacagcctcaaccggttcacacttcgggccttctccctccctcgccatgccagcagccttgccatcatttccccctcctcctatacccataatgagtccaccgactacacctcccgcattgataaagctcatgtgcaagtttggtcaggtttgagaccgtgcataccagcattgagagatcttcatcaaaactaataagtagcttgttcatctacctacaatctgaaatgaaccctgctatacatccgacgttcttgtaatctcaatacctccaatactaccaaacttgccagagttactagtaatctcagtgattgtgcaactgcacgacgatgcttacaccagagtgaatgacccaaaacatacagccttatctatcataataggcacagacgcaacacgcaaagccctattagctagcagcaaactggtaaagcagacaatgccattgcagcacacaact

SEQ ID NO: 105114 - DNA, 547 bp, Oryza sativa
ggacaacaacaggaaagtgcagaaaccgtatggctactttatggttatgatgcttgataggttcatggttacaaataactatcagcaccttgattttaatggttactatccataaatctgggtttatcaatgccaggagctcatttttattgaacttcaggctactgtatggtgaaagtagtcaaaagtaccatatgacttaaattctgaagtaatttgataactcaaaagtaaactgcccgagaaaaacataaccaaagtgaatagttcatgccaatgtccaatagaattagaaaaataatgtactaataccaagtatggaaataactggcatgtcaaactcacccatcagaatacttttgttccaattccttgtacgcctgctgaagaacttcccttccaggaatgatagtgctctagaaaatagcataggtattatcgattttcatttcattttgaagcatgttatactttcatttgatctttgagtaaaacatgtgggaaccataagtttttgtactaaacagcaataagccaataacagtac

SEQ ID NO: 105115 - DNA, 1093 bp, Oryza sativa
caagtacaccataagtccataactctgcagaccattgctatgtttagttcagcgtaaagtttgaattttggttgaaattagagataatgtgactgaaaagtaaagttgtgtgtgtatgacatgttaatgtgatggaaaaggactgaaagtttggatccaaactttggatctaaacacagcccatgcatctttctgaaagtttatctatcaaaattcaaagcaccagcctgcatggaaacaattcttcccctatctgttttatgaagttctcaacccccaatcagataagtgcctgtatatggtagatgcacacacatagaccattttatttctttgttatatggtagatgcagcacaatccaactatatttttttgggtattttttttttcattttcatgtatagttatgaaccaacttacatcccatctgtcggggttgaagctcaacggatcatcgtaatatttagggtcaacatgtagtgatcggatccacacaattactttccacccctctggtattgtataacctgcttgcatgcatacaattaaacaattttgagtgagaatttacttagtatctcgatcatgggttattctcgataattattcattagtaccattttccctctgctccagaaataattttggtagttttaattttctacagtctacaatacaaaattgtgattattcttgtagtttatataattgctgggtaagagtgcaaacatgctactagtatagattagaaatgatagtgtgaactgtgaagaccacgggtattggcgccacatgtcagtaacacattgatgttattttccactcatgtataattactatttcgattaatttgcccttacatgcaaccaacaaaaaaaaatatcataaaaatgcatattatggaggcgtttgataacacagagatccatttaactttttcttaattatgaccttagttttatgttaatgatgatcaaagtctctaaaaataatcattaaagtataatttattgatatcacctcggtactcgacatctctgagtgccacccggtaaagcatcggagatatgttggccaaccgaattgtttctt

SEQ ID NO: 105116 - DNA, 867 bp, Oryza sativa
aggtgaagatggtgaccggagaaggaggcgacgacgacgacgacggtgacctgatgagcgggctgatgcacgtggaggatgagcaaggtagacgactcgacgacgatgaggtcgtggataacatagtctcccttgtcatcgcgggctatgagtcaactgctagtgccatcatgtgggcgacctaccatctcgcaaaatcgcccagtgcccttgccaagctaagagtaagccaataatttactatagtatatttctctaaaagtgctttcaagtctcaaatggctctcacacatgaacagatcgatcccatatctggcatgttgctgtccgatgagcattcctacatatgaatggatcacttgatcacctgtgccatggccagaggcctaggattggcagcccattagtatggagaatttttaaccatataatcaccatgtaaatcccaactctctatgggccgacccaagccttgggccaatcctggtctgcccttagatcgatcccataactggtatgcttgctctccaatgagccctctcatcagtggcagattcaaaaaatttcttgaacctggacaagtctaacgagataaaagcatatacaaaatctatttaactatatataaattttgtagactaaaaccaacctgagaggttagatggattaatgtatcctgggctagacaagtatatttaactatacaaaaattttgtccttaataattgccatgtgttagcctagcaggatttgtactagtgtagcaggcggagcctgagcacctgcccatgatgatcgaccaggcttcatccctgcctctcatcatgcaaacaaacaaattatgtgagttgacatggagttggaatg

SEQ ID NO: 105117 - DNA, 789 bp, Oryza sativa
gtatgaaatttggggtggggtgggaggggaagtagtcaaatctaaaagaaattaaacatggccaaagccattgaatatgtataagtacacgaaacattcaaaccaaaattccctccgctcattcctggaatttaaaatttgtacatgaatatacacatttcttggataataattagaatgcacataaatctaaatatttttaagggctgttcactttgataccatttcaaaccatattaccatatattttttttaaagttgacaaaaatgtgcatatgtttggtttcttaccaaactttggtaaatataccaaaaatatggcaactgcacaataatgactaaaattgggtagcatgtatggttccaacaaagtgaacgcatccaaaatagctagctatcttgctaaaatttggcaatactgtcaatcttgataagatttattttggcatcaaagtgaacaaccccttaaccatccagaagcttgggaatggcatttaacgattcaagaattcaaattttaactaatggtgggaactaatgaaaatatttttttccttgctagctaacctataaaagtacttatattttacaacagaggaaatattttgtactcgctccgtcctaaatattcgacgccgttgactttttaaaacatatttgaccgttcctcttattaaaaacttttgtgaatattatttaaaaacttgagtagtagtagtatatttaacaatgaatcaaatgatggaaaataattaaaaattacttaaattttttaaataagacgaacgg

SEQ ID NO: 105118 - DNA, 1023 bp, Oryza sativa
atttgggtttctttaagtcacaaccaatttttaattttgtaacttatttttgaatattaagtttatataattttttagctttataacttaattttatttttttcactttgatcactcatttggctttaggattgctaaagatagagtataagatatttccctaaatttattctcatatcatagctttagtaacatatctttcatttataaattacagccaaaaaggctcgaacaagcaagcccgatgtttcctcgaacagtggcatgtatggatgcaactcgattagtaagctgggttaattacttgtcgaccatgtgcaagcagctggcattatatttgctgtaagatataaaaaaaagaagaaaagaagattcccagggagctgtaagtgcgcacattcccctgttgtttatcatggggtttagtgaactaaatccccaaaagatcaagagatgtcttaacaaatcggtgcgtggttttgttaacttaatcatggtgaggcttttggaagattcgtaagcatgtgagagtggttagctagtagggtggcatgttctctgttccccttcaaccacacaaggagggggagccccccctttgtatgatggttgcaatttaaaatccaaacaagttttgtttgtacaaaagggtcactagctaaaatggatgactaattaattagacaatataaagtatcgtatttttttataaccattcatcaaattcatcctacaagtgggcgtagttaattatattgaaaaatatgaggaagaaaaactttcttacgttccatttcctcttgtaaaaataatcagacagcacatctccagcctgtggtgaaaattctgcatgcatatgatgagcaaattgatgaacacaacaatcttatctgctagaaatgcaggcttgctgaatgctgatggcccaatggctctacctgctaccgttaatggtttctttagcccttaatttggaaggataggagtgttaagttaagaagatagtattagaacatatctttc

SEQ ID NO: 105119 - DNA, 4226 bp, Oryza sativa
atctaaccgtagttagtctccttaatttcgttcttagagcctgttcatattatagccaaaataaatcctaacaaatttagtaatattgctaaaattttgacaggatttttttatgtattactaaagtttggcaagaaactaaatagatgcacatatatatttgataactctaaaaagatagtataatttaaaatgacataaatatgaacgagcccttaatttccgtggatgcatttcgtagcttactagtgccaactaatcaatggcatcgttcatatatatatggacggctgcgatgatccgatcaaaccccgggaagcagcacgggaggtcgacacgtgtccccccaatccgccgcgcgcgccgctgcagcttagctgcaacccacccacccccatgtgcgcccgccgctcccgtccaagaagacggcgacgacgacggcggcggcgacccaccgcggcggcggtgaacgcgtcagcgggaagctcgccgccggccgccgtgcacggcggcggtgggcccgactaggtagctactgacctatagctagatatatagcttagctagccgagtaaagctaattagcatgcagctgtagcgtttgcatgcccatgtgttgtgtaggcaaactgtgtgcctttactcggctacagtgtcattggctttatctgagaagatgggagatttttttttctttaaaagaaaaattagctagcagcacacatataaagtctactccaactgtgttttactccctccgtcccaaaataagggtttgtttgaggagaagaagattagggagattgggaaaatacgcaaaacgagatgagccattagcgcatgattaattgagtattaactattttaaatttcaaaaatggattaatatgattttttaaagcaacttttctatagaaaatttttgcaaaaaacgcaccatttaatagtttgggaagcgtgcgcgtggaaaacgatgtgctttctcaccctatatcacacaaacgaacgcagcctaagtgtagttttagcactgttcatgtccaacgtttgaccattcgtcttatataaaaaaagattatgattagtatttttatttttattagatataaaacatgaatagtaatttatgtgtgactaatttttttaatatttctcataaaattttcaaataagatggatggtcaaaacgcttagcacgtatatgtatatgtatggacggaggtagtacatgcgagcgaattcgttggctgcacaggagcagatgaattgaatgaagttcagccagcgaggttaacaatgacgtacgtacggcttaattaactatgtgttcttgggatgttgtctcaattttaaagagcttctttatcttatgggataatttccaaaaaaaaatataatacaagtatggttgtgtacttcacatatgggataattttagtataataatctttttcaaagttgggataattatcgaggtcttttttgtaaaaaaataataaataattagtgattttcatctgtagtgtcaaacaatgtataccatttattcagtattataattaactaggtacctccaaacacatcgggatacaaagtgatgatgtaaaaatatagattaaaatgctgatgcatgtagtatctatcatctagtataatatgaatattgtaaagagtaatatcaaacctaacattttctttgttttcttgatctagaaatgatttcatagatatttaatactctaaaattctaagatctatgcagtcaagatatatggttagcggatgtgtcttacatttagtttctaggcacaattaggtccaatgtaatcgcctcctatcaatatcgaacgattgcgatcgatataaatattagtgattggccaattataagggttgacactacacaatgcattcctcttaattaataaaaaaaattaaggaaccgtaacgtaggctatttttatagatatgccattatattagactacacttccatcacttcttccttctctagtcaagttatatattgtactcgtgcaaccatttcttctagtccactgtgcttattagtgaaggcgaccaacactcttggacttgacaaataatgcagatatgcaaccaaagctatatacatcaattttttttacaacagcattttacttttacaatttctagcatgtaatttctcaatttttatatattaatcctatgtttccgcctaaagacataatactccaccaagaacataaagaacataacagattatataaactaataccaatattggtgaaagccagacaacttacttaatttgttttttcaaatggtacacacaattgcgatcgactgctatattaaagacttactagtgaatatcttctgcttatgcatgcaccagggcatcacatatttaaaaagacattgcaaactttatacagcacaatacaaaacaattgatgtcaaaatgtacatgatgaaaattgtgagctgattgtgcctatccctttccaagatggatgcatctagaagggccccaactgattggtatcttattatatagggtgtatttagttcccttcaaactttcaatttttccatcacatcaaatgtttggacaaatacatgtagcattaaatatggataaaaaaccaattgcacattttacatgtaaattgcgagacgaatcttttgagcctaattacgccatgatttgacaatgtggtgctacagtaaacatttgctaatgatggattaattaggcttaatagattcgtctcgcagttcacatgtcgaatctgtaatttgttttgttattagtttatgtttaatacttcaaatgcgtattcatatgcttaaaaaaattaaaatggaactaaatacggccataaccttgtagacatactagtatacatagcatttgccggtcttcaccgctgcattacaataataatatattgcatgccctgccacatcaaaatgagctcattctcctcctctccctagcttctcaccaatcaaccatagacctttactctcttttattttgatttaattttttgctgcggttaaacaactcaatcaactcgtcaccgtcatgcatgcgtcactagctagctcctgcttttgcatggtgccatttttttgttgcccaaaggagcacattctatgatcaaaccctaggtactaatacggcatgcatgtatgataaattttacttcaattaagagtttaaaggttgctatactatagcatagtcactttcatctcggccttataatttttttcacctggggttatctctataatgagcaaatgatcttacaccaaatctagctttttttgttctgtttttactttgacgacctagctagaagtacttaagtagaactgtcacaactgggcctttttttacaattaccccccttaaacattcccttaaattaatatatcactcctcttcctcaattcaaccccactatctatatatcctctcccattcccaagttcccatgcatgttcctacctatatgctcatctcactgacaagtatggcccacatttatttttgtcaataggaacaaaaagttgtagggtaaaaccgtaaaagaaaaccataaaaaaaaattaatcactgtctccttcctccaagtatatgtctctgctagcttgtgccctagccagtagtagtaaaaactatagaaattgactttagttataattacccccatgcatgcatgtacaacttaacaatgccgtaatttacaacaatggcgtcaccaaccagccacaaagcaagcaatcaagccagctaattaagcttagctgagctcactctctcgctagctagctaagctctagcttctaccaaccctcggcgccgtaccaggagaggccgccggcgtgctcgtcgccggcgaagaatccggcgcctccgaggtcggcgtcggccactgcgccggcgccgccgccgccgacgaggagttcttggtggccatcgaaatgcgatgacgcgtggaacatggaagggaaggagagggacgaggtgagcgtggtggatggcgcgaagaaggaggtgaaccccgccgtgtcgtagctcgccggagtttggtggtggtggtggtcgatggccgcgccggagtacggcgacgcctctcgttgaacaccgcgctcgagtcgctgtccgtcgagccgtccaccaccttgctgttatacgccagtggcggcgg

SEQ ID NO: 105120 - DNA, 1818 bp, Oryza sativa
ttttgaaacggagggagtatatgagaaggtactccatattaatgtttattaagagatgatgagagtgagattcgaacccgggctacgctagtccatcaacttgtgatatatagtcgataagatttgggctagtctctctcaatttaattttgaaccccttttccgttttaaaatatttcctatttatttttactggacatcgtcgatacattgtcttcgataatcacacacacacacagatatatatattctacacccgggatataaaatacctccccctcaatagcccaacccacctcccccttcttttattgggctcaaaacccacctcccaccctagtcaaagtatggtcaaaggacggtcaaatcgctgccacatcggtcaaacccatgtgctaacttcctcccacgtccacctatttgttatccttgtctcgtacgaacggtgcagtaacatgatgactatcatgcagtaacgttgtaccttacttgcagtaacactaataaaatatagttaaaatatagtcgtgacggatctaattttgtagagctcttttttttaaagcattacggtgcaaacagttcaaaaatataatatgtggtgtgagagatattattgtttaaagatgtgaattcaaaagatatcacttgcacttacattttactagttcaaagtgggtggtaggtcctgtacctgtgtttggttgttacctcctgttattgcagtaacgctattaagaaattgcagtaacatacactgttactgtaaaaattatagttgttactgcacacatacagtaacgtcataatggaatggtagtaacacacaataaaaagtagtaacaataatgatttagtattactacttatggagagataaatttcaaaagaccgatcttcgagaagaaatagtagtaacacactcgattactgtaaaagcacataaactgttaaaactctacaggacacaaagttccatagttgtaagaagctaagtagaagagaaatatatatgttattacaaaattcataacaagttactatgttttagtagtaacattatcgtataagtatagtaacacgtcacgttactacaaaacatataggatgttactgcacttttgatagtaacatcatggtgaaattgtagtaaactaggaatcgaaacaaaaatatatgagttaaaagtctacatgctaaccatatatttgttactgcacaaaagtgtaagtgttactgcagtaagacgctttgttactgcaaaacttataatatttaccacactttcataataatgttatgatgggattgtagtaacgtacaatagatagtaataacacttgtggagagttaaattttaaaagaccaatctttgaaggttctctctacccttgccccataagtaaaccgagccaattcatctctctctccatgttactgcacatttttttcttactatacatattcttgcagtaacattatcaagtaatcgcagtaacacactatgttactatgaaacttgtaatcgatactacatcttgtagtacgatattatatgattgcagtaacgcatagcagatcagcagtaatacttatgatatagtattactgcttgtggagagccaaatttttaaaaaaaccaatctttgaagggtaatatctttcacatcatgtattacttttaaaaaccatttgcaccatgatgttagaaaaaaagtgcttatcaaaagtagatccgtcatgattatattatgactacatttcaatattgttactgcaagtaagacatggtgttactgcacgatgaacatcgtgtta

SEQ ID NO: 105121 - DNA, 704 bp, Oryza sativa
taattgtcatatatcaatctcacgattgctatagtggtgttgagtcgtaggtacatggtttaaatcctggtgtccatgactatggttgtgtgtatttttagttggtgagagagttatacgtacttccattgtgcaataaaaataaataaatcgatatccatgctttgagttattccaaaactatagcttacattcataagtcacaagcaattgaagtaagtccaaaactatagcttactttcactctaaatgttgatcaaacatctaggatcatactcctatataattgaagtaagtcgttttaatacaatccgatcacctggtcgatctgatatatatctttgtatgcaaaaaaaagaaagttaaattccctttgaaaaattgcaagagacgagggtacccccaacgaatcgaagtcacaagcactatactgaagtcatatacatgacacgaaaagccttcaactacgcacactaaattgcatcacacctcttattaattaaccgatatagtgggtttcgtccggactctagaaaattttagatctcccaataaattaattaaaccggacccaatatatatatatatatatatatatatatatatatatatatatatatatatataagcacatgtatatcaactaggagcagtagtgtagttcctagctagggttgataatggatcagtacttgtgtagcgta

SEQ ID NO: 105122 - DNA, 806 bp, Oryza sativa
ctacggatcagttgctacgagatccaccaatcgaaaaggcggaagtgaaatacttgtacgaactcggtaaaccgcttgtcaagcctgagtagctgcagtccctaccgatacaaatgtacaaattccatcaactgtacatggagatgaacgccaccggtagagagatgatcggagcgaggatcagggacacggacttcttgcaaggagaagatattctctagatcaatttcaagggtatctacgaactataccagctggacgccctcgacgtgtctattatgagttgttggactttgtaagtatcgttcagttagatttctttttacgtttcctttaattaattaggtccttgtatataagtacaccatatataatatatacttccttttatcgttgtagaatggagattcaaagggcccgacggcggggggttttcgatactggattcatcgaccctcggaaagtaaatatgcacacatatatatagtacacacatatataaatgtgcacttaattaagtaaatatggcctatatttacagaagtgcgtatatgtaatatataaatatttatatatatagtatacacatatataaatatgcacttaattaagtaaatatggcctatatttacagaagtgcatatatgtaatatgtttttacacatatatatgcaatatgcatacatatgtataaatacatataatacacacatatatgcacataagtaaatataggcgacatgcatatattaacaaaatttgagtttgcacctaagtaaatatacacacatatattatattatcaa

SEQ ID NO: 105123 - DNA, 693 bp, Oryza sativa
tattattctaacatatttatgcattgcaagcatcactagttctctcctgttttagtaatattgacggtcgaaactgatcgataacgaccatcaacagcgaccagatgtgttacatattcaggagacttgacaaaaatggctaaagatctacaacatctcaaatattcctaactcatactcatgtgaatctagttcccagaatgtgcactagattcacactttcatcttaagcatgaatatacatagcaaaatacatctaaagcaaaaaaaactcagattacatctttaaatagatacataggccgaccgaccaaataactatatcagagaacagcggaagcttgactacccaaatcctcaagcacactgactaggggtttaccccattaagttcaaatcctagaagaagcagtcgaaacccacatcactcaacttaaactaagccttttcctgcaaaacataaattagacaaaacatggcaagactcagtattaatgtactggcaagagcactatcaaacctacaaacatgaaagctctaagtcaaaggaaggctatatgtggtttcaattttcagcataaagcaaattttagttcacaaaccatttgcaacgtaatttaagcaaaacatgttagcaatatgtaaagcatattaattatggcatgatatcaacataaatagatagacatcatt

SEQ ID NO: 105124 - DNA, 739 bp, Oryza sativa
aaattgacgtatccattatttttaactattaaatatattttttaaaaaagtcttaagtcaccatatgtcacgtcgtataaaaaacagaaataaccttataaaattcttagaaaaatgaaacaccatatcatcggctttcacttaaatcatttagaaatattagaaaaataaaatatcctccgcctcctcctcgccctcacacgcacacaacattgctcgtctcctccctatcttttatctattaaaataaaagagaaacaatcaataatgttggatatttttttgagaaacaaattacaaacgcaggcgctcacaacacgcacactcacacctatgagggcacacacgcacatcccttactggacccacatattttgagattgacaatgccaccacgagcgccccactgtcaatgggtatgtcatctaccactgaaagaatttatcagtctaggacttgaacccgagtgggtaagttctaccacaagtaacctaaccagttgagctacgtccacttcgcaataatgttggatattaaaacaccataatttttaagctatatttctggaatactcctatgccttttaaacctggggaaccattatttctaagaaaaacaagtgtgtatttatggtacatcacatttttaaaatattattgtgcaattatattttatcattattgtattcaggttaggttgcatagaacctcttacccactctacatgaaatattcataga

SEQ ID NO: 105125 - DNA, 506 bp, Oryza sativa
tttacattatgttcatgttatactgaatatactgctagcttatctcggagatgctttagtgcaggtatagtgtttgcttatgcaattactctatgtcatgacgatgatattagagtagtatctggtagtttagcgtggtgtctagattatgggatatcattatccggggttatatattgcggatgagaggtgggccgctgatggtgcagctcagtacgggtattcctccgcgcctatatataatcctaagttaatttcctagggagggtattcctccgtatttagccccggttggatggttatgatgggctgtcgtaaggaactcggcagtcaggggtggcttctctcgaagtaaccaaggaagggcgcccattccggggtaattaggaaagggggtttaattttaaaggcccttttaagggctttaatttaatcagttaactagaatatatgtatactatgaatattagaagtataggaatatattctctttctattttctttcc

SEQ ID NO: 105126 - DNA, 1592 bp, Oryza sativa
ttggatggcatatgggtccaagttgatgtatcctaggtgtacgtgagaggtagagtagtagctagtttaggtatgaaatgatttttattcctctctctcacctttagaaaaatgaaatataaattaaatgagaggtgtgtagatgatgtgttggctgtgagtgtatgacacatgggtcccacaagagcatagtcccacatgtaagagagagatgtgtagaaggagaaacctagaagctctaaattttgagtgttaaaactataccaacatgtagtttatttcctactcctctcttccatttaatttagaattttggggagacaaggttgctacaaggtagacaagaatttgatggttcaatgtgccaagttccaagatttaattactttttgagttaccatggtaatttagtaaataggcctaagatactatgttgactgcagtctaaatactgtttaagcaaattatggctctcatctcatgtggttacattttgaatttaattcagccattgaaccaggtggtagagcacactatgattagcattctgactaagtggtttagctagataagttatgactaaattttggtgaatgttcaaagtatgctaaatgatatgctgttttttccagatttctagatgagttgttggaattatttgagataccatttgatgtgataaattcaaactaaaattactatagactcagaatgttgtgtaatatttatgagaattttgtgctattcattgttgcttaatttagttttaggaatttttgtttagacatgacatgcatatgaaacctattatgagatgcaccaagaatatccaaaaacaaacctaaaataataaaatgcacataccaccaagtatatttatttccatttaggtttttcttattttaaaacatatatttccatttgtttgcttttagttcgaatattttgcttaggttagaatgcaaaaccaaaaggcttaaatttctatttaaaatttaaaccaacttatttgatttggaatttgttaactcaagattttataaaatctaattttggactagctctaatcttgtcccaacaaaactttgtgttttatcttattcacaggatttaaactctaagatcaactattatatatgctctcaaatgctttggttttcaaaaagttttaaattttcctaaaaaattttccttcgtgaaattcctggtatcttacagccgattattgtaatgaaccaacacttacagcaggtacaatcactgcaacaaatatgtcttataaagacatttttgtaatactatagacacatttttaaaatgactttacagtgttatagacaattcacagccaattcatatagacccattcccaacatcacatcagccaattcacattcatattccatcatagcatagccaattcacaaaatcaaacacatatacattcacatccacaacccattcacatatatatgtcattcacatccattattctctccaaaccgccgacatgcatcaaaacctgtaaaactaagttataaattggaacaattttatatgtaactagaaatgcaaatatatacagagacgag

SEQ ID NO: 105127 - DNA, 1230 bp, Oryza sativa
gtctgcaactactaccatatgcataccacatgccgcccaagtcaaatcacatttttatctcattgtatttcacaaataatcagagaatcacctctttccataatgttcaaaaagtgtttgcaaaatgtatagtaagtgaaccatagccatgtttttatttatcactaagcaaggctaagcatttgcactttataaaagcatagcatagtcatatgagcacaattaaagtactctaattaatcctaaggttcaaaacagcaagggatgatttttcaaaagggaagttatgcatatttttaggggacaactacaatctatcgtttggaagtatcgatagttagaaatacgcgtgcaactttacaatcaaaacatttagcctggaaacataggatttaatatgttcaaaggaagggcaacacttgccttgattgatataagacctccctgagaatagatataatccatctccttcaccggtatcgatttcgctgtctaaatgaaataacggtaacgataaataccaaaacatgtaaaaatctaaaatgatctaaaatgcatgagtttactagtgcggttaggtactggtctaagatgaatttaggtgaaagaatttatattttattactttgcatttgagagttattaattttcaaagtttaatactagctctagattaattaacctctaatcgtccttaggtgcattttaggtctaagttttgtgaaatgttggctttctgcagtcaaggggatgctcacaggagttcaacaaagttggtttcacaatttttaaggttagcatgattttattatgaattttacaagataggtcatatgctatagtctttattagttatttcgaattttagatatgttttgagtactgtatgtgtcatattttatttcataaaaactaagttcatggttcttataacctaagagacctgagatcacttcatttagactggtattaaattttatatgaattctagaagtttctataccgtcctttaattttaattcattattcaaattttagtgatgtttttggatatggtttcttctacagatttatatacagaacaaatgtacatgctattatcaaactaacaaattttagtttgtctcatttggagttaaaataaatcactcatgggttttatagtttctggtttacactatactagttattttaccaattaaatagttggtgatgattttatacagaaag

SEQ ID NO: 105128 - DNA, 669 bp, Oryza sativa
actgcggctttcataaaacttaatatgccatctctatactccttgtactgacgcctcaagccagtcatgtacatccaactttgatccatcgctgaacaatgaacaaaatattagttaacatctcataacataagtactactaaattaataggaaattattagtacccttttacttacttttatgattttcatgtttttgtttgcaaaaaaattacaaaaattcgcccccttcaacctcccaccaaaatagttattagtgggataactacagacaacggactgctggagtatatatagtgtgcaaagtatatctcaatcgggccaaaaaaaagtcatctctaacgggcgcacactaatctctaacgggcagaaatagaagcccgacgccgataagagtcatcgatgacgggcattcaggccatctcaatcgggccttctttggagcccgtcaccgatgacactcatcggtgacgggctcactatttggcccgtatgaggatagtgtgcgcccgctcgagctgtcctaacttaggcccggtcgcgaatgactgtgatccctgactgtccacaagaagatgcaccccgacaagtatatctacaacggcaaaaatttaggcccgattgagatgacttcgttttgacggcccacgttgcccaagcatgtgatgg

SEQ ID NO: 105129 - DNA, 2810 bp, Oryza sativa
aaggcctcatatgggtttaaactacttgatcattaacggaatgaaaataagccattaattcattagcgtggatgagcctaatagaccccaacggcccaaataaagaaaagtctaattaaaagagtaaaagagttaaaagtgtacggacggtacttaaatttattcaaccatattgcccaataatttcggaaatgctctttgccggtcgcccggcgcagggggagccggatcgggcgctccccccgcgccccctcccccacgtgcttacttgggcctacccacttctgctccccttttttctataaaagatgtttcacctagtgtatttataatgtttcactatttatagatctaatgttgcagtgaattaaaatactcttttacaacaaaaaacccacatattttggaaactctctattaagagaatttggttcattttttgttccacccaaaatgtttcacctattgtactcacaatgtttcactatatatagatctaatgttgctatgaacgaaacattccattgcaacaaaaaaacctacatattttggaaacctctattaaaggaatttggtttattttttcttctaccgaaaaatgtttcatctagtgtactcacaatgtttcactatgtatatgtatagatctaatgttgcagtgaactgaaacattctttcgctatttgctgaaacattgtttttatataaggtgaaacaacacccgatttaaacgagtgaaacattttttatctacttagtgaaacaattccgatatatctggtggaacatcatgcaacatttaaaaataagtcaataataagctaaaaaaaatttttgtcagaatatatccatgtgtggtcttgttttgaagatttaattgcaacgaatttaatggtgcaatcagatcatgatttggataaataatttaagagataaatcagtttaaaataattttgcacgtaaatcgaacgctgacgtcagcgcccgattttaccccttcccgatcgggcgcccgaccgggagtcatccccaataatttgcctaaataatcaatcagcctagatggtaccgagaactatgtggaacaatattcgctcaaccaacaatctctcaggaacaaatgagtcgatgtgggtattgatatttcttctgtatgctatagatctaacttagctatgttcatggattttgtggggaaatatatgtgatggaatgatatatgtcgtcaaatacaacctcgtttcgaaatatttgttagcatggactattactattcaattattataactcagtcatgtatatctctgaggaaatatatgtatgattgcataatctacaacttgtttatagctatttggacaacatataaattaaagggctagaataagatactaaacatactagtattttctaaatcaaaacatagcagttgatatgattttaagggaaatttggcactttattcaatcacattatcacattacttgtattaattacaatctaccacttaaaaaatctaatactgcagacttagtggcgagaaccacgtgaaaaaagtatttgctcgagcactaatccttcagacacatatgagctaatacatgttgtgatatttctcttgtattagttatattagttataaatgtttgtggggtaacgaatgatagaataacctatgttgtcaaatttactttttttttactacttataagactatttggatgagaataacatgaagaggatacaatttggtttcatgtgatatttgtttaatcaaaatataattaatatatctataaattttctacgggaaagaggagtgccaaggttcataaattagtatagttaccactattaattattaaaaaagagagaaagacagtataattataagatagttaatataaatgtagttgtaatacttttcctatatacaactaatttagataagtttatacttttatacggtggatgttttcttgtacgtataaagatttgaggagggtaggacggtgtgtactatttacgtgcacgggagattttttttttgtttttttctcaattaggtgaatagtagtacatatttatatgtacacgtgagattctttttcagtttttttttttgttgaagtgcgtatgaatatgtttctctcgtagcaattaggtgaaaggactaatacttctttttttcaatcgtaatcacgtattttttttgttgttttttccgtgagtagtaagtagttacgtatttatacatactatcacatgggatttttttttattccggagaggttaggtgggatgcatttttttaataaatgtaatctaatgctttaaaataatgggttcattcatttaaataaaaatcaagggttttctttttttttctcgaaatttataaggttttctctaatttattagagcgtctcgtggcggcgtaggaccgtttgtaagagcgtcacatagtgatttatgagtgtttgtagtaaatttaatggacttttagtatagaataaatggatagattgagccctacatttgagaattttttggctccgttattgcatatgggtgtgtttataggagtgattatgcgcgtgttatgatcgagcttatgtgtttgtactgcgtttaaaaaaaagaattgctaaaaaattgtcgcaagtatttttggtaaaaaaactttcaaatgtaactatatatatatattatagttgtagtgtaactacaatgtaattacactatagttacattgtaattaaaatgttgttattgtactgtaaccacattgtaatctctatataagttag

SEQ ID NO: 105130 - DNA, 905 bp, Oryza sativa
ccctgaaaaatgaattttagccgtatagaaaaattgtttgtgtagtagtgttggtatcctatttacattgtaaggtatgtaaaaaatcaacaattttgtaccggcggattctatcgtaaaaatggctttctagttttcaattttttgcaggtgtacgtaaaaagactgaaaaataaataccttacattttagtaatcatccatgcacggtctcatgttgcaagtcacaagtcacacgaattttcacgcacatgtgatgtataggaatcgaaccaggaactctcactctacatgtaacctccttaaccttctatcaacgaaacatttgattactataggatgaattctatgtgactttacctttctacaacttgtaacacatattgatacgctaaataatatcaaataaaaaagtcgtcaagtagactccatccgaggttatttgaaaaactcaatattttgttccttgtaaaatagatccaagagttcataactgatatttgggcccctaaacggtctcacataaaaaaaagttcaaccatatagttgtagatctcatcaaaggttataactttgatataatgtttgccatcatccaacttcatatataaaattttgatttttttttttgcaaatatgggttttttatttttagaggtgggccattaagagaactgactgcactaattagaggcagtgcttctttaagaagtccgcctgtgaaagagatttctttattcttcaaagattactaaactcaaacatttatagaaattttatcttaagttcaattgagttgatctatgatcgatacaatatcttattaaatatggcacgtccatatttttcataaagtatttcttgatatatgattatttagttatgtcaatttgtctgtgtaagagt

SEQ ID NO: 105131 - DNA, 634 bp, Oryza sativa
ctgcttccgagatcagatttattaggggcgccggagacaggagtagggcagttaattagggctgcagccctactcctcattctaattatacattagaattgtattataaaacttcaaaaatagaagattaattaaaggtaaagtatgtaaattacattagttgagtattaggcttagaagaatttgattccgccactctacgtagccataatgcagttaaacaacgaactgatctgaacgtcgatcgactgaggttgtggacttgtggacgtacggagcaagcaatcaagtgttcaaatatttattaatgcatatgcgtgcttgttatatatatacttacataacaatgcaagtgcagtatttatatataggcactaagaggcatgcaagatcaaaaaccatgtactgtgtaaactactgtacgaattacctgtcatgcacgccaattcactgtgatccataatcccattcccaattagtataagagctaagctcttagttaattagtcaatatattgacaatttaatatttggaagtcgcggcatcgatcgatcatgggcgtggtcagaaggaaaatgtcggaaatgctcgccatcagatgtccgacgcaacaaagaaaaattggacggacaa

SEQ ID NO: 105132 - DNA, 1371 bp, Oryza sativa
tcgtttttatccgaattttgttcgctccaattttgaaaaaacggaatgagaagatcaagtggatcaaaagccctaaaccaattttaggagatcgagaaagatttggccaaatttgatggggagaatcagctcaagcatcgtacgggcacggcaccatcttgtgcaggttgaagatggagacccacagctccacatgtgagttgggccaaagaaaggattaaaaacatcttacccattgcaacgcacgggcatttgttttctagtatatagaaaaaagaagaggagagaggatgctctattctatgtgctaaaaccctaaaccctaaacacctccgatcggtttaacgcactataagaggttcatgtagctgtctcaggtagtgccggtgaagacccgaaggacattgtgatcaagagagaagccgacgacaagaaattgatcgagtcgccatcctagagcatttgccgatgcaagaatcaaaagaagaagaagagaagggaaaaggaaaacgaaaaatattgacatcgatggcttcacaagcaggtcagtagtttaaattgttttgcaattagagaagtcgattgtttataggctggagtaatagctgatctttagcctactcagtcccttattcacatcatccctattattagcagccatatgtgccacttacaagttttaagattgattcagcttgtcttagattagattaaattagggtttaaatctatactgtctttgcatgttttaaattcaattttcaagttccattacttgcttagcagtagaattgagaaagataagggaagagaggataagcctgattgaatccaccctgaaatccccaaaattgaaaagaacccttattttttatgaaatcctagaatcccaaatcaaatccaaatcagaaattaagttattagttcggattcttaccatactagaagcgctattctcactagaaaaccgcacaacatcgtgcaaacttctctgggacgtggcatcgccgccgtcattgcacgggtgtgttggtatttcttacgaccacagataaatccgcaagcgcatggaataccgctgtagcacttcaccttcgggtgacccccaaaaggatatcgaactcagggaacgtgtgtaatctacctaaggctaagactatccaaggacaacaactgatcataggtaggctaggctagagaggactttctatatattttaattatctacgataagtaaggtaattccctatttgttgcttcgggcaccgacccctgctggtctgccagcgtggttccggctatagctctatgatgtatccgaacatggaggattactagatgggattcagggttgtcaccacctgccgccta

SEQ ID NO: 105133 - DNA, 587 bp, Oryza sativa
atatatatatatatatatatatatatatatatatatatatacatatatatatatatatatacatacatatatatatatatatatacatacatatatacatacatatatatatatatatatatatatatatatatatatatacatacatatatatatatacatatatatatatatattgcatttcacgttaacgttcgtcctcgttcgttcgctcgttcacgttccctagctcgttcacgttcgttcgctcgttctcattcacgttcattcgctcgttctcattcacgttcgttcgctcgttctcattcacgttcgttccctcgttctcgcttgtcttcgttcgatcgttctcgttctcgctctcgttcgttcgatcgttctcgttctcgttcacgttgtcgcggcaacgtacgttgacgtgttcgttctcgctctcgttcgttcgatcgttctcgttctcgttcgttaacggcggtgtggcggcatcggggcggcggttggcgcggcggcgtggcgacggcggcggcggcgtggcgttgtggggccgtggcggcggctgcatggcgtggcggcggtggcgtggcgtg

SEQ ID NO: 105134 - DNA, 681 bp, Oryza sativa
caaaaaaagtctgaaactattattttgcttgggttttattattttcataattctaatgtggtttcttgatggatttgcttgggttggaccgagacaccgttaatcagttcgttcacctctgcaattgctgtctcacaaagtcacagctgttcctaattgtgtcaaatttacttaaattagtttaattcacatgaaaccatcaatttgattctaatgcttctaatatttaggtgcttacctactggctttctcaaacaattggttgtttctatacccggttaacaaatacaaatgttagggctcaattagtgaatgaaggtgatccatttgttcttgtcggccaattattttcatacatgttatattgtcacatatgcagccaagtgcatgtaaactatggtggtttattatgtttctttagcatcggcatggatttagcaccaaaattcaaaatgtctgtagcaagataattttgaaattttgcggtatagattatgaaaaacaactgatctcataggtttgatgctacattattaattgctctttctcagtttaatttgtgttcccaaaaatgagtagcatcactctagaaagaatagaatgtttttttaatacactgataagtgattaatgatactttttgtcggtaattctttttgttctttctcattccatttatcg

SEQ ID NO: 105135 - DNA, 1154 bp, Oryza sativa
tccccctctccgcctgcgacaggatctcaccactgtccatcccggctcagggggtgtgaatgctctgtgcagtgtcgtatacctaggaggggagctccttctttcttccatctcataggcgcggcggtaggcatcgcgtcgaggcgacggcatagtaaatgtagacttcaattttgcccgcggcggtggttgggcgggaggcgagcttgcgttgactctggcgggggagaggacgacctcagcaaacgagcgtgggcgagttggagttgcaaaggcaagggtgacgctggtcggtgaccaggtggagcgagctggagtcgcggagacgtgggtgacactatccggcgaccatggagggcggcgggggtggtggcgtggcctgccagaacttactaggggagggggagcccatgctgcggctcaggggaggggcggactgcggccaagagacggcggaaatgggcgcccaaacctgcgaccggcggagaagcgtgggcaccgtcggttggagcaccggcggcggcggtggtgaagcgcgctgcggcatttcaaaaaaatatgtgaagtggtggtaattcttcatagggcctaactagattatcctagctactagtgcgtattaggagctagaattaattcgtgcctagctgggttcactgtattttacacatgggtgtttcttgcaaatttgatgcacccccgctgattcgtccacatttgtacctggagaggcgttgtgtggggcccacatcctagaacgcagacgggtccgtgatgtgtggggtgacacgtatataactcgagtcagtcaagctattgactctttctgattttgttttccttcttctttttcatgttattattgctgtgaactactactagtgagcatgaggtttcaacttcctacttctagtatttactactactaggggtgtattatgtttacatgtataagactagttctagtttgaccgtatgatagtactccttcgtttctaaatattaaataccgttgactttttagcacatgtttgactgttcgtcttattcaaaaattttttgtgaatatgtaaaactatatgtatacataaaagtatatttaacaataaatcaaatgataggaaaataattaataattatttattttttaataa

SEQ ID NO: 105136 - DNA, 595 bp, Oryza sativa
cctgactgcctccaccgcgccgccgccgccgccaccgtcctccaccgcgccgctgccgcctccgccctccaccgcgttggcgacgcctccgtcctccatcgcgccagcgccgcctctgtcaaattttttcattccaaacttactcctgaaaaattttggtaagaccgagaccgagactgaatttgctgatcctgagatttttttgatgaaatttggtcctgagttttcaaagaccgaactgaccgaaaaaccgaaaaccgagaccgaatttttcggtaaaaccgaatgcccacccctacctgtaagatgccacctccttccacgatcgtcgttgctgaggcgccagccaatgcggccaccctgcgcgtgcgccggccagccggctcttcgcccactgcccgccccttccctgcgtcgtcaaccgcgtcctactcctactatgccgccgggcgtgccgcggtggttggccccactgctggcctccgctcgaggccgtgaaggccgcgcttatcggtcgtggccatggccagcggtggtgagcaagctacagtgcactgtttgttccatttatttccctaaacgtgtggttgctgtt

SEQ ID NO: 105137 - DNA, 1862 bp, Oryza sativa
ctaaatatgcccacccatacttacaggcgaggggtggctctggtgcggacgtgcggcaagggaggctccgaacggatcgacgagggacggtactgatgcagagcagcacgctggagacagcccgcgaatagtcggtgaagggacgactatttctttgcaaggcttcaccatatctaccgttggttcctaatccaatggatgtgtgtgcaaattaaaccctggaatcggcagccacgtggcgcactaatcacccgagatggtgcgtggaattcggtataagagattgagctcaagctctgtctctacttcctccttcacgatccttgcagaggctagccggagcaccgcatccgcttcattcactgagctcgcatttatcccctccaccgagctttgcacccctaagcttaaccacctcgtcaagtttgagagcggcggtcagccaagcagagaaggcggtgctagagctcgacagagcagtgacactcttggcatagaggagggcggcgaagagcgctggagtcgagaggatggtcactagcgtagctcacgccatcctccaccacactgatagttcgacgcccaccgaagtcattgccaccaccgctatcggctcgaatcgagtatgagcccaagcggcagtggtgcgtccatcgggtttccttggaggttcagagaggatactgatggcaacgtctttaaaagaagtccacactcggcatcagtaatcaatgcatagattgaatagggagggaaatggagaagagaagggagagagaaagcaagatggtggtcaatggcaagtggactctgtaattttttttttaggatttttcttattggatagccacatcaacatcatgcaggtgaaatccgccttggtttggcctaagcagggtaaggtaaatggtattaaaaagctaaggaggtgtcgatacacgattttaaagttgaaaggtgaactttaaacaaaatgaagaattcaggagatcaaattaatggactaatccctgaacactaattccatcgagggattaacatcctagtccaaagttcttctctggacttggactagtgcctggcttgctagctgccctgcctgagctcgtgagcacatagcaaagagaaatgtcacatatatggcacgtcatcagtatcggacaatgctggccacttgtcatagtgcttttcattgagactttaagaagtttctactccctccgtcaaaaaaaaaacaaatccgagttttcgtgttcaacgtttgactgttcgtcttatttaaaaaaattataaaaaaaattaaaaagataagtcacacataaattattaatcatgttttatcatctaacaataatgaaaatactaattataaaaaaatttcatataagacggacagtcaaacgttggacacggaaaccagggtttgtcttttttttttttggacggagggagtatgtcagtattgactagtggctattggtgacgaagaagacacaagcaaactgtaaacaacacatacagagaagaaagttgtaggcgatttttaattttcgctatgattcgatgatagtgtcatgaactcatgataaaaggcacacgatagtgtcaaaagggcaagagaaatgccacatgtcacatcatcggtactataggggtttgggccatcggtgactcggtgctgcaaaagacaaaccatttgtaatgttctctgatcatgatagcactgaatataccaaaaaaaaaaacgtggttcagctaatgcagacatgaaaaggtcacatttacgatcgatcgtgtcatcgatcactacgtacggtgcattcttaaccattggccatgcattattgtactaacttgcctag

SEQ ID NO: 105138 - DNA, 2893 bp, Oryza sativa
ctgcatatattaaaagcgcgaggtttaacgtgggcctacacgaataattgcacagtacctttcacgaatctacggtttgtttggtttcggtcaggagacggatcaggcgtcgcgaaacgtttcgttgcatccgtccgatctgaggcgaggcgagcccggcccggcccggcccaactgttcgtcggagctacccgcctgggggcccaccctcagaggcgaatatgccaaactttgatgcggacgagtccttccctgtgtccgccgtctccatcgacacaccccaaaggcccaaaggtgaccccaaatactactctacattttgaaactgtggggtaaatcactcaatgtcttcacttagggcctgtttacttggggaaaaaaaaattttaggtgtcacaccgaacatttgaccggatatcggaagggattttcgaatacgaatgagaaaactaatttcataattcgtctggaaaccacgagacgaatcttttgagcctaattaaaccatcattagcacatgtgggttactgtagcacttatggctaattatggcctaattaggctcaaaagattcatctcgcaatttacacgtaaactgtgtaattagtttttctttttattttatatttaatgctccatatatatgtccaaagattcgatgtgatatttttgagaaaagtttttgggaactaaacagggccttaatcagactatagaggtcctgtttagttccaaagtttttttttctaaacttccaactttccatcacatcaaaccattcatacacacacaacttttctatcacatcgtatcaatttcaaccaaactttcaaacttcagtgtgaactaaacacagccagaggctcttttttttccctaataggtccgctagttcaatcccaatagctatgatccttccttttaaaacatggtataaacacacgtactcacaacacgagcgcactttataaacacacagagacaaaacaggatgtgaagggagattgtgaaacgagacgaaacgatggtcgggtaggcaggcgccaggcgcgcgggagaacggttggctagttgaggagggtgtgaaataaggatgttataatttattattatattgtttttaaatatacatgtaggacgtgacgtttgactatttattttatttaagattattaaatattgaaaaaaataagtcattgctgaagtatctttgatgacaaacaacggattaatacttaaatagattttcaattagactaatgataaaatagcatgtctaaatatactagcttcattttctaaccatagttattttctatatgtccagtgtaatacttaattatcacatcaatcacgtatatgtaaatattttccttatgttatctcaaacaaagtttcctcccaaccttcatttaacgggtagcattacaaattatgatagaattatcttcaaaaatattgtaagttttatagtgggacacttttaaatataactacattatatttataatataattccaccacaactatacagtaactacaatattagttgtatataagtataaaaaatatatgtaaatttatacctaagttatatgacaacatatcctatgcacacagtccttcacgtgtacacacgtgcacaccaactaaaaaatgtcaccaaaaaatctagaaaaatcatacacatactttcaattgtattacacttagggttaaaatcttaacgtcaaattcattatattttagccataacaaaaaaacaaaaaatctgacagttttaaggttgtaattttgtcagaattttatcttttttttattctctatgtagaatgaatttgaagatatgactttgcacgtagatgtaatactattaaaagtacatgtatgaattttcctagaattttttgtgataatttttagttggtgtacatgatgtgtacacgcgaggacctgtgtgtataggatacgctcccaagttatatagcgattataatgtaacaacagtataattacgttgtagttacactacttacattttaaagctttttgcgacagtttttagcaatttttttgttaaatcctaatctcacttaaacaaccaaacaatatttatatttggaaactgagagagcagtatcaaagcttgccttgaagtcaaattttgtatcaaataatcgcccgtaattacgccgtgccgtcaatcaaatctggcgagagacgaagcgaagcgacgcacaaccaccactccaccagtgcgcgcgacttccgagacgaaccgatctgacggacggagagaacgccatcctcgatccaacggcctagatcctccctagcctcctccgttcccgtgtcactataatggcaaggcacacacctcgtgccacacacaaactgcaaccaagaactgccgccgccgccgccgccgcctgtgacctctcctctccctccggcgacgtcggcgaacactccgtcaccgatgggcagcgcccttttctccaccattgccacctcggtggaaagcctccgcgtcaccggcgccaacgccgacgtggacggcgtcgccgcggagaagaagccgccccgcaacgacaggaagaggaagaggaataagggcgcgagcgggaggacgtacgaggagacgcgcgccaggtacccgctgctcgtcgaggcggtggaggcgctcgccgctgccggcgagctcggtctgccgccgccgccgcacgtgcgggggcaccgtctcctgctggaacgcgtcagcgaggacgacgcgcggcggctcgagcgcaagctgaaggtggaagagctcgcgagggggaagttcgagcttcgccggcggcggctcaccgcgtcgttgaaggaggcgctggtcaaggccggcgggcgagcgccg

SEQ ID NO: 105139 - DNA, 865 bp, Oryza sativa
atacatataattttggtggatactacctccaccatttcaagttataaaacgttttgactttgatcaaagtcaaaatgtcttataatctgaaacggagggagtacaaagataaaaaaatacacttacacgtataaacataaactttatacgtatacatataaagggtctcatctttttgcttatgcttatgcttatcagctaaaatttgaattttcatccttaaatttggagttgattttgaggttttttttatcgaagtttattttttagcctttgtttttagatcgctaagaacacatatataaaaattctattcacaaattacttttcattttgcaaatataccgtttctcttatttcgcgatggctccgaaagtttgtacacataactacgtaagggccggactgatcgtgcattaaggatttctcattccgtgctctcacgtattatctcctttgatttctagtgtaatgaaccatccatttctacatgtcatgcatatgcttaggaaaaagctatacatatggattttatttcttacaaaatttttgctaacgctaatgttacatattgtagtaaatcaatctagatctactatgacatcgacctagttaaatcaaacgggtgagaactttgttaacctttgttaagagtttaatttgtaagattttcttttaatacatatagcgttgttcatattttcaacaacgtttgcttcctactcttaatttcttttttaattactacaatgtgacgtgtctgaagttcacatggtgtacaacgtggtcgccatcccggtcgccgccggcgcgctgttccccttcacgaggctgcagatgccgccgtggctcgccggcgcctgca

SEQ ID NO: 105140 - DNA, 2192 bp, Oryza sativa
cccttggacctcaccgccggtgacaaaatggtaagtgcaatgcatggttaattagccagccatgagctagcaaattctacgcaacaaatcacctgctgcatatatatacactccaaaaccatcaccaatatacagacgacaggccggttcaggttcaggccatatatatatatgctctctaacctgaactcgatcaatgcaagagtagcattggtagctaaaacaatacaacatctcgatcaaaatgtcattatctgaaaataaaacaaattgcaaatgcaaatgcaaatgcagcacatgttgtaatggatagctactaccactagtggcatgtactagtgctaccccggcctgcatgtacttgctacatgtgatggatggatcaaagtaggggcaataagtgcgagaggaggggttagccgtcttgacgacggcccttgtcgtcgagcccgttttcggcacgcctacacgagccctaggggtgtccatttccggcctcgcatgtgccttttaactcttgctccagtaacctgatcatattatgaattcagggtgtgcaagtcaagagaggaggagagaaattcaattcaatagctgatcctggcccatgtacatgcattgcattgcatatatatgactctgtgctagctgctgccattcgatcggtttatcttatccatcaagtgtgtttgtgtgtgtgtgtgcaagcaatattatggaaaccctgtgccatgtgaacggtttctttctctctcacctgcaaagctaagagcatgccatgatagattggtggttgaagaaggcatggaattttatccatgtgcgtgcgttcgcggttggactatccgcttggttcaaggtagcttttagcagctgcagggtttatcttttcgtttttgaaataaaaaccgcttcgtattggtttactgaaaacataaaactggtgaccttcggtaagcgatgtacgaaaaccagctaaaacggatcggttttcacaaacagacaattaatgtttttacagaagatgtatgaacggttttgcgaaaaaaaaagatcggttttgtgaactctaactttatttctaatctccaactctctccaaacaattcatatttttcattcaaattcttaaaatctgtagttataaatcctaaaaaaaaataaatcaaagttggttattactacctttgaaaaaaataaatctgtagttattgctttatgaatttgatttttatgcttcttcttctctctttctttttaaatattcagctttgatgaggtttagcaggattgcagctaactgatgtctatgcatatgacaagagcaataactctgttcttgtcaaatcaggatatatagtataggtgggtgaaatagcatgtgtgcatgtgttgcatttagaagaaggaaatgcatcgagagaaattaaagagcatgcattgcattgcatgctgcctttgtcgttgtccctagccaagttttgatgaggatcacagaggggcccaaagtgcatttaggggactgtttccaatacacgcctacaggcatatatatccacggctcacatataaccaattttttgttagtaatagaagatttgactgaaactgttaccctatcataacccaagatctctgtcctactactactactatttactaaaaaaaatagggtgcaacaaaaaattaattaattaatttattaacatgcatgtcacgttttcgcaccgctgatgaagcccaaacttaatttgcagcaaaggacatatatatatgtgtccagtgatgaagcccacaggtaaaggccttcttaatcttgagattacgccaagaacggcccatgtatcatatcgtcggctgtgttgctaagatgcttgcgtgctcactttcagcttggaaaaacgcaatgaacagttgccggggcctagcttcgtccatccaccatggaatcacctacgtgagagcagtattgcagtaggttataccacacaacgaatttctgattaaataggttacataattaacataatcgttcaattaagatgcacattctatctcgattttcattagcatgtttttcaaatcaataaacagcttttttttaaaaaaaaaacttagtagcaccctatatcacccgttggttcccttagtcgacatgtatgaatcgacctatggtgggcgggacctcatgt

SEQ ID NO: 105141 - DNA, 1718 bp, Oryza sativa
ttgatatttctgaaccttctggttgttttttatcatgctgaattcagtacattgcacctcttgtttatttagcacaacttgtatagtctgcatgtctaatatcagaatcaacgcaaacattctgttgggatgcagcaacccactaattttgttgggatagacgtgaaggaattctgggcctgtcagtccatccattgtttttctgggcctttgtcatagttcaaccattccagtgttgggctacaagtcccccagaattttttctcgccatcggcacaagttaatcatgaacctacgatgtttggcgtctcgaaagtgaaaaaaaataaattaaatgcttgagtttcacctgaatttctgagcaatctggtgcgttgcaccgtatactgtgatcgtgctctacccactaggccactatccagactatccatactccaaaggtcaaaacggccacgcacggacagatgcaggggttcttgaacaggtgaaaaaaaatagatggacataaagaaaacctgaccaatcaaaacggccacgcacggacagatgcgaggcggcaggaacgaaaatatgccattgccgaattagcactccagattcaaaggcctccttcgaaactgcaggcaatttgaaggagctttgtgcgaactgaactaccactaaggctgtgtttagttcacgctaaaattgaaagtgcttgaaatggaacgatgtgatgtaaaagttgaaagtttatgtgtgtagaaaaaattttgatgtgataaaaaagttagaagtttgaataaatattttggaactaaacacggagtaaaactctgtaaggaactttgtgggaactgaactaccatgagaactcagtaaaaatgttatgttctttttttattaagatacatattttatcttaggtttttattagcatgttttttaaatatgtttcatatgaaaattttctatataaaaattactttaaaatgaaataaatttatttttaatgtaataattaaatcttaattaatcatacgtcaattgttttttttcgtttgtccaactttattctccatccaccataatactacctccgtatcatattaagttattttttactcctacttatctcaaaataagtttatttctaagtaattaaattattgcatcagagtttgagtttatgaaagtatggaataattacattggaagtagataaagtaaaaaataataacttccggatttgataaagtaagagcattctaatgtttatattggtatgtgggggatgaataaaaaaaacaagctttagggtccctttgaatcgcaggaatggaaaaacacaggattctaacaggaatagaaatgcaaaacagaggattacaaaacacaggaaaaacacaagaatgacggtttgattgaaccgtggaaaaaacgcaagagtcggatgagagagatagactcaaagaaaagtttccaagagatcgatttgggcttttactaaatttcctccaaaatctctataggattgtccattctatagaaatttgaaaggataggattcaaagggcttcataggaaattttcatatagaattataatcttccaaaattactatgtttttcctctaaatcaaagaggtcctttaacggataagggtgtgttcgctggttgtacttggttcccaaccgaacccttcacacggaaaacagagcaatccattagcgcgtgat

SEQ ID NO: 105142 - DNA, 547 bp, Oryza sativa
ccatgatgagaatcaaaactccacaaatataattgcatacatagatttgacgcttcgtcataagaacaaagataggtccacctactaaactggataataagaatttaagacaagtcacaaataaactagtagtgcgccatagttttgaaggtggtagctgcagtgaatgaatccaaaactgtctctaacacatagaatgttgatgattttccattgttgattccaatctctgaaccaatcaacactaccgagtgataatgtgcatctagcattggaggataatatatttcgccatcattcagaaatgtaaacaaagatgtaaaggggatattaccaattaaaggaaacccattggccataaaccgagttatcaagtgaatatccctgacattaactttgaagtagcctcgaatccgcgtacatggtaaacgagattgttgttggtatttcttaacgtcacaaataaaatctacaagcacacggagaataccgatgtagcttcagtattcagtattccgagtatcgatttccacaaggaacgtgtgtg

SEQ ID NO: 105143 - DNA, 871 bp, Oryza sativa
tttactgaaatgttccaacaagcatttgttggtgttttactagtgcattagtaatgtttcatgttatcttttttatatgtttcagcaaatacattttttatgtttcaacaataattataatttgatatttcagtctaaatataaaaaatatttcactagtcgggacttaatgtttcatgtaataatgattattgttgcagtcaatactttttatatgttgtacctctttggaacaatttgtgaagtgggttgaaacatctccacaagtgatgaaacaattatttttaaatagttcaacataagtttgttttttttctaagaacacacatatatatttttattaaaatatattcatgtgagatcttgttataaagatttaattacaacgaataaagtcatctaatcaaattatagcggtgttattggatcatttccggattagtttcgcatctcccactttcagcctgtccttttttttccagtttcttttcatcttttatctacctttagtgtgtttgtaaataacttctatcctatttaatataacaccagcaaatcctggcatcggttctaaaaaaaacattcataatgctggagggcccattcaaaattttctttcctcttttgacctagtagtgatttgttagtaggggtggaaacgagccgagccagttcggcttgcagtggcttgtaacaaactaggcttggcttggctcggctcggctcagttagagaaacaagctaaaacttgagctcggctcggctcatttcctagctcgagccagcttgcaagccttcctgttgaaacacctcttcatatataatttgtaattattaaaaaaagtaagaacaaatcatcaacatgtaaaat

SEQ ID NO: 105144 - DNA, 678 bp, Oryza sativa
catagttggatttgttcaaaacattagtctagaccagatcaagagagccccagatggttcattgtaatgccatcgaatatattcaagtcatctaggctcctgtcatcgttgaacacctaacatccaatttatgcttcagaataatagaattcgaacacctgacatccaatttatgcttcaaaacaatagaattctcttggtcaccgtttctgcaagcacaaccttagagcagaatgattcagcaatttcactttaaaaaaataaaaaaaaaagtcctcgagctatttaaagtgtaatataagctcaatagtgtacagcgatcgcaggcttcagatttaacacgctatggacttttttgtattccacgttgaatttctaatcctacttgcgttatacttgaaaaatacgggaaataaaatttaagaattgctaaaagttgtttgacaacacaaagaaaaagttaggccctaattagcacatctatatcttgtatgacataacttaaaagtacatctatatcttgcaaacgatacatagtttgtcctttaaatagtcagtgtaccctaagcaagcaaatattccactaatttcctcacttgtcgcatagcacaatactcagtgtacccaaatctaaattggattcgacaataatcatatgtgtattccttagattacaaa

SEQ ID NO: 105145 - DNA, 678 bp, Oryza sativa
tggagtatatgtttgttcagaaaatggcagagatatgtgtaaaacgacatttcatatgaatgcacactaaacgagggtcactttctcgtaaacaaactaatctagtatagatgttgaatctcgatatctctctattcatattgatagtatagtgttaggctgttagcatatgttatattcagtattagattgagtatttttagtagggctaacgccgaaaatcaaacaaaccatttgatgaacattttttttaattcacagttgttgttctacctaaaaatatgtttaaaatgaaacttaattgaaagcttctttgagttacagtgtgctgtacaggttggagtcgcatgcatggctaaacgggagaagttgaccgagagggcaaaccgaggtgtagagccgtgagcagctcagcatcgatctatggtcgatccagtaggatcggtcgatcaaaatcgaaatggatctcatgagatagctttctgaccgaagccgacacttctctagtccccagaaaataacacctttcgcccactcacacgacctatggtctggaatgattattgtttctattatgagaaaactttttgtgaattctgacttgaattaataaatagtaactctattgtatttagggttttttttagtagtttagcaaagctactaaaagttttcttt

SEQ ID NO: 105146 - DNA, 538 bp, Oryza sativa
aatttgatgaagtgttttattcacccattcattttacaacaagccacataaaaatttaaattttagaattgactcagagctttttctctatattttgtagccttgatttttggataactaattagaagttaaaaaaagtgtcgaagttaaaagtcttaccgtcattttttttgttgcttcattacttttttaggtttataacccatagctcaaccaataaataatttgttgcataacacaaatgttgtagtagtaggctggaatctccaaggcatggtactagtttcaattaaaccaacactagcttaaactatttcgattttaaatagtaatctgaagtcaaacgataatttagaataattctcttgtttctatacgggacccttagagcagtataatagtagactataagccggctaaatgctgaggtggaggagagaagagaggagagagaagaagcgtgctataaaattatagccagcttggacacaagaaccaagaaactctgtgagagagttaagtgggccctgtattaatt

SEQ ID NO: 105147 - DNA, 646 bp, Oryza sativa
caatattggcattaattgacaaaagttcgccgtgcgaatcaagaagtatgtttttgccacaaacgcaccaaatacactccaatatgtccaaaaatcatgttttggtgctttttgaactttttcattccggtcaaaaacatcgcacccgtgtggggcaatattggcattaatggacaaaagttcgccgcgcgaatcaagaagtgtgtttttgccacgaacgcacgcaatacactccaatatgtccaaaaatcatgttttggtgctttttgagctttttcattccggtcaaaaacatcgcacccgtgtgggccaatatatgccaatattggcattaattgacaaaacttcgccgcgcgaatcaagaagtgtgtttttgccacgaacgcacaaaatacactccaatatgtccaaaaatcatgttttggtgctttttgagctgtttcattccggtcaaaaacatcgcacccgtgtgggccaatatatgccaatattggcattaattgacaaaacttcgccgcgcgaatcaagaagtgtgtttttgccacgaacgcacccaatacactccaatatgtccaaaaatcatgttttggtgctttttgaaccttttctttccggtcaaaaacatcgcacccgtgtggggcaatat

SEQ ID NO: 105148 - DNA, 1054 bp, Oryza sativa
tgccctttttgcttacgtttttttttcgctgggaggttttgcttacttaatttaagtgcctgctagtttctttttgctagtccagctagccactgcatacttaaattttatatctgccactgtcagctccaattatttgtcgttgtttttcaaacaacagtctgcatgcatttcggcatcaatagaggaccatcactgtgtagctcgatcattgtagctcatgaaattgatgtctcttccgtaaaggcgtcttcacttttttctcttaccatgcatatcatgcatcaaggctaaaaaggaattcaaccttttccattttgctttgcttagtactacagtaccatgtagggctcctcgcatgcatgacaagaaatgcagcaagattgtggtgttgagtttgaatactcaatgggagcagtatatagccgatcttgatgaatttatcatcacggaatgtgtctatgtttttcttttttgaaataatcaatgttaagtgcattcagatttttcacatttttaaattagtccatgctagttttggatatatatatatatatatatatatatatatatatatatatattgatacggtattgtatcgtacgtctgtaacatgttggcatggccccacgtattatcagcctcacaatgagtgatagtatatcatataatagaaatcaataatactacaatgagtgatacaggctcacaaataagtagtactaagaaagttttttttttgttaaaaacaaaattgaattttcatttcacgtttatggatgcaatgtatttgggcaagacaaagattagcagccttggagagttgggaaaatgttccaagaatattctctttttttttccaaaatacaaagcagcataaaatgttcaataaattttaagtggatgaaaaatagtggcaaatgtgataaactgataatacatataattccatactttttttaagaaattccatacttttcatacatactagtccgtcctttccctcttatagattactagtactacctagtactactctctctctctctcttcg

SEQ ID NO: 105149 - DNA, 1057 bp, Oryza sativa
tcttgtgtgcatagtatagtgtcgtcgagacacagcatgcatgcatgcggactagaacacggtcggaatcagtagcatctcttcgaaaataacgcttgatcggtcggtaactgactatatttatcatttaaactagtcgtcgttgatgttaatacaatagaagattttttttaaagaaacaaactcgtataaatagataaaaacagtacgttcggaaacggtaccctttacagaaagggagctcggtcgatcgggaatttcaccccctacgcgcgcgcgggtgcccgcagcccagccgatccgatctgtggtgcgcgcatgcgttgtctggctccacgccctgaccgcccgtcacgtggacgagtgcgcgcgcgcgtgccgcacgcgcacggcgagctcgcgagctcgtcgatcacctcacctcctccggccgcgcgggcgcggcgcgcgtactgttcaccgctcgcctcgacgcagcaaaagtccacgcgcgcgcgcacgccaccacgcgctcgatcgctcgcgaggacgcgacgagcggaacacggctttcgctgcaccgatcgatcgatcgatcgcacgcattcatggcgcgcgcgatggatggatggatcggtcgcaatattggtcaaaactgcaaacggcagggctcatgtacacgcgcctaactcctgccggcgatcgatcgatgtgcgtagcgtagctacagggaatttgaaaaacaagcttgatccatcgatcgatctctgaattcaaaccctgcaaagagaatcgaatcggacactgctatgctgagctagctacctagttaggctgctttctattgaagagcaaacagtacgtcgtatacatacactcctgctgctgatcgatctcgttgcatttgattctcactgtgccactactgcatcattggatggtacattggtacactatgctcttcaagtcttcgtggccgcgcgtgaccgggtcggtctgtctgtctgtctgtctgtctgtcgacctgatggagaactagctagtctgcaatatagtagcaacaccaatgctttgctta

SEQ ID NO: 105150 - DNA, 987 bp, Oryza sativa
aagaaatttatatgcaatcaagttaatcttatgatatgaataacccattggaaattgttgctttggacgagtaaaaagggaaaataccaatgcaaggaaggtatttggactagctaaaaagaggaagatgttcactccctaactaacaatgcaaactgtagagagaaatcccaacaataatatgggagagctacatattagtatatactatattgtttacatatattcttctatgaaaagtttgttgcaaatgctccttagtgggctcccctaactgaattttatgtgctatttggtccaataccagtgattgtttctgttttttttttcttcttttataaattggtcttttttcgatcatatgtgcagtgatacatactttgaagttttcctttcttttttaggagaacaaaagtagtacggtatgaccgatgttgtcttatttttctttccattttccaaagtgataaaatggacataaagactagagattccccacttgcaaaaaaaattaaaaagaataattcagattctccacatctttgcacgctcataaactataaaaattagttagtcatcacttggtctagaatacggagcttagtctttggcgcacatgcaaccaacgtgatcccatgtttaatttcctttattttttcccatcttttcatttcccttttactttacgttttttaaactaaaccatttgtttgatggttgagcatgcaattccagcatccaattgacaaatcccatcacctaattatgcagctgctaaaacagtagaattactattatatatttgccataataatgatgcaacgacgtatcttagaagcaagattaccagcacggcaaaacactatagtactaccttcaaaaaaaaaagaattaaaagggccttacattacacacgtatccatcaaaacatgtaagtagaggttagcttccaaatcaattaatttctctgtatgtacccaaaatata

SEQ ID NO: 105151 - DNA, 775 bp, Oryza sativa
cttcttttgtttggataaagtatgacatttagccatgacttttagaagaactttctgtgatattatcaaatgatgccctcatcacagtgttccggttctccttttagggttaggacacctttgtcactggttctagcagtattgacgctgacaccttcaactctgaaaatcccaatgccatcctcagtggatgaatggcatgagcgtgccatgctggagcaaccaacattggtgccagttgctgcaacactggtcagcaggattctggaatctggaccatgtactatgttgctctgccatctaggacaaagcctagacatctgatccgaaattcgtgcattcaatcatgtgcttttgctagtttgtaaccatcggagcgtatagctgggtttggagcaaaaaaggcaaactggaataatataattgcaaacaaagtaagacctctgaaggttccctttgtttctgtcacctgctttgggctgaactagggaactgtcataaccttagaagcctacatacaaaaagcaggcttttgaacctacgagagggtcttatttggagcttagctaatgcttcaaatacccttcagaccaagtcctcgaggttttactgagctgattttcatggctactaatttactatgggatttatatactttaccaagtggcatgtttttactcttaacatcaagctgctaagattcacacaacatgcacacttctattttaatagataagagttattgataacatcttcgcttttgtttttagtacca

SEQ ID NO: 105152 - DNA, 684 bp, Oryza sativa
cttttcttctgaacagaaaccacttgcaatgcgtatccggatgtcatacaaagtgaatggtgaggacagactggaacaaggccaagtgagcaattttcctgccggactatagtactgctcggtcagtgccattttgttgttacattattgtcgtgatagtcctctccatttgcgtaccttgttctacgtggttctttctgttttctgtctcccttggaggggttggttgatcaaaaatagttattttctcattcattcttcctatatattgtatagtagtagaaaggtacaatgtgaaatattcagattcatcaccaagataccaatgtactcatcagttcacgcctggtgtgctgtgtgcatcagtgactgaggaaaattaatgaaagaaaaatgaccagcctccctgcccgaataggaaaatttcttggacgccgttttgaatcttactcatgctgcagtacgtgacgaaattctacggcttgtgttcgtgtccgaaacagccttacgattatattgtcgtcgtggtagaaggaaacacacccacgatacgttacgtgcatcagtggcaatggttgtcgacgacggcgagcaacgagcgtgcgccgccgccgccggcgacggcgatggcggcggagacgaccatctcagcgggctacccgacgatgtcctgctcgacatact

SEQ ID NO: 105153 - DNA, 661 bp, Oryza sativa
atggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggattatatagtctacttctaatattccttatttttaattccgaatttcagttatttcctaattgtatttctatatggagtctatactctacttctaatatttcttatttttaattccgaatttcaggtattttctaattgtatttctatatggactctagtctcctcttctaatattccttattttttaattccgaatttcagctatttgtaaattgtatttctatatggactctagtcccctcttctaatattccttatttttaattccgaatttcagctatttgtaaattgtatttctatatggactctgttttttctttttctccgattaatgtgagaatttctaggccatgagagcgaacgtggaggctcctttttctattcctttaattatataatagataatactttaccactatttaccgataaatattagcacact

SEQ ID NO: 105154 - DNA, 739 bp, Oryza sativa
tttccttgctaatagaatagcacttcatatggtcatttttcacttgttgtatctatttatgttgaagatgatctatcctgatgagatgatgttaaagcaccgcctgacttcagctagtgagagcacaattgtgccaggttagagaacataaactatttccaataaccaatagtagtttcagattgcatttttggtgaacatttttttacattgactgaccttccctttgcttcttcaataggaaccgatgagaagtcggttaggcagaacacatacatgatgaatgctgatcgttttgatagatatgcactcagcaaagaccagttgcagcacattatgccgaaaaacacagaaagtgtacttgatatgccacacttgcaaaggtaaaagcttcttttgccacttatttatagtataatgaaagtaggctccattttccttatagataggattatttctttatagtacaccataatactttcctgtgatcataagcatattttaaggaaactggatttggatggcctaaagattagcgtgcgcctattttatcttgttttttcattaacatgtttagtaataaatgaatgtcccatagcagcaaggtttcttggtctgactatcttattctgagaaatagagaaaggaccctaaaattcaagctgtaggtagattaaacagcaagaactaacataattttgcaaattagactatgcaactgcaattattagactatgca

SEQ ID NO: 105155 - DNA, 612 bp, Oryza sativa
agtttgcatacttcaaaagaataagttggggaaaataacatgcgccttactgcagttgatattatagtaaatcaggttaactcaaatatatttcactatatgttttatacacttttagctaaatttctacaaaccttagttccatttataaagcattgtagttaactaatgaaaaatcaggtaagaaaattacttttcaggacttgcaggtgggctccttggtatatctagaagatgcctcagaaaagtttttagcatgtcctggaaagatggtcttcttgaaggtttgaactgcaaacagtcaccaatcatcttccagagctccccaggaagtcctacaccgactacccttgaatattgaggcggtggcttcctctcttttacaacagacttacaaatttcctctgcacttagcccagcccatctgcatttcaattagcatctaaccacaccattcgaggagcattaagaaacacaaatgaaataatcaggctacttacggaacagcaccagtacacatttccacaagtgtacatccaaaactccatgcatctgactctggtaatattccatttgcactatcccaaaacagattcattgacttcttcaatg

SEQ ID NO: 105156 - DNA, 1629 bp, Oryza sativa
ttagttgcttttcctttttctcagtgaaacttctttagatcttaatcaagtttatagaaaaaaaaatagcgacatttacaatatcaaaatagtttcattaaatattacattgaatatattattgataatgtgtttgttttatggtgaaattgctatttcttttatatacctagtcaaattttaaatggtttgattaaaaaaaaatcaaagtaccttataatatgaaaaggggttcccctagtgcacatgtaattttatccatacttaaaacatattgttttaaacatatttttttcaatcaaattagatactcaaacttaaactgtatcattttatatattaagattgaatgtgctcatctttacccaaagtaacctcgtactcttataatatttctgggttttataactatactactggcatcggtgtgcattaggtaggtgtcatcaagatgagatgagatggacaatatgacttaattgacatgaagagaatttatgttcaaatcataattgacatgaggagaagtaatacaaaatgtaaatattactatgagatatttgggtaagaatcgaacaacaaacctcatccatatgatcagataactgcatgtatacaacagtcagtattaggtgcattaacactattactccctcaattccaacagtcactatgtttattattattataacacatctctctcgactaaattaattgttattattttaaatctttcatgctcaagatctctgattctattgggtatatgcattatattttttgattgatccacataagaagaaagtgataataattgtttccaaatgaatataatttgttccaatcttatggattaagggtgtaccttataatttgtaacagatggaatatgatatgatagttagttctctccccgtccttatatttttttatatggtctttagtggcatacagggtggatctagcatgagggcgacggggtctcgagcctccactactgacgtgagaactatagaaacccccacgaatcctccactaaaattttttactataaatagatggggagaggctatagcttcgtttagtttattcagtccctcatgttatttctttatccatcacgtgtggtctactttgaccattaatatatttcatattatgtgcccaatggatatgtaattagcataactcgaaagtacttcaaaatataaaacgagtgttataacgtgcataatatttagtataatttggttagtatgattattagtcaaaaggtaccaagtttaattttccttaaaacgataatttgggacggagggagtatcattatactctttatattatataaatataaataaataacatcactattgctttctaaataagctacgatgagagcataaaaacgctttcgacagtatcaattcctaccaaaaatgaaccgcaaaaaaattccataaaaaagagagccattccttatcggaatcagaacccccactacaggattcgcgctccgcacgggcgggcagcagcaggcaggctcgctcgagaccgatcgacacgataacgacacacggccacagtgcaccaccgcccggccgcacccgatccctcccctcctcggactcc

SEQ ID NO: 105157 - DNA, 2456 bp, Oryza sativa
acattgcagatgcaatccacaccgaggatggatggatcggttgatctgatacgtattgactccgctgcttgtcggtgaaacgcggcgtgcacacacgtggttcttcggtcgggatggccaataagggcctatttagtcccctgaataaaatttttcacgctatcacattaaatatttggacacacgtatagaatattaaatatagataaaataaccaattacacattttgtcacgaaattgcgagagaccaattacacagttcgtcctgaaattgtgagacggatcttttaaacctaattgcgccatgatttgacaaatgataatgtggtgctacaataaatatttactaatgatggattaattaggcttaataaatttgtatcgtagtttcctgacggaatatgtaatttattttattattagattacatttaatactttaaatatatgttcgtatatccgatataacattttgccaactaaacaggccctaaatatagccttttttctgcttttgtgtacttccagtactttcttcctagctacctctagaaataagtacttccccgataaactaatttcacatgatttttttatgccatgagtcttcactgatcaattgaaacttctatatgtttttgttataggaataattttaaatattacattttagtaccaatgctaccaaaatttgataaagtttaaaacattagcttccatttcttacctaatagaatttggcattatcaaatttgtagtactgttgatttggataacaaattaaaatagccttaaaatattcagcccgaggaaaggacaaaaacataaggactcctcatcgatagtattataatatcaatattataagtaaaagtgatcttaacaattaatttatgaattttactaatatcgtattgtactataatagttaagatagtagtataaatatatataatctattagattataaaatatgaacgaataagcaaaacatcagcagttccacattatttgtatatatacaccgaattcgacaaatatatacgatgcgagaggcacctaatctgattgaatgcgtggtacattgaacgcagggatttggtgctggagcttttcagggcaccatccaaacacaaggatattgcgggagattgtgattctgttattattgctggtcatgaacagttgaaaaatgtgaatatatagcggcagaaagctgcgagcaacttcctaaagtcttttctctaatcatgcatgcgtcctcttggtcagctcatgttctctacataggcctagtttaggcctgtttagttcccaaaaatttttcccaaaaacatcacatcgaatctttggacatatgcatgaagcattaaatatagataaatgaaaaaactaattgcacagttagggaggaaatcgcgagacgaatattttgagtctaattagtccatgattagccataagtgctacagtaaccacatgtgctaatggcggattaattagactcaaaagatttgtctcgcggtttccaggcgagttatgaaattagttttttcatttgtgtccgaaaacccttccgacatccgatcaaacatccaatgtgacatccaaaaattttcttttcgcgaactaaaccagttcccaactttttctttaaactcctaaccttttcatcacatcaaaacttttctacatacacaaactttcaacttttccgacacatcgttccaatttcaatcaaacttccaattttagcgtgaactaaacacacccatatataagcagagcaacaagtgtgagaatgctactggtagcagtgtacgtaatgtggtcgggctgtacgttttttgtaggcacaattaagacggtgacgctgcaatgctgtgatgagtgtagacatggtggactaattgtcggatcttgtacgaactggtgccccagactttgtgttaaacgaaaaattacagacgataaatatttccgttacgatatttggttggtcttttgacactaggtaagttggagctgtacgcatgtaccaaacaagccctacatatgctatatggatgccaaattcctatagtgaattgagtgtgtagctatgttactcagtgttttataaaaatgtaatactacctctctactaaaaattaataagtttatatttaggctacttttgtactaaataagatcatttatatcctagtacgtacccttaccgtaaatcgatgagttttatttcttcaatatttcttacctattccctccttcccataataaatttatttttggctcatctcatttgttgcaaaataactactctagattcatccacatgacttggttttttatgggtcagaggaagtacatttttgagtaatcaccgcgttgaggttgtgaaagtataaaataattgtattgaaagtataaaataattgtattttaacttttaagta

SEQ ID NO: 105158 - DNA, 775 bp, Oryza sativa
agagtttagtagtcgccgtgtgttatgggtaaaagcatttaacttgatacaatgaactagttgtccagttgatatatgaacttttaaatttttattttgaagatgggttgtattttttcttttaaagattggcttcaaagttcaaatctaggaaggcctttgtactgaagtttcaaaggcctgttttgatcattataaatttttattattattatcaaagaccactgcagtacaatttaggtgccatgacggaataatttttgcattaatgtaggcctacctcacttaaactctgaatcttagttgcatgactgattgatcagtgatcatcttagcatcacaaagattgagtgaaaaaaatgttttagaattatttcagttttcagcaaagctcataatctatatagtgaagattactactagataccaacagtatccaatgtcttgttttgctgtaatatttgatcaaaatttccaaacaactacttactatagtttcttctagacatatgctacctatgacaagaatgacctatgctaccctttccttttttagcaccaatctaatggttcttaaaagcaattcgcaactgtaacatttattgatatttctttttcggcatcctagggatcgaaacactggtatctgggatgaagtatcaatatccgtaactggggtgagtttttccacccctgcattcttttatgagtatttttatacttactttatttgcatgaattccttgattgttgattatatgagtttttttgttgt

SEQ ID NO: 105159 - DNA, 1810 bp, Oryza sativa
ttcctgcagccctacctagcttcataaaatcttggatccgcagttgtgccaaacaaacacttgagaaatcttaagatactgaggctgtaagacggccgtgatgacaggggaagaacgttaataatcacaatctggatcagctgaccactgtcttgtgcagtagggtagaaatgatggaaacagctgtgacatgacacctctaaacttgctttgttacccgtaattagcagtattattgatttataatcctataatttctttttaatcatctgcagagatgttcatcttaggggccgtttggaacagttcggagacagtaattttacaggaaacagttcaattctcgtaggatttatgaaaaaaaaaatctgcatttcaaaaggaccttaactggtcattagtgcctttttcgaaatttatctctctccactcagcaaacaatgatattttgaatgttgtactgtgttttggcgaatagacgctcaatctcacaggatcctaatgcaaacaggacaatgacatatgcattgtgtttcaacaaacaatctacaaagtccaaactagatatgcagtagcaaggttttcttttttataaaaatgtgcaatggtattgagaaagctatcgatgttattggtgtggtggtgaagttgtgcattagtgtggtggtgaagtcgcatgactatacttacaaaggatcaaatctttgtgctcataggtattacgcatatgtaggtgcaattttaatagatttttagtgattatagggatcggttgctagtctatgtttctttaagcatgtgaagcacactcattggcatatgagtgcgcatcttccattaaattttatatattaagaatatacagacatgtactccctccaacttaaataacttcatttttcaccatcttatttgtttcaaaatattttttttcaaacaattattgcattagagtttgtaaaaattggggacaaaagcattgaggttagataaagtggaggtggacatttataaaatgagtatttctttttttttgtattggtaaggtgtaggatgggtgaaaaatgaagttatttttgggaccttttaagcggtgtgtgcatgtgtgtcttctatttaatcaatataaaaatatgtaatggttctgtctgcattaggattattttatatatagggtagctgttaacacattgatctaatggttaatgcttggaggcaaggtagattttttaaaagcttatttctttcatcggggtaacatctgcattctgaaatcgacgaagtaggtgacgttcagtacgtaggccttgtatggtttgggaaaatttttgggtttgtagtcacattggatattcggtacacatttaaaatattaaacgtagtctaataataaaacaaattataaattctgtcaggatacaagacgaatttattaagcctaattaatctgttattagcaaatgtttactgtagcgcaacatcaaatttcttgattaaggctgtgtatggttccctttaaactttcaactttttcgtcacatcaaatgtttagacacatgcatggagcattaaatgtggacgaaaaaaaatcaattgcacagtttgcatgtaaattgtgagacgaatcttttgaacctaattacaccatgatttgacaatatggtgctatagtaaacatttgctaatgacggattaattaggcttaatagattcgtcttgcagtttacaggtaaaatttataatttgttttgttattagtctacgttgtccgtatacgataaagaaaatttggacggggaactatacacgc

SEQ ID NO: 105160 - DNA, 698 bp, Oryza sativa
attatggcgacacatgttacactatgaattttttagcaacttgatcctctctgcaattcgtgtaggagcagcgttaaactggctagctaactaaagctactcaaaaagactcaattcttgggttccagtgtccaacgtttgactgtccgtcttatatgaaatttttttatgattagtatttttcattattgttagataataaaacatgaataatactttatgcatgacttatctttttaaatttttttataattttttaaataagatagacggtcaattgttagacacggaaacccacaaattgagtttttttttgggacggggggagtagctaggtaggcagttatttatatatttatataattttacacggtagttacaacacacttacacatcagttacgtatgtaaactcgacttacacatcacttacatatgtaattagtatgtaattttgggatttacatatgtaattttaggacttacatatgtaattttgggagttacattgtaaatataataaaattacatatgtaattttgggacttacaatggaaatatatgccaactattttttggtgaaaaatatagcgccataaatatagctactccctcttaaaaaaataagcttaggaaatagcttaaaataagtggtttaaacaatagtataatagaagaaagttttcttaaaaaaagttt

SEQ ID NO: 105161 - DNA, 901 bp, Oryza sativa
gttcttatgttcattagctttagcgacacggaaaatgttgaaaatacttgagttggggatatggggaatgcatgcatgcaggcagcaggttgtgtaccggcaaagtgccaaaccattaaagtttgcaccattaattgggggcaacacagctcacaacctaaccatatgccacgagccggtgtaagcgggattgggagccttcagtcatgaacgagccatatttttttttcttttcttacaaacaaagaaaaccacttggagatagggttaattagtcgtcaaacgtatgtacgacttgtagagctagctggaaacatttgatagttttagttgataccctaatgttatggaatgtagcagcatgtgcataggagtatataatactgtcacattgctacgacggttgttgtatgtactaattattaacaagccatgtgaaaaatacactaaactaattgacatcgacgcttatttgtattaatttcttgagaatctattgggtgatctttaataaattttaccgcgtttagacaagtctgcaggaaaatgtgtgttattacgcgcgtcgacttcacttgattggttttgaacccctgcagcttaggcaagtctacagcttgagattggagcaagaaacggtcagttcattaaataattatcaccgctaattggtcccatggcatgtcaatttcgcggctaatcccatcgtgaacaatcgttcaattcgtcaattagagtacgtcactgcatacctgaactgaaagaaagttgggcatgtgaacagtcaagtcgtcatagggaagaaaaatactgaaagtaccacgcgagacaaattcaaaggatactatggttgtattttgctatgtgatcgaattatcaacacactgcacggacgatcgat

SEQ ID NO: 105162 - DNA, 2087 bp, Oryza sativa
  unsure (1)..(2087): unsure at all n locations
ttcctgcatttcaaaatattgatatttaaaatttatctagaacatagatacttatccacctttttttatctcaacccactgtaaccacaatttcatatgattttttcacctatctccacatatctgctaatcatagttacgactcatttaatttcactcatttcttaaatctcgtaaagaactcagaaatatttatattttactgtctatgccttaaaattttacaacttctagagtttaaattttgctaaaaaaattaaaaacttactacttataaaatatgacttttatcactaaactaccatatactcctacaatcctttggctttattatggtcctaataagtcagggcggcataancttactccaacttcgagaaagacaantcaagttccttttagagcacatccaagagatgtacaaatctcctctctgaatctctttttagataatcattaaatttaaggattaaatatattcttccttttaatatatatatatatatatagcctatatttaacactaaaataaacatatgggcctccctccatatttttgtcatctggctcagcgatcacccatctaggaccccctccacccttgtcactttttcagacgacaatctcgagatgggaattttgagcaataatgatttccaacttgtgaagagcaaaaataaaggaaaagaaatacctttttttttaggaagagtctgtttggccgaactttagctctatcttcacctctcttatagttagatctcagtcaaacagtctgacttagctttacctaaaaaaggagtggagctgactggatgttttcacgaaatgaactagagaggggaatgtgagttatggttgtttcacaactctactccgaatctaactcttggagttaaatttagaagttagagctgtgctaaataggttcgaagaggaaaactattgaagcagttttttcaactaataatatctttaaaatatcaggattgaaaatggaataaggacattgttgatgatgctcttatccttctccttaatgcttatgcgaaaggctaatatttactcccaccgtttcaaaataattgtcgttttaggattcaaattctttcaacaaaagcttatcactttagagtaacttttgtcacatcagtcaactcctatttaaaattttctccattctacccataactattctcttactcccaacctcataagagatactatagttatttttgcttaaccttagttttttttttctaaataatctagaatgacaactatcatgggacggagagagtactttaaaaatatattttaaaagtgtgaaccgcctcattttaagtgcacttgtggctttcaatggcaatgtttgattgtccatctatttaaaaattttttatgatcagtatttttattattattagatgaaaagatatgaataatattttatggtgatttattttttaaaatatctcttataaattttttaaataagatggacagttaaatgttggacacgaatgccttaaaatgggaatgtgtagatcgcgagcacgtgatttcctcaaagaatttccaatgcaatatctctattgccaacaaacatcattcgtttagaattattccaagggaaattcaaccccaattttcctcgagttatcttgcacagtttctgcattttcagtggctgtctcctgcctgtcttccctaccctacaggctacacgaccgacactgcggatttcggacgcagcggaaaagacagtgatttatcgtcagattccgtggtaaaccgcgccatcttgccgttcacgtccccactcaactcgcacaccctctcctctactactcctacacctgtcagctgcacggagcacgcagcagccacgctgtccgagccaaagacaagccgcggccgccacgtgctgctcgcgcctcggtatccgcgacggtaaaacacggaaatggacaaaataaacgtcctgtctccaagtgggcctccctctcgcgcctttacttttccctggtcacttttgacactttctgcatcacaatgtgtgcgctgcactgtactggagtacttct

SEQ ID NO: 105163 - DNA, 1083 bp, Oryza sativa
aactgcggaatggtcccgtcaatggcgtctgctcttcccacccatattgaccaaactgatcagtgatcactcgatggctttacccaaacgaggaccaacaaacggggtgcagcagctagctactactcgctctttcatttggccagccagccagccagcaagctccacgctagccacgcctttgcgtgcgtgcccggctagctcagctagctagcctccggcgacgaccaacaaccatcgtgaacctaaagctaccaccaacttgcacgacgatggctgggtccatggcacttgatccaactgctctccagggctttctctgctccattgcactgtacatcacattgtaccgcctgaccaggctagatctgggcgtgacagcttgatcaaagttgcttcacatcgcagcctctccggccatggaaactgatctggtggtagctaggctggttactggtatactttagtggtttggtgtactacgatcgtagtctttgtacacaattcctaaagaccttcctgctcccctcaaatgtttctgtccaattcttgaaggctgggacttgtaacgaaccttaaagttcaggaggagcataaaaaaaatctgataaatatacctaagtacattgttttttttctttttatgtcaactctagtttctttctaggatggtagtaattcactcagcacactacaaaccaaccaaatgtgttttactgtctcgactagtttgtactatttcattttcagtatgcaccaatggccgaccaatcatgtgcctaagaatagcactagcatgaatctcgcgagcaatgaagattcggcaaccagctgaatatcaacgtggaaaagactaatgggacttacctcatactagtactttgataccttcatggttatcaatgcatatcaggctaacactaattaagcaagcgaaagggaaacattgagatccaaacagaaaacctacggatataaactgtgcaatccattatctaaaaaaaaaactgtgcaatcatttttataccctaaaatgtgtccaccaaactgtaccgactcaaacccaccgacaccctggccata

SEQ ID NO: 105164 - DNA, 976 bp, Oryza sativa
tatgggcatgtatatttaacacaatcaaaagctctctctacaacgtgaaattacattgcagtggccaatgggtaactaaaagttctctctacaatagtggacagtgggacgattattgtgattttcattgtcatagcggatagcggacatatttcaatagtgcgaaaaaaatactagtcaaaatataagtaaattgtttgtgtatattaatttatgtgagatcaatttagttttgaaattataatttgtagctaatttagtcagaaggtatcatttatacaacttattagtcgtataaccaagcctaaaaagttaaataaaaacattttataacatgtaaaatagctcttgccacaatagcagccgctagcccactattttaacactcataatgtttccgtcactattttagcaacaacatcatcctaatagtaagaacatcccactgatggtttattgctattgtggctgcaatagtggtcattatcactgctacttagtactcccgcgtgggacttaattgccgccactaccaggcactatttttatctccatttacacatatcatagtttaaacatacaaatttaaatcacctagcgcttacaaaacattacatgttatgaacactcccaagaggacacaacggggacatggataaagtggacttaatgtttgatgtgcttcagttcttgggaactcaaaatatgctatatattgagataaattaaaggggaaaatacattatattttgggacggaggaaataccatagtaatatatagtacggattgagatcctctaacgtgaaatcagagtaacatgatcactaacatgcaaactccatcacccatgggctcatatataagtgataaagggatatgtaatgttagtgggtcccctttcatagtacttttttgttagataagaggaatgccacgttgcacaaatgtttcgtagcaatcaaacacaaatgtca

SEQ ID NO: 105165 - DNA, 4201 bp, Oryza sativa
caaccataggcattgcaacatcactcacggcctcatcaggataattaagctccatgcttccaccatcttcttatagctcttaatccacttgaagaatgtacaacaatttggcacctacaaaattgcatacagaccaatttcaaaccaaaaacaaaaacaaatcaaatgcacaaaataaatcaaagactcacaaattgttcgttatcctcgcatttgaagaaaacgcgtccccctgcctccaagatctgcactccactactgcacttccacaacgagggcaacgaacaagggtgaggccactgggacctataggataccgagttgccccaataagaccaggtaatgaggagctaccttcttcacttgccactccaaatcttcgctgcatggctctagggttaggatttcctcccagctgggaacggcgggcttcggccatacgggcggaggcggaaaggaaacctccacagcacagcgacaacgatggctcgagaagaactcgctggcgccgacgacggtgcttcagcacagcggcggcctccatcggcgaggactgcgacgcggtgaggacgggaggatgaatgggctgcaccgcaccatttcaactcggttaaaccgaccgcaagggcatttcagtcagctcatctgggaaaaaatgtcaaaatccaatgaaatggtgaatatgacactgcagcgggctggcaatgcttggggatggttttttagcgaatcgattcggcggagtggcattccagcgaaaccacttattgggaatagcagaatgtccaaaacctcctcaggtggtgttcttttttcctgaatatgaggatgaagatgaagattaagtttttttacgtaaaacgaggtggtattaacgtatgattgattgagttttaattattaaaaacttaaaaaatagattaatatgatattttagagcaatttttatatagaaagtttttgcacaaaacacaccatttaatattttgaaaaacgtgccataaaaatcttaatcttcatccaacttttgttgtagaaaagaactgggcctcagtgcgtttgacccctttggcatggcatcgccgtcgtctcccagaggcctcgtccttcctctcttatccaatggcatgtacacgctcgtttgtgacttgtgaggtccccgtagatggacgacgactgtttggagacgtcgttcgagggcgtacgttggtggccctccacgtattgtttacgtggttagggcgttcaattcgtggggcagaagacagcaacatcaccattgattcaaattaacttgtttgacagaaacgtctttggttcagcttaatttgcccgcggcttcaagcaatactacataagaaatgggagtactgcacatttgggaattggagtactagttactacctttgtacctgatcactcatgttttaatcactatttcctgggccttcttatctgtgcttctgtagggcaccatgagaaaattaccgcaatagtttgagaagtacttcctccgttccataaaaaatcaacctaataccagatgtgacacatcatagtactacaaatctgaacatacatatgtccagatttatcgtcctagtatatgtcacatctagttatagattcgttttttatgagacggagggaatagtaaataaatctgatcatcaattaagggtctgtttagttcacgaaaagtcacatcggatatttgaccagatgtcggaatgggttttcggacacgaatgaaacaactaatttcataactcgcctggaaaccacgagacgaatcttttgagcctaattaatcctcaaaagattcgtcttgtgatttccctcctaactatgcaattagtttttttaatttatatttaatgttatatacatatgtccaaagattcgatgtgatgttttagggaaaaaattttgggaactaaaccaggcctaatgtgagaccaaatcaatgactgagcacgccaaaaaaaactaggtgggtcaaacccacaaggcatatattgaagtcacatgtatacatgaacgtgaagacgagcctgagctgacacttaaacttgaaaatggctctaaaaatctacaccaattcttaatccattaaaaaaaagataaatataaacacattactgtagggcagattcttaatccattaccaaaaatgataaaaaatggtaaacacattactgcttctagctcctgatttgttctcttgttgaatctgctaaattgcaacctaccgatggtaatgggtaatttctagtgactaacgactttcagttaaataagcgcattatctcttcttaccgttctatttctaattggaatagtgttgcggcaatcgggtgacacacctcgaccttttccgattataaaagttgcatgtcgtaaacttggatatataactttttatcaactatcgatggagattcataaataaactttaataaatgtgtactccttatcttatattggttatttcttatttttggttggtgttttcaatttttattttaactacactctttttagagtgctagattataataattggctgtaactcttctgagcaaaggccgggatgttctattattaaaaaaaaaagaagcctcaggcgctagctgcaacttctgaactggcgccaccgccgcgcactgcccgcggccggcaatcccgctgcctttgtgcctcatgtcctctctcgtccttcatggggcgtcggccgccgaggctacgggtaagtactccctttgtcccaaaataaatgtggttttacactgttaatgtctaatgtttggtcgttcgttttatttaaaaaaatttatgattagtatttttattgttattagataataaaacatgaataatactctatgtgtgactatctttttaaaaaaaattatattttttttaaataagacggacggtcgtggatatggatatccacggctaagcttatttggacggaggcagtaggcaagtagcgatgcgtgacacagcagcgaaggacggcgctactgaagttcgtgaagctaggggaccaggggtgactgaggtgacgctaggagaggaggtcgccaggttggggctaggtatcgaacagatcgggaacaaggccagggagcagatcgagcatatgtagcccaacttgcagactgtggcctgcgggggtagggggtgtccgggccgccggtagctgggccaagcgcactactttaccgtatggggccatccgcctctggaccaaattgtagggccattttagattgaagctaaaatgtgaccttaccaatttatttgtattttgaatagtgatagtgtatttttgattgaatccaaattattggtaatacccattaacaatttaacactaatctagaactttcttctctatatcatcaatatttggctttacattggtagcaatttaaatatgtaccatgcatctctaccctaccaaagaattggtagtgccaaaacatgccaaaattttgacacaaccaaagatttggtagggtaaagaaccaaacagccccataatgatttatattaaaacatgagttcaattcatgggcagaagttacctcgtaactagttgataccctgcgctttccagcgggacatgtcgataaatgcatgttatacattaaacaaatgatagatttatatatttaaataatataaaaatgacgtggagataatgatttgacattgcttacatattgagctctaaaaatacaataaaattgtaaatgatatgtcatatttgcatgatatttaaaatacactagatgataattgctagtgagtaataatgcggcacttttgcatgtgatttaaaatactttagataataattgctagtgggtgatgatgtgacacacttgcatactgtgttttaaaagttagtgtgtatcaactttacagtaagataggattagaggcctggtgcttaatgcaaaattaatcccaacatttggtaaatgctaataaccaaatatattttcttaattatataactgatgcattttttcaataataggaaacacagaaaaaaaatcatcaattgtcattgtcgaggcaaactttcaaaaccccaattagagtttagaaaaaaaaacatagaaaaatagatgagatggaggagtggattcattggtaggaggaaaactgtgagggggaggaaatg

SEQ ID NO: 105166 - DNA, 725 bp, Oryza sativa
ttcctgcagccctgatgaccgagttctccatgcaacacaagatggcacaatcggtagcttcgctggtactaatggcttccttctcaaggcattccctgtgtcattgaccactttgacttcctcgtcagagtcaagaatttcaatataggagctcccttcattaaaactgagagatccttttccctttgactccatctcatccttgatagcctcctcatcctcatgaggcctcacttcactaacattaacattgtggctcaccaaatcttgtgtttccaccttagaaaagtcatgcatttgtacagatttgtcaccttcatccgcatcacccccaaaattatcaccgtcgtcatcagcatcattatcattatcatcatcaaattccatctcatcctcagcttcccagtccactacatttgtatccaaatcagcaaattccatctcatcctcggcttcccagtccactccatttgtatccaaatcagcgccattgctgtaagcacgaatgacatctccgacaagcttttcctccaacatttcatcgtcgtaatcatcctcatcggaagccaactcttcattcactggatccaccactgataactccgtgttcccacgatcctctgtgccctccccagcgatgatctcaccgccatcacgattcgaattggcgacactggcttccacattaccgcagtgctcctcaattcgatccccaccagcgacgc

SEQ ID NO: 105167 - DNA, 611 bp, Oryza sativa
gcatggaataccatacataaccaatattgtacgatattatatggattcgagtacatgccacattctatataatagataaataaagtaatatggattcaagtacaagccacatgtcacgccatttagtcaggtccatttactatcacaagttcacatgcatatactgcacacattatttattacagcagttataaagttagcaaaagtgtccatttcacatggcaacttgtcctctagcgtatggacttttcatatgagatgcctcgaaacccatgtcctatggaccgtcatttctattttgtttgtgccatcacttccgacgcccgagtaacattaatgcttgtctaaacatggttgatgttgggaggtaacaagccgattaacgctaatatatttcagatttaaaaacaactctataaggttcaatgaattttgaattttgatcctcgcgttgaacacccaacatgtaatgtttttaatcaattgcaaattgaagctaccacacgtgtatatgagcatctttactgtttttcgaagaaaaaaaaaagagaatgaaacaattcttgtacacccggttcactacacggcagaaatgctgagccttcacagaa

SEQ ID NO: 105168 - DNA, 659 bp, Oryza sativa
aaaagggaaccacgttgtccgccgcccccactctcgcgcgtgaaacatgtcgagtcgtgtgggggagggcgcacgagactagttacgaattagcattcacataggagaaaagtagaggttatcgtaccccggcagtataagcccgataaccatttagttatcaccacgaatagtaggaaaattggacggaatttattaaataaataaatatcgcttaaatgtattttgaatttggtagagctattaggctaccttaccgttaccgcacccaactactacggtcggtaactggcggtcggtaagagaagctctccttgctgttcccatctttccaatgccacccaccgtgctatgtttaaaaaccgtgaattaattatttctccgttcagctgaaatcgaatcattccatataaaattcttgtattctaaactggcgcttgcccatgctgtgcgttcgtaaattgtgttttttcggaaagagaagtggctcacttagtgaaacaggacttagacttacgtagctgggcgtttaagcctccttgagctgtgttttttatcttttgtaatcaaggatctgtctgtattctgtttttcttcttaatcaaattccggcagagctcctgccgtcgtcttcctcaaaaaaaaaatgtgttttttct

SEQ ID NO: 105169 - DNA, 635 bp, Oryza sativa
aatctgtgcaatgaatatgttcatttaaggatcagtgctatcctgccttcctatcttcattgccaggagaggagtatatatttttgttgcaacagcaaatctgaagggtccaaccggagcctggaggataccaagtggtgtcaacctatggaacctgttacctgtttagtacctagggtgtgtttagttacgccaaaattgaaagtttggttgaaattggaacgatgtgacggaaaagttggaagtttgtgtgtatagaaaaatttttgatgtgatggaaaagttggaaatttgaagaaaaattttgtaactaaactcggccatagtaagcaaaataatcactatcctatgagaaaaatatctgactgtcagaaagttgtaaaagcaaggtgctagatggaagattcaagattctcttgtactgtttgtactgctcatcgtatggcaccatcaggttgtaatacatcacatcacactgtcagattattactactatttgttttatatatatctaccataacttgtgatgttattacgtgcaggattaattgggacatgacaggttttgttgttatcagaggctcacctgtgcagtttagttgatgaggatgcttcaaatgatataaggttatctt

SEQ ID NO: 105170 - DNA, 588 bp, Oryza sativa
catctcgtgtttctaattatatagtttttaaaagtcacaccagttgctaccccttatgtcatctccttctttatttgcttgcttgatctaccactatttctttttattcttcttgaaacctttaaaaattggattttatagtttttagagtttagtgtcatgttgggtttcatttttataatttctagatgtcttgtcaaacgttgtcattatactcctctacggcccgtctaatgtctcttctctttattgtcattgagattttaaaaatcgaacataattattgtctgggttcaattttactttcaagaagtctcgccaaaatgtctatggctttgccattgtactcctctatagctcgcccgcagcattccttctttattgtcattgagattttaaaatcgaacatgattattagtgttttttttttactttttagaagtttcgaacctttaaaaattggacttgtagttccattttttatattttttagaagtcccatcaaacgatgccactatgcccctctatagcccgtccgccgtctattctttattgtcattatgattctaaaaatcgaacataaatatc

SEQ ID NO: 105171 - DNA, 757 bp, Oryza sativa
tgcagcccgccgcgtgctgttgccttcacgagctcaccaagtttcctagattgtagagaagaaagtgatgagagagctggagagggaagtggtacaaagtgaatcattttgcaaacttatctaaatcaaagtgaaaatattttcttctccctagtccaagttgcaaccttggtaaacataagtggccactgtgcaattaactgtaaattatatggtgtataaataccgacgtgtctagacctcagcgacacactggagcgtatggtttaacgagacaattcttcgcttttggttgaaccataaaccaaatcacctacaccagatcatgacaaggaaaaaagggccgtaagcaaggctgagaatcgagaggtctgggaagtccacggcttgggtttataggcttcagagaggaagaacctgaaaagtaggccgaatggccaagcaacaatttgtgggatgctagctagtggagtggcagcatttgttcaataacagtagagcatctccctggattaattaagataaggaatccctttaagatgactcgtgtagataggccaaacccaaaatacacttttcaaagattagccgataaaaacgaacatgtatgtctcgctctcaacggggtgcatgtgtgctcagccgccgcaccaccgcaaccaaatccaagcatggtcccgtgccaaatctatctcaactagtactactactatacatctgcatctactactattctactctactcgcaagtctcaca

SEQ ID NO: 105172 - DNA, 740 bp, Oryza sativa
tgatcgatgaagatccttcttgtgcggattagtggtgtgggtttggacagggaatcgcgggcgaaagccttgccgagccgtttggccggctgacgacggcgacgccgtttggcatcgttcccctccttggaggcgtcattttagattacccctctccttttctaaccatattctccgggtgaaaaccttgcttccttccgaacgagcggtggcggcgatccacgtcgcgtcctccttgggggcaccgctttggagaaacctcttcgtgcaaggattgtcaatggtctatgcattggcttcgaacttcagtcctaggctttgacgaggccttctagctccactttttgttttgcttttcttagtttgtgtcctctcttttcctgtttggtgtgttcaacttgtcttgaactacactctcttctggagtggaattttgtaataattggctgtagctctttttgagcaaaggccgagatattatattccattatctaaaaagctacgccgaataagaaacccaccagaagttttgataggggtcgacgccaaagcagataatccaaagaagccagccccatccataccaccggcaaggatagcaagagtaacaccactaactgcaaaagaaactgaggggcatcccgattagggcctccacgcatgggaggttgagaccatctcagcaaaacttgaaaccttcagccgtgtaattgatcttcactggaggtcaagaagaagac

SEQ ID NO: 105173 - DNA, 1186 bp, Oryza sativa
gctcaatctttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtataccccggcttttcctgggacggggattaatacactagcgttcgggaaaaggcaattttcccggtcgcgacaagctggtatcagagccatctcgactgtaggataagccaagtggataaaacccaaggacatattttataaataaaaaaattatttgcgaaagttcctttttctccttcccctaatgctatttgcaaaaggtttactcttttctttcttcggatttcaactaagtactagatggtcagctttgcgaagaagaagatgtcgtcagttgtttgccgaagctccggaagactgcaggatccgctagcgaagcaaaggaagcagtgaagccagctgtgaagcaggagtgaagatcttggagaacccgtcgtagaacctaagccaccctatagggtagtgttgttagtcgtgtgttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaacaaattgcttatagagatactacagcagcatcggatgccaattttgaacccgagtcagatgcaacctcaagtacagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtc

SEQ ID NO: 105174 - DNA, 589 bp, Oryza sativa
aggctgccaccagtgctgcgccagatgcaattgcaacatgcatttttctatgttcatctttccctatggcagtcatgatagtgttgtttgcattggtagactcagattggcaataaccaaccattcgtgcaactgctgtagctagtcttgcaactgagagagctgcatgcatctgagctgtttggagtcttatgtcctctctcttccttccacatcccctctgtaccatgtttgctaatttacttttcaagaattctgccacgccccccacagtcatctacacatgaaaaacttggtttaatgttgtagagtattccattttcttacgcaggttttgtgcctagtcttgattttctgatatgttgtgtgaggaaccttttcactggagagcagagtcttgaaattaaatcatgcagtagggaaagaatttccagttagatcaattctgtattcatataatctacatgtaagcactgtatttgttttaccctgattccatccatggtttgtttgatctcttgattgacattgtgtacgctgttctcctcatgtttcccttgggcatccttgccctgatcgaatgcaccat

SEQ ID NO: 105175 - DNA, 898 bp, Oryza sativa
atattcaatgttaaattttatgaaactagtttggtattttagatgttcctaattgtttttataatcttagtcaaacttgactaggaaaaaaggagttttttttggaaataatattattttaatggaaaatcgcaaaattataggtcagttagacgaaatcgcaagtttagcaccctgtcgaacggaggcagttcgaaagggtacctgtcgaactgccccagttcgaaagggtacctgtcgaactgccccagttcgaaagggtacctgtcgaactgccccagttcgacaggtaataaaataacttaaaaaagaggaaaaacactgtagcacactgtagcgcacactgtagcggcactgtagcgacactgcctatcgaacttccgctgttcgatacgtccatgccacgcgccctatcgaactccccctgttcgatacgtccctatcgggcactgtagcaagtacttttttattttttttcttggacaactagcatgccccagttcgacagtaccctgtcgaactgccccagttcgacagtaccctgtcgaactgccccagttcgacagtaccctgtcgaactgccccagttcgacaggggtacctatcgaactgccccagttcgacagggcgctaaacttgcgatttcgtctagccgacctataattttgcgattttccattaaaataatattattttcaaaaaaaattcggaaaaaagtgaaaggaggtaacaatgcccatcctgccaactatatctaagataaaaacgatttagtactgcgagacaccggtatctcaaggttttttttgctggactgaagcaaatctctaatatgaaaccgaaggagtactggctgctggctccagtgaatataagttggaacattatattggaataa

SEQ ID NO: 105176 - DNA, 698 bp, Oryza sativa
ttgctatggtttattgccgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggaataatgcccttcttcactgcagttgtaacaaacaataactttcttacactcgggttcttcatcttgtacttgatttctcagctgctgtattggaacttccaaaggtacaacgcagatactggcccctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaacggtgatcttggcggggatttgtgttgccttgatgcttctctccgttggaactggcggg

SEQ ID NO: 105177 - DNA, 666 bp, Oryza sativa
tggatggattttcctgtgccgctcggctgcttgctgccgatggcttctgctgcgcctgcgctgctcctctgacacgcgcacggcaggaaggacgacgtcgactcggagttgatggcgactccgctttggattggatttcgccgaacagaatttcgacggaacaacgaatacgacgacgcgtaccgccgattagatcgatttcttcgatcggaaaaaatcgccggtggccgggactgcagtagatcgatctccaatgctctgataccacttgttatgaaaatagatgcacaacggagacacgaattttacgtggaaatcccttgcggaaaaaaaccacgggcgccgaccggcaatgatcactatagaggagatgattacaaacgtaggggaatcacattgggaacgtcacccattcccgtacggcttacaagagtatatataagggataatagaaagacacctaataggactcttattaggaaactaatccgaatatattgtgggcccaaaattcggatcacatatttaacagaagccaccccttgccgaggagcagcgtgacctcggtgtcagcaacgacgatgaggtagtagtcgccgcctcgccggtgggctcaggggacgacgaatccaacgcgtacgtggcctcggcggtgttctagtggac

SEQ ID NO: 105178 - DNA, 809 bp, Oryza sativa
ccattctagaagctacggtcatactcgttcgtttgacataagtatttggtggcaattatatcgaccgggacagtactagccacccagaaatcaaccaaatcttacgtattgtcccaatctaagttcattaaattttatgcatattctaactaagcatggttaagcaaaagctagcatataactggttcgctatatgttcagattatgcattcaaaatcatgtatggctagtgtatagaatataatatagaatgtagggtatttatgctcaaagggaaggaataataacttgccttgctccaacgcaaataaatccgagataggcaacctgattatccgatcctcgaaataccacaggttaccatccaaaataaaatagactctactaagaaagatgaagaaccaatttcaataaaatccataaaatagtaagaaagagataaacggttatgtgggctaaggtttagggtatagtctatctcttttatagggtatatggattactgtgttgatattttatgcggaggttctagagggttggaggctagaggggattaagcaactactcttgcttatatttcatgtgtgggtttgattagtaggaggatgggaagtatactggatgattgaactagttgaacagatatatagcaagtatcggctgatggtaggttttggtaggatcatacctagggtttagtatttttgggtagcatatcggctagactctatattttatgtgtaggttctggtagacagaaagtaggtggctaagagtatggtggatagatagtattgtagagggtatgt

SEQ ID NO: 105179 - DNA, 1358 bp, Oryza sativa
cgaccggttcggtgacgccggcccccggcaaggcactggcggagacggaggggtcgccggcaagactgagagagtaatcgatccgcgtcgcatcttagtcctcgtccatctccggccggtggagcgggcggtggagcgttcggtggagccagagccaccacagcaaccggcagaagaactcgtggcggtgggacccggaggcggcggtgatgtcggcgtcgcgtggggtggacgacgacaagccgggcttcgtcacgctgtaccgttggatcgtaggcgtatagaactagccccctgtaattacaggacctcacgaggttttttttgtcaatttccttccacattttttttactaggactattttgtaaagagaaaaaaaattccagccccagatgagcttaacgtctctgaactctgaaccttccatcgatttggacaacatagtagccattctctcttcccattctcctcctgtcatagcaacaatcctcgcaaattttggcggtattcaagctcagattgtaaccactggagactggtcattcgttcgttttctggagaggcaattttctggagggggaaaccgggcgaatcgcacacggcaggatgccacgccgtgctgtttgctcctttttccttgtggtttatagctgatctggtcgcggctactctgaagcctggtggtgcgcctgcagcctgtgcagatgtgtggattctgaatcacttgtgttgggtggaatggatccatggccgtggcttagtgccctagtgcgtcgtaggcttgcagtcaaaaacgtgtccaatcccctgcgaactgaggacacaccacttcaggtttgttcgttgtggtgatcctttcttgtgcccagttgaagagtgtaacaaaaaaaaagtttaggacattactgagagaatggattagtgatcctagttggatctagtatgtagacagttttagtttttttttccctttgtttgttgctaccgtagcatgctcctggcttgtctctgtcatggagtcgaggatcttgctaagttgggtagcctgcccggtggtccttgttatcattggatatggttggtgggctggaggcttggtgcaatggtgccaaattgccaatccctcctagtagcatatactgaattcagatttttttctttcccggggaatatgaattcaggttttatcatgtatactccctcacttcctaaatacaactattttttggtacgcggatttcagtgcacgggaatcaaaacattttcaaccaaacaagtgacgagaatcaagcgatttaaaattcgaaattcgatcaacaaaatgactgaaaagaaatcttccctcctatctttaatc

SEQ ID NO: 105180 - DNA, 2045 bp, Oryza sativa
tgccttctctatggatttaggcctccatactggtggtggtcgcaactcattgaaccttttatcccttttctcttcggcctttttctcccttaattcttgggcccgaagacgttgcaaccttctcttttgtgtagccgtcaaatccttaggcatccacctaggattcggctctgttccaggaggtaaataatgtcctttattaaccttgtttgaagacgatgaagcccttacatcgccttttgcaactctcccgtcaaaccggcgctggaaaccggtcagaccggcagcagaccgccggtcagaccggccagatgcgccggttagatcgacgttagacacacggtcagaccggcctgaggcgtcggtcagaccgtcgtcagatcggcggtcagaccggccagatggcccggtcggaccggcaacatggccgcggtcagaccggccagaaagcctggtcagaccggccgactgcaaggagctagaaccggcttcggactttttacttggggactttccaactccatcttcggaaggtataggcacatcatgggatcctatcttgatggtaatcacctccgaagtcctctcttctatcttgacgcgctttccttccctcttctcttcattaacccgatttttaccataaaatcggcttttgtttggtgaagataaacgctcatgaattggcctccgtggtcctccccatccttggttgaatctcattggcggcatatgattgtacattggcggcgttgccccccctggcataaagtaaggataaggataacccggcggcggcattggataaggaccccatgacatgtcttgtggatgaaaatatggaggtgaacatgaccgtcttggcgaatgaccaaatcgctccctaggaggtgatcttggtcttttccctttgttgtgatccctctcaccaccttgcctctcatacttttccaaaagcatatcaaaagtcactttggtctttctaggggccttagaagtcgaagcttcacccttattctccttccaaacgccaatctcctgcttctttggcaccatcatcttaggccttggctcaccaatgaccactttctttcccttggtagattcggcttgctccggccgaatcaacaccttcttattattgaaattaattgtattcaccggaaaaggatcatgatcaaacttcatcttggagccatcggtgaatttcaatcgtccctcatctatggccgattgaacctgtcgtcgaaacacattgcaatcattagtagagtgagaatgagaattatgccatttacaatatgctcgacgcttcttgagaaggtatgacatggcctttaggtaatctaatttgcttctcttgcaaaagataatcaaaatcttatcacacttagccacatcaaaactatatttaacctcactttgccgatctttacgaagagtcggcattaagttagaacaaacaaaaggtttatttttgttagtccatgaccattcggcaacataaatatcatgatcaccctcctcctcactatcactagcatcagagtaatcaactgcattaacattaggatttttgtctaatggtctagcaaattttttattatctttaacctggctttcttgagccagagccctttacataagttgactaacatcaagaaattgttggccatctagtttttctctaagaggagcaactaaaccattaaaagcaagaccggccaaatctctatcagttatattcaaagtataacatcggtttctaacatctctaaaactcttaatataatcaacaacagattcattatacttttgcttaaccgatgttaaatcacataacctaagctcatcttctccagtatagaaataatcatgaaatcgcccctctaattgagaccaagtatgaataaaattcgcccgaaagaagtaaaccatgtaaaagcattaccggataaacataaagaaaacaagcccaatttaaaagtttcactattagcctcaccacattgcgctaaaaattgacctacatgttcccatgtggt

SEQ ID NO: 105181 - DNA, 705 bp, Oryza sativa
tgaccggctcagggcccggtctgaccggcgtcatgttgcgcggtcggaccggcctgagggccggtctgaccggtgggataatacccggtctgaccggccatctggccggtcggaccaacggctgtgtcgctgtctgaccggccatcaggcccggtcggaccggccgtgaacgccgctccgtcggttttagaccctattggatctatgggagattgactaacagtggtataggctttatcttttaatgtgtaatcatccataagagaacctagcctattccttaaaaacccatcaaccttttccttaaacattacatctaatctatctttaaaattaaccatagatgaatctattgtagatgcaatttgttggttgatagattgcgatacctcgtcattacttaccatgtcgggagcgagtttgggacgtggcccgggcttgatgatcacgccttgacgagtcctagtagttgctctcatcaacgcctcccgtgtgagctcgttgatgtgctcttccatggctttacgatcctctccttcaaagtcatccaatgtgaccggtatcacatgagatggctccacctccgtcttagatgatggcttcgtcatggcgaagtcgaagtcgagttgacgatgaacggatcttgtccccagcggagtcaccaaaaatcgtgttggcaacttttttgacaagttgacaagcacg

SEQ ID NO: 105182 - DNA, 745 bp, Oryza sativa
atacgaggacttgtcgtgccatcctgccaaatcgacgtccgccgcgggctcgcgccgcgcgcgggacggacgggacatcgcctcgcgcccgttcgccgcgttgcgcttgcgctttgctcgtgaaacgcccgtgcggcagggtgggggcgcgcaggtgcaaagcggcccgtgggcggtgggctctctcgcatcggcaaaaaacgggtggcggctacgtcccttgtcccaggtggcccaactgaacggggagctagttttggacgagaaattgttcgagaggcttgggctcgcgataagatgggccgagacaccagtgctgcaagccggccacagccaggggccaatagcccactactgcggggaccgctaatgcgcgggtccacacccctctcccctatacgtctctctcctcccccttcctcctccccttatccaaattcatttgcacttaataaataccagcttctgccatagtggaacggaggcgcgtcgccatatatatacctcttgtaagccgccgtgcggcgttgtaacctcaccccagatatagtgaagatattttgctggctagcgtccgtggtttttctctccctactttgggagggttttccacgttaaaatctcgtgtcttctgtgattaatctattattctttatcttttgtttgcctatcatttcctaacaccttcttctcttccctactatagtacaccacaaaattattaataaaaaacaagggctgcagg

SEQ ID NO: 105183 - DNA, 692 bp, Oryza sativa
ggggtggagaaggagagaagggatttggcatgtggggtccgcatagtaactcggcctgctagagtaggtcaacgagtcacgtcaacaaaaaaacaccctcaaaaccactaagggagtcatcttgcattggttttaatagttatgggtcaagatatctgatatagtagttaagagatacaaattagatcggaccttcaatcatcaaacccaactaatgaaggaaacggtccatttcgcatccctaatttgagtttgcatcactcaactataaaattaggtaagagtatcctctaacttttaaaatcactgcaaatcgagtccctcgactaatttgaaagtggtttttgacctatgtaacctctacttggcacgttggcatagtcttaatctaacatggcacttgtggtaatcacgaaactagaaaaaaatttaaaaaattttaaaaataaggagacccaatgtgagtcgtagttgtgccataatttttctaatgaaagatgtaggactcatatgtttcacatggaaaaaaaatataagagtaaatttcacaaagctataaatactttgattaaattatcataaaactacatatttaaagtgatgtatcacaaaactacagatctaacaataaatttatgacaaacctactggtttaaggctaagtataaaaaagatatagatttgctgatgaa

SEQ ID NO: 105184 - DNA, 696 bp, Oryza sativa
tttgtaccaccaaccttgccatttgtgcagaaaaatcaagtctactttgtctcagatccctggggtttagggtggatctatatgcaggttaattacataagttacggttcttgagaagctgagatgccttgagacacactacagccttgttctttctcctaccaatcccgtggagaccggccgtccaaagtaagcaatgactagtagcagccatcaaatcacagctatttgtctcaagcacaagaacaaacaagaatagattaattgtgacttggtctagtttaatccatcaatgccatggggcaatggaaccgggaggagttcaggaatattgtagctgcaggttcttctcctatataggtacttaaaaatatatacatgggctaggagacttggtgtttctttaatttcttctcatgttgcttgcaaagtgtcctagggattgaggatagaggtgatacgaaacaccttcatttgttgcatgatcgagagtagccaattgttttataggagctattaacggtaaaaaattgttgctatcgatggcagcaaaactagccgctcgctggtagtagtaataaatagtcagagataatgagatatactccatggagacaggctttgaaaaaagcaagcagagatcatgcaccctgcctgcctgttggcctaaaatatcaatggaaaaaacacaaattt

SEQ ID NO: 105185 - DNA, 653 bp, Oryza sativa
tttgtttaactttatatactccaatcttccagctctttggtaggattcatccttttgtttttgctcatggtaccatcaacataccaaagtacaggagttgctgctaataaacaacatcaaaccagtagctagtactcctacttcactaagcaaatatattatttgggagatgtggctcactcttgttaagatcacccgttacactttctgttaattaaaatagaaggttggacttttcaattgctgtgctaatatttttctctctgtttgaattagccctggatcatatagtagtattatccagtggagccggtagaaaaatatataattttttgaatgttactcctgctaatctaacgtgagctttgcatcatcactggaattgtagcggcagtgcaggcagagttttgattcgccttcggctccttgttttcaacgtatttcgccttttctatcggactctactccctccatcaaaaaaaaataaaaaaataaaaagataagtcacgtataaagtattaatcaaaacctgcgttttcgtatacaacgtttaaccgtatgtcttatttaaaaaaaattataaaaaaaattaaaaagataagtcacgcataaagtattaattatgttttatcatctaacaacaatgaaaatac

SEQ ID NO: 105186 - DNA, 937 bp, Oryza sativa
ctggctgctgctgctgctccccttttgctctgctttgcggcgaaggatggacatgtacttgcccctgtgggctgtggcctgctgctggtcaagtgcctcgtcgccaacgcgcaacaaacttcaggtcccgagcgagcgtgattacgcaattgattgaatgacggatcaagcgtttgttgggagccagggaaaaatcgtaggacgtcacgcaactctcttttaatttgggacattgtctacaccgtggctcgatcgatcgttgctctcctggagaatgaaaaacacgttttgctcttctgtttttgtttttgtacttccaggacaacatgaaaccgcctactcagaatgatttttttcttgcgacctggtaattgagatcctaagcatggcagcatcgtgggctaattttgcgtgctcaattgctcatggaaccgtgaaagctagcctggttgcatgcacggcaaggctactgatccagcactgtgtgaggccgattgaagcttccgtggagtagaagaatcttctggcgtttgatgtacggagtacttcatctccagggacaggtacggtgatggtcgccattccaccaacctcgaggataaatgcgtctggttacagttgttaagttgatgatgtacgtatgaacgcaatagatgagcaaagtatttcaagcacatgcgtcgctaattgatgcgttcacaacaaaacaagcccttaaatggagaactgtattaggaccatccatgataagtaccacaaatggagttgcacttaaccttcttgctgacgcgccagcgcatggcgatgacccaagcacgatctacgaaactggctgttgagagtatttatgtcatagattctccattttcggtggcagcggtccagttggtttctccgtttctgcaaactatgtagtcttgtactgcaaaatggacgg

SEQ ID NO: 105187 - DNA, 1132 bp, Oryza sativa
ctgcaccccgttgagggatctccggtgaacttattcctctggctgactggctcaatgggccgaatgtgatcgctcgtgcaaaagcaacgaagaagattcgacccgtatatggcccactctacctcagcagtcatcatgggaccacctatacatttgtcgacaaattttcttctaaaaatttgacagatgtaattacagtacaatcgtagtgtaattacactgtaatttgtatgtaattacactgtaacttgcatgtaagtttcacgtaattttaaattattagatctattataaagatttgttttggtgaggaagaaaaaaaaatcacagtacacacatatctgaaaaaaaattgttcccacaacctttattttaccaaaataatatgttatggagagatttttgaaagttacatacaagttatattataagttatattatagttatagtgtaattacatataagttatagtgttaaatttttaagagaaaatttgtcgacaaatatatagcaaaattggtcatcataggttgcccgtttgggcgtccgtcaccgtcgtggccgtcccgttccgagttttgttcacaaattagacgcgagaaaaaaaatcaaggagatgcggtgaagctgttggttggcgagctaactcctggtggcgttacagtatggcggcgtctttggctgattcttgtcccattgctttcgcctgctcaatttcaattctcctaatatttttatgagccggccagagctatcagcagatcgagcgtcgtcgccctcttatgattggatttcatcaccaagtaagtcattgtgataaccatccaatctggatgtttgacatacacatagacactgataacatatatttgaacctgcattcgactgtatacacttgaatcaaacccaataatggcacagtatcaacttgccaagcgtgccaaaaatcacaaccacaatatcgacttgactactccacaggacaaggaaaattgggggtgacataaaatttattctcttgcttgatacatccttacatcagagtaatcaagacaatatgtatagttatataccaaatggtgcaaaaatggaatttctttgatgaggttcctaataactacagtaccttact

SEQ ID NO: 105188 - DNA, 959 bp, Oryza sativa
gatcagcaccgtgaagcgtgaagcaccaaagctcaaaagtagaatgaaattttaaaatataccctaatcgattttcttcaaagaccatacatttattcgaaccgctttgagccggatgaagtggccatacgaataagccataaatatgctaccgaaggtctattttgttaacaactagtgtaactagtgtttttttttctttttacaaaaataacaagaaatggtgcaccgagtgggttggaggagctagtcctagctatcagaccatccaacaacatgtgaacatgaggaaagtggagtgtaccatggaccactcagaacatattggatattttttattgtagaattaaccggattcataactttagacaggctaaaatactaatttgataggtgacaattattttcatcttttaagttatattttatcattatcaattattgatatgggactaaacctaacatgaagaatcaaagccaacggacaataaaagagcctagatgagaggggctattggcgaacagctcgagcttggctggtcagagctcgcaagcttcagagcaggctcgagcgaatcaaagcatgtaacgaccaagctcgagtagctaacgagcctcaaacgtcttttttccaactttgcagccaagattcgttctgggtggaccaatgattttcaggtagagtgaggatcagcccaactgatgtatagttggcactccaaatttgaccacagaaagcacgcaaaaaaagggaaaaaaaagctaaacgatatttgagaatttcgcaaaacttattttgttcgtaaacgctccaaaattctgattatttgccatcgattatggcacacgttgttatattatttcctgctattttggacacagaaacattatcaaatgacctcagtaccactcggttcatctatagctcagagtatggatggcgtcatgaccctgaggcc

SEQ ID NO: 105189 - DNA, 708 bp, Oryza sativa
cgaagttaaacaaaagccgatagcgtattgtagaatatgactaaatgataaatcataaacatgtgacaaacttagtggcatatccactctttaatttatgtgttggctttaacttaggccctgattgattcagcttagcattattataatctggattattataagtagattgaaacaaacaagtaaattattttgatagattattataatctataagccagattattataatctaataatctcctttggaggagctttttccagattattaagtgactaaagactcattacccttacatgcatgtaataatctatagaaacaaacaactcacagcttattttatgtcagcttattataatccagtttagagtaatctgatttaataatttagattacaataatcttaagctaaaacaaacatggccttaaacgaaactcttcacatgggccacttccattgggccaagatattctgtagacactggtgcaggcttccgggctcaaactttgaaatgtcatagaagttccttctgcagatttcagtgtacagggtgaatttctccgtaattggctaactagtcactagggaagactttttctgtaaggatcactacagatgacttaagaaataagtccaatttaactacctcaattgtagggccaatctgatttatatccctcaaacccaatattgcatatgttgaccc

SEQ ID NO: 105190 - DNA, 710 bp, Oryza sativa
catggagtgtctacaggacaataccatttacagaatcaccatatgatatttctgtatcattttcacatctatttccttacgatagctattcagcctattctaatactagtatatgctctgcatagaaaatgtgaaatgaaaaacattcgggatatggtccactaaacagcataggaccatgaacaacattttttttctttatgggcacgagaacaagtgatcaacagttgacactgcacaatcatgactaatctgaaggggcgagttggcaagttgcttcagaccacgttttgttgaggagtgaaccagataatttttaggtcatacactgtacgacctatccaaaaggttttttgtggagcttgtgcacccacgatactgaaagtcttcagatcatgcactattttctatagtccccacacactcaaatcaaaagccccatttttattctagtagcatgttttgtcaaaagcaatcatggtatttaatcgttgaaaattgattcgaggtaacaaacttggacagttcactgccccagtttaattgtagctctgtttatctaccccaattcgatcattttctgaattctgataatcgaaaaaggctatcaggaagaggcagggaacacacctaaccttaaaatttggccacgatattactggattctgtttctctcgccccgggacatttaagaccaaggaaggggtgca

SEQ ID NO: 105191 - DNA, 2744 bp, Oryza sativa
acacacacacattttgcttatagtctgctaattgttttctaacgggtgcaggttttgtaagctacgatctcctgcttccgcacaggcagccattggtgtgatgaacggtttccaattaggcagtaaaaaactcaaagtacaactcagagagacaactccaagcacagtaaacccttttgacgaaaactatgatgaccacgcgatcaggttcctggtacatatttgtcagataattgatcgttgaattgtttgctctggccgcagcattgggagcttcgtgtatcttctttgttcaattcacattcttgaacactgttacgtcgtgtaatttactgcagcctagtggtagaatttgtttcatcagacccttgtacatcagaagtcagattcattcaattgtggacattttctcctgacagtgattccggtttctcattgacacgattccggactcacccaaaactattatctgaaccattattgacttatcatgtctaaatccccccatggaaatctgatgcttttggaaaatgcttgtcagtgattcatattaagtggagtagtaataatttgtcagtactaacgtggagtatcatttgacaagattcagaatatgaaatttggtggggcgagagtttgatgtctgagcagcagatgcagatcagaaattcagaacaggataaaagcaatggaccccctgcactccatcgtgcaacaactccagatggccatgccatgggccccaacacagggtattctttctagcttgtcccaacaacaattttgtcctttctcatgtgcaaccagcagcgacaggactacgctgcaattgcttgtgcttaccctgaattaaccggtaagaggcgccacagccgcgaaacggccaattgttttgcagtaactcatctgaacttttgaaaaagagtttctcctttctggctcgccgctaccaacatcaaaatggatcgtgctgtgtatgtttgccagctttggctatgattgtgacagtgtacttaattgcgtgtgcacaacgggttatctgagtaggacgcgttagctgagtagctgtacggttatcatgcacggctcattaggcacatctgcattctgcaccaaactcactgattagtctctactcagtttgggcatgtgaaacagtgaaagagtttgaataactccgtagtgcatcatcaggaattcaatctcaagctatctgcttgaattaaacatcactccttctgttccgtagtattacattatgggtttgtcctagatcaaccttcctcagatttaaccaaatgtcctaaatcaaccttcctcaaatttaaccaaatatatatatatatatatatatatatatataaagcaacattttcaacacaaatatactatcaaaatattcaattatgaatttgatgttacagatgttagtactatatatttttataaacttgaataaactaaaaaaaattagcttagtgtaaacctaaaacgacttggctgtgttcggaaccttgtgttcccaacacaagctggccgcacggaaaacggcacggtccattagcacatgattaattagatatttgctattttttttaaaaaaagaattaatatgattttttaagcaactttcgtatagaaactttttaaaaaacacaccgtttaacagtttgaaaagcgtgcgcgcgaaaaacaagaaaaaagtgttgggaacttgtacttccaaacaacatgagacgacggaaggagtaccctggtacgagaaaacagtctggtgattggtgagtaccacaaacttgtaataatgcttaccgatcccttggtagcacggcacgaagccccccttgtccaggctggccatggtctgcgacgtacggcgtagcctgcacaaacgtctatatgtagttgccgccaaagaggtcaacatactccctccgtcccaaaaaaaaaaccaatcctgtgtttgaatttaggattaggtttttttagactagggagtaggggatttgggggctctttgccattgacgccgtcaccgacgccgtgtggccatcccgccgccaaacgatcttcttgcaaatcactctcctcctagcagcgggtctgcacaagaaatggcggcgaaggtggggaggtcatctcctctctggcgaagtttggaaggggaaatggaagagatccgatggcctagattgctctggtagtgacatagttgtatggtttgatcgcgtgtgactttcccatttgatagggtctaaactcctaaatttaatttcaaaatttaatttcaaaagttgggtttgaattgtagttatggagttactaaaacccaattctacctctctaatttattttattagagcactttagtcagctcacttcattttttatttttatattgaagttgaaattgttttgattggactttagctccagaaaatgtggacttcagctccggacttcattttttttattgaagctgtgtcaaactggcggtagaagtcctctgtgttcgcatgagctcgatgtgaattgtgaactattccctccacacgaaaaaccgagcgtttcattagcgcataattaattaagtattagttttttttttcaaaaatggattaatttgattttttaagcaactttcatatagaaacttttttaagtagtacaccatttagcagtttaaaaaacgtgcgcgtgaaaaacgagggaaatgtgttgggaacgaggggttgcaacacagc

SEQ ID NO: 105192 - DNA, 772 bp, Oryza sativa
tgaaatcacgaaatttcacgcgaaggattgtaaattctgatactgatacaaaccgacaactgattcctcagtcctcactaacgacaggtgttcgagcacaagtgccctaaggccattcacagtacacctaggtatcattctccctcatgcagccagcttaaagattcccctccacttagacatagttcggagcctcgccaagaatcgtcagaattacagcttttgggcccacaagagaagaggtgaagaagggggagggaggggagaagcaccgatgccgtcgtcctccccgatctgcgccagccgaagctcgctggccgcgcagccccccgatccatgcctgccaccaagggaggaggccggacggggagctccgcccgcagcatgggtcgcgtcgccgcctccagccccgacgaggagagatggaggcgtagagctcggtgccgccgccgctccgccgacgctatcgaacaatgacatcgccgccttcggcctcgacgaggagaggtggaggcgtggagctcggcgtgccgccgcttcgcttcgttcgcccgggagagagaatggtggggaaagtgtgagaggagagagagggagagataaaactgagtggagagagataggtgggacccactccaagcaacatgcattgtgaagtatgtagctaatatggttctttagcccaattggaagcccaggcgtagcattttccaggacgcactgtgagcagggttcctcttactgcgtggtaacctcgagacatgccgtggtt

SEQ ID NO: 105193 - DNA, 730 bp, Oryza sativa
ccgttgctggtaaatccttcgccgctccggttcttccaatctgcccgcgatcttcttttcacgcccttttctgttgcgtgtaactaatcgtgagtccgaattccccgttctggctacgaatgctcacaccaatctagatagttgtggattttttttttcgccgggtcggcggcgaaggaagatagttgcggatttcgttgatgtcatgtggaatactggaatactagcctaattcgctcatcactacattctattgctgttaccaaaaaaacatttactttcacagcttcacaaagcgaatagtagtattgaatgtgcctatatggtgtagttcacctttactgtgtgcaagttgcttatgagggataagatgttaggactgtcaattctgctacactgataatttttaaacttgtttttttttgttcaattgttgagaaaacaatcaggacaatcgtgtttcaactgctgagtttcttagatttttaatcttattcaatcctgtcgttgtatataggctctgtaatctgtatgcaccgccattgatctgaatacatactgctttctatgaccttatcatcttcctttgaatagctttggattttccatcttcctgtatgatgctattttatcacttattgccatatatgttgttagaattgctaagtaaatcatgtaaagttggagctgatccttttcaagtatatatgttttttttctatttgcaccc

SEQ ID NO: 105194 - DNA, 964 bp, Oryza sativa
tggtggccggcggcgtgccggaggccttggcggccttgcgggcggcgcggtggctgggcggcgcggcggagggccgggcggcctcgcggcgggcggcgcgccagcggccggcgctgcagcggcagcggcaacgacaacgggcttttttttcttctttttagaatttgtgtgtgatgtgaatgtgatgtatctgtgatgaattttataaaatttgtgatgtatctatgatgtatcgatttgaggagttgaggatttgaggatttggggataatttatttgggattttgggatggggatggggtgaaatcaatatattaaaaacaatgaagaaaagaaaataataatggagcaaccggatctagctagcctagctctatctttagtccctaccaaccgggactaaaaaggctctatcgggacttaaaaattgatttttactcccggttttttcacccgggactaaagatcagtcccggattggtagtcccggttttcaaaccgggactaaggggggttacaaaccgagagtaaagcccctttctccatcggtaaattttttgtcaactaaacatgccctaagaatgaaaaaaaaaatttggtggagacaggatgcaaattaacaggctctcattcatccccaccctatatagctgtcacgtggacaaccgagcgatcgaacgtctcagctgggcaaggctccaggcgcagggcaaatagaatggaggagccgagtcacccgtcatctcccaagcctgtcggctcacgggctcagagcctcagattgcatcggcatatttactttgcaaatccgccgacgtcgtctatctcgtcgatcagctcttttgcccgttgtccgcgcgctcaccagcgatggctagggcgaacaccgttggtccactcctccttgacattggacgtaacccactgctgcaggtcgatccataccattgtcatttcgctttcg

SEQ ID NO: 105195 - DNA, 1098 bp, Oryza sativa
ggcatgatggctgcgatgatgatggcgtccatcggcgatcgagaggacgccgctcccgacacctgcacgcctcgggagccactctgcaccttggacctggtctacggtggacgccgcaacccatacatattaccgccacaatcatcatcatgccctccattactcctcctagtactacttcattatctctccatactgattcatctgcaaactggagtagtagcatttgcaatcctgcatattgcaccgctacacgaacaaaaagtttcactagccccctctgcattgtgggccccacttcttagcacacaatcacacatgcaattaaattttaaaatatactgttcattttttctttctcgtaaatatgcgggatgcaattttattgatacagatataccatcaatatcacagtcccgcgccacgaatgggagagactatactcggtgtcgtgtggcgcgttctggcatgcccaataagagagcccaaatagtcgttattcatccaatttcagaccggtcttcacataaaagcgttggttttccccaggtcattgggggccaagaattaaccaaattggccgtaaaatggggttaaccaattacatcaggatatttatgagaaaaagaaaaatgaccatatattaatatttcaaatttaattcctcgcacgtgactgtcggtcggtgacatatatataggcacgcaactaatagaagttagttttcgtgctccatccatgtgtatgcagtatggagtatggactatggtctatgagtatataagtatgcatgcattcatacgcaacgtgttagtgcttaattgcatgcgggtgctaattaatcttgtttgcataaggtgactgtcctgtctagtgtgccgctgatctttccatggaatctgctgctgctactacgaatagtactccattttacaaaaggtgcaggggatcgagggcgtgcaactacaaatgtgaggccgcactagcgtataattgtggatgaatgcatgcgggcatgtgttttggcccacctgcctgcccatgtgggcgcatggtgtacccgctgtcttttctacattgtgggtgtactcaagttcg

SEQ ID NO: 105196 - DNA, 743 bp, Oryza sativa
tgtactgctacttcaggagtagtagttcaattagtttttggtcaatatttgtagggtcaagatgccaccgatccatcatgcatatcaaggagttgacgatggccttttaaatgaatataagagcgagtactgtactgtacactgttgattagcacccacagtttggattttaagtcagggaaccctggtaaggatctggctgtatgtctatctgcagtagtacacaattacgcatcacacgagatcaatggtaagggaaaattgcccgtttggatcgatccaagacaatccggctcggttctggagtcttaggttataaacattgggctggattatgccctgatgaaaccatctcatacccatggtccgagcaagcactaatcaagggcacgtacggttgtctgacattgaacgattataagagatagattatatagagtaggactttataaatatggagaaacatcctatatgacgactttctcccgttatatagtgcagcaagggtaagtggctaagaaacccgatttttacaaattctcaccgactagtttctcggaatcttgagtttcccaaacggagcctaaaataagcttttctggcctagcaggatgtttgctttggggcaacaaaagtacaaaacatgaaggcgactacaaagtgagcgcaaaaatcgagcgatgtttcactgcaactagaaaaaaaatgtttcactactaaatagaaaatttgtcagcctacaa

SEQ ID NO: 105197 - DNA, 1160 bp, Oryza sativa
ggggagtccggcgtagcatccaccgccagtccgccgccggcgctaggcgtagctgcggcaatgcgaatatgcgaccgcatcgttggtttcaggcttcagaaggttcgattgattgcgcggttcagaaacttcagaactcagaagcataggcctcgacggcccaaaagttcgagcccattcaacaagggtttgggcccatttgggctacggcaatttcagcccagctgggagctgtttcaaagcccagcagaaggattaatttcggtcagtttcaggttaagcccattttgattcaaaggaaattcagggtgtgtttagttcttcgggggtaaagtttttaagtatatggacacacatttgaagtattaaacgtagactaatagtaaaacaaattatagattccaccagctgtaaactacgagacgaatttattaagcctaattaatcactcattagcaaatatttattgtagcatcacattgtcaaatcatgacgcaattaggtttaaaagattcgtctcgcaatttcctggtgaactgtaattgattttttttcaacatttaatacttcaagcatgcatccaaatatttgatatgacagagcgaaaaattttatttaggaactaataggcccttagatgctgagacgagagaggcagcccgcgaataggacaagtggggaatccgatcctttgacgacggcacggccgggccaatcgagtcggccagcgaaatgctcggctccgctctccagcgtgcgtgtttcgatcgatccgagccgcacccacccaccacttgcctgcatgcatgtgttgttgctgcagcagcagctgcagagctctcgatagatggacggatcatgagcttgcctagctgttctttctaaggaaaggtgatcatgagcttggctatgccaaagtgctccaggcattgtttgtaccctagcagctatgcctacagcaggaatagctaccgtacgcacagctctgtattattgttcgtatcgtgcacgggcacaccgtaacattggctcctccgagtaagcgaatatctgtatatctgatgtccattagggcaaaagcaatgcgtcacggtacttgttcagcctggggtgccacgttggatgtaatttgtaccaagcaacttaacccacagtgcaag

SEQ ID NO: 105198 - DNA, 740 bp, Oryza sativa
tgaatgattcggggcactgctgaaacccaaagctctccttggattatgcctcctgatctttaacaaagtgatcactgtttagtagtattgtcggatttagcaggcacttaaaaaatgaaccagaattgtaatcttatccatttattgtatatacttcgttgcaattaacgacttacccagatccctagctaatgagcattatatgcggctccttcaggttaacttcagcagaatgcaatattactatgattaattgccccaggtccgaacgagtcaaatcaaatcatcctctgttgtgtgctttggtagcaataatgagccaaattgcaactttctgctttgcgagggaagaagcctgcagatacagtgacacacattctgctatgcccagactccagaatccagccatccaggccattaccttttcagaaagaaagcagatgtctttactcttttaataactgtactattactcctaactgcagcgccatatagggcaggctcactcatctgatcggtaatcacacagctggtagatattgtactctagtcacacaaaaaaacgaatctaaaattagatataacacactctattaataaatctggagagagctgtatccaaattcatagtactaaaatgtatcacatccaatactagattgggtttttttatgagatgaaggaagtactggaaagtgtcaatcttagatgagaacctcgaccatcctagctaagcatgt

SEQ ID NO: 105199 - DNA, 503 bp, Oryza sativa
caattattgacattacttagcattgcttgtatagacgattatacactccatgcttattattattatgcaacccctatgctacatccgtagtccagaggggttacataatgtctataaaagtggagacacaagatatgagggtgtggcatcctttctcattcttccattgcattctcaagtgtacaaaacctctcctccaaccctccatttatagggcaatgccttgcccactttccatattagtgatgggcccaattagtaggtaaccgggccgggccttcatgggctggcggtatcctaaaactcccccttaggctctcactgcgtgatgcctatgtctcatcaaaactccacaaaaacccagcgggaaaaatttggagaaagagtacatagcatacgcttgcaatgtcgcatgaattgcctcactaaaaaccttataagaaactactgggaaaacttatctaagggaaaaagtgtacaacccacccaattcatcgtttatt

SEQ ID NO: 105200 - DNA, 969 bp, Oryza sativa
cattttgtagccaccataattagctagaacgatcggggggccttggtagatatgtttatgatattatgaaaactatctgttcttaacttcttactatattttttaatacatgttttttttgttgccaaagttaagtgaaaatcccacagttttttgttgcctcaatgagataaatgtaatacatagagatgtatctgtgtactgcaaaaggtatcagtgcgaatttctttgcattaatttttattgaaaattgactagtatttccgacattcactaggagcggtgatgtgcacccaagcaatcctaggatttggacccagccacccaagtggatggagttattaaatagcttcaccaccaggccattggggtgtatttctttgcattagtttatgtcaaagtaaatatatctcagagaactgtatgctgtgacattgccaatggggagtggcattgatatgtatccttgaggaaaagaggaagagaatttagataaattcataaatatcaaatagtgactgctttctgaatacatgcttagttattctgtatgcaagtttccatcacgagtacagctagtcaaagcctcatcgaagcttgtactgcatgtgttatcaactctattatacctatgttgagattaaactgtcttttatgtttgcatgagagattctgttaggagtccatggaactgatcttcatgctgacttgtataattaactacaagctgcgttgcacctaacactttgtttgctagttgttaagtgctggatgttttctaacagttgaggtactctcctcaaggaccacggaaaagctcaagttataactgaaatatgtatatccattatgttctgatttttgaacaaactggtagctattgatgagaaacttgtaattatgaactttactgtttcgtagagcgcatggtagctcttttgcaattctgatcacaaatcatgggctgca

SEQ ID NO: 105201 - DNA, 593 bp, Oryza sativa
tactatgaatgtgagatataagccaagtaatctgtgtagctctacgactacagagttgagagtcagtccattttctgagcatccaaggcctgaaaccttgaaccacagtttagtgatcaaataatatgtggctaactagctatgtgctcagtagacagaggtatattacattaagaaaaacaacttagctttatatcatgttaatccaaggaaaattacattcttagcaaagtataacaagcatgatgcaacaaaacaaacataacttcaaacaatcaattctgacctatcaaagcaagaacaaagcccaggaatataataactacttcgaagaaattaaaatgcagcttcacagagagccatacctgcggggcatcgtcggggctgtgctcgtgccgagatcggcgaggcgacggcgagagctttcatcacagcggccatcctgctgccgtttggtggctcttggaggaggtggtggtggatgagcgccaaggaggaaggaaggagaggaggggtgaaatgcagagggaggtcggggtttgagtggtgcagagggggaggggagtgcagagagcgattgggtggtggcgtgt

SEQ ID NO: 105202 - DNA, 1389 bp, Oryza sativa
gccaatttgtttgtgaaagctctcttcccacaagtgcactccgtctctttgctttagggaagaccctaccacagtccaccatgagcaaagttattccatgcgacggcatgctccacctacatgtcgcttgcatgagcaaagttattctatttgcccaccaaatagattttaaaatttttagtgcgttttccttaatgaaatttggtcgaccgaacctttcggccgacccggcaaaaaattttttagtgcgcacactttgcattgacacctgatgtgctgagtaggcagtttcagtgcttgctatatcgtctaaaggcaaaatgcactgattctgataaagcattaagatttgcaagtatcagcattttgatgaaaggaattcatagtttagtccatggcatagtgcgcttggtaggtggtgcgtggtggccttcctggagaggatacatatttaatattttacagaaaaggttaaagcgatggagtccaaattaattggaagataaaattaaaatgatttgcaatagccaaacaatggtgaaacctgggtaatctgtcaacaagaagaaatgactatggagacttatccaacaacttgccttagatgcgcaagctaccagacagctagcacatgcgcaagctctctctctctctctcccacaggaatgtatgctgcctgtttgtttgtgaaagctctctacccacaagtgcacttcgtctctttgttttgtggaggaccctaccacagtccacaactgcatgtccatgagagtttttccttgcgattggcatgctccaccaatatgtcgcttgctttacccgtttgcccgccaaatagatttttagtggcacaatttgcatctctttgtttcttgacctgtagcctttttgcatcgacacctgatgtgcagtgcagtgtagacaattcagtgcttgctatatcgtctaaaggcaaaacacatcgattctgagaaagcattacgatttgcaagcatcatccctttgaagaaagaagtattgttgagaccatggcttggcacgcttggtggatggtgggtggcggccttcctggcactgagagtaagagaaaacagtaaaaatcaattcgaagatgaatgaaaaacggaagtgaaaccgggataaagatgggggaagagactagtccagcgacaacttagcattcaatctgcatcttttagtctttacaagacatcaatttgggaaggatctaacaggcctacagtacgtgtgaagatgcaggatcaccacacacgatccagaattattattccagatggacaacggcttgttggaatgtggtgaggaagagccagcagcaaaggccgcggaatcacttccaacttttgggttgcaactgcaaggagggga

SEQ ID NO: 105203 - DNA, 1695 bp, Oryza sativa
ttggggttggcactagcgggagcctgcctttttggcgagaagtgatcgagcaagcatcgatcccatcccgccgtctctcgcccccttttgttctagctagctagtgctcgaatcccacacgggaaaaggggggtttagcaatgtcaacttgatgcatgcttggtaaaagttgtcctaatgatgctcattaactattagttgttcctgctaattaactccatggatctggtcttaaagcacggggatgagtagcgtgtcatttgcttgttgatgttcagatcagaggatgggtttacgagtagtaagcagctttttagggattaattcccttggccaatgattggacaagaggctatatgtttcttggcgtactagtaggctttctgcatgctttgagtgccacgatcttgacccaagctttcacgtaacagttgacaatttctacatcgccatcaggccgtatcggtcgggctacagtacaccaaccaatattttagctttggttacctcagcgagtcaggagcctcgttcattcgttctttaaagatgtgactcctggcctttttttttaagttccaaactttttttaaaacttttaactttttcatcacaatattttaattttaaccaaacttttaattttagcgcgaactaaacacatcatctattgaggaaactccacccaaacagtagcgatttacgacacaatctttttttctttttctttttttttttttttgctgtggatgaatgagagaaaggggggagggagagatgaactctatttgtcagaccgctcagctcaatatatgagcaaaaagtactcgcagagtagcgacatgaagggagtatatatttgtattttgatctagcacaatagccagcatatttgggttagatttacttcaaagcttaggcctcctttgatttgttggaaaacattttgaaacttggaggatttcaatactatagaaaaaaaattcgtacaaaggtctttggaaaaaagattgaatcaaatggataatcctacaacgattttggaggaacatttctttttaaatctatatctctcattcgattcctgcggcttaatcaaaggaccattcctatgtttagcgaattcctatgttttacaattctttattttgtacttacgttcatgtcaaaatcttatgcttcttctatttctatttctttgttttctcaatcttgcgtttgaaatgaacccttataattgcatataaatttgttcttttgtcatctttgaatggtacattagattatttggtttatcttagtcgttacccctcctagtttaataaactctgtttaatatttgtcttccatatctatatatacgattataaatttgtagtgctgtgacactaagtgcaaccaagtgctattattgtctacattggccagctcgccaccttgctccaattatacaaacctccttttcctaagttgtcattgtatgaacttatggttgcataatcttgtatctctcttttctaagttgtcattgtctaaacttatggttgcatacttgtatagtatttagtacattgttactagccatatatgggcatgtgtactacatattttaaataatttatatatatatcagcgtggtatttattaattcatttagaattattaagtcatggatatattataattcagattacaact

SEQ ID NO: 105204 - DNA, 4257 bp, Oryza sativa
ttaataaattcattttgtgtgtgtgtgtgtaggatttcaatggtagatttgatcgatggatgaaaacaatatgatggtgctttttttttattaacacaggaatttttagtttttctgattgagaatttctatttgacatatggacgcatatgcatatattaggataaatcggggtttcaataattgggaaaaagaaaaagaaaacaccgattggcgatatcgtggtccactagccatttcctgcgccgagcaggttgtcttcggaaaagacgaccgatgtatatgccatccatttgttccatttcttccacaggagcacaggacgcacgcatgctagttagcgttcggcgccagccacgacgacaccaaaatggcaccagctagcatcgtgcagcgctatgtgcgttcgcatctattctacgccgacctaacaaaattaaaagtcacttctttcactagctacaaacacacgtactcgtgcgagtgatccaggaaagctctccgcactgctctgcactcgtgaaaggaaattttgttggcgcgagagagctccccgcatttcaaccggtcgaccatccatctatctatcagcgccccgcgtgcgcacgcgacgcgatcgagctaccgagatttccaccggccggccgctactatagcatcgatcgatccaaccatcgcatcctcggtgcgcgccgctcgtgcgtgcatgcctccatccacaccggccactatatttgcagtgcagtgcagatggatagcgcgcgcgcgtgcacgatgggtgggtgcttccgccactattagttgcgccgttgcacgcacgagtagtactacggccgattaatggaggcgtacatcgatccctgccgacgtccacgcgggatggctccatcgatcgtggcatgtcaactcgatcgtctcgaaataaattaatgtttgcgtccttgtttggattcgattccgctggcactgcctcgatcattttctctgtttgtgagttgtgacctgcacacgcactgcatgcttgcagatggttggaaggatcacgtagagctagctagggtggtccagatcgggacttgagatgagatcaccgtgcactgcacacgcgcacgcacgggtgcacggccaaatccatcctgctactagctagcagccacatccatgcatgatccatgtctagaaccttcgattgtgtcttcactccgttttttctctgctctcatgcacagcccactcgcgcacagcacagtgcacccgcagcactcggcgaattgaatggcacacggtgcgcggtgcgcgcgagagacagagcacgcgcacgcaccgatcgagtacgagcgtagctagttctcggttgattccaccgtacgtacgccggccggccggcaaatgcacgatgtagtgcggcacgagacggattaagactatctgattgtgaagttaattagaagaatcgtggtttccatcgttcacaggccaatatatatatcagtgactaagttaagagaaagttcacgtcagagtgtgcgctttctaataacgagatgtgcatgcgtatgttgtcgtaccgtcttgtagctatccgtgccggtggatacgtagtacgtagtgcgacacagcggggcgcccacccaggcgtacgtagtgcatgcggccgtagtagcacctgcacgcaggcgcgggcgcgcgcgtggtgatggagcggcccgatcgatcgatccagccggccgggggacgtcgtacgtacgccagtgcgcgcaccgcacgcgggcacgcggcccgtcgcacgtacgtctctcgatcccttccggccgtccgccacgaaccgcgcgcaaggcccgtcacgtctccgcactgtacgtgcgccaccatcgatatcatcggtttaacagggtgctgggtattgtgttgattggccagccacacattctctataccggccgtacgtgccctggttttggcacacaatatcgccctttcacttgccagattgggataaaaacctctggattatactgtgaccaattaattaccttgtgagcgtgaaagagcacgagtcgcgtatagctggccatattggttctgcgccaacgaatatggaggatgggggatggcaacaagcacgaaagtaaacttagggtgtgtttgtggagaaggtgattaaggggactgggaagatacgtaaaacgaggtaagctattagctcataattaattgagtattaactattttaaatttaaaaaatggattaatatgattttttaaagcaactttaatatagaaaatttttttaaaaaacgcaccgtttagtagtttagaaaacgtacgcacggaaaacgaaacaaacaaactcactctctcaccctttcaaacgctgccttagcgccaatggcagctagcagtccaccaaaagcttttatatatatatgggattaatcggatcaccaaaaccatatatacgtagtgacggtacgggtgagcatagatttctcctgtgtcaccgatggtcggcacgaagaaaatggcgcacgatcacaactggacataaggaagaaattcaagtggctgggttgcaatgcaccaattgtggcactaggagtatgtggtggttctttttcccgattatatgggaatactatacgcatacacagaccattacataatactctctattttcttaatatacacgacgtaattgaattttagaaatatttaatcatttgtcttgtttaaaaaatacataaatattatttttttgttagacttattttagcactattttaatcatgacttatattttttatatatgtataaatttttaataagacacaagataataagtatatccaaaagttaatgacgttctatattaaaaaagaagtattccatcaaccaacaatttctttagggcatatacaaatatagagtaatattagctctttatactaatcaatgtcattagagactatcctcctacaatagtagtattgtaggagactataaggtttctaaatcattaatgcactaaataactttttattatacttctttccttttctctacgctcatgcaacaaattttttgttaataaatgctaaaaatcaactttaagccgttctcatgcgtagcaacgatatttctcattccttctctctctttattccacatcactaaatttacttgcatgataatgaagagagcccgttattagacaccattgtacatgcccttttatacgtgtgattaaatgtactccaacaccattaaaatggagaggtaagaaactcagcacttgtacatatcaaacaaaatctcatgcacgcaaagatttttcatacatccatccaaacatctcatctcaccacattcaggatcaaccaatcaagtcaaccaaatagccttcttgcatctactcagccatgctaaaatcatcctggatgacacgtagagtaagggccaggttcaaatggttcaggcaacaaaacagaccctaaccctcttagcttccactcaaccaggctcaaaccatcctggatgacatgcacgagtcagaatgaagcggtgcaggcaatcaaataggccaatagagagcagctgatgggatgggcgctttaagaattgtgttgtcatgaattggaggggcctagcgtgatggataatagacatgatctcataggaccatttttccccaattttcgtatatacatgtaaccatttagagcacattagaaagtacatgcgtttcgatgcattgccaggaaaaaagaacgggtatacatatctaaactttcattcaagtatcacaaggtaagcaattaaccatagtcctaaaactttcatttcaaccacattttggtatggaaacacgctatatctgcacatactttcttaaggcaatgcacgtatttgtttctcaagaccaaagctacaagtctataacactacaataacaagagtaacaaacacactttctcctcgggtcagtgttacgtcaatgaaataaacagaactccaatgtccaagcttaatctgaaacatgttacttcatcgacatgttaacttaatctgttctttaattattttacaaaggtagggggaaactggttttatcatttaaatgaaccaagcaattctcctgtttctgttacctgcctgaatatattaaagttcctgtagaagtatgcacaaattattttgactttttccaaatagaactcatgccaaagtatagccaccctttgacaggaagggctgcag

SEQ ID NO: 105205 - DNA, 613 bp, Oryza sativa
ttaaaagtggcaagggagttaaatgtcccgttgttgccaacatccctaacttagttccttatatttttcttcccaagtactattgacatgtgggtcagccgtcatcgtaaataatgtataatatagttggctttaagtgaacaaggcggttcaaagtaacacttggttaattaagcgagagagaagggaaatcttaggccgtacattttagatctttaaaaacttattttacaaacaaactaaaaaaatttattccaacaatagatcatttttatagcaccaacatcattggcgtcgtggtccaacatgacaacgccaatgacattggcgcaatcccccggcttccccatggatgctaagtcacttatatggagggggactttgccaatatcgttggacattagtaccgatgacctatttgttaatacttttattacaaataggttcttttatcagtgtcactgacacttacatcgatgacctatttataaatatattttttatcacaaataagtattttttttttacaaataggtcatcagcgctaatgatattggcgtggcttaggctctctttgggacaattctggatccaagatttcttagagctgggt

SEQ ID NO: 105206 - DNA, 728 bp, Oryza sativa
gaatttttctcccgtgtgaagcgttccctagtagccaaacatagcctaaaatattgaaataatcaatcactcgcacaatgccgcttacagttgcaaaatcacaggcataagaaatactccctccattttttaatatttaacacttcttttttaccaatttactgcaggggaatatttaacacgacttttaatcacatgtatgaccattcttattaaaaaaattatgcaaatatataaacatataagataggtttaaaatatttttaatgataaaccaacttataacaaaataaataatatttacataatttttttaataagacaattaatcaaatatatatttaaaaatcaacagcgtcaaatatcaaaaatcggagggagtaaaaatacttaatgaatccaacaatataattttttataacaaaaaccatgttattcgattaatcattagtcgagggttaaaattagacggtctttcgggtgtgaaagaaagaatacaagttacattacacaatcttaaattaattacactactccctaataactaaagaacaagccatcatctgcatcgccctacagcataaatgtactcattggattagcgaagtaccgccttccacacttggagggttctctattgtggccttgcctcaaaatattctgcagcgtggtcggagcagtaggcacaggttcatcaaacacccgaacataaaggtgtttatcaattg

SEQ ID NO: 105207 - DNA, 646 bp, Oryza sativa
ttgctgatttcaataaacaacaacaataatataaaaataataaaggcaaataaatatacagctgtgatggatctcaaataaatatacttaggttctaaaagctcaaatatgaacaaagaaatttcctcaacagaaaaaatgtatttactagagaaaagaaaacaacactcaaccaactttatgtgcccatatattattgtcttcatgacagggagttttgcctattttcattagggattacaccaagaaggataatgtcattgcaagaattttatatctatctcatttaagttcgggacgaaataaattagttaatgccattgtagctcaaacaaaaacaaagaaatgcttgtgatgctagaaatgcagctcaaacaaaaaaaaagttatgatgctagaaatgagccaaatacaacacagaatcagcgcaggactaaaactggctaacatctcatgataagctgcaccggatagtcataggcttgcatttgcttgcccataagatataagatagagagattactgatagctcagatgtatagactctatcaaaggtcatatttctacaattctactacataaagagtgttttttccctcttttgagtctctactccatcatttggaagcacactatacatatcaca

SEQ ID NO: 105208 - DNA, 720 bp, Oryza sativa
aaaatagtaaaaataatatttgtgatacagaacctctattgaatagacttgctatagtgcttactatagatgagtagcaagcgagtgcagctatcagttggctctcttatcgaccttgctctaaaaagaccgtaataatgatgggattctcccttcaaacactgacatccttctcaggatcttagatccagcaactgagattcatcccatgatccaccccatctctcttgagtgccccatgtctcaccaccgtgaaaagacatgcgtaaatccttgtgttcctcttctgctcccacaaaacagcagagtgctaccagctgctctcccttcccaacctgtcgtcgagatctcccctacattggctctccctccaccgcaccctaccatcggcttctccctgccatcggcccctcaacccgccaacagcttcgctcgtgccccctacccaatcaaaccctaaccatcgcccccaccacgtgccgtgttgcctcgcggaacctctcctaccaaatcaccatcaatccatgtgcctgtctcatcaccgacttgtgcttggaatcttggctttgtcatgtctactatatcgacggtgagaccatggaactcatggcctctatcacacctgtgactagacctagcaacccgtcgagaacagggagatggactgtgttgtcctccgcccagggttcagccttgtcgagaaggtagtcgcaaccgcag

SEQ ID NO: 105209 - DNA, 1391 bp, Oryza sativa
ttattcctttttgtttccactcatcttctaaaaatttgggtgtgtaagacatcagttatggtatgtttaacccaatataaaggattagatatggtcttgtattctacaagaattaatatgtggcctctgaatgtggtgtccagatatcattttacaaaatctagtaggtatgttttctatttagatgttgcctaggtctgaataaaagtgatacgcgcacggtgaagatcatattgtagcggctgccgaagcaacaagtgctcgagtggacggtttcagaggggatagcgacaatgctcacaatcaccctatggccgaaagcagggctcttcctggccagtgagaggctcttaataacgtgcgaataacttgactggattaatcttgcttgccgaagaatacaatcgagtgccccctttataactcaaagggggattaactacttctctagataaatgactccctagatttaatggataatccttcctaacaacttaacaaactaaaaccatcgacctaggagtaaaacctatgcacacttaatttgtgagcaacaatacttgctaccaccatagctgacgcaataggagtacgtgtcggccatggcatcccagaagaacatcgtgaaactttgcaagcgatgagactatgagagagaggatgaccaagctgtagaggctgaccagttcatcgtcgtcatcggggtagagcatgaagatccactggttctctcgaggcctacgaggatgggcagctgagaaagtcttttctaaacctaggtgcaggcacacctaggtttagaaaagtttagatcactccaagattcatgcctacaagtaattagcccaaaagtatatcaacgaatatcgaatgtattgtctatttctagacgatcacctagaatacaatgagacctacctgtagccatatgtattgtccacctcaagctccctctttttcacttttccacctgtagcgacccctctctttttcactttccccttctgcctttacccaattcgcccccattttggcacagcgcatccgctctatggtccacggagacgacagagtaagaggtggtgacgtgttgtagtcccgcaatggagatgctcaagtatatgacactttgacatggaatattgagttatttcctttaattccagcatgcataataatgcttggtggctttgcattttaattttcatgtcttatgtcttctgtactggtatgacgactgcatctcattgttgcggcccaacaacgccgtcaagctggcgcagatcgacgtggatctgacatccagcatggtggcatggttcggcgacatgagaatcataaagcggaccatctccggggagctatcacttttaacgctggggctgcaggaa

SEQ ID NO: 105210 - DNA, 606 bp, Oryza sativa
aacacgagtgtcccatcattctacagttaattcaatagtcagaatgccacctggtcatttttatttcctctatgtgacccaagtaaggccctagttggcaaaaaaaattgttttagggtgtcacatcggatatatggacacacatttgaagtattaaacattgtctaataacaaaacaaattatagattccggcagaaaattgcgagatgaatttattaagcctaattaatccgtcattagcaaatatttactgtagcaccatattatcgaatcatgacgcaattaggcttaaaagatccgtctcgcaatttacacgtgtctgtgtaattggtttttttttcttacatttaaacatttgatgtgacagcgtgaaaatttttattttgggaactaaaaatggcctaagtaaacagcctgcattccctcttcttcagcttaaatattgaaggaaatgccacacagaacatgctaattgacattgcatattatcctcatttcagctgaaatgaactcatattatgtaccgtgagacttatcacagtgatatctagagaatagttatgtggcattgcaaagcacccaatgaccgtagctcatctgatatt

SEQ ID NO: 105211 - DNA, 1547 bp, Oryza sativa
caccacccacctgcctcatcgccggatccagctaaggggagcacggaatgggtgcttcgcctcggcagcctaagcttctggattatgtttcgttttagcactgctaataccagcttgctttccatttgaaattcagaaaaaaaaattgaaataatatctgaggaaggaggggaataatcaacaggaacatgaaaatcataagttattaatcagctgccagaagtgaatcatcacagaacagaggcatcagacatgcaggcaagaaacaggaacagataaaggtcacaaccacaggctgatgcttgattcctcggtacggagcacaagtgcacaaccttcatgggtacccgaaatcaagtcccatctaaaaaaacttaataacaacttaaaaactataccaacttcttactgtgagcacgtcgtcgatttcagacaatctcaaattttcatcacactgccattcatgtcttaaattagacaattaaaaccagacacttaagagacattgtgaatagaaagctccaaatgaaatttcaggtccaagtgcacaaaatgcaattcctgcagaatttcagatgtacactgacatgccaaatttcagttccatcctagttttaattcaaaaggaacatcacttgtccttgacaaaaggttcaaaacaaatgcaaagactgcaggtatgccatggccatcttactttcagcacaacctgaacttcaaaagtatgtttccttttagcactccaaatgtcaactagctccacatttcaaattcgtaataacatttgaaagaatctctgagataatactggaaaagaatcagtaggaatgtagcaatcataagttattaatcaacgactcaactgtcacaagtatattcactacaacatcagctgtcagaagtaggaaaacctgtccgttgcatcattcagtcattaaacaaatgcagagatcaggatttctctttgtagaatgttaaaatgattagcatcacagcagagggccagagccattcatgtcccaagttagacttatgattcacattatgaattgaaatctcaaaacttcaatgaagtactcaaaaatgccattcctgatagtgcacatgtacacagacatgccaaatatcaattacaaccatctgaattaaaaatgaccatctcttgtatctgacaaactgttaaaaaaagtaagaaaccacatccatccctgttaagcacaccataactgctgaactatgtttcattttagcactgcaaatctgcaattataccaatcaggttcacatttgaaattcgtaagaacatttgaaagaacctataagaaaagaggaaaacaccaacatgaccgtagcagcccaaatttattaatcaactgcatgaggtgaattaggagaattgtagcctgcatcattcagtcattaggcaaatgcagagatgaaactttctcacagtagaatgttaaaacttccccgcaaaaaaagtagaatgttaaaacgattagaagcccaccagaggcatcaggcatcatagcaatggaaaaaatagc

SEQ ID NO: 105212 - DNA, 1442 bp, Oryza sativa
gtcatcatgcgaaatatcgccggcggcgacccaacccttcaaggtgggcgccgcagaagcgcgcgccgcgggcgttgtccggcaggcagggcccctggtgggtgcgctcgcaggcgacgcagaagaaggaggtcgcgttggtggacggcatgaacaaccacggttgcataggcggcagatgccgcatggcgatggtgcgccaccttgtgcagacaccggagaacatggagtggtcagggaggcaaaggaggtggtggaggatgccggcgacgcactcttcggggagctccgcccacgccatgtttgcgtcggccatgggagggggaggaggaggaggaggatgagtttctggaaacttttggatgggattgggaatggtgggaagaagaagagggcaagtgggaagattcgttgaggaggagattgctgcggttttataggcttctcgtctgaagccacgcggctgctaatccttttcttcttgcttgccaagttttcctattgttctgcatttccattgttctacagtgatctccagacattactctgctatagtatctgcttgttctgcattaatgtcagtttattgtagaagattatctttgtttatactgcagtgctttccttattcaaagtaaaaaaattcttctgttctgttctttcacaaaatttacatagtttcaacagctataaggctctacccaaccctcactcccggcacacaaaatgaagcagcgttttagtgcgtgattaattaagttttagctatttttttttaaaaaataaattaatatgatttttaagcaacttttgtatagaaactttttttaaaaaacgcaccgtttagcagtttgaaaagcgtgcgcgcggaaaacgagaaagaggagttgggatactaccgaatggagcctaagatgggttgttgccccacattcctactgatttggaagattaagaacaggaaatgtcccttcaatctatggttaatttcaataggcagacatcactgtcaccatttttcatttcctacttatttcaatttcagctgagattaatgaactcacatagtcacatactcctattgtaagtaaaaacttgccacagtattatccagagaatgccagccaattaataatacatacattgctccgtgaataatacgcaattttaggtttattttacactagacaaaccgacaacaatcttcatcttgaccaaacagactattaaaaagacctaagatgttttattcttcattagtaaaatacccatactaacgctatggttatattaaatttcactaatgctaattagatgaaagggttactcataaattgcatcatataaacatgccacacagcactgtccaaggaccaaaatgtcataatggtaagcaaatgcctcattcaagattaaaatgccataacgccacacaccggaat

SEQ ID NO: 105213 - DNA, 667 bp, Oryza sativa
aaaataactattttatacccctcccctcccttaccaaggcccaaacctacctcccacctccaccgagccgccccatgccccagctgtgtcgcaccccatgccaatcccgtccgctgcaccacaccaacctcctcccatgctccgcgctggcgccgcgttgctccacgccaacaggccgagccgagccgtgcgccgctttgcaccgggtaagggtgcaggtggggcgggttgcgggcacccgcaacctgtccgcagcatccgcaagatgtattgtggcaacccaccaacccacatcatgtccgctgggctatttgcggccagaccacaacccgcaaacaaaccgcaaacacaaattgctgctaaacagcatacagaagatcattgaatacatgaacccattttgttttcttaaaaagaaaacagcaagcctagttttgttatgacatatatgggctttatgcccattttgttctctcaaaagagcacaggaagacaacatggcttactgcccgattacagtaccagtacattaaaaaggccatcaagaagagcacaccatcataaaaaagagagaaaaaaaagctcaatcaactaagtcaattggggcttaacaaatgagcctagacaatgtcaaatctacatgcacatgcaagcaccgcaactcgcg

SEQ ID NO: 105214 - DNA, 748 bp, Oryza sativa
atttagacaggttcaggccctcttaatgagaggtaatactctactcctgtttggagatttgaatccaccgggtgtagtatagatctgatgattttatgtgtccatgcccgtagaaggcatcctgcccaccttatataagatgagggcaggattataagatagaaacattaaccaacgcggtatcggtttcctaaatctattttataatattaccaaaccaggactttaggccgttccataatatacaaggaaacgtaatatccaaatcatgatctattacatattccatatatataagttatcccctataactagtcggataaacatgctgtgtgggtatggggtacccataatttccacagtagcccttgagaccttcacagtcgaaaagataatcttttctcgaactagattactccaaagccgagtgcttcaatcatcttcgccatggtctcccgagtacttttaccaaatctgaagactgtggagagctgaaaaataacctaatgtaaacttaggtgcatcgatgcacctaataggtttagcccccgactatgtggttagttgagcaaactaaacatatagtcatggagtaaataatccaaccaactgagtagcttttgataattatagtcaaccaagtgattgatcttaatatatagcatatgcggtgtgaatccccgaataacacgatccaagtgatataccgactgctttgtaaaatatcaagcgtccaacctgggcgcag

SEQ ID NO: 105215 - DNA, 1293 bp, Oryza sativa
tgcacccttgtgtgcgggccggttgatagggtcgccacccctgcccgttccccctccccactctactccttcgttaccttgcactcctgccaccattgtagctgccttgatcccccggtcatcaccatgccacacggtcgtcataactgccattatgcacaatgagggcgaccgcagtggaagcgtgacagacggccctatgtcctgctatgatacaatgttgaatgctagaggaagaggaatactgctaatattggacacgttgtatattaagcctcaggaaccaatatatagaggagtaaatgtagaggagataagaacgaatctagagataataaaggagtccatacaaataaatcatatcttaatatgactctaactaccacactgcataattaatttttcttgatgaggccctatttaggttgcaagtggaccataattgctcccacttgcaaatatcactcctttgggtcggttcaagggccgcatgtgaaaatgctttttcgtatgcgacctcttaagagactcgcctgagaaaatagaattatttttccagatggacctcttaagcggtcacatgcaaaaatcagattttcgcaggcaaatcctttaagatgccctttacgaaaatcactagaaactaaatataaaaaccaaatcctctccaccatctatctcgaggggtggaaattttccagttgaggccgaggtgggggaaatttctcacccgcaggtgagcggggtcgggggcggggatgggagttgacgtaagtgacccacagggcctcgatggtatgagttacatgtcaaaagatcgcacattctaaggtccatttggcccgtaggggaaggactacataagaaaaaccctttcttttcccaaataaagccgccactctctcctctctgactcgcgcatcacttcctcctagcgcgccgcccctagccaacctgcctcttcacgtgccatccctagttgcacaatcccgagttggtacaacctcttccgcgtcacctctggacatcgccgccttgtcatagcgcgtcgcccccaatcattgtcacctcctcacagtccatcgcccttggccagcgtcgcctcctcgtagcgtgctacccctagccaacgccgctaagagtaaccccctagggtttctcccggtgccctttatatagaactagggttatggtatcccttataatccagatacctactacctatttacatggaatatgattgattgccttatcctctatctcttactcaatttacaagtgtgctgcatgggc

SEQ ID NO: 105216 - DNA, 857 bp, Oryza sativa
ggcgcattgataggatgaaccctcctccttggttatgctatcttgagagcggtaggtagtgttacgaaacttcaaggccttatatcatcctttgataagatcgactgtttgctatttaatatgcctttttcattcactggtctcgctacacatgcctgcatgctccatggcttctattatcgaaaaactgttgaatgtgaatgagtatgtttttttgcatccaagagtgttgtgggactgacatttggcttaattctgtgcaacacttgtgatctgcccactcgcgcgtcgtagaattttgtaacagctcaaattaggtatatgtactactatgtaaaaaaaaaaactaatcctaactacatatgtgtacatgctagcatagcatgtgctcaggtaaatagctatttgatttttttataggaagttcaagcatttgttcaagtaaatagctatttgatttttttataggaagttcaagcatttgttcaagtaaatagctatttgattttttataaggagaggtttcacggatgtgttcaagtaaaaatagttagaattggattggactatttatggagaggtttcacgcatgtgttcaactaaaaataaatagttagaattggattggattattaatgagacggtgagatttcaagtggtaaaaataattagaattggattggattatttatgagacagcgaggtttcaagtgtgtgttaaggtaaatagttggaattgaattttttatgagggagaggttagggctgtagcgatatgaagaaaccatcagtactgcacagagaactcaattcgcagcaagtcatcgaactcacaaacgggccgtcccgtcctgtat

SEQ ID NO: 105217 - DNA, 1227 bp, Oryza sativa
gggggaattttgattgtttggcgagaatttgctggattacgctttgagctactggaggaccccttgagagagattttgtatcagattgctgttagtttgtatcaatgctgctgctatgtttcttcgaattcgctcattgtctattaggaaagccgaaagggaccagagtatattgatgcattcattgtgcattgtattttacacagtagggattcagagcctccatggaggcggcgcataaaccattgagtaccattgataaggattttagggtcacaagctaactgctgtttgttttatcagatggctgctgctaggtttcatttagtttgctcactgtcaattaatacagcgaaagggatcagagtatactgatgcactcatgtgcattgtattttacacagcaggatcgctactgtagggagcagggagtctccatggcggcattgcataaccattcttgtgttctttatttattgtttagggttagactaatgttttctgaacactgattcctatgtagatggcttcacagcatgtgatcatacatgatgcaaacaatcagtagtaaatcacgtggttgggtctgtcactgcagcagtgttttgacatgtgatgatcatgatattatgccactcacgcaatatgatttccctgttgcccttgaccatatgctaagcattacaattctttagtactttgctgcagtttattgtcttttatttttgtgatctattttgtttgtatgtgtgagcgtgtgcctatctgtgtatccatgacttattgtatcgtgctgatttatgtttgtactggagatgttttctactacatggaagcatttatattgtcttctacgatgattgttgtactttagtagttctgctgtacataataaatatttgacaatgttattcctaaaggaggttaaataacctttatgtagccatgtaccagcagtccaacactcagtgcttctggtttatggagcttggatacatcgcatccattgtagatatttagttggatttaatgtgtcagttgatgttatcaactttaatggcaagggaaaaaaagatccccctcttggcaaggacatctatctatgaattatttctttcttgctttggatgtggttctatatatataaatgtcggttcagtctacctggtttggagttaggaatagctttggtaacattttgctttgattgtaaagttctgacacctc

SEQ ID NO: 105218 - DNA, 632 bp, Oryza sativa
taggctggagtacgatgcagccacatgcgttgtgtatgctgccgaccccacgcatgtaggacaggatcagccatgcactagcctgtgctgacctgcttgaattaaccaggagaatcatcttaaacttgctctgggctggactgcatgtgcggtggtcaccatgcctacgtggttctgcacgcagaacgctcaccaaactactagacggcgtactgttcacaacaagtcactatagaaaaattcaacgcacaaatcatattaagctatgcgtaaaggcatgactaatactcaattaatcatatactcatcagtcactgcgtttgcttgacaacgagagaggtgccaaccctgctcagtaacacagccggctcaccagacaccaccaatctggctctgaacgatcctgagagtcaagcccacagttaagctaactgactcctttaattgctataattaacgccacctgacactgacaggacatttaggcagctgctgaccgtactcataaattatacttcctttatccacgaacacaaatatatttcacgtgcaaatttatactcctttacaaaagtgggggaccccacctaccatgatagattttgtaaataacccttggaacctattaatac

SEQ ID NO: 105219 - DNA, 769 bp, Oryza sativa
cctgcagccctgtctagagcgtgtagtctatatgaccagatgaaacaaaataatccatgcatactaagctggatgataaactgtgtattggatgctgggctgactaaggctaatatcttcagtgattacaaacctacactatgctatggtaatattgggcatgacctaaaccaaggcataaccaaaatactgggaatacaagttcatttggattgcaaccatactgtttgcccttttatttagtaaaatcgctagggtgggatctggatcaatgaaatatattggcagtataataaccatgctagtgcttttctgattgtttgatcttcatagagcgcatttattctgaaaactaatcaaataatcacaccatgcagtaaagaacaaaggatattgtaaaagtgtgagaaatgattcgatttatccaaaattttggcgaagattccactacacacatctgatccaatatttacaggaaggacaagggcaatacctatcggtgggcatgctaaaatttggtatgcatccaagcagtagccaaaaacatggggggtatcaccaacactttggcacgcctggcttaggcatttcgtaaagttcaacaatttacatcaggctcttgttacaaacaatcctaacatgataaaaaaaatgagcaacctcactctaatgttcttccttaaatgcatacggttgttttggaaatgtccttacaaattctaaagtgaatcgataacaggatgtgtgttttggaggttaccaagttata

SEQ ID NO: 105220 - DNA, 689 bp, Oryza sativa
agtgtccacccatcaagtatcatgtgaccctctctctctctctctctctgctgagaacaaggcgaatgacatgattacatgaacacgcgcccttcgcatacgtcaaagtgcctgtcattgaagtaaccaacatactaagcttgccaactgcgctagtgtgtactttgacttgcctatgtgccactaaaacgtttccataataattcaagattcatctgctactccagatcttttgagttttgacaatacattttgtacttcttatttgttattagattttgcgatattaccaattactaggaagacaacaaaaaaaaagcaacgtaggagagatgagcaacaaattgacttccatcatgcaaaagtagtccgtagatatttttctttggacaatggtaattacatctcaagttaccgcccctctatatttgttagggtaaaagtattcattgagttctgaatattttctcttgattgctccgattcatcacttctgtatgcaaagtaggcggggcgacttggggctggaagtgcagaactactcccattctccagaatgaacacagtagatgacataagtggcctgtcatttgggttgtcttgaacacacaatagtgctacatggatgcaaagcaaaacctcatcaagtaagcaactaccaataattgatgagtccgccaaatccttgg

SEQ ID NO: 105221 - DNA, 586 bp, Oryza sativa
ctactacctggaccctgcatggataactcgcaccctgctcgtgcacaaacacaaaacagtcagagaggtcacacaggagaattactgagttaatggagacaccgtgtcgcggactggagggaggacttacgctgccctcgtgcttgtcagccacctaggacttggacttgccaaaatctactgaagtaaccgggcctcccgcctgtatcgacaaacgcacaacagatcaaacccaatgtgtaatgacagacgcaggtgcaaacctgcagagagggggatcacgtgctcgttgttgtcagcgtaaacgagcttggtgtactcatccaatgagctcctcagccttggatactaacagagcatacacctgtatcgttcaccacacctccatgtacgagctacacacaacacaaggtggactgatacactaacagagcattcactacaaacgacggagacaacaaatcagcacatatgatgaaaccactgttccaaatacacgcctaaacatagcgggtgagtacatatggccaccaaattttactataatttgactcggcggtgaacattctgacttaacattaaccaa

SEQ ID NO: 105222 - DNA, 1011 bp, Oryza sativa
ggcacaaagctgctttgagcttatatttattgacttaggatggattctgaaatgtgaacttctgattgacattccagggctactgctaagtgccaactgcaagtggtggcttctgatcttgcttgtggaactagttttccttcaaaacctttgtgaatataataatttacgcttcttggttggtgtcattgtttgcattactatgtaatgtaaactaatttatttgggccacacctaccttttatatagttctctgcatacaatattattaaatatcaatcttgtttcagcatttgcagaaatgtttgaaataacaatttgatttctttttcagatacacatttgatgaaatttggaaatatgaaccagtttttcttctgagaattttgcaaaatcagaatgattttggctattaattctccactttgacttttcactaaagctgtgcactgccacttgtatctccatgaccaacctattgcatgatgaatatgcattatgcagccatattgtatttttttgaacgaaaggcagccatattgtatttggtctgaatatatctatctatctatctatcaactagttatatatgcatggatctcgtgaggaaactctcccttgagatacaactaacgaagatgcctttattttcagtgtcttatatatgcatatactaagacaatcatatccaggacagacgctagagttggagtggatcaatgcagattaagctggcatctggtacaacaggtatacttttgttcagttttcattgatgtatataggcacaaaacaactatgcaatggcatagcttcactcttttctcacaaaaaaggaagaagaagaagaaaaaggctccacttaagaagcaagatattgcacttgaagctcaagaagaaaacgcacaaatttagaaataaaagaaagagagacatcaaaatgctggctgttcctatatatatgatcataactataatcctccttatgaactaaactccaggaaggactcc

SEQ ID NO: 105223 - DNA, 1313 bp, Oryza sativa
atgccgccggatctggggtcgagctcggattcagccgcacagcactgccatcacgaccggcgatgacgaggggacgccatgtgggtgccttctcatctccttggagctcctccccttcttgaccgcctggtcgtggggagctcctttgcgagacagtgaaggcggtggcaaggttgccccaggttgttatcgatagtgatgggcggtggcgggcactctctttggaggtgacggcatgggaggaaggctagctggtcgccgaagtgcagcggtggtttggtcgtgctcgttccaacgtgtagctgtgggggtcgcgctggcagcaggttaggtcgcttggagtccagccgacggaggggtgtcgttgctgtagaggccacgtgttgacattgcctgggagtcggtgaggtagcggcaagaggggcattggcaggtgctaggcgaaagccggcccaattcttgggcggcaacggcgacgtctttgggcgttgcaaccctcttgagggcgttgttgaggtgcctccctccccctcttcaaggatcctctaggtgaaaacctcatcctttcgggatgggcgatggcggcgttttgaatgtcgtgaccttcttgaaggcatcgttttggaggtggtcgtgtgttcctctcggtgtggtggtgtgtaggcacgtggcagggtatgttttctcttgtccggttcccctgtcccctgctgcttttgcctttggttgtaaatgtctgttttactcctcttaatgtaaaaatacgcttctagcgtattcctgaaaaaaaatacgaggcacacgtgtaaatcagaactttgaacctgaagtaggaaggttctactgtaaaaattgtaacaagttaacctacgctcacctcgtggtctattattttaaaaccaagaaagaaacgactaaaaggatgtctttaagagtttagacaacgagaccctgttagaacagggacaagaagtcaaaacaaaattgaattggtccttcgtgaacgaaaacatgaagtttttttttttgagaattgaaaacatgaagtttgagaggaaattatcacaattgagtcctgaaaacaaattccccgttcagcagccaatgtcaaatgccagctcgtatggacatcttcagcgatcaagtaccgccgtaggcggcgccacacaaatgcacgcaagggaattaactaattaattaagctactccgtattacgcaccgtagcaacaacgaaattaagttgaaaaacaggtcactactatcctccatatatatatattttagataatattacattaatgtactatcccct

SEQ ID NO: 105224 - DNA, 1217 bp, Oryza sativa
ttcctgcagccccatctctatgattgcctctagggcatatcaccaacactcagcaagtcatgagaaacgtgagcatgaggacttcgaagggaggctgggtttacttcgcaaccatttctttttaaaagaacattttgcgaaccactaagtgccctcaatcatggggtcagaaagaagtttttgcttagatactgttggcaaattgctttacaacaactcaaacggacgaagcaaattttagttggttaacattattctgccatcaagcagcttctaactccgttctcaactatcagtttcttttcactttcaaaccatcgggtagcccatctcatcactcatctctttggctccaagagttgtccataatctctagcacacactgcttccactagggaagcctaatctataatgccaatcgacaccccgatctacacaagatcattttcagaccacgtaatggtcctctattactcatcatgactgattctagtaatggttcccaatcccacaaacacttttcacaaagtataggcaaacaaatctatgcaaagaggaatcacctcacatttgcccatgaccatggtcacggccgttcgaatagtttgataatcctctgcagagggtgcatgctttacccacgagacgtgatcttactccctcactagccaagcggggaaggttcgtgacaaggtctttctgaagccaaccagggatacctcatgcaacatagaagggttctctctgaacttgagaatcaggcaaatctcagccttcatctacctaggcattggggatgtctccaatcagtcgtgctttagattcctgtgagctaccaggtgatacttgcgaggtattaggcgatacacttgatatcagtttttgataatgatgtgtatcggatgattactatgagatattaggtatacttgcgaggtaccaagcaatacttgtagaaagagcatctatgcccctagtgggttttggttaattgatgacaaacgattaagggattaatgcacttattgaatgtataagcaagggatttgtccgatgaagaaccaatgaagatgatgaagaaaaatatgcaatacaacgaggtttcattgtcatccaattctacaagtgacggaaaatggcaagaggtggtgaagggttggcaagacttgctacgcgatggaccatgcatgggagaagatcaagcaaatgtttggcgc

SEQ ID NO: 105225 - DNA, 728 bp, Oryza sativa
catagacttgctcatacacactcttctggaaagcagtatgaaaacggggatccggggtgtcccgaggcctcaaaaactgatcgtggtgcctcaagatggtatattgggatggattcctcatgtttacaacaaactggatggagggatcaatattcatctcatcacttccttcatcctcatcctctccacttccactgtcatcatctccactttccccctcgctagccccctcaacattggcctcaacctcttcatcactttgagcatactcatctccgcttgactcctcactcacgggatcaggagtgggcgcacgacgaccatgacgggtgcggggaggcatagctgaaaaacaaggagcaaaggatggataagcaacaattttagaaaccacatagtgaagtgggaggaagggcgagtgctgcctatcaggggcggtcagactgagagccacggccggtcagaccgccggccctcggccgatcagaccgcgtgccctcggccggtcagaccgacggccaatggctggttagaccgcctttggtcagaccaccactgacaagagcacacccaaatccttccacaatccacataaatgattctaaaaattgctaggacagtgttgcacacgattggaactagaacatcaaggtgtgtgtcacgaccggaaataacccaacgggcgttccttacgtgcgtgcattattccttgtcccaggaggcaaggt

SEQ ID NO: 105226 - DNA, 751 bp, Oryza sativa
tatatatatatatatatatatatagacacacacacacatacatacatatatatgtgtatatatatatagacacacaccagattattgatattaattagtatctccaaggctgcatatagaggaatcagaaaagtctatcctaaatttggtacagatcttccctaaagaaaaattgtacatatctgctggacccaaacggaggtattcatttggtcctccggctgtatatatgtatcctgaacatagttctcttatcagaattattacttgtttgttatgtaggagggtaacttatttggatgtagttggtcaaatacctgcggagctacagaatctcacccatctagtggacctgtacggtatcgaagacttctcttcttaatttatcttgctacctgtcacattcggaaattcactagtaatttccgaactaagttgtgcatataatacactcatctactaattagctgagatactaaaattgacaattgaatatacagatccaatattataattacgttagatattacttataaatgaaaagaaaacaacaggtaacaaacaatctaacattagcttcagctccactctcacagacagttcaactgaggtataagccacatgtcttctccttcgaaaactttcttcaactgagatttgatgattattgcaaggtgagtaaatagaatactccgtaagccacatagaaaaaatgcaggtgcatggggatacaaaggaaggtatagtaggg

SEQ ID NO: 105227 - DNA, 972 bp, Oryza sativa
atccgtgttcctttcttatgttatttaattactttgtctaagtaggatatatttccatctttgctggttcattgtttagtatttatactaagtgctttagtactaggactccggatagagaaggaatttcctgcgcagtattagagtagtaattaataacttagacgtggtgtctagtttagagattacctttgtttgttgtgtatcccacggatttgtcagaggtaggcggcaggtggtgacagccctgaatcctgtcctagtaattctccacgtttggatacatcaaagagctatagccggaaccacgttggcaggccagcaggggtaggtgcccgaagcaacagataggaaattacctttgcttagcgtagataattaaaacccatagaaagtcctctctagcctggtctacctatcatcagttgttgtccttgaatagtcttagccttaggtagattacgcatgttccctgagttagatatccttttggggtcacccgaaggtgaagtgctacagtggtattccgtgcgcttgtggatttatctgtggtcgtaataaataccaacaagctcaaggctagatatgtgccatcctctaatagctaatcattcactcgaacctatgatagattatataatttgtgatagactcctcaatcacctttggcatggccatgcactccataatctataacattgaggggcccagagatatctctccataggagggcaaatcacactatgattattcatatcccactacatgtttcatagcatacccgaaaactacttttataactacccaattatggggtagcgtttagcagtccctaagtaagctactacatatgttgggaaccatgataatctcatgtctaagaattcaacaccaacactaaatgaaatcactgatgacacaacacatatggctcttgcagtgtctcgagttgggtctatccaacaacaagtt

SEQ ID NO: 105228 - DNA, 981 bp, Oryza sativa
ataaaacttacactgtaacttttgtaagttacactgtaatttttgaatttttgcatgtaaattttaaattttgtattggatttggtctttttcttgaggatatggtaatttagtgtccattatggtgtttcttaattgctttttgctttttattatatctatcggattttaatccaaagattaaaaatctgtgtgatacgatcataaaaatctttcgaaagatgtataggtactccctatttcgaaagatgtataggtactctctatgagtaatcgattttgctatatctcactcgaaagatttttcttatctctcactcgattttcttactcaaatttacagtgcattttcttgtaagttacagtgtaatttatgaaacttacactgtaacttttgtaagttacactgtaatttttgaatcttcgcatgtaaattttaaattttgtattggatttggtctttttattgaggatatggtaatttagtgtccattatggtgtttcttaattgctttttgctttttattatatctatcggattttaatctaaagattaaaaatctgtgtgatacgattataaaaatctttcgaaagatgtataggtactcccatgagtaatatggtcaattgtcccccccatttacatggcccatgtttaacaatctacaaaaaccgatgtgaaatcacaattaaaacatgcagaatcccccgcaatataaagtcattcccaacccaatgactaggatggtatccatattattaaataagctgccacctagaataaaaaatgatgtggcaagtgaataaatgaggaaagagaaggaaaccatgtcttgcatgagacatgatttctacacaacacccaagacatcatgtgagataagtaacattaaatttaagtatgaaatattgatgtttgcattgaaagagtagtgtctagtactaaatttttttggtgatgtggagtttatggaaaccatg

SEQ ID NO: 105229 - DNA, 1445 bp, Oryza sativa
acgtcgttgtcctcagctccggccaacatctgccgttcgatccaagcaattccggtggtcagacggccacacgccgtgcccgcgacggcgccattgacgtatacgtatacgtacgcggtacgcctccgcctccgtacacacgtataaatacgtaccagagctgcgcttgcgacgccacgtacaagccgatcgatacgccgtcgcatttctcctcccattaattcgacacagcagcttaatttttttttcaattctacgatatcacactatggttgtctttagttccacgttaaaattaaaagtttgaagaaattgaaatgatacgatgaaaaagttgaaagtttatgtgtgtaggaaagttcgacgtgtcgaaaaaattaaaagtttgaagaaaaaaattggaatataaacagtgcgtgcattttgtacagctagttaataatagtccttcgtcttgtactacaaggacctgcacgacaaagctgatgcttttttttttctgttcatcactctttgagaaaattaagctttttcgattcagacgtttaccagaccagtgtactatgctaagcaccaaacatatacttcctctcatcgtcatccatggtaaaatttgattcttaacgaagaataacctagctaaaaaaaaggtggagatgaacgctattgtttctgctatacacaatagacaatataacattttttctctgagtgccacgttatttggtttgttggagatgcattttttctattttaatatcccttcactccataatgtcaaacggtagttttggtaatttacttagaggaggagtaattaggttcatcaaaaaaataattctaattaaagctagtgctttatattggttaatttgatgttgtcgtaataataaagtttttttaaaacaattgtaagttattttcgtatatttttattggctccaaatttgattggtgctatcgaggatgagcatcatactatacggctgtgttctttccccaactttcctaactcacatttcagtgtttcgcgcgcacgctttttaaattgctaaacggtgcatttttttttgcaaaaaatttctatacaaaagttgttttaaaaaccatatcagcccatttttcattaaaaaattaacaaatacttaattaatcataagaaaatacatcactccgttttacatgcgcgggaggtgagttcccaacctcacatctcgaacatagccgtaatgatgctacactcttagaatcggtagttaaatttaagcctcttattttataatgggtgacgcatagttacattagaattgctggctaaaaaatctatttgataatgccaatcaacaatatgcatgggggaagttgggtttgtcacatcacttacaatttaacaaactcatggttgtgtctcatggtagaaacagcatgtaaaattctttcattat

SEQ ID NO: 105230 - DNA, 700 bp, Oryza sativa
caaaaatatatatatataaatgtcatttattttgttgtgacttgttttaccatcaaagaaactataatcttaacttatacttctacatatttatactaaatttttgaaaatgatgaatggtcaaacattatgtgaaaagtcaacggcgtcatacataaaaaaaacggaggtagtatgttttatttacttatgatgcacacagaaattaaacaggaatacaacgtggcacaaaaggtaaataacaagctaaaactaccataatacatgcaggcagctataagatagaagttcagaacttcatattattaaggttaaagatattttcacaaattagcatgcaatcaaatttcatgtttctcctagtatttttttcaaatgattatttttaattatgatgattcaccgataaaaataacctcaatacaaaagcacaacaaattagagcaacatttaattaaggagacaagtatcctactttgaggcctgtttggtggttctggtgcaatacggaaacttttgtagtttttaagtatttcgcaaatttcagcaggacgcaaccatcgttgttgagcctccttcagtatctgcgcaatatctgtttatagatcacagagtcagcgacagttaaacagtgcaccatatttctcaaaaaaaaaaaatcatagacagcatcatcacataacaaaattctctttcagaa

SEQ ID NO: 105231 - DNA, 708 bp, Oryza sativa
atgtaatatatccgatatgaattttcatccataccacgaagatttgttcaaagagcataagatatcacatttttggagggttctaatttatagtacaactgaacaaagtgcaatgacactcttgcccttctcctccctgctaccgttggtcaaagctcatccaagagcaatggccagcgacatggactcaggcaagcctcccagcggcgtcgccatagatcaagcttgtcccaagcaatgtcattgtcatcggtcaggatcactccatgcaacaaaggtggcgcttgaacttattgtgggtaattgcagtgtggatcaacctcattctaggcagtaatggtgtggttcgaccacatcttggcagcggtggcaacgttcaagcctatcctagtgtctacggtgtggatcaagctcctcttgggtagcatcttcgatggcgcttgagctcatccttcaacggcggtgcggaccaaccttcgacctcgagaaacctgtctagggacttctttgttcggtgtagacaagggaagacgataagggtaattgtagaattagcaaatttttttcataaggaaaagggaaattttgtgggatagattggaagttttgatgttgctatagtaaactcttgtggtattttatggtttcggtctggtatggatggaatcttcccataggataatttgaggatttcaattttatgagaat

SEQ ID NO: 105232 - DNA, 604 bp, Oryza sativa
ggctccccctcctccacagctgcgagccagtgcgccgctgttgccgccttcgccaaggaagagaggagcagcatcagcagctgacaagcagaccagagagaggaaggagagagttgtgcgactgacaagtgggccacacatcaagttttacactgcattggcatgttggcatgtcacatgggcaaaattggcaaatagttgattccaccactttagaggggggaaaaattaatggcaaatcgtatttggataattgacaatcctaatagtggcaaacagttaaatttccccatcattttaatatggtttgtcactctaatagggttaaaaataataaaataatggttgcgatgtcttgcaagaaattattagttttttaagatgtcctcaagtcgtggtatgttttcacgttatccaccaataaactatacataaactttaagtattatgagcaaaattcgtcataaattttcctttgatatgataaagagatatcgttagtgcacagagattttcaactgttcaaccattaattcattgttttttttagagctatacatcaaaggaattctttataggtgtcctaaataggaacactggtgtt

SEQ ID NO: 105233 - DNA, 502 bp, Oryza sativa
tagtaacgtcgtgtgggtaaagtgtaccccctctgcagaggttattaaactattcgaacagccgtgcccacggtcatgggcggatgtgaggtgattcctagcgtagtttttgtttgactactactttgtgaaactgctgttatggaaagggttcgatgttgggaaaatctatggctgatgggatcaaccaggcctgggtggccgtttgaaagctgttggccgggtgccaaccttgatcaattcaaagactgatacattgcacatactccgactggacgagacgcactgtctcatccgtgtcgtttgagaagcactcacttagtcgtttaaaaaaaaagagtttaactaaaatcaattgtgaaaacaagcagcctttcctttgaagcctgcattaaacacataattcccatggcttgctgagtacgaaagtactcacccttgcgctctctctctctctctatatatatatatatatagtatctctattatatacccctccctt

SEQ ID NO: 105234 - DNA, 537 bp, Oryza sativa
ccacgcacgccgccggcggtgcgggcacgcgccgcgcgtgatgggcggcgccatgggagatgctggctgtagccgagaagaaggtgacggctacggcgaggagcaagcaggagggggagcagctagcagcaatattgggatgcggcatggttgttgtggtggttgatgcgtgcgtacgtgtagctagcgagctagctgcttgcgttcatcgattacgcgcaggctttggtggctcttttataaggcctggtttagtttcccacaacagatttttccccgaaacataacatcgaatctttgacacatctatagagtattaaatatagatttcaaaaattaattgcatagttaggatgaaaaccacgagatgaatcttttgtgcctaattaatccatgattagctataagtgctacagtaatcccatatatgctaatcacggattaattagactcacaagattcgtctcgtggtttccaggcaagatatgaaattaattttttcattcgtgtccgagactccttccgacatctggtcaa

SEQ ID NO: 105235 - DNA, 1460 bp, Oryza sativa
  unsure (1)..(1460): unsure at all n locations
ttaactacccctntcaaaaaaatagaatgatattcatgtactaaaatcgatcaggacaaagaatgaaatcaatgtacaacaagttgttggggaaatccgtcgtgtgttgcactgtatagctaattcttttaaagcaaaacagccattcaatagatgctgttgtaaacactcattttgatttgaaaagcacagtaaatgaaaaaaaatggatggtcgactgttgcaatgttgcaacgctcttgttatgtcttctataaattaacttcattgcatcctatatattctctgtgtgcaataccagatcaatgcaatagtcatgtgttaactttcttttcatctcttcttttttcttttgcggagagtcatgcattagctaactgtttggatgtactctactcatgcacaaggaagcgtttgttccgttgttgaacagagagagagtccgggatacacattgtgaagtcactgggctcatgcacttgcacgcttaaaaaaggtggatagaacactatttggatcaccaataaaaattataaggcgcaaacctacaagatacttatgcattgtgatagtaataccagcaaaaaagtaattcatatcaatgggatgaaaatctcatttagaatgcatgtttgaaatggtagtgttgcactgaaaaggatagcactatatatatgcactaattagggacggatgtgaagcatctacaagaaactatataggctactaaaagatcattatttatagatcttgtctttttcagccaagttaattatctgagatattgaagtccaccaaattagatcttagtgtttttatcatatctgacattgtagaaggttaacatagacagctgggcagctagccacggttataaactacttcaccatactatttgaacatttttcttcctcccaacaacgcggtatcaccatactatttgagcatttctcttcctcctagcaacgggatcatactatttgagcatttctcttcctcctagcaacgggatcagatgaattagtaccatactggttccacaatgttaggatacaatttgaaaacattaagcatggatctcacaatgttatggtacaacttgaaaaattaagcatggatacatgcgcgtacttataggtagcgattctgcgctaaaagcatctgcaatgtaggaatgtaggaattaagaggtgtactaagagaatctttccactatagcaaaggttttatacataaccatacaactgcacggtttgttaaagtgaaaccggcgaaaaccttacacagaagacacaaaaagcctgaggcaaaacaactacgaattgcagatgatggagggaagagcaagacctaaggcgaagcctttaagagagtgaaacaacgacataagccggtgtcgacgcatgcccaacagctggattgggttttcaccggggaagagtccacaaagtcaacacctc

SEQ ID NO: 105236 - DNA, 1557 bp, Oryza sativa
atggctcatgagccaaaattcaaaaggctaacgttggcaacttttacatcgagatgtcgacaggatcgatatgaatatcttttcttgaggcttaaaatccaagctacggagtcgccgtgaacttgcgggtgaaaggacgtacaggtgccgacttgatgatccatgtccggcaccatcatttaaggagagcactgtccaatagaagctgtccatatataccatcagacattcagagtttcagacggcacaagttttcattccatatcatcaggagaacttcaggtacaaactgcactttctttgtttccgttcatattttgccaggccggttactgttcatgttcctcagaaagtaacatcatgcatgatctagggcataatgatctcctgttgaacctggtaggctatgcttctatttttgatataagctaccaagtcattatattataatagacaaaaaaaatggcaaaaccaaccagaggttaatcgactggagattctgagttcctgacctgatttttcttatacctgtacaaacagattgaaaatttaattcacgtcttgtttttcctgctttgcttttagaaattcaatttcaacgaagaaaggttcaaggtgtgaccaaattgccacatatatgagaacacgtgaatggcatatttaatgaaacactcattcgttatggacaataccagagcatgtttacttattttaaagagagcggagatcatttttatgattagaaaaataaaatgtaaggatttagctgaataactcttaactagccatggagattatcgacaaaaatagatgcaacctatcatgcataataacaacctattcggcgaacaaccaccgctgttgtacttcttctccaaaccatcataccagttaaaaaatatatttaaacaaatgcatcaccatgtcattgtcctcagtcataatgcacacatgacaagaactgtttacaaaactacaacagggattatttgcacatgtcctcatattttggagggtggaattctcgatttcatgttccaggaggttaagtaggccaaaccactgtatcatgcaggcggttaagtttccaacctttaaactttcaaaagtttagattgatacatgtagatttgcttgagtactttcatagcattataacactaatgagctttataaatagtattttatataaagatcagatatcaaagttttatttgggagaccatgtcaatgtccaaaatggcgtatttctgagttgtgaccgatgggagttttttctggcacacttattattccaagtgaaacttacctgggcatggaattgaagactaattcttttttgtttttagctgccagaaaagtgcttcaaaatgtttactgccctaaaattgcttctcttgccatatctgctcctactggcatcagcttcatgtactcaaggattgcctttcagcaataacactgatctggatgccttgtaggattcaaggcaggtctaagccatcagtcagatgcactggcttcatggaacacaacaacaagctagtgtcagtgtaa

SEQ ID NO: 105237 - DNA, 1119 bp, Oryza sativa
tttctgtgcatatgttagagttgggaagtcaggcatccgaacacagccttaattatcttccaaagccagattgggtttatttatgtttaaaaaaagggtttattcataaaattgtacaaaattgtatataatttatgatcttatgtgcatatatatggtaattttttcataatatttaaacatatataatttatctcatatttttttgagaaattcatctcataatttttttttgagaaacacatgaatatcgtacattatgtaattcttaattactcgaggattagcatgtactggacgctcacagaaaaaaaaggtaaaatttcactcttacaaggtataattagataaagcatcaattgcaatgacattgacatgaacgacgacattcactgctacgtagttaaatattgattatatatatatatgttatgggtgactgatgcatatgcatgcaaacttgacgtactctcttcataagaaaaggataaattgatattacgtacattcggatctattaaattttctggcagttgtcgagaataattttcaattcgctagctagctagctagctatcatatataaatatgtatatacaatttttacatctaaaaccttacgtacgcatagaacttaattattctgtggacatttctcgattaattagggcctacttattacgtgattaattaggctcttttgcctcttgggatgagatggcttctggaccgcttcagtagccacatgccaaattttgcgatcttaacccttgaaaagtttaatagtacatcgaatgattaagatttgatatacaatttattattatctgtgcgtcattttgattatgccggtcgggattggactaggtattaactcggccggcgagatcttgcttcaaattaaagcagatactgatttgctcaccaagttttatataatagaagcatgagttataaccaactctaatttgaatattatttaaattcaatctggttggaggctgaggtccacaaattaagggtttaccacaggtaatttgaatattatttaaattcaatctggttggaggctgaggtccacaaataaggggttaccacaggttagataagtttgatcac

SEQ ID NO: 105238 - DNA, 539 bp, Oryza sativa
atttgacgcccaaaattcatcatctggtgtttctgttagagtttatggtagtgagagggatattagtataggattgacttgtgtcaaaataccattttttttatctcagatccccttccttatctcttgtactctatatataccggtcctctgaagctcaatacaatccaccaagttacgcggtatattcgtctccccatactatttcaacagtttcatgtgtcttcataaaaaaacgaattatgctccctcccgaaaagaaaaagaaaaagaattatgcattcatgttgccattttaggtgcacaaataattccctggagtgcttccggagcatatcaacatcctttctgcagtttctgagttatttctgaacaacgactaaattttgccaaattaaaaacgttccgttccgttcctgtccagaaacagcacctaatcgtttcatgaccgtcggccaattaaaatccaatccccaattggcctctaatcccaagtttgcacaatcaggccgtgcaattctacccgaagctattacaaa

SEQ ID NO: 105239 - DNA, 732 bp, Oryza sativa
aaaggaactgctatcactacttcagatcagcagaagtgtgatttgttggaaggacattgctactatgtggccttccactgaattgctccgctaaattgctacaagctctgtcctaaaaagaaaaggcaatctagaaagagatgtgatataacctagtataacgaatctagacaactttatctgaattcgttgtactaagttatgttacatcctctcttacgttttctttttgggaacggggtatatatgtttcataactcatgctcccctatcataagtcttctcctaaaaatttatatgattgaaatggattacaccgtttactataccatttggagcgagtataatagcaagtttaacagtatagtcaactactaactctaaattatctatagcttattcatataatagttatctataaatatatactattaatacatgatcccacctctcatacatatagtgtcttatagtccgtgctacagctggctataaatatgtagctcacttttttttatcttatttcttatatcctccatgtgtgcttattactggcttatgtacttactctaataagtgatgtaagcagactctaaaaattaccacatcggttttgtacttaaataaaaaaagatagagaagaaaaacggattgctaatttggaccagcaatagcatgagctatatgacgttgtgtgggaggtcatttattatggtgtgtattatatgtaat

SEQ ID NO: 105240 - DNA, 668 bp, Oryza sativa
ggaacctaacggcgatggtatttttgggaaaaaaaatctattgtacgatggcatttcttgtaattcacacttgttgatggcatttattagatttggacgcttgtcaatgacatttttttattatctcttaaaccaattatcttagacaattgacattcaatacagtgcacgatgtttctcaagggaaaacaaaggtattttgcactaacttgagtcatgtgtcactgacccaaaaaatttagaaatatagcaaattggctttaaaatatcaacatttttggggtgctatctttattgagaagtaattctgaaaatatttttagatttgttgtgtgcaccaatttgatctcgtaaaatcattttttgcaaatgcttctttttgaaaaaagatttgtttgaatttgcaaccaaaaaaagtagagccatatgcaccaaattgttaaaattttagtttgaatatgatttatagaataacaaatttaggatgtattagaagtgcatttagtcaatgcaaaaacaccttggcttcgcctcaatctttagggtcagaaattaaactatcgaaaaagttgagagacatgaagtagacaatcctttataaagaccaaaccagttttaaaattaaattcagggaaaaagactaaatggtaatggaatttggagtgtaa

SEQ ID NO: 105241 - DNA, 678 bp, Oryza sativa
ttgatacactgggagtgatggtgcctgctggtgcggtacatggggataacaagtatacataaacgttattgggatgctttacagctttagcaatgtggttgaataaactttagttgtactttcgggttttgcaagatgcaatcgtgtccagtaggttccagatcattaaattatgggacatgtatcacatttgacagagaacctcttatttttgttacattttagacgggcttagatcgctttgagatttattatgcggttgcagtgccttcaccttatcctccactgacgctcctgagatatttatttttttttcactcttacgagtaaaagatttaccactagacccatatgttataaacatacaaggactcacatgtcatacattgtgagtagcaaaaagttcaaatgccccctccctctctcctctctctcctcattcatcagatcaacgtgctcgacaactcgagaagccaatcctcctgtcgcagccgataaggtccttctgaccagcctcctttgtttacctcggctcttattcggatgacctaataaaccaaagaaaaagccaaaatttaaatttttaaacttaattttgagatactttacaacgtagtttatttttcaccattagcttttaagtcataaaaacacatatataaaagttttatctacata

SEQ ID NO: 105242 - DNA, 889 bp, Oryza sativa
tttatcaaagtctaatacaactatttttcactttatatactcccaatacaattattttctactttcataaactacgatgtaatgattactttaaaaataaacttattttagaacagatagaagaaactaaagatgaacttcttacggaaaggaggaagtagctctttgataatcatgtgggattggacaggggtcagaaggtgaaggagaattattgagcttttatagagcctagttataagccgtttattgcgatggttttttatacaggttagttgaaagatttcgacacagtgggcagtttggttttatataccatagtcagatttgtttaaatatcggtttttcaaggtggacggggaagaggtttctagccgaaagtaaaaagagacggaaaagtaataagactcggttcttttcttcacttttcctactctcttattttcgcttgcacgccttttaagatgttaaacggtgtgtttttataaaaaaattatatacgaatgttgcttttaaaaaaatcatattaatccatttttttaaaaatagctaatacttaactattcatgtgtgtgttacctcctccgtttcacaatgtaagtcattctagcatttcctacattcatattgatattaatgaatctagatataacatttctcacattcatattaacatcaagtctagatttattaatattaatataaatatgagaaatgctagaatgatttacgttatgaaactgagggagtacatcattttacgtgcctaagacagtctaactaactgttgtggttgaaattgttgatatagaccgatgccttgaatggaaaggtagaatggcagttgggaattttctgtttcccccattttccttcctactccacttgt

SEQ ID NO: 105243 - DNA, 818 bp, Oryza sativa
tatccatgtgcacacaagacattagttataaagttacgtactgccttactggcccttctttaattaggttactagttggcaacttggtattctatctcttggttaattaatttaaatactacatgtgtgttcagtccctgtttaatctaggaaaaaacttaaagctttgtaggtaaacacaattcatgactgtaaatttaggttgggttcttttagtggggttggaacccttctccttggcacgcaaaatgaagcggcgagttaagacataattaagtattagttaaaaattgaaaatagattaatatggtttttttaagaaacttttccatagaaaattttggtaaaaaaacacatcatttagcggttcataaaacgtatgcgtggaaaacttaggccgagtttagttccaaactttttttttcaaacttccaacttttccatcacatcaaaacttttctacacacacaaactttcaacttttctatcacatcgttccaattttaaccaaacttccaattttagtgtgaactaaacacacccttaagagtagaagttgggaaaaaggagaaaagcagtgatgtttttttttcttgcaccatgtggccatgtagcaccattttcaatcattctcattcagattgatgaatcatcaaatcattccacaaagatattaaatgctcattccgatgggtgatcattaaatcattgagctgatcagcagtgctgaatctcccacaggatgtacatgtgccttctaaccatgtgacatgttatgttaggtctcctgtcatgggctttgggctgggcgttctatg

SEQ ID NO: 105244 - DNA, 579 bp, Oryza sativa
tcggctcaattggagaaagaaattcttcaaaaatgataagaatgcccttatggtcaaaagcttttgagcttatgtgatagaatgaagatggaatatgatttatgctagtgatgtacttggagtgatggtaaatagtgatggtaaatttagagttgcataattttcaaatttttattttgacgccatgattgaagtatgcggttctagggccattctcgtctttcttaagatttatctctctaattgaaccgaaagtttcctctagcaatttaggattttttttagatttctttcggcgtgacatatttttccaatgtctatcagtaaattacacaaattttagatgtcctttagcaaaatttgccaaaagattttaatgttgtagtttggaccacaataaatcactttggaccacattttcttttaccaatgttacagtttggactaggagtaaaacttcattttcatttttgaaccggataagattgctaaagatttcagtttagaccttttccatcctctccttgtcctctctctctctctcccggactttgctatgccgcggtaagcaacagctga

SEQ ID NO: 105245 - DNA, 3346 bp, Oryza sativa
tttttttttaatgcttcacatccatgactaatttccatgtgaaaaattctactaccctttccaacatgcattttgaacgggattttcatatcattggtatgaattcccttgccagttttactgtcacagttgatgagtatattctgcccttagaaattgtttttatcattcaaatagtggtcaatccccattctgtaatgagcaaaagcatgagtccaacagttttaaatgtgtatccaagacactcttttgtcaacaacatatcaaacacttccttagcttgtgcatgagtacagcatatgggaagggttagcaaacgcatgactctccagcaaaaatggaagttaacacatgactgctgcattgatatgaaattcaacccgttgcaaaggaagaagaatgtttacagaagacatgaatgtgatagaaatcagaaccatggggtttgatttgcttctaaaaacaaaacgagtgtttgagaggatggaagctttgttggctggttgtacatgcccttaaattgaagcacctatacaaattgtgtagcttaattgccctataatgtataatgcaaggattttgaaccacctatacaaattgtgcagcttaattgcctgttaattgatatgagtaatcattgggtttaaattatgtagttattggtttaaattcaaatttggtgcctttaataataatagtagtagtagtagtaacttgcgatattcttttttggatgagaatgatcctatggttctcaatgatgtacttctttttttttctactatccatgtcaaagccataaacttctcaaagtttattgatggttttgaatcaacatatcacatgtggtgtttttatgttgacatgaactttaattaggtaagtttcattgttgtggaggcttctacattagcaaaattcatgataaaggtatgtacagactcagaaaaccagcttcatctgaaacaactagtaaaaatatgtcttatagtgttatttgtctctgttcttgagagttgagggggttgacaaacaaccaatttcgtagtttatggtgaaaatttgccagcctggattaagacattggaaatcatttgtgttcccggcatcataccatgcattagtggttttgtgcatacataatagctaataatgaagatgtcttgtttaacgatcttataatacttaatactacaaggattacgtgaattagacccgaatagaccaagtatgatcaattacattacaaaacatagtaagatatggtagcggcatcaaagctccaaaagagtaagtcattatgtgatagaatatttgatttatttggcactactgagtacaatgacgtgatcatatcggaaaaaatatttgacactttccccaaactaaaggacatgtagattgccaatgcctaatgcagctgccaaatgcaattcgaatgtggacaactggatgtcatcatcgaggtgtaagcattccacccgttacgcggctgctgctagcgctatctcatctataagaacgatgatgccattaggccaagcaggtccaaagccgaagaggtccgaaccaccgctgtcatcagcccacatgtgaaccgtactgagctcattgtcagtcagaacgacgacacgatcaggcccaacaaggacaaggaaaagcaccatgtcaccgatccctaaagtacgcagaacaagctctataatgacaacatgtccgtgttgaaaacactacgattgaatttggtagactccaatacctcaggtaattaacttggcagaaaacatatgacccataactgacaaatgtatacattgatagcatagtttcttttttgatgcttcacatccctggctaattgtggtatatataagatactattaccatttctaacatgcactatgaattttttgaagaaaaaaatgcattatgaatgaaaatttcatatcattggtatgagttgccttttgctaactttacagtcacaattgataagtatcttctgcacttatataaataatttttgatgattcaaacactggtcaattgaccttctgtaaatgagccattgcatgagttcaacggttttaaaatatgtatccaagaccctctctggtcaaaaacagatcaaatgcttcattgtgcatgagtacaacatgcggaaagggttagaaaacgcacgactctccaccagatcaaaagaaagaagttgacacatgactattgcattgatttggaattgcatatgtagcagaggatgaaatgtcatttataaaaaacatgaatgtgatagaaacccgaaccgtccaactcggtgccgtatcgttcctatcccaatagtttggtcatcctagactgcgtcaaatcgacgatgatacattgaatcccaataggagaattatgtgaaagtcttttccccttgagggaatgtcccattgtttttgtcaataatgcacactatgcacaatcatatttcttatttttattttgacttgtgtatattatatttatacttaggccccgtttggtagagctccaaactccaactctgaactctaaactccaactccagtgagagctagccccaataggagccgaggtgagtttgaaagtgtttggctgacttgttagctccacaccaccgtgttccttgtcgcgccaacgttgctggtcaccccatgcgccgcctacctgcgccgccaccacctagcccgcgccactttcgcccgccgcctgtatccaccgctgtcaatgccgcccagcccgcgcgggatgccgcccagtccgcgcgtcgcagccaacccgcgcacctccagtcaccgctgccagcccccgcgcggccgcccaggctgcgcatcgccggttgtcgcagccagcccgtgcgtcaccaccaggccgcgtgtcacggccgccaggctacgcatcgccggtcaccgcagccaacctacgggccgccgctgcagtcgggctgccggtcgccgccctaggtcgattgggaggactgagagagagaataggagaggaggtgtgaaggggttgttcagtggcattttttgtgtaaatatattaaaaatgaaatggtagtgggtcttttggagtggagtggagctgcagaaaatagctctaccccatagtataaatttatggagcagctctatcaattctgctaaaaaaaatagagaatctgtaccatttagcacaactccagctctaggtaagttagagttgggagctagagccgtgtcaaaccgcgccttacatgcatgtttgtgaagtgatatttcgcattttgatccatcttactttgataaattttgctgtgacacgcaaaacaacgagagtatat

SEQ ID NO: 105246 - DNA, 632 bp, Oryza sativa
aaaccccaagtttacccatcgttgggatatttaaatttgaggggaggtgttccgatgcgcgtgcccaaaggcccgtgcatcgaagcaaaacagtcgacaaaggaggtttaagtgttcaataattcaaggagggtaattgcagcaattaggattggggccggaaggctatctcgcaagccgtggccgaattactcgtgttaatcctattcatgcaatatttgcggaaaagaaatacttagttttaaattatagctgcaagatgatcaaaggtgatttgccttgctcaatgtcttcattgagcttcacgaatcttcgagaaaacccgcgattaacgaaaatccagtaacctcaactatacgcaaacaatcaaaacctaaacaaaagaccaaaagaaagatcctatttaggctaatttagtagtgccattagatagatctcaattttacggaattactggaagttgaacgggggcgatcggacgaacggatcgagagatatgaattttggtggtttaattggaatttctgggtgaaggaagatatttgtggaacaaaggaaaattgatttatgaaatttatagaaataatattctcaagaatattattgacagtcacagacgtgcgagaccaagg

SEQ ID NO: 105247 - DNA, 683 bp, Oryza sativa
ccaagttaatgatttcaagaattagctccaaaatattatcccacaaccatgaggataaacagtggcgggcgcagatttagaatacagatggggcggcagagctaaccctaattaagtgatggcacaatgcacacaaaccatagtcgctggttcacggtattggcgcaacagtgcacaacacgaacatcgagaaagttaacaacaaagattggtagtcaaacaaacatatatgatttatatgtagagagataaaaaaaataagaaatgttgttagacaataagggcaaccactttcaatagttcggggagggtataaaacgagatgaaaaattatttaggggtttaagtgcttcgtcaaaatagttcaagtgagtaaaataatttttttatatatatttaccaatttaactatttactatagactgtattatgtgctaaagaaatagaaagaaaatcaaattttatgtatggccaaaatcagaaacggtcaaaatgattttagttatacatgaattttcataaatgtttttcttcctacttaaaacacttgatttatctgattattcaatagtagactgatgactaatgtcttagaaataggcctaaaatgaggtttggggacgtggggcgatacggactgtagctgagccggccgacccaccctgcctaatgggtgtgtccac

SEQ ID NO: 105248 - DNA, 671 bp, Oryza sativa
aggaatggattatgaatggtcgaagcgcatgtaggtgatagggaaggggaaggtagagacgagcacttaccaagcagctagctagcagcaagaataccctggagatcatatgcgacacgcgcgcggcagatcggatcggataatgtggtctccgttgccgcgcgcgtcgctcttgccggccggccggcagcttcgtattatggaagcccggatgcaagacgaagaagaaaggcgtcttcgtcggtcaagtcaaagcagaaaggcgtcttcgtacgctgtctggccatatgcactgaatgcatgacttttgtggcaggcatggctattttcatttttttttttgctatatccctgtctattacttcctccgactatttttgatattttatttgcactatttgaccacttatcttatttaaaatattgtgcaaatataaaaaacgaaaagttgtgcttaaattactttgaataataaattaagtaaaaaataaataataaattcaaaaaagttttgaataagatgggtagttaaactgtgcaagcaaaatgtcaaaatctcttatattagaggacggagggagtatataaggtggagatcgactccattgattgattttgttgtactagcaattttttttatatcggcaatttaaacggatgtatatgaacgg

SEQ ID NO: 105249 - DNA, 897 bp, Oryza sativa
tttatgttgaccgttcgccttattcaaaaaattttgtgaaatgtgtacatgaaagtatatttaacaataaactaaaaagtcaacggtgtcaaatattttgaaacggaggaagtactagctactcccaccgtccagaatataagtatttttagaattggacacagttattaagaaagtaggtagaagtgaatggtggagggttgtgattggttaagtagtagaggtaggtaggaaaaatgaatggtggagagttgtgattagttgggaagagaatgttggtgtagaagttgttatattttagaacaaatcttaagagctaaaaattgaaaaattattatattttgggacggagaaagtaccaatctaagttggattggtgtttctatccagagatcagtctgcagtgtttgtggtgttgatgcctccttttcacaccgctaacacaattcaagggccatctaaatattttatggtgatatggagtcaccaatcatcttaaactttgaggaatctccttggtcaagatgggtttaattagaagatcaaaattggttaatagagccaatctatctatctatcttctattatatactaaaagtccattaaacatcctataaacgctctcaagccgtcacataggattcctaaaaacgctcatatgccgccacgtggcgttctaatatattagaaacatctagcccttaattttcatttaaaccggtgggtccattattttagaccattagattagatcacactataataaatagatggacccactatttttaactattagatttatctttaaaaaaattaaaaaacatgtaatccatctcgctctttgtcacgccctgaagttcttctccctagcaaaaatccaattgataaattgttgga

SEQ ID NO: 105250 - DNA, 827 bp, Oryza sativa
tccatataactattatataagttattagtattttatttaattaaataaatacaaaggattataagttagatatatatttgaaaaataattcaaaagatgaacatttaaagatagttgatttggtgctaatttaaccgtgcatatttgtaaagtaataatatgggaaatcctattttaaagacaatattgttcttacagcgtagatatgttttttttggcttttttatcttgctacgtaactatgtctgtttggttttttttaggagaacaatacgcaagttttatatccgtatgtacgttattttttctgttaaataatttcaatgaagctgagactttttttaaaatagatctaatctaatggtttaaaatagcgggtccaccaatttaaatgaaaatcgacggttagattagaaagtgccacgtggcggtttaggagttttcgtagtagtgccacgtgacgtcttagggatgtttataggaattttaatggacttttagtatataagaagtagataataaatagatagatagtattacatgtcaacgtcatccattgcaatctattttgcattaaaacataattaaccaacataagtcatcaatgtaaaatcataagaaaataagttataattacgtatgttttttagtccgacaaataatcaaatatatactcaaaagtcaataccataaaaaatgaaggtaatataaataaatatattataggggtatctccagtgaaaaaaattaaagggggtaaatggaaaaaaattggtgaggtgtacgtgtggggagggagacgtacttacgtacgcgagagagagagg

SEQ ID NO: 105251 - DNA, 1373 bp, Oryza sativa
tgcaaccaacattactttcgaagaacacaatgtggtacatttgcaaatcaactaaggaaacaacgtaaaatactaaccgaaacaattaaatgaagcacttgcgatatttaaacaaatccattaaaaacctaacttttttttgtcggaatatataatcatgtgcggttttgttgtaaagatttaactgtaagaaattattggtacaatcgaattgtagatcagataaataatttagaagaaaaaataatttagaaaaaataataaggttattgcatgcatggggttaaaagagagaacaattagataagaaaaaaaatatgtacttataattctaatagcacgtgcaagtaagaagttacgtaacatacaagcatgaaacaaagcagtaagaaggagaccacccgattttatgattgggatcaggttcctgacccaaagcattatctggtgagttttgctttgttatattgtattttttcttgcggatggtcgttcgggtgagattgagaacactagttgttatggactccactcctactacaatattgttgagagaataatggcctatttgacatagtacaggtctcagatatatggtggattcgaagtttgtatattaaattatagtggattaaaattttaaattttatatagaaaatataaaataaatgatttatcgaaatgttatctatgtaatcatagatctatatatatatatatggatttatagacgtaggagttttaagaaatcttggactgaggcttaagaccgcttagcatttccatgttttaagtatggtttggtttgtggacataggaatttaaaggctagacagtcttaagttttcagtattcttcaactgaggcgctagggaagacaaaagagaaacaaagatcggatatggcgtgcgatgtgatgcgcgccagaaagcacgagaaaatggtaatttggccacgataaaaaaaacggttttactgaaatgctattccgaaaatgcatttcattaaaatgctaatatgaagcgtgcaccaactgctattttgccattttgaccgttttgtgtatttttgaaatcattttcgctggaatgccaggtgatgagacggaattgcgcatgctcgccatgcgtacagccttgatgctcatgctccccaacgcctccacctccatgccggtcaccaccgcgaaccgctccctcacctccgtctcctcctcatcttcctccgcggcggccttgaatcgccagtgctaggtcgtcgtcttcgaggcatgctgctaccgagcgggatgaggtaggacgccaccggggctggacaaaccttgtgcggtggcagcaatgggggcgtggcagtgaggtcggaggcgcggaggt

SEQ ID NO: 105252 - DNA, 823 bp, Oryza sativa
taattaatatcctcggtactaaaatagacagtatcgtgaagtgagcgtagctcaattggttagctttcttataatgaaccaatccatctggactcaaaattctaaatttgatatgggtgctcgtatttatgcttgtgtttgtactatatttctaaagaaaaattaagatagtgtcgtacaccacacattatttcctgcttcctcacatgcaagttattttcatgctaattactaacatggagaggcgtccattctttctttccaagaatatcccgatcatttccatctttccatgagatttgtacatattattccaatcctgtctctaccgccatctttatttctgctctggaaatccacatttttccttgtacttttcaaagggaacaattattaatctagcacctgcttgacacgtcaaggaaagagagatcgattattgtgcatatcgccataggataaaaagtgtctttaattttacacgcacaacaacaacaggtatttctttcagtaagattaatacagtgttatggatagcaacgagaaataatgtatggcaggcagatgtgttaggggcttttaactatttgccactctacttacggatgttgcttaacgatttgccactagacccacatgtcatagacacatgagggccgatgtgttaaggtagatctttttgtccacggcaagactgactgatctgaagaacgtctctctttcgaaaagaatggccatactttcttcaaccttgatatatagaaggggcaatttcattctcgcccctactttgatgtctaatattgattctgcccctgttttt

SEQ ID NO: 105253 - DNA, 670 bp, Oryza sativa
gaactaaacacaccctaaacaaaattacctactcagtattaccaatacaattttgctatgcgctgtcgacaaataattgaggaagaaatctgcaaaattatctaagaattaccaatatgattttgctacacgtctattgacaaatatttttctccctttttattctcgattatgctttaagattcatgtagataaaacaggttcaaaaaaggacttaaaaaaagtaaattacatactgggacacttttttttacgaccctttcaatttgggtcacggatatatctacatttctacattttaccatataaatatagaaaagtttcaccttggctttgttcttgtacctgcagttccctctctcctctctctctctctcttctctctctatctctcttccgtcaatggtaggaagaccgaagacccacaccactagtgagtaggtcaagcagccactgctaccgctgcgccgtgctagcgccgaagctccgccaacaccaatgttagggccgtgtgcttggaatggacctctatcaatttctccaccttggtttgcactaaaccatcccctgcacttgtttgcagggttcgacatttcggactgaattttgaaaattttggttattttggaccctaccgatacaatattattttggccgaaatttttaattt

SEQ ID NO: 105254 - DNA, 629 bp, Oryza sativa
actaccgaaaaatggagctcaaggtgaacaacataccatcattgtggaactaaaaaaattagcacatgctagaatgatgaaacatgtatgaacacaatcatcttctcctaaaattttattcatctcctaaaatagatgaaacattttttttcgtcgaagtttacttttcagtttttgcttttagatcgctaagaaaacgtatataaaagttttatttataaattacttttcgtttgtaaatatgccttttggggccgcaaatttgccaatcgagataagaggggagattcgtgtagaaaagaatctctttgagttttgacagtataaaacaagataattcggtggaaaataatatgaaatcacgaaataaataaacctttattaaatctgggaaattatctccaaagggaattcgttgttaccctaaactgcaaattgtagcttgcgatgataatgcgaatgtgtgctttagggaccaaaaaagaaaatccattttcttgcttgcttagtaaaagaaattgaatcatcgtattacggtttaattgctgttcttagaaccttactttatgctagggtaaaccacatcattggtctgttttcttctctttcttctcaatagatatttcagt

SEQ ID NO: 105255 - DNA, 536 bp, Oryza sativa
tacaactaccccagttgagagtctttttcatcaatgaattatttgaagaatatgctaagaaataggatgaaagagcagtacctgaatgattacttggatggttacatttcttgaacgtgaccttttttggggaatggataatatgacattatctgtcgcttccaaagcatggccaaacggattattttctttacttattttgtaatgtgccaagattcttgagaattctgcactatgaactgtttatgaactatttctagtggttttatagtacagttacaatttaacacgcattgtttttaatttacgttatatgcgaaatgattatctatttgtaaatgtgaataccgggccatgaattcctgaaaatagtacgtgtgtgcacttgtgtcggcatgagcctctccctccaggtctggaagaaaagaaactaaaaataatagtgacttttgtctttgcaggcggctgccggccatggacctattactttacctgatgctctgcacctactaaaacctgctcgtacactgcacata

SEQ ID NO: 105256 - DNA, 780 bp, Oryza sativa
cagttgttggcaatctcaaagcactgcggtatctccggctccggtgcaggtcatatgtccaaagcaagctcacccttggggaaaaacagttccagcatctcaaggttcttctcatccacggcgaagacattaccgatatcagcttcagcaagaatcctaagttggaaaaaattgtttggagtttcagggagatgaaatccatttctggaattgagcgtcttccgagcttgcgatcatttgagcttcatggtgactgcaacccagataaggtggaaattgctctaaaagatcaccccaaccatccagatttggagcatcatggtaaccgtcaaggccagggagacgctgctggaagcttggatgctgatgctgcctcaacctgtgcctcagtctcagctcccaaccatccagatgtgaagcatcctgataaccgtcaaggccatggagatgattctgctgcctcgacctctgcctctgcctcagcatcagctcccaaacacatccagagtattacttgattgattcattaatttatcctcaaatcaagatgcatctgtggataaaatccttgtcatcttcgtcctatctcaagtgccagctcaccgagttgatgaattccttctagtgtcaatccgttggcctttcctgcatgtatgtcaaatttctttagacatataatagttgtactcttctggactcctaattttcaaccttatgtaaattgtaatgcgtgcttgtttgtatggtgtttgagagctgccctagctgctagtcatgatt

SEQ ID NO: 105257 - DNA, 1409 bp, Oryza sativa
cagaacaaaatgagattcaggagttactctctggcgctgtcattccatcctcatctgatgggaccataaaataagtaagatgttttgatggtcagtacacagttcttgatatttccaaacttaaatgcagcatggacatgtacatgaaacctccctatagatgcacttgcacaacaatatgaggtatataaatcagagaatacatggtatatcatttttttgcgcttaaccgcactaatttgtgtactgaaactagttgattgtcgtcatttgatctaattccatcttctgatagatcagttttggacacttcagttctgctttgggcattgtctagtcctatcctatcaatagatgaactctggctgtggttgtgcgtccatttcgttctttcgctgttgcattcaatagactattttgtcacattagaaaaaacagtgggctagttcacaaacaattgggttgagcatcgctttcatgatatggacatgataagcagtgtatagggacttgcatgagggatcagcaactagcgaaaaacgctactagtagcactgcatgttgagcaagttgttgcctccttgatgctatccttaatatctcgacaaccaatgctttcttaacacgattgctgaaagataggttcattagctgataaaggttatgatgatctataaagaaacaagtttagattgaccatctaaaacataactgaagatgtcagggaaaattagacatgtgcaatgccatctagcattataagaatactttctttcagcatataaaattcacagtcattcccaagcaatataatactagtgatgaaacaatgttttcctcactttttttttctcatcatcattgacttgtttgttgtgcagtgaccaacatgcaaacaactaggggagataaacaaaggaaggcagaacaactggtcctagaagaatgatttgattccaagatgcagtttgtgtcctgtgagtcgtgtaaggctgaagctttgggacaccactcggcagtcgacacgtgtacaccgcctcctgatgctattcttatctgaagagtatagtgatcaacatcacctttctgtttctggaagggtttttgtctatgggagatgaactggaggatccctttgcatagataatcaagacaacaggaagatgcttcatatgatgctacatgtatggaaatggcaggcaccggcaatatgtgaagaatatagtggctgtgtggactcagcttgagccggcatcgcaaaagctgcacaagaacacaacagtgacagtttcactcttcttttagctgatgttactgttatatgatgcctgagggacatgcatctggtgagttcttacaagaacaaatcaaggaaccaaatgacagttttggttgctatgttgattttt

SEQ ID NO: 105258 - DNA, 1295 bp, Oryza sativa
acaaaacagctaccacatctgtatctcctcttgcctttggtactcattgcctcatcaatgtaactttcacctttctcatgatcttgactgtactacttgcaactagtcgaattccctgcacaattgtgcagtagacagtatagcaaatatgaaattgcatttcttgtacatctataatcacattattcgatcaatctccatcattataatttggacttaatttgcacatttcgcaacatatacataatttgcaagagaggtttttgcaatgtctggtagtgaaaatgccaaaatgggggactatgttcttcctgtgttaatgatagttagctggtacaccgttgctttgtcgttagttaatcatgacagggatgtgcttcattaatcactacttataaagtaattagtgagtccatttcagtcgctatcaatcaagatctgagcttttggtccgcatttatacgttgagatttggttctcgccctaaagttggatgtagagtatcttgttgggagaaaatggcacatcgagattgacataaacatatcatccttttttgtcaaaagatgatgtttatacgacaagccttcagtatggaagcattgcaatgttcaacagtagtacaaactaacaaacacaaaaacagccaacgcactacgtggatctcttcctatcactattcttccctcaatttgttaatctctctgcacccaaaatcgtgtattatcactctgatcagccaacaattcaggcagattaattttctctttaaaaaaaattaggcagattaacagactgttccatgaacagcagtttgcagggatagttttaatgctcttttaaattatttttttctactgcaaacacaaatggggtggtggcgcagttggctagcgcgtaggtctcatagctaatgttgtgagtgatcctgaggtcgagagttcgagcctctctcaccccaaatttttttccttttttcactgcaaacatgaaaccttagctaaacccacatgagttcatggaaaattaaatatgaattattatttttttgtaatgctgcttttatatttgttcagagcaaacatgaaacctgaacccacatgtgttcaatgaaaattaaatactccctttgcttttaataaatgatattgttgactattagaaatatgatgaatggaatgacaaaaaccgagtgattgcgtgtatcagctgttcttcctgttcatatgatcatatcgccggcgccaggggcaatggttcaactgctgcattcctgttcaatatcatcagggagg

SEQ ID NO: 105259 - DNA, 564 bp, Oryza sativa
ttccgcattgctttgttaatgccatgtcgatgatcaactcgaacagttcgtggaggaggacttggttttgttatctaacagactttctcgagctgtgactaatgttaggtaaaggaaaagaggtggaccaaatcattgctttgaatgtggctctacggatcactttcgttcacgatgtcctaagcttgggagagcgaggggggaagataatggtgatgagaagaccaatgacaacaagccgaagggtacattcaaagggaggaagatcaaggagaatctcaagaaggcttttgatcaagtctacaccgcgtttgagccactaagcgatgtagatggtgagagtggagatgaagataagggaaataacatctccggtgtttgcttcatggcgcgtggtgaattagattcagagtgtgaagacaatgaggtaagtgctcttgaggaagccattaatattttgagtgcaaaaaatatgaagtgtgagaagttgtatagaaaacaggagtttatcattgaatctcttaattctgaaattgctagattaaaatatcttattcctaatga

SEQ ID NO: 105260 - DNA, 516 bp, Oryza sativa
ccgccggacgaggacggcgacgaggaggggtacgtcgaggcggaccccgcaggccgcttcatccgggtacgggttgctgtcctgctcgtttctgttcgagttctatctagccttctagggttttgttgctgctgcggaagatgggtggattcgggtggtggctaattgttgttgttgttgttgccctctgcgtgtgcagtatgatgagatcgtggggtcaggggccgtcaaaacggtgtatcctttcatcaatctcatgtgctgtttctagtttagccctttttgttcttgattgaattatcacgattgaattagttgtggaatataattcgatttgttgatcacagtagaaccatgcccgatgattatttatttatcagtattagatgtgttctgaacttatgatggacacccgcgattccatgtagaatctacagacacattcagagatggaaccgaacttttcatgcttctgtaatctgtggctaaaattattgatcggtgttgaccttatta

SEQ ID NO: 105261 - DNA, 1011 bp, Oryza sativa
tgtggttgaagtttctcaagtatttgatcttcgttgaaagcatttgtgcttgttctcccttgtttccagtttaattctagcttccttaatcgggttttacttaatagttttgcttcagccgcttcttcttttgtgtgtacttttcaaggttatcaattctaagctctcttagctccatcagataacctagttgctttagctcaaaaccaacatcttttctattgacttgaaatccttttaactcttgcaaaaattgcagttttccaacattagaaatatttgagtgtattgggtatcccgggacaagaaagttgtgcaattttgcaaggttactaatgtctccaggcaaatgaaaacaattatcccatttttccagatccaaaatccttaaatgataaaatctggaaaggttaattggtaaatgaaagttattgccaatggtggtccctagcctaaggtaccgtaggtggacaagtgttgtaaattcatccaaaatggaccccaccgcaaatggcattttgggaaaataaagcacacgaagagcacttgcttccttaaacaaatcatgaaagcatccaataaagcttttatccacttctccaaatatcatcaaagtttgcacgttttcaacctttagtcttttctttagttttatcagttcactcttgaagttttcatcagttattccatcagtatcatttgcgccatctgtgatgatagataagtgacgaatggatggccggatttccactgatttcacattagaggaatgtaaactaacacactcaagagatgcaactttcaatgctagattatgtagcagatcatgaataatatagcatggatgcccatcagtttcttctcttttaaaaaatccatgactgaccaaactatctatattgcttagagctatatcttcaaatgctttattttgagattcggaatgtaaaatatctagtcctatccaaaagcgaatgagctctttgttgttgaacttgtaatcttcgggaa

SEQ ID NO: 105262 - DNA, 644 bp, Oryza sativa
cccaccagaaattttgtgcgaagaggaggcaaaggaagccaaaccatgtgcgcaatattgtaacaagttttagcttccaaattgctcttcaggtttgcttgtaacaagactcttatccttggctttcaaaatggaatgttcacctgtgctgatcttgtaccaagagatttggcctaataatactactatatatgaaagaagagcgcaacgttttagaataaaacattttaattggtgtgtgcactttctaaaagctatattcaattcctcaaatggcaaccatattcaattcctcaaaggtacacgtttgctaaagctatatgatccaatcttgtgctgataccaaacgcttggacagttgcttggaaagttgacggtgttcttggtgttagcagttccttatgtagacatgggaggcctcgaggaagacgagattgcagcgtttttcagttttgctctccctctattatttatcaacgtttttcagattagttcgtaataagttcaaaatactgagctttgatccagtaaaccaggccagttttctagttatataggcacaattcttctagagaaggataaatattatccatggagtcacagagagaggctcaatgcacatggtgattagcttgatcaggaat

SEQ ID NO: 105263 - DNA, 546 bp, Oryza sativa
tcctgcagcccgtctctgtttgcgcgtggaggaagaaccacgatgcgtgaagatctgattggggtctctatttgcaggtgggggaagaaccagcgatgcgtgaagatctgattgggggtctctgtttgcgcgtggaggaagaaccagcgatgggagaaagcgtgaagatctgatcgggggtgtctgttcctaatatcgcacgagaggaatcctcccgttgcagcattaacgacgcgatcaatgtgtattgaatcacctgcctgttacagaggcattctcgcgaattctgaaccgttgcgaaagaatctcgagagatgtcggacgcgacgcacaccacggccacggctcagctcaaggcgtgcgcgtgtgcgcgtgtggctttccgatccccacctgatccggtcaacagggagccttcaataactccctatttaaattgagattcttaacttttaattcccatggtggtattattatcttcaacatttattatgggcccttgagattttaatagaaaaatcgggcctagcccatttattataacag

SEQ ID NO: 105264 - DNA, 754 bp, Oryza sativa
accccagtatcgcgtgcctgggcttaaggcaataccctaaatttaccttcgaagtatactttattatccgcactgctcacgtggtggctatcacgccgtaattcaaaaaactacggataattcacttatacctaattaccctactttgtgtctttttctccaactatgtgtttacgtatattcgttaggatttaaatttgaggcctctaactctagtatcatatattcatacgcaatcagctagtccaacccaaaaaaacaacttaatttgacaaggagatatggacaaattccaagaggtcgatcgatcgcctgagtaaacacatgggttaaaacccaaatttgccggacaattaactagaatcaaaatcacttgaaaaccatacaaatttaagacattgactttataatcacatgtatatgctattccctccatcctaaaatataacggattttgaataaataagacacatcttatctatctagatttgtaattctaagatgtgtcttatccatcaaattccttatgttttaagacgaatgtagtattatctagctaaatatggaagcccgagtcgagtcgataagcacacaaatggatagaattcgccgaacaattaaacaaagatcacttgaaaaagcacacaaatctactaccaaaacacaacatataacagaacagaacaaaccaaaatgaattaccactagtaataataataactgataagtctattcttcataaaaaacaaattca

SEQ ID NO: 105265 - DNA, 1261 bp, Oryza sativa
taaagtaccatcattcagagatcgtgtcaggatcttaaaatatacttatattttaaaatggaatgagtacatataaacacataagccaaacaataggctacaacagagcaggcatgctcgaagtgccagctgtggtgaatgatgccattgccgtggaggaacaaagctccagctccggggaccgaccggagaggggtatcgacggcacggtcagaggatccttatccagtacttacatggtgctcgtttgtacccaagataatgttagagcacggaaaagaacaaaaccattaacacatgattaattaaattttaattattataaatttaaagaagtaagtttacctacttacttcgttccaatataaactgtaacttagtatatatcatatttacattagattgcacttatattagaactagaaaagtaatatttttaagcaatttatatatataaagtttttacgaaacacaccgttaagcagtttaaaaaaataccaataaaaattgaaataaaatatatatcttaatttttttagggtgcatatgcgtgcgagttgcgacggtgtacatgtgagcttggggtgtgtttagtttaaaaataagttaaagtttgaagaaagttaggagtttgaaaaaaaaaagttaaaaatttatgtgtgtagaaaagtttttattgtaatataatgtgatgaaaagttgagaacaccgggaaactgaacacggccttggtcactcgctccctccacagaaaaagtactacgcctacggcatggcctgatcatggtcaggtcagcggccaccgccggctttacgcagagcacacaggcagagctttgacctccccacgattccccaaaaccgaatattttttttcttcttcttacggttccggccggagtacgtgccactctacactacttgtactagagaagtatatacggtacacggtctaggacctccgagatctccgcaagatttttttgccacggataataagggtcccctgccaaaattttacatcctatcatattaaatgtttaaacacatacatagagtattaaatataaaaaaaataactaattatacagattgcgtgtaaattgcgagacaaatctttcctaattgctccatgatttgacaatgtggtgctacagtaaatatttgctaatgatagattaattagacctaataaattcgtctcgcagtttacatgtggaatctataatttgttttgttattagtctacgtttaatacttt

SEQ ID NO: 105266 - DNA, 939 bp, Oryza sativa
tatgataccatgtgaagaaggcggggatcgaagatgcattgagttaaccctagagggtaatataatgtacatgagggaaagggaaaatacttgaatgcctattacacacatgtatagcactcatactctaacagagataagatggcgatgactaactaaactcaaaaattatattatgtcctatcgtgtgtcaaaatgccctaaatttaggtgattgattcggctgccaattttgtccgagatgtgcccatcaaatccaacgaataaatgagtcatcggttgcatttactcttagctcaatcgtttaccctttagcttatcagtcatagctaaaattcgaatttcatatagtttattttttcatcgggttttaagtagctaatataagactgcatatataattttttttagtcacaagttacttactcactctctttttttaatatatgatacatcatacatttaactttttaacacatgttcgactattttcatcttattgaatttttttttgcgaatgtataaaatgtaaattatgcttaaaatgcttttagtgataaaaccactcatgacaaaattaatggtaattacattaattttttgaataagataaatgatgaaacatttatcgaaaatcaactgtgttatttatttatttatttaaaagaaataaggtagtataatcaactagctatcgagactgttttgttgatggccttacgaaaagactcaagtgtaacccagaaccagagccggcgccgccgtcccgggcaccggctgcgatgcacgagctgcacgtacggcatgcgtacgtgcatgccacacgcggcggcattcctggtttctctccccctccctttcctcttgcccgtccattgcccaccaccaccaccctgctctccccccagacgcgcgccaaatcccaaaatgccccactac

SEQ ID NO: 105267 - DNA, 583 bp, Oryza sativa
cgaatggatttaaatcggacggcttagattcatcaacagatatggctatatatagaacacttcaaccctagcaagccacctctgacccactctggttctccaccgaaccgccgccaccccccttgcatcaaccaaataatatgttcctagctattgtaactttggctattgctttaactgacatgaaccatgaattgcttgtatgctaattattaattgtaacctctttactgaaatatatatttatgttggaatgtgttgtgctcttgtgtgcttgttggtggtttatattgtgatggaaataagctctgatggatatagtaaacaaattgcaaatagcatatatttttttttattaacacatgttctcatagcgggtgcttcaaacacggtaacgcaccacatgttaccaggtgtgaatgaatcacggtaacacaccaaatgttaccgtgtgtgaaggacactcggtaagccaccgttccgttaggagctccgttacacaagagtccagctatgacggcagccttaccgtgtgattcagcacactcggtatgtgttttggccttcccgtgcgcataatcgt

SEQ ID NO: 105268 - DNA, 1056 bp, Oryza sativa
gcatggcagcggcgacgtcgtcgagccgcagatgagcgtgagcacggcgagtacgacgacgacgacgacggcgaagacgaagccgttgctgcgattctcggctatggactctggcattttggccaccgcgcgagagatcgatcaatcgtggaattaattgggatatcgatctgatgatatttttcacgcggcggtgaggcacttaagtagtataacgatgatgagtgatggagcggtcaagctcatgtggagtcgtcgtccacgcttaccgttgaaagcttcagaagttcagagcacttatccttgtatttggatttttttcacataaatataattttgttattttctttttctttttgtaagtctagataaaattaacttggcaaaatttgctgtaggacactcaaaaaacttataattggctgggagacactgcaaaaacgtgatacggctgatgcacactacaaaaattgtgtaattggttataggacactggagccaatattttataatttcttggtcaaaagaggtgagaaattttttgaaatagcgagattgcccctggcgccaccttcccccacccgaaatcacaatttttttttgtagctgggagcagccgtcggtgaggtagctggcagcggcatccgtgcgccaggagcggcagatcacacaaaggcggatgcggtcggggagggacgggaggtggaggagcaagagcgcaagcaggtctgccgggagatcctgccacggcggtgatggttgctgcgccgatgccatcgtcctcctcgtcgtcggtggtgacggcggtggcatggagcacgaataggaggcagccgtgcgcgagaccggcagcagtggcgaggagtgcgagcaggaggcggccgcgcggggggcaggcggtggccacgtcgatggcgtggagcgcgaccaggaggtggccgcgcgtgaggcggctgcggcggcgctccgtgttaggggcaatttcgctattttgaaaaatttctcgcctcttttgacccagtagttataaaatattgcctctggtgtcctatagcc

SEQ ID NO: 105269 - DNA, 924 bp, Oryza sativa
gggaccttgaggtactttttgttggactgtagcaaatctcatagtgtggataaagaaatcaaccatgtgttacatgaagtggcatttttgtgatggttattttaaactcaaggccagcatgcatttgggacaaaataggcaagcttgcaattttaaatctaaataaatgcaaagtcagctcgtgtgcgggaatacaggttgttcacgttttagtacgaatttgactagttttcttattattattgaaaaaatgttctaattattggcttttgttttttttcctggaaatacagtattggcaagtggatactaatttttaatgtgaaattagttggattcagttcgtcaagagagttatatatgacgaagaggacagataatcacttaatcagatgtgatgcaaattgtacttcaaaaatgcaatttcagtcaactctatggaacaattaaataaacataacatccccgcaaaaaaaaaaaaacaaagagaaggaaacagcgttgaaataagagaagataataaaatggaggatggatacagtgctggaaagaaaatatttggagatgttttttttcctactactttatacagtatcctactctctccatgcccatataattatcatcaacattggtcatatgtaaactttggccattcttatttttgcaacacatttgtatatatatgaaaacataagatattatccaagcatgttgcatgctaaacatgaccataccacaattttcgttcaacaaaaaaaaaacttgttaattatcaaagttgcaacgatattggtcaacagtgactagtactatctccatattttaatgtatgacgccgttgactttttatccaacgtttgaccattcgtcttatttaaaaaatttatgtaactatcatttatttcgttgtgacttgattcg

SEQ ID NO: 105270 - DNA, 714 bp, Oryza sativa
tcctgcagccccataaagaaactgtatagacctagttcccacatgcagcagtagtttctcactatttttgtcaaggagataattatattctaaaatcaggaaatattcttgagaatatcacatgtgaacttcttaatcatgaaaaggtaaaaacagctcggcttacactgcagtgaagctttacttccaagaaaaggaaacaaatgctgatcctaactcttgtaagaatgtttttctaggatattattctggacttaagcgttgcaatgtaatatataatttaatagctaatataaattggtgtcatcatttttttaaaagaatttttagctgtgcactgctacagagctcctgaaatatccaagtttagctttgagcctttaagttcactgaccataacttagtgtgcttgggtacttatattaaacttactactctcttttacaaattacaacctccctcccaaaattataagtttacagcacatttctcaaatataagagtttcatatagaccaatacacattatcaaaagacactgttcccaattatgtccaaatgagtatatacagtttacaacaagaattgtgctagattatttgtgcaaacgattaggcacaaataattgaatccctaaaggaaatataaactgcaaatgtaatgaataattgcatagataaagaattcagaataacaaaggcatgctaagaacctg

SEQ ID NO: 105271 - DNA, 667 bp, Oryza sativa
catggaatgttcttgcactagacaaggataatattcttgcaggtaattccgtaccgaagttacagttgtatcccatagttcctttggataagatttcatattcatgtgcctttcccaccttttccagtttcaagcagccttattacagttcctcaaatatactatgggtctgaggtttgtcagactggaaaaccaaaccaatgggagtggcaagaaattgcaactccttttccgagtccttctgataaggtataactgaaaaaatgcgttgcttgttcaacttttccccaaaaacactgacaaaaattttggcagtgtaaagtactaacagtttctgtgatgtatgtttggcagatcagtgcaatattagcagaccataagttcagtatactcaaaatcccgattagcaactcttctaacaaactcgctgatggtatgtgtacaacccaaagctcctttctttaatgaaatgacagacagctctcctgcattcgaggaaaaaaaaagcctctgactgtttttttttcctggaattggtactctttggtgccttgtgttttgaatacttctgttactgcattcttcagttgacgctatgtttttcttgagatcagctgtactgtctagtacttgtaggctgatatattctgaactgcgacaaaatcta

SEQ ID NO: 105272 - DNA, 676 bp, Oryza sativa
taaatcctaaccattcattctctctcacccatttaatcctaacattttatttatttcccaatctcaatcccacccctcatttcacattatccaaacacaccaaagttgaaattgcacctcttgtaactgcgttcggcagcaggtgaaagagaagatttctctctcgtttgtcacgtgcacacttcctgaactattaaatggtatgttttttaaaactttttaataggaaagttgctttaaaaatcatattaatctatttttgcaatttaaaatagttaatactcaattaaccatgcactaatggctcatctcgttttgcgtatattctcaatcttatcttttcctctcctctcaaacatataaaacggaaaatgcactttgaggatcagctatataccaaccctggaattgagctatctttgatagtaataggtcttaaccgtacctttctcttttttacgtgtacgcttcccaaattactaaacggtatgtattctataaaaaatttgctttaaaaaccacattaatttactttttaagtaatacttaattaattatgtgctaatatgtcaccctattttctacatgtataatataaagaagtataaagaagcatgtcagcctgtcaggtgctgtgctatgttgctgaccacattcctctcgaacagagcaagca

SEQ ID NO: 105273 - DNA, 688 bp, Oryza sativa
cgccaattttttcatagtaattttagtattatcaaaatattaaaataccaataaatcaaacaacgtatagcttatgttacgctacatctaacgcatgcattaaactagcctaacagtgtcgatgtgttctctctgctacccctctcttaaaaaaactaactctagatttaaatttggatatgtgtattcagatttaaacctaaaactagattttttttatagagggagtactttaaaagggagccctaattggtgcctgtgccgtgcctccccctagcgatgcacaccccctctagtctactacttatcctatataagtaataaaaactttgtatacacgtatataaaatttatacatatgtatacacatacacttttaacggataaaaatacgtacatatataaaaaagctatgacgtgtcctcacccttggcctctcctgcacaccacgtggcatcagccacacacgacgcacgcctttgtcatcacacgtctgagtgcatattagcaatctcgctttaaaatacgagtcgtcctccactctatcctgtgcttcttttctgaaactaatcctataaaaaaatattagtagaaaataaaaaccaaatatggcaaagcggcttcgttttccatccttaatatatactctctctgtcctaaaatataagcatttttagctatgaatttg

SEQ ID NO: 105274 - DNA, 2624 bp, Oryza sativa
ggcaatagtttttttttcatttacttactatttaatctctaatttattttctcccaaattaggtgggatgcgtaccatcccaaatacacaaatcaatcatatacactacagattatacatccgaaatcaaaccccaaatcaaagaaacatcccaaatatacaaatcatacacaaatcatgtacatctcagatccatacaatgagattccaaaaaaaaattatacatctcaatccatacaatgaaccacagattcttcatctcaatctacacatggatcacaaattctttgaaaaaaaaaagaaaaaaaaacgaagcaaagccgccggccggctgagccggccgccgcctcccctcctccccggctgccgccgccgccacgcggccctccgcgccggccgccgccgcgctgccctccgccggccgggccgcccaccccctcctgctgcgcacactggatcgagttgggaaggggagttgggaaggataagaagaaaaagagataaggaggaagggaagagataagattagagatggagggagagaggagtgggtgtggatgagaaaagagtggacgaaaaaagaggataagtaatagggattatatagtgtattttgatctttaatcccggttcgtaactccaaccgcgactaaagatcctggaggggcctgacaacacctgacagcatgtgaaccgggactaaagatcatcggtaacaccaacctggactaaagatcacgtagtctcgttctacttataaaccgggactaaaaaccatctttagtcccggtttttactgcatccgagactattgtggtttttggtcgaccggacaatgatggtttctccactagtgaatgaagatgagcgaatgggtataagagactgggaaatttaactatttgccactattagatttggcaattatcaaaatgcccttcttatatttgtacatacttttttccctcttaagtggtggttccttaactattcgttacttttgcccacgtggcatgccaacatggcatataggtctaaacgggctccaactcgctccatgtgctgacatggcatgacacctaaaacaaattcggagacctaaatatgtattttgggagttcaagaacctggatgatacactcgcacaagtttaaagaataccgtgtacatcactcaaaatataaattgtcgtcctcctctcccaatcgtacttccccacacaaaaatcaaactgtttcaaaaccaacctaaactataaaaagaaccattattccgacgagaagatttgatagacaagtcgttcgtattgctctaaatcacattgccacgcatggacacgttggtactaaggataaagataagggaaaatgtacgaattacccccccaaccctccgaactatcacgttcgaccgaattaccccctcgacccaacccagagcggttttgtcctacgtggcaatccggtcagcattttattttttaaaaaatggtgggacccacatgtcataccccctctttctctcttcctctatctatctctctctcagtcagtcactggcagcggcgcgcacgccggcacgcatggcatggcacggggacgagcggtgggcaccggcgcgcgggggcgagccggcggtcgaagtgcacggcggcacgcggggagggagaggtcggtgcgcacgacggccatggcggagaggcgggcaacagccggaagtgtcagcgaagggaggtagagggaatgggggtgagtggaggtggatggggaggtggaggaaatgcagggagtaggccggcagtcggcgcacacagcggcggccatggtggagaggcgggcggcggcgctcgccattgtggcgctggcggagaggcgaaggtccgcgaggaggcagccacgcgacggcctccgcctccatcgccgacctttcggtccgtctccgtctccgcgagctctgcctcagccgaccgcccgggcgagctccgcttccgccacctccgcctggtccgtccctactcggtgactccgactcggagcaggatggagaagaggaccgccgtccacgctgaccgccctcccccgtccccacgccggcatgcgcgcggcgcgccatctcgcgtcgaccagagatccgctggcgagcggcaagagaagaggcgccggtggagatccgccatgctcaccgcccgtagtggccttccggccgtcgccccctgtgcccccgccatcgccgccggccgctgcgcccccgtcacgcccgccgcacgccacacccattgctgccgtatgcaagagagaggaaaagaggaagaggagtatgacatgtggatcccacatttttttaataaataaaatgctgactggattgccacgtgtacgccacgtaggacaaaaccactctggattgagtcgagggaggtaatttgtccgatattgaaagttgaaggtgaacgatgtttggttttcgggttagggggtaatttggttgaccacgatagttcgggaggggggtaattcgtattttttccaaagataatacacctatatgtttccattagcccaatttcctagtgatcaaacccattgtacatttgtacgttaagtctattgtgtgatttaattttc

SEQ ID NO: 105275 - DNA, 1821 bp, Oryza sativa
acaagtatggatacgattcgagtagtccttatagtatccatataaaactctatttgtcatttcttatccggaactccctctatatatgaggtatgattccgtataagacttggtatatggtaggccccgccgagcttagtcgattactattgggtatgtggtatccataaatctgacaaaaagtataggagtaccatgtaagagcatacccaggagctcatctatatttgatcctccaaatacccatatggtgtatcatccaaaaaagattcctcatccatatcccttttaatccaacagattatccatattacatcattcatatcccatcatcctatattttagtaatatctttcaactaatcttacatttgtattttaagggatatattttgaatgacttaattttaacggtgttgtttatcgcgataatattttgaaatgagtaaactttaacggatatatttttaatgggtaatttttaattgatatatttaaaatgagtgaagcattttttatgtgttgaacggctacatttccaacggctagctagctcattcaaattgtccaacggctagtacatacatgtaaagtttagctctatatataccactacattgcttgctatctttttgcaccatccacattattgtgcatagttcttactcaatgagcttccttttgagacatgttttattggatgaatcatcgtcatcgacgatgaaatcattgttgcttcaagaagatctagttaaacatctatggcaatttcatggtaggaactagtgtagtatgcaacctcccatttatgtagtaggcaagtctaattatgtatgcaacctcgtttacatatgaaatccatcaattatgtatgcgacctcatttatgtatgccatccatcaattaagtatgcaatcctaatgtatgcaacctgtatgtgctcacaattaatcatagcattcttgcatagtacagcataaaggtcacaaaacattaagttccaacaataaccattacataatacatcaaagcctacacggcatacaacataaaagttcacaacccattagaaaatagtaataaatagtacatatccatacatcatgaaatcaatccatatgagcctttatgatctcctgctgcaaacgcaagtaatatgtttttcttggcccatccatagcactaagatccatattcataattctttcttctctttcatgggtttctatatctaactttcgtttttctactttcaacctctctttctctagtgaaataacttcaaccaaccggtcatttctttcctccctagattgtgcactcatctcctttttctctgaccacatgttatttaatgcaataactacaggactactctcacttgagcatgaagaagtattacctcgcgggcattttgccttttccaccttcttcccaggtggtctcactaaaggatcagaggtattaatgtcggggctgtaatgaaattcactagagtttggcttgcagatggtctcactaaaggatcgacatgagccttctgtcttttctggaacaacctatcattccactttggatgatgatgcaaaatctcccaacagtgcattaagaaaatgtcttcttctctgctgacttgtacaaagtaaaagcctgagttatctgcaataattggccaagtcgataattggaaaaacaatatttttttaaagcaaggtactagctgaatgagatgcttacataatcttgaacaaccattccactttgaggtccattaagaatctgctcataatatccacaaaacttgttaacttgctcttgaatg

SEQ ID NO: 105276 - DNA, 4432 bp, Oryza sativa
cggccgagctggcaacaggcgacggcgggcatgcagccaaggggcggcggcggacgaccggactggcgagaggcaggggggatgcacgcgacggccgcggaggcggacaggcagggaagagccatggatggtcgggaagaaggcagccggcaacgggtgggtgagaggcggaggaggcaagcgacggctgcgcgcttggcaacagcggtaggcagctgccgcgggcagggcgacggcggaagtctgcaggcgtgcgcatggcgacgacggcagacggcagtcgcgcggctccagatctggtacgcctctccctctccactctcactccaccctccctctccaccatccgctgaaaaaacaacccaaaaaggtgcatggaggactcaccttcgctggccggccacgacggcgatggagaggaggtcgcggaagtttggataggggcgggagctcgatccagatgcggttgttacgatttggcgtgaggagagagacacgctatttttggcttttctctctctctgtttagcgcatccgacacttttagcgctttggatggcacatctcctggaccttgttttttcgctcctatacgccaaaatgcggatggagtagcgggtagcgtatgtcctgggatgctctgacagggaggtacctagtgtgcttatcgcctctgcacccgctctgcctctccttcacttggtacgccgtacgtgtatggtaaaaaaaaaaaagagtactagctggcaagctgctgtttgttaatgggcctaccccaatttgcgtgagggccttaatgggctcaactggcgcgcctcggaaagttgggcctcacacaggcccatatcttacggggaaagtaaagctacggcctaaatggaataacgtctttgcgccaccgttttcttccgcagctggccaactcgagccacctcatcaggaaaaaaaaaaagaaagagagaaaaaaaaaatctcgcctccctttcaaatacgccgccgcggccgcaaagctttcgctcggagcacacgcacgcgcggcgcgacggcgcgacctcgcctcgacacgagctctcgtgatctcgtctcgccgcgtctagctcgccggcgccgccgcgcgcgcgcgtcccctcgccgccgtacgtgtagcggagcgactccctctctccctcccgcctcacctccgggaccggtcggtcggtcgatcgatcgacggggcgaggggatggcggcaccggaaggccagaacaagttcgcgggcgtccgcttcttgcccaaggacctggagctcctcgccatccttgacgccaagctccgcggaagcccgttaggccccgtggaagccatcttccacgacacgcagatcctcgacttccacccgtacaagctctacggtatccaccgcctcgatcgatcgatctccctctctctctctcttagtcgatctccttcttcttctccggcgacgggtgggtgcctggatcagatcatgcagttttggggattttgattcgggatttcgggtggatattactcgactgattttgcagagatgtatgctgaggacgagcaggaggaaggctacatctacttcttcagcacgatgcagttcagatgcaggaagattgtggagcgcgcggcgcagggcggccggtggaaggtgaacaactgcgagactctggaggttggcggcgtcgccgttggccggaagttcaccatgaatttctacgagcatatcggcggcgacaacgacctcatctggaccaactggggcatgcaagagttcgccaggatcatcggcccaaacaaggaggtattccattcggaaatccacttctgaatcttcgttcaatgatcggatacatttgatctcatttgggtgaaatttttctgatcattttggccaaaagctcgcggatcttgccttgtaccgcctatacaagaagaaaataacaagggggacaggcgaggagaagccggaagacatcgccgcggctagcgatggcgataccgagagcagcatgaacaagcgtagacgtgtagaagcgtcggcggcggccatggcgctgccaccgccaccgccatcgccaggcctgcctggaacaatgatgttcatggcggcggaccaggcgaacgtggcctcgacctcgcaggaatggcacggccagttcgccaacggcgctgcggcggcgccgagtcctagcggctgctggccctgggcgccaccgccgacaccgagcgcagtggagcctttcagcttctgggccagcgcgtcggcggcgactcctcctgccgccgcgaactaccacccgtcgccgcagccgcagccgctgccgccgcagggcggcgagtactactccagacacggcgccttctcggtggcgcccgtgcccgcgtccgcctgctcgacgccgtccccggaggcggcgaccagctgcctcttggctacgacgtcacctctgccggcggcaggtactgagggcagtgacagtcagcagcaagaacccccctgcgaattgatggaattttgaaattttggcgaattgcttatagctgattctgatctggccgacaaatttccgtcaaattcgcagtgttcaacttcgtactctttttctgaccgttggctgttacttcactagttctacatatgtgagactgcattgttttttgtactagtattaatcttggtgatctgttgttctgaaatgcttataaattttgcccttgtgccttgaagaatttgctatgtgcgtcacttgctttgatttgggatgaaatgtttgatgaacaatcatttttaattaccacatgcataggagcttcaggaagggcttgaatttgacagttgctatgtgtttagccatgatgcatgtagttttgtgatagtaccaacgcgggatattcataggatttttgtggaggttcctgttaaatcattgaattttaatttggaggctctgaagtgttcatagtccaaaatactgtcaagtaaattcaagtgatgaggtcatgactttaatttttcatagcaaataactagattaatagaccggcatgattttctctaaaacaaaatagttagattctgtttctggcaaggaaacaagatcactgaatttcgttccggtcaaaaccatgtagcttgaactcaacttggactctagagagagaaagagatactatatcatgcaagatatagtagatacaacctacaaaatccaagaatttcatatttttcatacaatgtaagtgagcgcatgattttatcaacatctcgatccatctactgatgaactgaagatatgtagtaccagctaacagggaggtgctcacgctggtcgcctttgttctacagctcgaaataaaaaaaaaaattaatatgtaccaattcttttgaaacgtgtatattttcttaaaaccggtggaaaaaatatttccaaatcttatttgctgcagctctgcctctccttcagttggtacgcgtatggtcgaaaaaaaaaagacagtactagaaacagcggtttttaatgggttgagcccaattttcctgatggacttaatgggctcaactggcgtccctcggaaagttgggcctcagataggcccatatcttgcggagaaagtaagcttctcgccgtgctcgtccacattccgccagctggccagctcgagccacctcatcaggggaaaaaaagggaaaaaaaaatctcgcctctccttccttacaaatacgccgccgcggccgcaacccgcaaagctcggagaacgcacgcacgcacgcgcgcgcgcgacacgcgacgtcgacacgagctctcgtctcgccgcgtccacaccaatcggcgccgccgtgtagcgaagactagctagctccctctcctccgcgagaccggccgatcgatcggggcatcgcgcgcggcgcgcgcgggcggggctagctgggcatggcggcaccggaggatggggaggacaagaatttcgggaagaacaagcacgggctcccgatcggcttctacttcgcgcccacggaccaggagctcctcgccatcctcgaggccaagcgcctcggccgcccgctctcccgcgcgcacgacgccttcttccacgacatccgcatcctcgacttccaccccgccgagctctacggtatccacccttctccgtctctctccttgtccccttcttcttcttctccggcgccggcgaccggcttggtggtggggatttgattcgggtggatttggaatgatttgggggcggcgcagagaagtacgccaaggacgaggagaagggctacttctacttcttcagcaagagggagttcccgacgagcagcaagaagcggccgctgcgggtggcggagggcggcacgtggaacagctccggcgccgtttacaaggtggtgaagagcagcaagtccggcggcgactacgac

SEQ ID NO: 105277 - DNA, 667 bp, Oryza sativa
gcagcgacgccatgggctgcggcggcggcggcggcggccggagagggaggcgaagcgtcgccgccgtttgctcccggagcgagaggggctggagaagtggggagtagatattgtggtgggcttcgctaccgttggatccgatctggacggcccatattggcccagggtttaattttctgggcctttgcctatttctcccaggtaaacctgcatttttaggatcgttttcaccgcgattttttgttttaataagaagtagaaaatggcgctggctagttaaccggtataggcatatgtaaaaaatgaataagcattcaataaagccgttatatattgtaaaatttatctaaagctctcctaatttgtaaaaccgttatatattgtaaaattttgaaatcctaattttttttcaacaaaattttatgaatattcaaatgttacttacaacttgtgttttatctgatttttgcaatgtaaaaaatcatacataataatcgataccattggacaacctatcaaatattgtcaaccacaagttagcctagccattgttattatgttttacgaattaacattgaaaatctatatgtctgttgacgcacccattcattagcccctattcttgtcactcactaaatatacacgttagtggtgcgcccaccaaatt

SEQ ID NO: 105278 - DNA, 711 bp, Oryza sativa
attcctgcagcccagaaacaacatgcagagtcttttttgacactatattctaaccaattaaatttatctaaccaattcttttgaaatgatcttataaccttaccaacaaatataccatccttatttcatctctcatttcgtgacaaaacttacctattgttattcttattttgtgcacaatcagcaaaaattccattctgttctcatcagtttgattggtactacttgaattgcttgcataataatttaacaacattgttttcttctccatcgaaaatctacgaataaatcaaaactatgaatcgcgaagctcaattcttataaatcacatcatctagatgcattactgaaacagagacgaagagtatgaacaccggcaccgggctaggactcaccgcttgctctgctagctgctgctgcttgcccctcgtcgtctgatgcccttcatggagggatggcctgatctgctagctcctcgccctcacctcctgctgctcgctcctcgtcgcccggttgccgcgtctgctcgtcactacggcgctgcgccacaacgctgcagcctgccacaactgcttgccacattagctatgtactactacaaattaatatgtgaaatgaggatgacctcggctccgttgagcgcagcggtggactgcagtggcgtcgccggatgggaagacctcagcttcgagggcaggggaagaggggggg

SEQ ID NO: 105279 - DNA, 693 bp, Oryza sativa
attcctgcagcccaattgaatttactgcctattcgtgagttggtcctcctgactctgactctggatgccactacctgctggagctatggaaatgggagtaaagctatgcacatctgatttccctgaagtttgatggtctgacgactgaaaacttgagcagtcacaatattgctgtccgataccaatcggtttaaaaggtcatgtggtagccgcggagatgacgagagattcaaatgtaaaagttaacctaatgaaaactcatcgcagaatttctttctgggattcatgtgtttcaaatgaggtttgaatctcaacagacacgcatttctcatagcacacggaattggcttgatttttctccccctcacacaccggacgatctcacaaatgcttcaccaaaagtacaagcagataagaagtacgcctccgtgcgagcaacacgtaaaagtcaaagtccatcaccccccgcgaaccccggaagcttccagaaggaacccaacaaactagcgcctccatctctcactggcagccgggccccacgagtcgtcgggcccacctgtcactcactctacgcgactactactacatcgcgcctctctctccccctcccccttcgaagcttttcctcctcctccgcgcatctcggcgccgcgccatggccgctctcagctcgcgccgccgccatggcagcct

SEQ ID NO: 105280 - DNA, 965 bp, Oryza sativa
tctttcgataatgttttgaggtgttggattggtcccgacctggttataggcctcactggctcagctcgctgttaatagtagagatctaggaaggagaatgcctctgtgtcgactgtaatttcgacatggaaaggggaattggtggaattgctgcggtatagtttgtatttttagattggatatgtgttggaaatctaaaatagcagatttttgtattttgggtggtagtccttgtaggtaatgattcttgatgcgctaccatgccactgccataccaggtctttatagttggtgttcgtgcatgtttaggtagtattaaactgccaagggagattaatctatgtgcttgtaccaatttaggattttatagcagaagcagttcagaatttgaatttaatgtgcttggattaaatagcctgtggcagatgcagtcttttacagctttttgttggttatcacaatcagtacactaaatgctggatcagaacttggctactatagttcttcttgtgatttggtgaacttgttgtttcctctcaatttggagataacatttcatctaaaatgcttggggatacttttttagcatggccaaattaaaagaggggatatatggctaagcttctatttggtaatacgcaactttggtgatttggtatctgcaacacatgtttgaaaccaatgtttttttttggctgaagtttcatcgttgggggttcatatctttttatcatgttcgctcaatgtactaatacttctccatgttttttttgtcttcatatttattggaatctggggtgcttattttttttcctaggtagttttcttttgtagtttgcgagagatgaaattcgatcaattatttcctatttacattagtattgtttgcaaaggtatgctactatttgaaattcatgtatatttctattccttatatttttacctgttttcagcttttcttacaa

SEQ ID NO: 105281 - DNA, 698 bp, Oryza sativa
ggcacgctggcaaaatcatccacctatgaacatgccatacctttgtcggagtataggatggacatggctagtgaagagagtcgaagtagtccaaaagtacaacaaacgtaaagttagctactttaaagtgaaaagatcagagtaggggtgttcaaagtgaaactacaaattcaattcactctatttattatctcaattgttccaagaaaataataaacagcatgtattgcttataaaactgtatgaagtataactgctgtactcgttctactcatgctctataacttggtacaagacattccaaaataaatccacctatgagtataccattaactttgctagagtataggataaacgtgactagtgaagagagtcgagtgaagagagtcgagataatccaaagtacaataaaccttaaaaagattagagtaaaggtgtccaaagtaaaactaaaaaataaaatatgacccaaaatataattcactctatttattatctgaactgttccaagaaaataatctctaaacaacatatattgcttataaaactgtatgaaacacaaccgttgtactcgctctaactcccaccctataacttagtactggaatggaggacacacttgtaatggggttattattggacaagacattccaaaataaatccacctcccgtataaatgcccgaacatttttcttggg

SEQ ID NO: 105282 - DNA, 635 bp, Oryza sativa
tctcgtccatctgttccaaccgccttttcttttttcaaatggtttttaattggaaaatggatttgccacatgattcacgatcagtaaacgctttcagccttttcatcttacaattgagtactccatcaatttaaaaaccatttgaaatgtcgtaggagataatataccgtcgtacagtatataccgtcgtgctccatcaattccatctccacgtgttattgtctagtatcaatacagcataatgtcgtaggcgataattaatcagagtatcatgcacataagtaaaatacaaatacatgttcctttcgttttatattataattcgttttgacttttttcttagtaaaacttttatgtttgatcaagtttatgaaaaatgtaatggtattcctaacacgaaataaatatattattaaaatatattcaatgttagattaaataaagtttcaaatgttgccaaaattttctaataaacccaatcaaaatttaaaaaattgacaaaaaaaatcaaaatgacttataatatgaaacagaggcagtacaccaaatgcccgttgtgatcctaccccgaagtagcctacaggctacagtctcagagacagggttcaccaaactgttctcaagccaaaacaggg

SEQ ID NO: 105283 - DNA, 638 bp, Oryza sativa
ttcctgcagcccacatgtaacctgataaaacagaagcctatataaagaagattctagaaatatatccatggtaggagctaccaaggaaatgcacattcataattgatgcaaaattaatgcaagtgttttcatacactgataagtgacactaataattctggcccatctgtatgtcaaaagatggatctggattaggttctttctgctccattgctgaataccatcaggttttagctatgtttgcgttattctcagtacattaatccctcttgtcatttctttgatattcaatttctttatataatttaattataggattgcaaatgttgtccatgaatgctctgcttaaccataaatcattgacaactttggcctaaccttttcttgcagctcttctcatgtagtgctacagaccttcatggtgcttcttgttagagcagcattgaagaggtctagaaatcgatgtcggtgaaagatcatctgaaatgaggaaaaggagcatgcactgacaaaaaaaacttccattccttgtactaatcttcaagttttcattgaccaggctggccccctgttgctgtaattctgtcactgcttcagtaaattactgaaacagacaaaaacatctcctctatatcgat

SEQ ID NO: 105284 - DNA, 750 bp, Oryza sativa
aactgcacatggagttaagtcactgacatgtgagtcccattttattatggctcatatgttaatggctcaactgcacaacagttaaattagagtatccattttcgttagaagttgtggagcagccgtggatgttgctttctctttttctctatctcgtttcgatggtaatcccccagctgtcttgttttgccttttgtaccgtacttgtactagtaatatgcccgtgctaacgcaacggtgatatttataagtgcagtcaaacaactaaaagaaaatatcatgacaaatttaaaactatcacatgcgtaaaataacatcacaagtgttgtattttttaaaatcatcaattacacataggtccatacaaaggaaacatcgctaattcatgatatatatcctggttacaaatctttctattgtcaattgaggtaaaaactaagaattcaaatcctcactccccatgaaagattctaagcttctcttatcaggaattgctaatgtgcccgatattctctcagttttctaaacatgcatgtaagcctgcaaatttgttagttgaccaagtctagctgcaagagaatcgagcccatagaaaactaaaatgcacaaaagaatctgctgaatcaaaatgcaaaattctggaaaatagtatgcagtctgagcctactgttctgtctaaaatattaggggaattatggaaaatgactttcttaaatatcgatatctatccagaggtactaacacaaaata

SEQ ID NO: 105285 - DNA, 1027 bp, Oryza sativa
acgaaaaaacaaaaaatcacgaaaaaagaaaaatggacaaaaaaaacatggaaaccttgcgtatttttatattaggtatagatatagatatagatttgtgacatgtgaatttgccatatcattatatatctcaggctctatttagattccaacttttttctttaaacttccaacttttctgtcacatcgaactttcctatacacaatctttcaacttttctgtcacatcgttctaatttctttgaacttccaattttaacgtggaactaaacacagcctcgattctaattactgctataaaatttctactacgggtactattgggaagtgatggggttagaaagacttttagccccgataaacgtaagttagaatatgtaatatcccattcgtttcaaattatctgtaattctatcacatctcacgataacaaataagatgtgacacttacattgctaccccatttgctttgctcactgctttggaaaaataattactccctccatcccatccactaagaccaaaattaatttaaataacttcaattgagacactatgtacacattcttccaaaatgcatacatcgattaaaacaccatgtcatttagtacatcctagtatgcatatattctctcatgctgtattaattgtattccaataaaatccgtgttcatgcggttatatgatcatcaatttgagaaattttaaatttcactatatgatgatcaatttgggaaggagggtgtaggatgtacaactccaattagttaagactagccaataagatgtgtggctgcattaatgaaaagtagggagggaaaattagcttctgaaagtgctttggaatttggaatatagaatgacaactaatttgaatcagatatcgaaattcttccttcaaccgcaacaacatgaaaaattaataaaggggtgtttagatccatgggtgtaaagttttgacgtgtcacatcggatatacgaacacacatttgaagtattaaacgtagactaataacaaaacaaatta

SEQ ID NO: 105286 - DNA, 1251 bp, Oryza sativa
gtagttaaatttataaacgatagccgatcggctagatgccgatgacatatcatttatctttgagccgatgtcatctgtgcgtcgatcggcagtcatgaataagtaaaaaaggactaaatctactcgatcggctgtagatattaacaatatatactccttatatcgatgtctacttaaatcaagtgattgggatagatcggtcatcatgccgagacagtataaatcacttagatcgaaatatatgtcaataacaagactatatatgtttatagcatagccgatcagatagatctagcatgtatcggctaatactccgatactactctatatcaagatattaaagcaagtataatatattgagcaaaagcctaacatacttagatacggcaatatcttaacataaagggcagatttaacatatcaataaggcatatagaacaaatgaagttaaatcagatacgatcggctgaaactccgatactattctaatcggcaactagaaggcaggctagagatcgatattctaagcacgacttacagatcaaactcaactgatgcaacattaagtataaaaagaagaacaatatctagacaatcaagccactagaaatttcatagaatgatagatatcttatataatctagatcaacgtcaagatctaacctaatcggctgtcttctgcatacagatattggcggatagtagtctagatggcgatattgctagagattatgtaagatatatgataatttgatgaattaaataaacaagattagagtgtcatgaagatggaagcactaatcctaagaacgcaatccatcacgacgaattttacctcttgttgaagatcgaaatcgatgcagctcaacccgaaagcaagaactcgtcgaaacaaaactaaagcaaaaagggtggcgatgcgccgaaattatgttgaatgtgtgtgttcaaaattacatagggctcggggtctatttatacccgaggattacaagatatgcccataccggacacaaccattatctctaacaaactctaagataccacaagtctttgcggcagacttttgcccacacttatctataaggaattcacataaaatattctaattaatagatacaattgcctttccaggactctatccatgtgtggcaatcatcttgaagtacattaacttgaacccgatgtcgcgcacaagtcgtattgtcggaatcggctatatcggcttatttagctcgactcagactcagc

SEQ ID NO: 105287 - DNA, 537 bp, Oryza sativa
gacgcagccgcgcggggccatggaggtggcggagccctgcgcgaccggcggaagcgacggaaccgcgtgcgccggcgtgggaccgtccggagccacgaacgaacggtggaggcgcgtgcgccggcggggccgcgccgagctatgtgcgggcggcggagccccgcgcaaccggtggaggcgacagagtcggcggagccctacgcgaacggcggaagcgacagagccgcccgtggccgcggaggcgacggagccttgcgcggttgcgacgtcgactcagcggaggcgctcgtgggcgacggagccgcgacggccggagccccgcggcgctcgtggaggcgacgatgccggctggccgaggcggcgacagatgcacggagttcccttgccgcgccgggcgcggtgaccagcggccgaagcttggcgcgctagcggcagctccggagcgttccgagccacgcggggctagcggaggcggcggttcccgagtgtgctggcagagcaggaggcggagtaccccggcgcgcgcgttgcatggcg

SEQ ID NO: 105288 - DNA, 544 bp, Oryza sativa
ttctcctctttcccgggactctttacccattggcatggtataaccttttttgctccttacccattcggctgcagctatttcagaatcatcttcttcgtcatccgacccatacatatatggacaaacgtgattaactttctttgagcttttcctgacttccgccgacctatgctcaagcaaggttaccttctgtatcagatgcgataagctatcgaagtcttcggatgaaaatttctccctgattggaggaatcataccctggaaggccaaatcggctaactgagcatcagtcagactcaagctaaagcacttgttccgcatctctctgaacctctgaatatactcgtgcacaggctcatcatgccgctgcttgatcgctgtcaggtcggataacttcatctcatggaccccactgtagaaatagctgtggaattgcttctccaaatcggcccaactattgatcgacccatatggcaaagaggaaaaccaagtaaaagctgatccggacagagataaccggaacaacctaactctcaaggtgtct

SEQ ID NO: 105289 - DNA, 942 bp, Oryza sativa
caacaccttaccaatcacatcatatgtgactcttgtgctgtcggaatgacatctccatgtccaatcctacatatgcctcaaggtccaaaaccgttttgataaccttgtcaagtaaaccgataatctccgcatatagatgtctaacatctatcctattttatcatgataaaaagtgagactctgctatggcaaacccatcacttatgatcacaatcgtaataggtgcaattattggaagagcataaattacacttaatttttgagggaatctatcctaccatgtcatatcctgaaaaggtcacggggtacacagatctcatctatgattcgccatatgaaaaccttaacggtgtaatcaaattgtgccgaaactgagtcaatctcattgtctcgtttttctcaatgcgtgcggttccagtggacatcggactatccgatgaacacaatcatgctcggccgtggtgagtaccagacattctagtgaagtcaccaacacatatactgattgatctcatcaacccatgtgcctatcggtccatcttatgttccgatcatctaagtactcatctactacaaaatagatctcatctactacgcccgcatatcaactatatgcaatgatctaaatcataaattatacaaggcggctctgataccactgttaggatacgcgaaggctacgatagcataaatcaaaattttctaccacgtaaactaggaaccatgcaagtattagatcatagatcattaccactcgacgtgttgcgcagcggaagaaagcgctaagaaggcaaaggaaccctcgcgatgtagcgcgcgtcgatgtagaggaagttgtcgatcgcaccaggtcgaccttctccttcccgtgcattctcctcgccgtagtaccacgccgatcagcaccgcaatgcagcggcgcctctactgtacagagacgga

SEQ ID NO: 105290 - DNA, 1827 bp, Oryza sativa
ttccaaggcctgattaaagagggaagcaaatgcccggtttatgggagcttctcccagctgcagcttttcccaaaagctgcttctgttagaagctgcctcaaacagtccacagcttctgagaatctgtagttatagattctaaaaaatgaactaagaagccaaaagctggagaagctgggtttcagagcttttccacattctcagaagctggctaccaaacagctgcttctcagaatctaaagctcccccaaacaggcccaaagcagacttcgacagagagaaagaggctgctggatcggctgggctgaaggagagagatgggccatattaagacctgagctttggaaagtattttaattacttttccaactaaattaatcactgaaatgatatttgaattgttaaaaatacttcaaatactgaaatatgttcaagaaaaatctcgcaactacttggacacttagagtatttaacaaacttaagataagatcatttaatgactaatttaatatttaaataattcctaaaatgttctttgtattattaaaattagtaattgagctctaaaaaatccgagaaaatttcagagagtataattaaccatgtagaatttaataaaatttaatccatccatgctttatatttaggaaattttatttcccacatttaacttcacttgtttattaatgtacatttaatataaattttaataataatttattaaataatttataaatcctaatacgaaaataaggatgtgacaaagactgctagaagaaatcacaagaagaaagatagtgacttgactcctacaaatgaagggattcatcttacacgcagtgtggagattatgggtagttgggtaccacatacccacatggcacgtatatccgactggttataggtgatagcttgtacagatagaatatgtttaggaaatgactcgggaattatgttaacttgtatgtcaagaaaatatccaatagtgccagttagttacagttgtaatacatattcgttagcctagtacgtaagccatatgggctgtacattgtaatcttggctcctccccctatataaggtcgggtccaagtgtacctaggggcataacttttctcccagatcatcagatcaataatacactcggtggaataattccccggctgtataaacctttgcctcctacgtcctaacctatccacttttccagcttgattgctaccccttttagtattgccggaatcttgttttgacagttggcgcgtcaggtaggggttgcgccatgtttttcgccgactagtgcgatgggattcatttcgggcatcaccgacttcgctttccctcccgggcagacgtgctggttcggcggcccatggacctcatcagccacccgtacatgcatgcaaagaagacatcgtacgacagatcaatccatgattataaatcaagctaataatattatatagattgtgaaagaagttcttctgtatatgtgcagaatgaaggatcccttaaagcaaattgtttttgattggttgcaagctttatagttttatttaactccttcgactgtaactttgtaaatattttttgagttatataaaattacactgctcggcaaagccctggcagtatttcaggtcaaaaaagatttcatatagattgaaacgacaaaccaatcgacgtcagagattagaatcatcgatctcattgagattgccctcgagcaaaaacaatgcctttgattcctgaagttgtttccattgcacttcttgatggataattcgacgcttcccctacctgtcgcgccaactgtttaaactggaa

SEQ ID NO: 105291 - DNA, 599 bp, Oryza sativa
gttcaaacactataagcaaacttaagatccttttacattataaaacggagggagtagtacgatggttgagagaccaagagctgcacgctaactgctgccggtccattcgagaccatttacatatgatggtcttgtgtggaggagaatggccctgcaggcagaaattccggtgcttgctgacgtcgatcaacagtataccactcgtggattcatctgccgaattccctcatctccctatcccaactgccccgttctgacgttcattccagtagcgttcaattagtattagacttccctatgctcactcaggattaagactccatgtacttcttccctgtgtaaaaaaaaaatccaattccatagatgaataatctgaacatgtgttcatcttcagagttagatatttttgtgacagagggagtagaagtactacaagtactaatcaatacacgcacatttttttttagatcgacattcgaaaggagtactaaaaatatatataaataaatgaaactattcttcgatcaaaacaatatttaaggtcagcaaaaaatgacttgtaggataatataatgcaggttagtcaggtatacgtacgt

SEQ ID NO: 105292 - DNA, 575 bp, Oryza sativa
tttgctcgcttgacatctattctttcctctcaggaaccaccaaggagatgtcaatatagagaatggatagacactagaagggttctaactccacctagccatgttgtgcagcttgaactaccagagcaatacagggttactaaagcgcggtttgagagaggagagggatcctcacgtaggggttagctattatcggacaacttggcatattgaaatttctactgtcatgcttccttgtcccattactgcatcgtcgttgtgttcaactattgcactacctccctcctagttcgaatctaatatcatctatgtaaccgcaatggaaatagttgtatcatgttcaaattgtactactatttcttcatgttacataattctccttgtttaagtccatataatgtttctacgaccgagactgcgataggcctatattaattatccgagtactgatacgtcgaataaggtacaaaataatacctcacttaacatatgaaattgcgaaacaaccaacttcaatacatttttataacaatattaacaagttttaccaataaatacttctttatttattatta

SEQ ID NO: 105293 - DNA, 935 bp, Oryza sativa
actggcactactggatatttccttgacatacaagttaacataattcccgagtcatttcctaaacatattctatctatacaagctattacctataaccagtcggatatacgtgccatgtgggtatgtggtacccaactacccataatctccactctgtgtgtaagatgcatcccttcatttgtaggagtcaagtcactatctttcttcttgtgatttcttagagcagtctttgtcacatccttattttcgtattaggatttataaattatttaataaattattattaaaatttatattaaatgtacattaataaacaagtgaagttaaatgtgggaaataaaatttcctaaatataaagcatggatggattaaattttattaaattctacatggttaattatactctctgaaattttctcggattttttagagctcaattactaattttaataatacaaagaacattttaggaattatttaaatattaaattagtcattaaatgatcttatcttaagtttgttaaatactctaagtgtccaagtagttgcgagatttttcttgaacatatttcagtatttgaagtatttttaacaattcaaatatcatttcagtgattaatttagttggaaaagtaattaaaatcctttcgaaagctcaggtcttaatctggcccatctctccccttcagcccagccgatccagcagcctctttctctctgtcgaagtctgctttggggctatttgggggagctttagattctgagaagcagctgtttggtagccagcttctgagaatgtggaaaagctctgaaacccatcttctccagcttttggcttcttagttcatttttcagaatctgtaactacagattctcagaagctatggacagtttgaggcagcttctaacagaagcagcttttgggaaaagctgca

SEQ ID NO: 105294 - DNA, 667 bp, Oryza sativa
ccaaatatgtatttatcccacggtaccaatacaagaccaaaacgaccataataccgttacttgctgagatgatcaatgtttttttattccttgctagcaggttgtaatgcaattgtcacatatttgtagcttactacctccaaaatgtttactattcggtataagtgttgtatttggtgcttactacaccctcatcccaaaataagttcatgtttcacacatctcacaccaatacaaaacaaaaagaccacaatacaatagttttctcaaatgacaatgaaattcttgctaaaagaattaatgtttttttattccctactagcaggttgtagtcctattgctctatatgtgttgcttagtacctccgtatgtttactatttggtataagggatatatttattgcttattacaccccgctcgtaaaataagtttatttctcacacatcccacacatagcaaccactatctatttaatttatttatctattttttcttctcaaccaatcacaaacttcatccaattatttttgttacttctttaatatccatgcccacctaatatttgaacggagaaagtatctattttgtgacaaagacagtatccttttcaagagttcattctggaagccctatgccttatcctatataaagcagctagctagctag

SEQ ID NO: 105295 - DNA, 662 bp, Oryza sativa
catgagctgctgcccggtagtcgagatgtcatggcacagggccggtgtcctgctgctaggggctcaaccttggttgcccgtctcgggaatcccggccgtagccagggttaggtcggtactcttgtttatggctaggatgggttgggaactatgtcacgtctttcgtccgtatgccgtggtggtatgtggcgcgttgttagacgtgaggaagacgtgtcttgtggataaagatttacacctctgatcagagtataatctattcgaatagccgcgccctcggttatgggcaagcctagcaatgtacccaagttagtggtttacttcttaaaatttgcttaacaactataatgtggaatggttggcctgggttggcttgggacaagctgggacctagtcgggttgtcagttcggtctgaatcatcgtaggccttgggttaaggcaggttcgtgagggttcacggccttgattaataacagtgtagctctaggatcgtctttataaaatggctttgggcaactaagtgacttttaaatgctgtttactgcaaaacttaacccctatattattaccccttgtacccccttgcattaatcatgcatctcccggtgtggcttgctgaatactgtggttgtactcattcttgctctatcttccctcccct

SEQ ID NO: 105296 - DNA, 658 bp, Oryza sativa
aggaagtatatatatgctattcgtctcgtacattttttttctcggactgttaacgcattaaagattgcggcacaaagaaaatttattagtgtcatttctcgaaccacacccactgataataattatctcgttgaatctattgggtatatatctgtcttgggctgttcgtgtgtcagattatatatactacattcgttttttacattcgttttttaaatagatgatgccatcgaccctttttatatgtttattattcgttttattcaaaaatttacgtaataataatttattttgttgtaagttattttattagttaaagtactttaagcatgcactactaaaaagggatttttttcaaactgtcaaaatcaattgcggttcgaccagccgtctgtccgaaatggtccgtgaaatagcaatttttccatatggctcacccgcatgcgggcatttaagccattctcatgtgaaaatggaaaatcacaaatattaatctaaaaatcaaaacctgaccctaatcctaaccctagtcggccaccaccgtcgtcgtcgacggtagtggatctgcgcgcgtggaggccggatctgcgccgccgccgccatctgcacctgtcgccggagcccgtgcctgccaccacaatgccatctgccgcgcccg

SEQ ID NO: 105297 - DNA, 693 bp, Oryza sativa
aatacgatacccttggaatactcttgggtgaaatgctacaatggtatatacgtgtgcttgcggataaactctgtaaccataatatttctgcagtaatgtagtaagaaataccaacacacggcaataaagtaaaatttaagaaattgtgcaactctaaatttaccatcaccacaagtatatcactagcatacactgtatttgtttttgaccctatcggcattctcattttttttcaataatttctcttcaattgagctgaaagtgtcctccagtaaattactagttattcaagtatcttttagccatgacacgttttaacagtatctaatttcaaattacacaatgtttgagtgtcctgtagtaaattttgccatgacagaatcaacacatagcgaagagaacgaatattttttttttattccttgctagtatattgtactactattttgtgacatttcttgcttagtacagaccttttagtatttattattggaaaaagtatgaattaccccctccctccgaaccacaaaaccagacatattaaacctcaaactattgaaaccggacaaattaccatcctattagattcggagcggtttcaatcctacaaggcgttgacgtggaaatccaatcagcaaaaaaaaaaaacagggctcacaagtcatattaattcccatttaccggcactgttgg

SEQ ID NO: 105298 - DNA, 625 bp, Oryza sativa
ccgtggtggtatgtggcacgtggttacacgtgaggaagatgtgtcttgtgggtaaagatgtacacctgtgatcagagtataacctattcgaatagccgcgccctcggttatgggcaagccgagcaatgtacccaagttagtgttttaatccttaaaacctgcttaacaattaaaatgtggaatggttggcctgggttggcttgggacgagctgggacccagggtcgggttgccagtttggtctgaatcatcgtaggccttgggttaaggcaggttcgtgtgggttcacggccttgattaataatcttgtatagctctaggatcatatttacaatatagctttgagcaactaagtgtcttttagtgctgtttactacaaaccctaaccccttatatgataacccccttgtactcccttacatttattctgcacttgtgggtgtgtcttgttgagtacggtggttgtactcagtcttgctcaatttttcccaaacccagaagaggagtttctggaagatgaaggctttggtgtctagctcgtgcctgccgtcaagcgcctgtggtcgtcgccctagtctttcgctgtttcccgtttgtctttgtgtgctgggccttcgccgcccatg

SEQ ID NO: 105299 - DNA, 1568 bp, Oryza sativa
gatccggtaagcacctttgttagttaatttcaccattagttgtgatttgttttcatatatgtctagtcaaggcagccgtggcggcctatcgctactaccagatctccaggatggtggtgtgtactgttcttagtttatatatgaaattctgaatcacagatccacactcagatgagtatacactatttcttattcttcttccttttaatctctgtacgtacacgtagataaaaattaatcctagagttcagaatgaaaaatactgtgatttggatgaaaaaaatgtcatcaacagatggtagattaattgtcctttgcatgcgtgaatgttgttccaggatagtggtttgtgatggatttctttagttccttgaaatttgaatgaataagcccctaatctttttgttgcttgcaggtggtgtccggccgcgccggccgtctgcagaacatgtcgactcaacgccacaatccaacggcaccagcggagagaatatacacgcaaggggaaggatccttgtttgacaaactgtgatttggatgtacattattacttttcaatctgcgattcagcatgttcaatttgtgttcttgatcatgttttctcgtctgtgaggctagttcttttggaactacatatatctttgagaatatactaaaacttttggatcataatacgtgcatgcagcacgaacactgagttctgcgacagggtaaaagcaagtaataaaaatagcatatatactgctactatcttaaaaaatagcatatactgctactgctaaaaatggtatatactgcaattatcttaacaaaagtataaacctgcaccttaaaaaggtatatgttactaccaccttaaaaagaagtatatatgtatattgctaccacctaggaaacagtatatatactagtcttaactgaagcacagtacttaaactactttggtgaagcacagtactaagtaaaaaaaagaagtatatactattaaaaaaaataagtatatactgtcataaaaaacacgtatgtgggatatttatctgtatatatttctctacatcaaaatgaagtatatggcagctgcctataaactgctgcctactacaaataaaaaaaaacagtatataccgttgcttactaaaaacaaaaacagtatatactttcatgcagaaatggcagcatatacatagctaggaaatatactgcacgaaaaaagagtataaactgttacctactactaataataaaaaacagtttactaaaaacagtatataccctatatgggctcttctggccccagcttcctccaggagacttccatgtgggcccctaaatcagtgacatacattctaggcccatttgtgattgttaaattggacttttgggccttctcatgcaattgcagatcaccagcagactttcgactgattgattgatatatttccacatccttctcttcatttatgagtgcttctcctgcatacatgttagtagcatagcatatagtggaagtaattattttatttgggaattatgcattgcaaccataggtagtcttcatatattggata

SEQ ID NO: 105300 - DNA, 704 bp, Oryza sativa
caacaagtataataaataaaataatgtacttccacttagtaggtagctagagagcatgcgtagacccagaggttggtgcttaggatggtggcggccacctcggcgaccttcacctggttgccctcgaagaaggcagcgtaggggaggagatggtcatagcagaagctggagccgtcgcggtcggcctgcagggcggtgtcgcagcaggagcggacgaacgctgccgcgtccgcggagggcgcctcccctggcgccgccgcaggtggcagcaccaccactggcttctcctccttcgcagcggccgcacatggtggggataagccgccggcgctgacgaccatcaacaccacgaggacggtggccatgctcgagctcgacctgctcatttctgtatattatttatctctctccctctctctctctctctctctctctgcttgtttcgttactacaggatgaattacttcataacaacgaggtacaatttatactagtaggctcgattggtcgttaactaattaaccacaacctttctttctaatttattcaatggctgttctagcatcacggcatgtctttttggtgttgtgatgtagtgccatgcttgcaattataaactactatattaatgcaactaattgcccatatatagacagcctgctcgctttttgtttcatatccattcacttaggcgcctagcattg

SEQ ID NO: 105301 - DNA, 1457 bp, Oryza sativa
tcttcttcttcctttgtctccttctattctgcactagattccccagtctctttccatattatattgagttctcattgtattcgatcttgtggtagtttgtgtgattcgatctctcacgaacttgggtcataacaattggtatcaaagccgttccgatccatcgtctcttggtctgagcagtagatccaagcaaggttggtgtttatccttagcgccgtgattctgttccatggtttgagcagcgagaagatgagtgaagacggtggttgtcatgctcatggagacggtcatgtatgctttgaacaacacggcaagcaccacaaagggtaacaattttggtgaagctttgaaaagttagatgtcatgcttcacaaaggaggccatgtatgctcgaattttggtgaagctttgaaaagttagatgtcaatttggaccataccctcggttgtgcatcctcttccccagccggcctccgatgtaaattaatgcttcaccagcatcctcggatatcaccagtaatgtgaatggttgcaggagaaagaaagattgaggagattcagagagaatatgatttaggggggcaacgtagatatttcacgtcatccgttcacactgggacacctaagaaaacaatattaagaatttagaggttatatctccattgacaaaaacatctaaggccaaacctaaaaatggacattttcaaaagttgtcggtttttattgcgacaactagtggaaattcccccttggctacaacatttccactgttctcttttttttcttcttctttcctctctggctcagttgctcggcacatctgttattttaatattttttaattcccagcttgcatcagtaaccacggcagcaacaaacgaagagtagaccaggcagcaggcagcagagcacaaagcagcagcagtagaaaatagcaagcaggagcagggatgggcagagcaaaagctagcgggggtggaagccagctagagcagatcgatccatctctttacgcctcttttttatccgttctccctttatttatttttgagagtgaatcgaacattagtctagatatcttaaccatgtactttcgtatcggatcagggacagtggcggacctaagatttttttatcttgggtgtgcccacgtaaaccttagtatacaaattgagtatttcattaaggttttaatctgaagatagaacggtactagagaggtgaaaaactacttgatgaccttatctaggctatgtttagttccacgataaaattgaaaatttaaagaaattaaaacgatgtgacgaaaaaattaaaagtttatgtgtgtaggtaagtttggtgtgacaaaaagttagaggaagaaaaaagttggaatctaaacaggaccctaagtcttgggacaaactccaagccccagttgcttgtcctggctgccaatgacccaatggccttagg

SEQ ID NO: 105302 - DNA, 1291 bp, Oryza sativa
acaagttttctgaaaaccctacttgcaaattgtctcctctcgcccttcggcatttctttgtgaaacggtttttcaaaattctcctcccaatctctccaattcttttagttgtcaaacctagaggaccagctgtcagcttcatgtctgttcggaagtcaagtcaattcgagcctcaagcttcgtgcaaggagtgagaagatcagttcagagtcgtcgttctgcgaagatcaagtggagttttctcggagatgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacaacatatcagtaggcaagtggtttagtaccttatctttagcaacccctctcttccacctctcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagtgtagcggaaagaactccagcagtagtgtgttgcagtcaagagtcagtgtgtccatgagctaaatgagagtcacttttatgtggaatttcctatcatcaactaaggcttaagttccaaatcttgtcgggatgaaagtgcatcgccattgcttcaatttgatggaccgatgaagtttcagtcttcaaagtcagggcatctgtaaatccgagaaatgttggtcatttttttcaaggacaatagttcaaaagttctcagtcaggcgaaagtaagactacccactgtaaggggggtaggtctcagagatgagttttggtttacctcgtcggcatttcacttgaatgttcaacccagtgcagcaatttggttagtaattaaaggagtccgttgcgagccactagcagagtctcccaatctcaagtcaacaggttcaattctaatgtacacccttgaggccaggtcaacagttcagcttagagaagtagcatcgaggatggttgcagttcagacgaaagacaggtcaagcaggttttcctggaattacttgttatttgaattgggaccagtcgaagcggacatagggtaaatgatttataaatgccagattccattttcatcctcttatagccagcgtggtg

SEQ ID NO: 105303 - DNA, 2072 bp, Oryza sativa
gatgaatccacgagtggtatactgttgatcgacgtcagcaagcaccggaatttctgcctgcagggccattctcctccacacaagaccatcatatgtaaatggtctcgaatggaccggcagcagttagcgtgcagctcttggtctctcaaccatcgtactactccctccgttttataatgtaaaaggatcttaagtttgcttatagtgtttgaacattcgtcttattcaaaaaaattttagaattattatttacttttttatgacttactttattatccaaagtactttacgcataacttttcgttttttatatttgcataaactttttgaataaaacgagtggtcaaacactataggcaaaaactcaaaatcccttatattaaggacggagggagctaataactaattagcactgtacttgttttggaagactcagcgtacgtgcttcatgtttatcatctgccagaatctagcggcatctttttccttgcttaccacgagcacgtactgtacgttttattttttaaaaaatcatgtagaagtccttttcaaaatcaaatgaactaatttttaaaatttctaacagttaatatttaattaatcatgcactactagcttccctcttgtttaatttcatttggcaccgacttatcaaatcctacggctctatcaaactaagggtatcaacaatgtattatttaccaactactccctccgtccaaaaaaaacgaatctataattagatgtgacacatctcagtacaacaccctcattttacataccttcagtacaaatctggacagaacaatacatcccttataccaaataataaatattgtagtacataccttctaaaataagttcattttacacattccacctaccaatgtataaccaacacaactagaatacccttactttcttaaaacccaatgccattattccttactaagagtaacaatgcttttttattccttcctatgaggttgtagtgctattactacctgatattagttgcttagtaccttcacaatgtttactaattggtactataagagatgtattttcgcttactatacccttgtcccaaatatgtatttatcccacggtaccaatacaagaccaaaacgaccataataccgttacttgctgagatgatcaatgtttttttattccttgctagcaggttgtaatgcaattgtcacatatttgtagcttactacctccaaaatgtttactattcggtataagtgttgtatttggtgcttactacaccctcatcccaaaataagttcatgtttcacacatctcacaccaatacaaaacaaaaagaccacaatacaatagttttctcaaatgacaatgaaattcttgctaaaagaattaatgtttttttattccctactagcaggttgtagtcctattgctctatatgtgttgcttagtacctccgtatgtttactatttggtataagggatatatttattgcttattacaccccgctcgtaaaataagtttatttctcacacatcccacacatagcaaccactatctatttaatttatttatctattttttcttctcaaccaatcacaaacttcatccaattatttttgttacttctttaatatccatgcccacctaatatttgaacggagaaagtatctattttgtgacaaagacagtatccttttcaagagttcattctggaagccctatgccttatcctatataaagcagctagctagctagctaaagcaaccatcagactaccacactacaatagtatcagtgaactgctagctgttgccctcccaagggaaatatactagtatgtctacttccatccctctccctttcttcttctctcatggtgttgtgcatgctaggacaggccatcctccaatctggccgccggttgggctcctttctgctggtgccccggcaaaagtctccttccgacgacaaagcaatgcgcatcgacatgctgcacaagttgtgtccacacaatcaatcactcctgcgaaggaggtgtctagctttgagccctctgtgtggggggacttcttta

SEQ ID NO: 105304 - DNA, 503 bp, Oryza sativa
atgtcccacggaacggtcgcgcgggcccgcaatggtcccaaaacgcgggagcgaactggccagcgatttatttactgagtcggcactgtttgacaatgtttcgggtactgtttgccactttacatcactgtttagacctgtttatggccagttccgcacattgaacctgcggtaccgccttacaaaactgtgtcaaacagggctacacagtgtccatagtgctaaacaacgttaaaaatcactggctgcctcgctcccgaattttgaacctgcgggaccgtcgaggtcccgcgcaaccgttttgtaggatcgtcggtcatgcgttttggagcggtcacgcgttttagagctgcgggaccatcacaggcccgcgtttccgtcccgatatttttgcaaatcgtctgatgtagatatataaatgtaagttattaaaaaaaataagtatattagcaaattttttttctttaaaaagtttgcaagcactcattgtagaacggcacata

SEQ ID NO: 105305 - DNA, 691 bp, Oryza sativa
aaatttttgatgcaaaatttgttgtattcaagcctagagctgggacatgggctgtgcattctggggccgaggcaggcccagggaaggcagcccggcacaacgaaaaacactatagcctcaggccgatttgaacctagccgggcagttgggccgtgcctgtgcctgaaaatttggcacgatggctgtcatgttaaagtcctattttggctccactatgatctggaatcatagttatgaggatcagaccatacgtcaaaccgttgaagccctcgatttagtgttcgctcagtctgaccggttcgaccactcgttcaacacgactcaaatatactagtactaatggccgtccttgatattttttttgtctgaactctaatgaaagaattgctttcgcccacacgtttcctaccaataacacgagggggaatgtgtttttcttttgctgtagggatgtggaaggatctacttgcaaaaagaagtttcatgaaggaccacaagaagattccaccgatgcaacaatccaacggttcgcatcatctggagtgaagatctgacgacctttgttttagacgtggacatggtaactttgcaataaaggattcttctttcacttatttagattagcgatttcaattaaattgtcaactgatacatagctcagtggtgtaagacaacacctgggccctaaggt

SEQ ID NO: 105306 - DNA, 500 bp, Oryza sativa
ccgactaacccacaagcaacaaacctaagcacggaaactagcaagcaaacaaaactaagaagacgataaagctaagggcggcgactctgaagcttggagcggcgcttgcgatcgaagaacatgtctgacttctaaggtagacaagggataggaatcaatgcatgctcaaatccaaatttaaaccaagcaacaactggcccaaacaactagccaagcatgatgatttttatgcatagaacatttttcatgaacccggataaagacactaatgcgactgactaaactatagcttaatgcataaactagatgcatgaaaaatggtgcgcgtaacattgccccatcgaacatagacacgacctaatgcatatcacccgataaattcccaactgactgtcaaataaactccaaataaacttttaccaaaccctagactgtccctagtcgagaaatccaattaaataagcgaccaagatttttcccacaaactcaaaagaacaaaa

SEQ ID NO: 105307 - DNA, 1331 bp, Oryza sativa
aattgttcattagctaacagaggtatctaataacctgtaggctagcacctttctcatcaatacaaaccatagtggtacttttttggacaacagtagagtaaaatgcctaaagttttagccaattctgaaattattcttctagagcagtagagaaaagtggtactcagactgcaatacataggtttatgctatttttgttttggtgcagcagatatggcaaggagtagaaggcggtgcattgttcaaagccatgaggaatatttgtcagaggaacacattgcagaagaaaatgcccctaaacagcttgccacaccatctgaagagaaacaatatgcagtgatgttcaagagggtaatgaagatactgatgacgatgttggagaagtcaatgaagatactgatgacgatgctagtatgaatgctggagaaggcaatgaagaatctgatgatgatgttaaaattaatgttcgaggtaaatactaaatcttgatggtaagaaataatgaaattattcttcttatcctggactgttgagcatcacttttatctttgcaatttaacattgaacagatgaaaatggaacaattgaaacacgtgggaagacaaaactgaaagatatttggaaccttccgaaaggtcttaggattgtggttcagtgcaatgatctcaatcaggcagtaggagatgaagctggaattttgtctaaatttcttggaatggtagctaggaatggtactttgtgtagcttaagctacacagactggagatttctaataggaaagagagagagaaaaaaaatgaattaaaagttaaaaaggacattcttaaacaaatatccatgttcaggacaaggttttgcaactaccaaccaagcaatctactgtagataaggtcattctcttcctatttgttatgtcgaactcactacatagcattatatgatctcaatattgtttgcaactgtcaacgtttattgtagctgttcattacaatcttatgtcttatcttattacacagcaatcaaacttatggccaaaatcaccttgagaaacagaggaagattatttgtgtgaaggctagtcttcacttttttattgattggaactgacagtgtttgattataaaaataactagattattgtagtttgtgccaatattttgatattccgtgcagaataaaggaaacatgaaccagaatgatcacatgcaacaagggaagaataattctaatgcttataaggtaaattttcacttctggagccacctaatataaagataagctatagaattctatttggtataatatgtttgtactttatagttaaattattg

SEQ ID NO: 105308 - DNA, 502 bp, Oryza sativa
ccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaaacgactctaaaatacatcctcgaaattgtgcaaagaataattaaaattcatgtgaaagcctccaacaattaaaatgtgcaaatataaaagtcaaataaggcttggaggatttttgtatatttcctaaaagcctaaaatgcgtaaataaattttagtggaattttcagagcacaaataataattgagaagaaataaacaaagttaaaaaggtttataaaaagaaaaaccctaaaagaagtcttctttcccccccttcccttcttgggccggctcggcccaacttcctccctccctctcctctcccccgcggcccatcggccttcccccgcgcgcgcgccgctgacgggcgggcccgccc

SEQ ID NO: 105309 - DNA, 977 bp, Oryza sativa
ttcttgcatgatgtgtgtcatccttgttttatttttttgttaatgatgttaggtttgactaaagtgtcaaacccatcacattaattagcaagtaggagtatcatcaacgaggaaagggttgtcctttggaatgaagaggttaagctaagcttggcacataaaggcagcacagatatgctactagctcaattatttgcatgtacaagatggtctagactatagatgattatatattaatacttaagctatgcaggggaggaggagaaagagggttagcttaccaaacaaaagcttcagccacaaaagattttacaaacaaatgggagaattattttgaatgccaaccaatctgatcttccccaaattaaacacacccatctacatctccaaatcctccatggtataagaaatacatggaaattctgaagagcatgggcaggtatactgtaagccacttcaaccttttttctaatctgaaataccttcttaattaatcaacaaaatacttaagtcaattcaatggagacgaggattgtagtagactagctaatccaggagtatgccttatattttcaataaattaaggttcgccctaactgaaatgaaatcatttttcaaaaatttaaaatggagaagccagttgcccactatgtgtacagttgcccactatgtgtacagtgcaattagttaattggcaaaaataaccttgctgaggtgatctgtatatttattttatatgattcaaaccacagtacgtaccaaaaagaattctgtaagggcgtcacatacgttgaatttctctgaccgtagtaagacttttgaggtactacaaaacaacactatcattattttacttaatcttcaagcatatatggatcattaaagaaaaccacaattggattagactttgacatgcttcaattatgagaagacttgtcaccacaaaacaacaaatgacacgtacatagctagcacca

SEQ ID NO: 105310 - DNA, 1724 bp, Oryza sativa
tttctattgaaaagccatttgtatttttctaataaatagtgaaaagtgaccggttttaaagcttatgttgtattttagactccaatgaaagtatagatatacaacaatggacttctatactatctataaatttgcaaaaaaaatcctataaagatccagtgaattttatgtattccaatgcaggccttattatactatactcctagctccaggggagcagccaaggagaaaacaatgagaccatcttaatttacatatacaatcgtcttaatataaggcagaaaaagaaacatcgatgatcagatgagccgcatacaactttgacataaataaatattttttcttaaagaagcacagcacttgcccatgtatagggaaacaaaacacaggcggcgcatgaaaaagttgggggtcggatttgattaattcgacaaggaattcttctggatcttgactagaaagtagtttgttgacttgcttatcactacgaaaagacgatttagtcttgttcgagcagtgttcctctgcctagctagagaacaaattaaaaatatcaaaattgattccagattctgctccggctttttaagtacacctagctagctgcgaacaaagcagcccaattagaggcgaaaaaaggtccttgcatgctggctaaacactctacagttgcagatgagcaaatcatcttccaaacatccgttcatcatatctagttatgaactatcgacgacaaagttaccatgatcactgagaaaatgttttttttctccctaaaagctatagacaaaacatggattataatcaggtctagatctaactagtacaattttttaaacaaaaggataattaacttccgatctactccctccatcaaaaaaaacctaaccatccatttcctagtataatgaatctggataatctttaggttgatatttgtcggtacagagggagtaattaagaatactacgtgtacactgaaatttaaaatttaatgagcggagtacatagatagttagatatgtacatccgacatgtattgggcaaatcgtttggtagaatacaaatgagaccgtacaacaaaaacccgtggtttacttacttttggcacatgtacgtgtgttcggtacctacaaggccaacgaggataggaaatcgaccgacaaaaccgtggattttaattgcaaaggctcgctaccgtccgtgagcgccaccggacattcggcgccgccataaattcgaatcccggtatgcaaactcaaaccgatatcctactacgatttcatttcacgcagttttttttttcaagtttcaaaatccatttggctccaaatactacagctactagcgatttctcgatctggtaccacttgctactgtacgtcttgcaacaatgtggggttcgtttcattcaagcgtacgacgacgtggcctgtcagatcagctggttgaaggggcttgaagtagtagagtacgagtgagtacgacgcagttgttgcctgaaaagttgaaatactatttctgctcttctacgaaacgtgcagtgccggtagttgcatgatgtctacgtgcttaattggagtattaaaagttgttgctgctgctgctgctgttgcttgttgctttgctgtccctccgtgtattctgttcttggaggaaacgacggatcgatcgatctgcggagattaattaacgacgatcagtacagcgagagattaactaag

SEQ ID NO: 105311 - DNA, 595 bp, Oryza sativa
tagcgagggaagaagagaagaggcgccgccgcaggaccggtgctgcatttgcatcgatcgcataggcatgaagtcatgcaagcgtacacctacgcggtcaagtgaccagctgctgctgctgtgcacacgcagccgcagtggttcgccatgaatgtgtctgcagcatcatcactcatcagcgagcaggaatcgagcaaccgaatgtgccgtctcctttgcgcgtggaaccaatcccggaagatatgccatgccaggccgttttcatcccatctcattcatcggaccctgacctactgacctcatcccaaattattatcaaactgtttctgttcgcgtacgtaggcccctggttcatatggtatacctgtctttaattttttttaaagaattacgcagtatactcacaacacacgcatactcacccctatgaacgcacgtgcgcaaaccctcataatgcacgcacactcaccactgtgagcatcttcgaagatcgggccaacaaatcataaagattgacgaagtcaccgtaggcgcctcgctgtcgacggatacgtcgcctaccactgaaagcacgagaccgttaaatcctagaaaa

SEQ ID NO: 105312 - DNA, 676 bp, Oryza sativa
cagcatttgggtgcaatgtttttggagcttggtcgaacaatgatgatgcttcggatggggccatcccctgtatgcttaatttaaattctctattatagtatttaactgatttctgcatgtgttaattcataacgcttcttattttggtaggctgatgcttttgtcaatgctggatcttctgtttatataaactctgcaggaccgaatccaatcatggttcaggtgacatacattgagatgctttctcatgttgactttaattgttgtgccactttaatgacaacacacattctattgctctgcagccatcttttcaaaatactcctccttttggagtttcgagcataccagtcctcggtggaatttctggtgcctttggtattgttgatccttctcgtacatctgctgtcaatacccatggtaagatcacatttcaagttctcttcagtggctctgttgagtgtactcagctgagtcatgaagctaccatttcaaatccttaatctctactgagaagttcaaatggttatggttatggcctatgattacaaactattacactaataggttagtaggtaaattatctgttagttatttcccttttttttttcttgaacacgagggagttcttccctatattacctgcttcgtcgtgatttacctctaaccagaactg

SEQ ID NO: 105313 - DNA, 865 bp, Oryza sativa
aagatggaacacctcttcccctaagccctccgacgtggccaacttctaaaaactaagacgccaccacaagaggatgagaatctagagcgtgcttgcaccaattgctcgggtggtttcggcgaggggatgcctagacaacgtctccaaggagataagcgacggaacaccgccgccgccatccaccaaggtctcaaaagggcagagaatgacctttcgcccggcaaccacccttgaggggtgagacggcacgacaacgccctcaggagggggaatgacactcgagcaccatcgttgtcggtccgagcaaggacgagctgggttttcacccgccgtccaccacctgccaatctaccacagatacaccaatgctccaccaccatctagacctccgccggtgcgtgggcacactgcaccgacgccctcccccggccagtccccacatgccaccacctcaccgggctccacctccaccgacatcacctcccgctgcgcagccatcacacactggccgtcctcgacgccgccggccacgcctacacgcgttccaccgttgccggtcgcaactccttcaccgtgtcggttgtcggctacgtctcccagcctcgccggccatccacagccaccggcgcccgtgcatgccgccacatccgccacgggtggcgccgcccatgccggcctccctgcagccgccggcaccacccacaccaacctcccgctgcaatggcgacgcccaccgacgcctccacggtgccctgactgttgccgccggtgccatcctcgcgcagccgctagctccgtcgcgctgtccacgccctctttccgtgccgtgtcgttcacagctcttcaccatgccgcgccgcgccgt

SEQ ID NO: 105314 - DNA, 658 bp, Oryza sativa
aatgagtaataaagttaaatttttctttaatatatcatcacaacacataatagataatatgacaatcaaagttatcattttcaaccaataaatagttcaaaaatgtgcaatttttttgtatatgacctattctattgagtcaaaagagctcacgagcggctcgtgagccagctcgggcttggcttgtttcggaaacgagctaggaagcagtcttgggcttggcttgtttggctttcgagccgagccgacctatgcgagcctgaaccaagcttgagccgagctcacaaggccaaactttttgtccacccctaattacagatggcctgtcaaggatgaccgaatttgtagcagtgatggtggcacaccatctatatttatatttatggggtagtctgcgttgcagagattgggacatcaatcttttgcatataattacagctttaaaaccatctataacctattggaacttatatattcaaattcaatagctattcgaccaataacaacttctctcttcgtcccaaaatataacacttttacgatttagaatttgtcacaaaatataattacgtatccaccaatattttcttcttgatcaatcacaaccctccaccatttaattttcccattaccttcacttctcatccaatcacaacat

SEQ ID NO: 105315 - DNA, 1282 bp, Oryza sativa
ttgaagggtaacccaaagtgaaatactggtaataaaaggtgacccaaagtgaaatttactctttttttaaatttttcttttcactttcccctctcctttccaaattccgaattccaatccccaactgtgaggtggcggcatttggactgaaaaaaaggggaattagtatggtaagatataagcgcctatggcattgatagagtgtggggatcattggcgaaattcttaatgggcgggcgatcgatcgatcgcctctcctcacgaggggcctgcttggcacagctccagctccaactccacccttcctggagctggagctcagccaaacagtttcagctccaccaaaaatgggagtgtagctgggtggagctctcacaaaatgaactagagttgtggagctgggtttaggcagctctacaactccacttcagacccaactcctggaactaaatttaggagttggagttgtaccaaacatgcacttggttttcttttttttcaccgtattacttttctattttagtaaatttatacacctaaagtttgtacgcatctaaagtttatacacctaaagtttagagacccaaagtttataagttaaaagtttatatgcctgattcaaatttgaatttgaattcaaatatgtttttttatatatattatttctatacatatataaagtttatgcacctaaagttcatagacacaaaatttataatcaaaagtttatatacccgattcaaatttgaatttgaattcaaatattttttatatatagtattttctatacataaagtttgcgcatgcgaagtttacggtataaagtctgtacataagtacagagtctatgcacataaaataagagtattagattttttttctattttaattttttttctagactttgtttttttattttttaaaatttatggtgtagtagtaagagaagaagtgaggaggaagggggagaggagcgtgtaagagggatggggggtgatcgccccagcgatcacatgcccattagggtccccccgatcattggtgctaagatatacgtgagattgatgtaaaagagaagggagatatggatttttatagaggtccagcccctaaactgacaagtaatacccttactccttattagctgaagtcggtgttgcttatatatagtaggggcgagaaagtacaatatttaggatgatctaatctactttatgcttgctcgaatatgaacttggcgagattggaggtcatcctagatccctcttgtcgacctctgtag

SEQ ID NO: 105316 - DNA, 3122 bp, Oryza sativa
actgttcatatatgggcacgttttactgaatttatcagggcaaagatggtctgaaatgataatgactaatcaaccatttccttgtcattttgtgctgcttcagtttattagggcaatttactatcaactcaagcatggctttcagcacacacaggataatagaagtggtgaggaaatggggaattctctgttcttagatgaagcatggttttcaagagacatatttctctatcgtctttctaaggtacttattaccatcttttgttgataaccctacaaaatcttcttggttacaagatatatgcttactgtttaaggtaaatatttcctaaaactagttgtatgactaagaagaaacattatataatttttaattgtgtcaaatacgaaaaatcaagtaatggtaatattgatctctagatcagattgtacatcttgaaacaaccacaacaagtcaccactgtccaacactggctactgatcgagtcatttttcgtattttagttagctcctaccagatatgtcccaacagttagtaaaacctcatctctcctctatcactgctcttttcatttgaaactgtatttcacccttatattgattactccataattgcatttaaatgggtccttaagcaattgcaatgaatgcactgcttggacctgaagtaaaacgattttagcttcactgtgtatagttagcagacatatcctggattcaattagttacatgtttactgtttttaattgttgtgaagacagtaagcagcagcgcagtgtgcctattcaatgctaacttaagtttgatcgtccatttgggactcgtaatgcagaggaccctaacattcgtacatttttaaactcgaggactattaaacacctataataatagtaaactcatcaaggtagaggtgaatttgcatatctggaaaatgtgtgaatatattgttcagttcatttgacttcatgatttattttggaatcattatatttaatcatgaccaagcatgatttcttatcgcatatttgaattatggagtaagaaacagtttgcttagaagcacagctagaagctgaatagcttgttctgctattgtcaggatttctttgcggtgatacttgaagctacagttgttgatggtgaccttctgtcatgggtgggcattcctataccttctctctcacatttacacataccacataagcaattctgtagcccatgcttgaattaccacatttagactgagtttagaacttcatactttctctgaaaataccctagctggactagtattttggttacttcaaattcctggtttaatatccacaaaaccacaaattatggacctttgaccagttattttgagggagttatattttcgtgcacttgaatgattggtctgtggttgccgtttatatgaacagaggagagtaatatcagagaaaaatgtttttttattttattcataactagagtacgttgcagacaaagtatgctgcaaattcaatccattgagcagccagcctcattatttctgtagaaaatttatttcagctttattattgtgtaatgttggaataatatcaaaagatgtttctaatgtttacctccatatattcagactcgaaaactaaaatcacttctggagaccacatttggatgggatcttgacaacaatacggtgaatctaattgatgaagatgatgaggtaaatttggatcacgattcatgatcgagtgatagcatttctttgctgcactcagagtgaaaacattcttttcatctgaatgcagtttgctcctgtggtcgtggaaatggatgggtcatagactcaggtggacttttgaagccatattcaggtttgttgacaatttgcagtttcacccttctgttcagtcatccctatatcaaatttcttggtttcctaggtttactggaatctcattgtagctagacttctgctcgtagtactagcataaaaaaaatgcactgaaatgtttactatatgtatttctaggacatctgatccgactaacactggacttgcttaacagctggctacttgatcagtgatggagatgcatacaagattacaagtagggctttcttggcagtatgtatcctggtttcctaaattcctgtttgtaaatatacgaagaataatttctctttgcactaagcggtctatcttgtactagtacgctatttaccgagccttttatcttctgcagcgaacggcagttttctctatggtttgttctagtacttccagtaaagttcttatcctgttacacgagttctttagataacagctagaaatatccgtaaaataccagcgcttccagggtaagatagtaggggtaactttacagtggaaaccactgtttatatgaaatccagtcaccacatcatttaaattctcagataattgaaatcacagtgtagacagccatctaaacaatactaggtgatttctactccattctaccaatgagattgatggtacctttatcaaaggagcatatatgtaatatatacatccactggtttaggcactctttgcccttaactgtaattattgaccgccatgctagaaatacaggttttagttttacgtgtaatgtccgtgtacagctctagttggtgtacatcccaggaattagaacttttaattgaaaaggataaaactaaacagattttacatctatcatgaacatcagtatcacccagcctacaaaacaaaattaagacctatgcccaattcagaaattaatataatcatgcatactaatgttttgctaataggcacaaagaaatttggatcttttggcggcggttccacgtggctacgagcctagctacttgcttgtagctttgtatagtacataatacacgttgaaaaagagatggagatggaatggtaagataaacttaagtgggttaagcggtgtgagatggaatctaacagcatgtgacgtcctaattaaccttgggatgcgtgtatagttaatccgtctggagagaggccagtgttttaacctttaaactcgcttcaaaagcagcagcagctgaccgggatggatggtgtgcagtgtggctggtgattatacagcatggtcact

SEQ ID NO: 105317 - DNA, 1584 bp, Oryza sativa
aaatgtctagtaaaaaacgaacattgcttcaccgaaacaaccaacattgcatatatactgctcctactttgtgacaacagagttgctcctgcactgtctgtcttgaactcgctagggtttggaaaaccagtgttctctggagccttatcctgtttggtctctatttgcttggctggttttctctttatttggatctgcttgtatttgcagtttgaccagaataggcattatatcacctgttttctaagattatatattatatcactttttgccttccaaattaatggaccagcttttgtgctggaaatcacctgtttcaggatgaaaaccagaactggcaatatccgttttttggccccagaatggttatttaaattctctcttttcaggtgttgatttatagtagtagtttattaattcattacaccacttgcgctacttaaatgctattcttttactctccagtattagacccttactcactccacagtatttaagaccctctttgccaaaaagttctagctaatttttttctcttctgttgggtgactcacttcccttgctttcctggtttcttccctcaaatgaaatactggaatacctagttgctagttcatttcattgaaagaaatcgtttctggacttgatacttgattcacacaggagataatgattccccgcatcctacccattctaggtttgggtttcctttttaaaataataaaataatctgtagatatgataataccatttggaattgaacattaccttgtgctggaatggttggcaataggcagtagtagggtatttttttccattgcacaatgtcgtcaatttccactgttgtcccagatagccgctgccactactgtttcaatacaatctgtaccaagttatcatagccattatctgctgtgtaaaccagccgatatagatatatatatatattttacttttatgtactttttatgtaagtgtcaattaacataaatcgaaatatttgatacgatgttgaaaagtactaattttcccatagcgtggataaggataaggggatactatggtctatggcatggtggtgtacattgtatgacgggtctgcttcgtacctgatcaatgactttgtcgggtgtcatatgtaattttaggtgaaagacaatgccgtggagcttgccaaggccatggaatctgaagatggtgtgtcaggtgcagtcagggcattcctcagacatctaccttcaagagcagaggaaacagcacctcagcagacatccagcttcctggaattcttaggtcctgtaagtaaatgtcttggttgctcataggtgacagtgaggcaattacacaaagaatgccatttctccctgttgaaagaagagaattttgaacatccctgcaaggatcaggagaacggatttcctggagagtgtgctttattatcttttatttttttcctttttgtgtattttttctcttttattgtgtaaaaggtgcttgtctatacatcattttgatgtgcatcgttgccctgctggtcctgcaacaagtaaagaatctcacatgtacgaccagtcctttctgtgt

SEQ ID NO: 105318 - DNA, 667 bp, Oryza sativa
gcttcagaatatctgatttcctaccaaaaagtaaacttcagtttcctaaacgaaaaaccaactgggcatatctgttatgtgtatttttgtcaagtcatagtgaattttgcagaagcacaagtctgtggaatatgtacaagttaggggtattagacaaatttaattttacctgattcatgtaatgtacactgtttctcactaacaacagtggcaatccatagaaaaacaagttcaaacttcaaacataggttgagtgcattttgtctagtcctttttttagggaattgtctagtctaatttccactgtcatttatggtgcaagtatgagagagctgcaattccaattttaagcaatgtatcttatacctcattataaactgatttagttattcacaagttgccatgtctgtcttcataatgtacaatcacaatacaattgatacttggcatactttacagtttaacagcgcatgaaggaaatatgaaaattacaggatttaaaagaacttgaagctactataccaacattcagcaaaatgcactcttttatcttctgaaatagtggcttttcaagacacttccatctcagttcagtgcaatgtagcctttataagaactagaaagggacaggtgcttctatgctccacatactttaatttgcaccggt

SEQ ID NO: 105319 - DNA, 758 bp, Oryza sativa
aatacactagctgaatgcacatgctttgcgtcagaatttgaaaaagagaaccccaccatacactctaaagccccctaaacaacaacaataatatccccattgttatcaatatttcccaaaaaattgtacatctacgtcaagctacatagttcctttaatatatatttgtacactcgtctatagagaagttcacttactcaccagtaagggtccctcatggcagtggtggtgggtggtgagactggtgacaaacaccattcaccaccaccattggagtcctctataggagtatatacaatatttatatacacagggttccagtgatcctatcaactacagggtgactgctaactgtcttttcaaagtattcactctcagtttacagggatattgtaaaagcatcttattaatctctttaggcctaaattaacagctactttaaattgtaaaaaccctttagttgcttttactctcaaaagattaatcaaggtggtttgaagatgtggttaactgtccaagcagttagatgttactgttgtatatgtacaagtgttggtgtttatagagggattatgcactaaaaattctcttaactgcaatgttgaacactcattcatcaaatgcaacttcaatgagcagtaattttgtccggatgtggataatttgtttcaacgtagtctttacttgatttgtcaacatacagaagggttctagcatattactccctccgtttcatattataagactttctagcattg

SEQ ID NO: 105320 - DNA, 608 bp, Oryza sativa
aatgttctggatagcaagattctgatgttatcaagcataggcagcattggatataaagcaggtataccaacttgacagagcttggaagttgtaacaggaaaaggtaacatactggttttgagaatactggagttcaagaagctaggcttgttagctggagatcgctcaatcaagggtctcacaggatataaatgtgctacttgtgctgtcatatattgctgtcttgtgcgcaacatcctttccacagttttaagacggacatggagaccattttcccctgacagcaatttatcagcttcctacaaaaataggttcaagaaaaattagttaaatagaaaaaggcacatcatatacagtttaaaagcacatcgtatctttcttgttctataaaccacacatttagatgtgataattcttatatcataaggaacagtcattactactaaagggcactgggacaatatggatgaagaggaggaattaagagaaaaaggagatgatacagcatttgaggagaaggattaattcattggtcttgtagcttaatcataatgaatacaagagttatacctatatagaggatgaactaggatgcctaacaggaaacc

SEQ ID NO: 105321 - DNA, 699 bp, Oryza sativa
atggatcgagctctgaagatgacgagagaattgtcagagttgtcaccaaactcaccacgctttgccgccgggttctacatgaaatgagtagcacaaatggcgaccgacgacagctcagggggatggtcctcgttgcaatctccacggcgaatattcttctttggttaattagtggcttattattcgccgtcttagaattaataatcacatcctgtaattaaatggccaaagacagtacagtacactagttctactgctcatgacacaagtctcaacaagtcggcaaatcttgtttgcatcgtccactccaccgtcgtctggaacgaagaccatatgccatcttctcctttgactactttcttcagcttcaattagcatcttactcactacactaatcccatcagaagaaggttctaatgcacattaaggaaaaaaaatattggatcaccaagttgttgtaggggaagaaatctagagcactgatttttaatctggttcggtggagatgtggctgtaaagtaagttcagcaggtcatggcttgatggtgacttgtctgaaaaaaatctgtttttcaggagggtttacttgtctgcttctgtaactgcaagcacttgaggttcagacgattggatcaggttgaggttccaactgattttcagatcatgtgggacttttggttgcaccatgaccatactaca

SEQ ID NO: 105322 - DNA, 619 bp, Oryza sativa
atagtattatacctatgtataaaattttatcttcaaattcattatattttagacgtaacaaaaaagacagaattttacccttaaaactgttagatttttcacatctttgttaccgctataatataatgaatttcaatataagacttcgcatatatgtgtaatactattaggagtaagtgtccatttttttctaaaattttttgtgacatttgttagttggtgtgcacggggaacttgtgtgtataggatatattttctaaattaaaaatgctcaacaatacagtatgtggaaacgcgtaattctttttatcaaacaaattatctaaggtatgtattttgaatatccgaaatgccacatcgcctccttgtgctcatcttttctgccacacccacagcacgccacgtgtcaccaccctagccaaccttcggcgttttaccctctaacagtgccagggtttacctaataacgcttatgctgggacacggtaacggtttaccgtggtatggtttggatgaaatttgagcaaattaaaaattccaaaaaaaataaaaaaagaaaaaaaatcatggatgtagttcttgatttgtagtggcagatgatgaagatttttttttaaaa

SEQ ID NO: 105323 - DNA, 609 bp, Oryza sativa
ttctggcagttttgttgtagaagattttatctgacattctttcactgtacataaggacttgtaaaatttgtgaaaccattcttggaaccacacgatgttaggaaattcttggaaccagattgtcccagttacctaatctgtttgtttgacagtgagcgagcagaattgctcgctgaatgttgtgcagtatgaatcagaaaagtgaagtatggtgcatgggcagcatggctgctgtcgtcagaaagtgaaataagatcttcaggattcgtttgaatctcgcttattttactgattcgatttacaacctcatcttttcgcttatacttatacttatcggtcaaaatttaaattttcaaccttaaatttggagttgattttggagttttttcatcgaagtttatttttcaacttttgcttttagttcgccaagaacacatatataaaagttttattcacattatttttcgtttgtaaataagccaaacgatggggccattaatttccatctaagttattttgcgtagtcctgatttgtttatacttgcaaaaggcatagtcatgatttatttatactggtaaaaagataaaggtggtgaatgcccatccgac

SEQ ID NO: 105324 - DNA, 695 bp, Oryza sativa
tgttctggaagttttgatcctaaactcgcttttaaactggttgctcttcacttgattttggtgcagtgaattttatattgaataccaaaagaagcgggcagccgaggttgatgacgcaagactgaaatttgaaataagcacagttctgtctaaggaggtaatgcactacattcagcacatcttccttcctatgggcattatgattatctaattaatgcaccgagcgtatatattttttaagtagaagactagcagttattctggaatattaatatcccaagaagaaccatgtattcgtaactcataattggttgatccattctacagcttatcgcctcttatttttgcctatttaactttcttgttttatgataatcgatggttcagtaacaactttttaaaatggacacattgaacaggggattgaagtctgcacggtatcgtccaatggtagagtaagtttactagtttccatatctgttctttcatgaaaattgatgtttgctcttacttatttttaatatattcacttatagccagatgaggtgaaatttgctgtcccacttctggatctggaccttgccaaactggttcctggatgtccttggaaacttcctcaaagatccatttgcaggttaacttctaatgccattccttccatgggcatagttaaaatggtagcagtgatgatgacg

SEQ ID NO: 105325 - DNA, 678 bp, Oryza sativa
gatttgtttctgcttagttaggtagccagccggtgagaattctccacgacttgatgcaccaaacacgcgttgccgcaaacggagcgctttgtttgggttcgaaatctcaatccgccttccacgtccaattcctcaaaatcacaagttgggggtattattgatttgatgttattttttgctgcgtttcttctctcgccgccgtgttcagaaattcagagaagctgtcaaactgagcatcactgtgaagctttaattgagctgcctttcgctgtcaaggcttccatggggacttcatctgaagctgctctctcgtatttcagtctccgctttgattaactcaaatcaaactagattggcagtggtctgaggatgcagaatttcacaaaccgtggggaatctgcactgcatctttgcatgaattctttaagcggatcaggggaaagagagggacacaacaatacatacagcaagtgaaaaccaacagcttacacacacaaaaattcatcaagtccgtgtaggatgcagcagagtcaatcttggcggcccttggtttatcatattgtaagcactattgtcctataggaggaggattccgtccttttgctcagataagtgaagaactgccgtgcttatttaacgttcacgttgctgtcagcctgagtctacttcttggactgg

SEQ ID NO: 105326 - DNA, 610 bp, Oryza sativa
ttaagcgaataggctgtaccaaattcatttatatttgacttcatcatagtaccattttttaagtgaataggctctaccaaaaatggttcagctcaagaaacaagacaatttcagcaagacaattttaatgtagtcctccgtacgaatgtagtacctatagtgaataaaaatcgaataacggaggtaagtaatcgctgataattagccaggataccagaacaaaatctagcagaaaacttctactataatgtaacaaagaaatcttggaagacttggtatttcggcaattaataacatgaaacaacttgatcttactgttttccctaattataatcctgaaatgtacttgcttgcaattgcatacaagataatgcagaataaacacgcattatcctcgagagtaactaaaagacaattatgaaacaacttgatcttactgttttaccctatttaccatcctgaattgtacttgcttgcacacaagataatgcagaataaactcgcattttcctcgagagtaactaaaaaacaaaaacaattatgaaactacaagtacaaggttgatagatttgggtggctgcaaaagcaattgtgaaaatgacatctaact

SEQ ID NO: 105327 - DNA, 612 bp, Oryza sativa
agacaaaaagatgagcctacacagcatatgattttcccctcagccaagaatgtaattttctatgtttttaatcagtcatgggcatttccttaacattaggatgcgcatcactcaaatcagaaggtgaaggaactggaactacatgtttagaggacagcaagaaaaagtgttttggactaagtgctgaaatgcaaaccagtagaaaacatactgagacttagtcaattctatatccacaaaagcatgcatcattttgacaactgaacatccatacgaaattttggacatgatcaaaacacacaatttttctgcagttaaatgtgaagttggggaccaactcctagacttgatgattcgatttatactacactaacgtaacaccatatcagctgacaatagtctctatgatatcaaaaggtgacaaagtatttaaatactctagatgactcatttcaatgatatttagcatgattaaaagcaactatcaacaaatctgacaaaacactctttaccattgatcaacacagtggggataggtcatagttgttacaaaaaagaaggcttctggagatgcagtgtaaactctaatttataacagaatagatgtagctt

SEQ ID NO: 105328 - DNA, 692 bp, Oryza sativa
agatgtaaaccatttatattatcttaagagaaaaatatatacacagttaaccgagcactcctaccatttcataattctttgtgttttgaacaaagttgaggtcaaacttttataactttgattatcaataattttaaatatatttagtttaaaggagctagagatttatctttcaaagtattataagaaaattaaacatgcatttatttattgtatatattataataaaaaaacaaaatcaaatatatattttggagaacatgtcattgtccaaaacgttaagaattatggaaccggagagagtatatatagttgtgtctccaagctaattaaatcctgattactgtaatgtgggatattaaataaaggcactaatctgttcattttaagtgatttggtataataattgtttatagctcgttaagtaaagacagatatggtattatattccattataaaaaaaagcattaatctacacaattcgaactttctacttatggctattatgactaactttattttcatatccaattgagattagataaagagatactccctccatactcataaaggaagtcgtttaggataatgtttaagtcaaaccttgggaatataaatcatgaataactctcaaattattaagtttgaaaatgtaaaaattatatgaatagatttatcttgaaaaatatttt

SEQ ID NO: 105329 - DNA, 635 bp, Oryza sativa
agtcaaagttataaaagtttgacaaaaaacttgtccaaaacgttaagaattatgaaaccggagggagtatattggtatgatttttagacaataaattttggtccagaccttagggctggctgattagtatgaaaatcaaccgagggagtatttcttaagtaagatttcccgagagaactgattcaacagggccttagggctggctttaaatagagcaatattgtcattccgcacacaattgtcagcagaaaatgatagcttaggaaaatttggaatgacataagatgttaagtacttgcaggaaagcccttatttatcatttctttcatgaaatagagggtttaaatgatccagttgcacacagttttttttctttctgacaagtgccatgtaaggtaaaacaaggaacaggggatacctgcagaactgcctgtttcttcctcctttgctgtgtgtaacataattgttccggtaagaattgttatcagaccacaaaattcagaagcaatgctactgaagctttgaccagcccagtcctgcatttgatagtaagatgaattaagtcgtgagccccatccaagggatcagtctcaattaactaaaccttaaatatttgtttctaccttgaacataat

SEQ ID NO: 105330 - DNA, 552 bp, Oryza sativa
cctcatacgtatgataataagcgacaaggttcagccaatgtaaaggttcggctggatagagctttggcagatgaaagttggagggatatttttaccaatgcacaggtggtccatctgacttcgccatgttctgatcattctcccatcctagttaagtttacaaccgggagtgatagacagtgccgtgctaaatgcctgcactatgagatatgttgggaacgtgaaccagcagtccaggacatagttaaggatgcttgagtagagtcagatgagatgttgcatctgggggatattagcaaagctttgaaaagggttatgggggctcttcagtcttggagtaaggtgaagtttaagaacattggtagagagctagaaaaggcaaggaaacatctggcaatgttaatggaatgaaatgctgacagtagagagatccgtcaggccttaaaccgcatgaatgaactgttgtatagagaggagatgctttggctgcaaagatcaaggattagttggttgaaagagggggatcgcaacacaaagttctttcataataaa

SEQ ID NO: 105331 - DNA, 723 bp, Oryza sativa
atctttctccacttcaaatgtctttagtacatgtcagcctgcagttgctgtgacactacctcccactgattgtgaattgtgactggcaaatggtgacacccaaaacctctctttcctatgatgtgcttttcgaaactaccgtctcatatggactaaaaataccgataattgatcactagaccagtgtattcatgtcagcttttccccagatgtgtcacatgaaaatccacctcaaaatcgacaatccttaactaaaagccaaaaaggacagataaaaaaggtaggttaggacatgtactgctgattggttagaatatcatttatcactagcaacgattggctaagtcaccaatttaatcaatgtactagctgcatccaaaagcctcttcacaccacaaattaagacttgggtaactgttcgtccctcacaaatgcaactatcttcccctactgtttccagtcaaaaaagaaaaacaaatgtaactctctaaaggaggaaaatgcagaaatatcctggttcaaccttactgtctatttctctgaaagacaaactcctcaaaaaaaatgaaattgaatgagataatcctactccagaaactgagcaagattaaccaatcgccaatgtagaactaatgtggcaaaatccgagattcgcaatcttccatttgtgccagtatccttggggggggggggataatataataagacaaaattcctaaatct

SEQ ID NO: 105332 - DNA, 658 bp, Oryza sativa
ggtggcaatgaatgagtacggggtgaatgacaggtggggccgtgtggactcgtggcgggaggtgggtggtggggggagtgggtgtttggtgtttgtgtgtgaggtggggtggtttggggggcgctccagaaacacggcgggtggccggggcagttgatgcttccgttgtccacttgtgtgtctgtaccccgtttttattacacccccaaaacctgcctctctctctctctctctgctatcaaggattagtttgtttcttcataaccttgattagtttataatgaaatggatcactagtttattttccagtacatttgaccaccatttcaccgtggctttaacctctcacagtttgttctacggtttaggtggttttcttttctccagaaaatgaagatgatgaagattaagttttttacgtaaaacgaggtggtatttacgtatgatttattaagtataaattattacaaacttgaaaatagattaatatgatattttagagaaactttcatatagaaagttttcacacaaaacacaccgtttagcagtttgaaaagcgtgctacaaaaatctttaacttcatccgactcttattggagaaatgaacaggaccttaatgaaatggattactagtccttaaaagatgaacgaggcaacg

SEQ ID NO: 105333 - DNA, 691 bp, Oryza sativa
agtgcactatgcagctcgcttatgatgccgcatgacattccactgtgcattgtgacatcgatatgctatttagttcgggtttcttgcatcgcatatggattcttgctaaacagtgctgtccaaagctttacttccgtgttgtatcaaacttgagcccatttccaacctatatataatttatctctcataaccttcaattttatgctcaagttttcttatgttagaatatcaacatgcttaatgctttgttacgttgaagtctgaacaaattcatatttcattgttggcattcagcacagaatattcttcttaaaccttgcacattagttcaaacatatgtaagttatgtaagttaattgttagataggttatcttacaaacatacaatgatgtattgtgcacaatattgttaattggggtgattttttataagaaagtttgaaaatcgctgcctgcaggcacaggtggcagtggttcataaggggaaacaattgttacaatttagaatttcgaactggaagttagtactaataattattccagttaccacatatccctgctattatgggcattgttgtaatctgatcaattgcttgtgataaccatgcacccaaagtggcagaccgttagtgtataaagttaccatgcaatctgaatataatgtcaaattggtgaaatcaacacatataaa

SEQ ID NO: 105334 - DNA, 643 bp, Oryza sativa
agttaggtctgcaaaacgagagagtgattagtacatgattaattgactcttaattattataaacttggaaaaggaatttatttgatatttcaaaacaatttctacatataattatttttgcaagaaaacaaaccgtttaccagtttcaaaagaatgctaacggaaatcgaggaaaaatatgtgtcttaattggtgggttcttctctgattaagatacaaaatttacctcgatttttgctagcacgcttttcatagtgctaatcagtatgttttgtgtgaaaattttatgtatagaagttactttaaaatataaaataaatttcttttttaagtttataataattaaaactaaattaatcataaggtattagctattttgctttgtatgagtataatagtcaaatcaaagtactcatccatagtgcacaatcatttaaagagaaccaaatgagaccctctctctctatgctcatttcccccctataaatactctacttgcccaatccctctttccccacaagaaccacatcctctcatctctgtcattctgcagctagctgaaaaaatcttcagagcatcatcagttcatcacaaaagactatcaagtactacataagatctcccttactctctctctagacct

SEQ ID NO: 105335 - DNA, 1334 bp, Oryza sativa
cccttttcctagagctcaggttttctgagagtcgtcccctttctcggtgggcaaggtcctccttttatacctcaaggggataccacatgcactgcctctacctactctcctattgggtggggacccaccctatcttgaccgaatctcgacccgtgccttcgcctgtaagctaagccatagcttgtccttgagtggggcccagtgtcgtccctcgcctgacacaggggacagccctgtcattcccttattaataggtgaagacttgtggtggcctccctttcgtggggagaactccgaatgaccctccgatgggacgggtcatacctacctccactccaccggaggcagatgcgacgtgggggcacggccgtccgtccagtcggatgtgaccggcgacaagccggtcacagatcgatcattcctgaccgacgcgcgctagtcgggcacgccgcacgtctgcccctactgcattgaatgcggcatggggcagttggggcgctgcgcgcattaaaggtggttcaggctgggccccttccccacttgctcccccgccagatggcagctgggcgagggcctcggggcaaagtggtgcgagggcccgaggggcatgacgtggcaccccgaggtcccccggccgctcctgcaagtcacggggtgtgggggtagggccaggctgtagggtcacgcgacaggatgggaaggtaaattcccctcacttcgcatacccccgggcccatatctccgacaaatacaatctcagcgcatcgccaccctttttacttccgttttgtttcgacgagttcttgctttcgggttgagctacatcggtatcgatcttcaacaagaggtaaaacttgttatggtggcttgcgttctcgggattagtgcttccatcttcatgacactctaatcttgtttatgtaattcgccgggttatcatatatcttatataatctccggcaatatcgttatccaacctacaatcggctaaaatctgtcagaaggcagccgattaggttaaataccgatgttgacctacattatataggatatccaccactctatgacacatccaacgacttgattgtctagatattgtccttcttttcatacttatagctgcatcagttgagtttgaccttatgagtcgtgattagaatctcaatctctagcttgtctttggttgccgattaggatagtatcggagtttcagccgatcttatctgatttgactatatttatcttataagctttattgacatgttaaatctgccctttatgttaagatcttgttgcatgtaagtatattaggctttctgtttgatatattttac

SEQ ID NO: 105336 - DNA, 1143 bp, Oryza sativa
tacctcatatgtatcatcatgtttgaacacgaggtatccgccgatacctagcaggtatcaagcgatatctcagaggtaccatcctgtacgaacgggacaccgtcacgtagaatttccctttatatttagcaaatatttgttatcatatttgttccgtttcatattcatttcgtatctatattcgattctattttcttattcgggttttcaaatccgattttgagaaaaaattataaaaaacgaacgtgataaaactagtttccgatttcgaaaaagaatagtgcctttatcctaaaatataacaatttatatctctcaagatttgtctcaaaatataacaacttcttcaccagcattctcttcccaaccaatcacaatcctttaccattcacttttcccacctacctccactacttatccaatcacaaccctccaccatttaggccctgtttagttcccaaaataaaaattttcacgctgtcacatcgaatgtttggacacatgcatggagtattaaatgtaggaaaaaaactcaattacacagattgcatgtaaattgcgagacatatattttaagcctaattgcgccatgatttgataatatggtgctacagtaaacatttgctaatgacggattaattaggcttaataaagtcgtctgaatatgtaatttgttttgttattagactacgtttaatacttcaaatatgtgtttgtatatccgatgtgacaactaaatccaaaaagtttccccaactaaattaggccttacttctacctactttattactcactccacccctaaatataagggattttggttgaacttatatatcctgtctagattttgtctagattcgcatacttagggcatgctcactttaatgaaaaaaaaaaccttaccaaatttttggcatagttgccaaaattttggtaacttgttaaaattttggtaggatttcttatatagtcatcaaaatttagcagtaaactaaatatagtcatatttttagtaactttatgttaaaaatggcattaaagtaaacatgccctcagagggagtaataaccgtttccgtccgttttcatgcgtctagcctggttccgggtccggtcccaccggaccatccccgtgtgcgatgcg

SEQ ID NO: 105337 - DNA, 1297 bp, Oryza sativa
gaatgaaaaaactaatttcataactcatctagaaaccgcgagacgaatcttttgagcctaattaatccgtcgttaggacatataggttattgtagcacttatggctaatcatggcctaattaagctcaaaagattcgtctcgtgatttacatgcaaactgtgcaattagttttacctatatttaatgcttcatatatgtatccaaagattcgatgtgatgtttttggaaaaatattttggggaactaaatagttcctgaaggcaagctgttcagattgagaggcaaaactggtctgctcctgcctgtaatgcctgacactactctagcgtgagatctttgacctaattaaaagcagcatgatctgattataaattactattactactattactaacacactctgttctatatggttgcttcgttgacctggagctggaacagcttaggccggcgaatgcaggagcatagcagcagtacacgtggacaagataaacaaatacggcatgtctccattagatcgacaacgagataattaagcttgtcaatgagctaattaagcctgtttagatccgctaattaacaccggaaagaaaaattaatgcagggacgtgcaccacctacggatgaataatgtactccctccgtcaaaaaaaaaaatacctaggtttccgtgtccaacatttgaccacccgtcttatttgaaaaaaatataaaacaaattaaaaaaataagtcacgcataaagtattaattatgttttatcatctaacaacaataaaaatactaattataaaaaaaatttatataagacatacagtcaaacgttgaacacggaaacccagggtttgtctttttttgggacggatggagtagtcctgaaccaccgacctatgaggctatgtggattaatcttgtacggcaggcacgcaacatccaccaattagatccttgtcatcgtggtcgaccgctcagtacagtgtctaagggtaattcctccggtatttaaagtttaggatggataatgtctgattttcaagttcagagaggtaagtcagtcgaccgcgatagttcggaggggtaattcacactttttccttaaaataataccactgctattcacaatatcggctggatgtcatcgatattttatcaaattataaccatgccatatatacatttgaattaggtttttacataaaatatttttatacataccaaaatgcacccaaccctagaagctaacaagtggcacccacattatcatacgcatcttcgtccccaagccttatcttggctg

SEQ ID NO: 105338 - DNA, 1768 bp, Oryza sativa
aaaatggtgagttgctaaagttggaagcatttttaaggttctcgtgaaatacgaccaacttttaacctttagagactctgccattggtggatatggtcaagctatccacggcaagttattttttaaaattaaaggaaacttttgttaatctcagatgattacattaagttgagaggaccatattaagaacactcccaacctttgcataaataggatgaatagatttggcacggcaatcagccaatcacatagattttggtagccaaaggtacgccataatgaccatcaaatgaccaagttgtgtcgaacagtgagcactagtaattctcaatgatagggatcttcagcatgggaaagtatataacaaccacaaatctcagtgagaaaatcatcataatctgcgtaggcagtccaagaaaatcaggggtactactggggtacattatctggtaggggggcgatatagacatttatcagataggaatgcatgactcaagaatcagcaacacctgccaatcttgcacaaccaagaatctgcaaatcaatgactgaaaatctgaagtaagaactgcaaaaatcattatggaattattaactgccggccggcagataatatcatgtctcagttcataccacatcaaccatcagaggacaacagttacaatagcatgaagttttccagacaaatagtactattccgatatggatgcacaaaagcctcagactttgtactcacaaacttttcaaacatcatcttcaatcgcactaatctccttacataaaaaaggtgcactgtcagcttcccactcacttaattgtatgacatgccgacagttcatttttcaaacgtagctgctcagacaaagaaatttggctgaacaagagatgcatgagcacctatctagtaaagagcacctaaaaacatttaagatcatcattgacaatttgggaatgattagtaaggtctatatatgctgatttacagaaggatcaccttcccccaataaatctggcctctataggagagctattcaattcaatacaaacaaacaagagagtaagtatgattattgcccagcaccaactcgttgacaagttaattacagtgaccatcactactcaatcacaaccgacagaacttttatatcaatgaaaatcagattgaataaataccgatggaaagaaccaccaaattaagaaaataaccccaaaggacagccatgcatgaaaaataaatgctaaaattgcattaagctaatgtctaagcagtgcaacttgcattgctgaagaaatcaatcaattatcaatgtccaagatcatatgctgactgtacattcatgctttttttttatacataactggacattcatacttactatgtttcatttacgcatagtactttattgcacgagcaattttgaagtccttgtggaggtaccactttttctattataaatttggtacctcatagtacactaaattttttatacctcatgatatctccttaagaactgtagaattgttcttattgcgcaaccttcgaattagaagatctgggccaaaatgagaaatattggattattaatcaagataagctgattacttatcgagatatatcattaaagacataaactcaaacttgttttcaaataaaacatggcacttatcttcatcaggattaatataattacacttaaatatctagcttatgcaatgaccttggatattactccctctatttcaaaatgtatgacaatgttgatttttt

SEQ ID NO: 105339 - DNA, 705 bp, Oryza sativa
agcaagcaatacacgcatgcagctcaagaaggcaaaaacaaatggcggcagcgaacattcagtcattggaccttacaaaaacagagcaccgtaagctattacggtgacctcagctcaaacggcgattactcaaatggggaagggaatacatgtgcaacctctcaaacatgttgtttattcatgagtacagcacaagccatgttatgcatacagcatgcaaagccaaccagcaaccagagattgtaacaactaacaagcccacgcaatgcgagctgctaccatcaccacgtgtccacagaccagcacagaaacaagctgccctgctgcttgttttgcggccgtcccagcaattgacagattaataggagcccataatattagtgcaccatataaataacattatgattttagccagaaggcatcagggcataagctttgatgaaattttacagaaagcatcgcatttttttaattaatgaaaagaataaacctaaaccacagacagggaaacaattcacaatgtcagattgcttctcatgtatcacacagaataaagtttcaattccaatacttcatatgttggcttctctccagtagcggtagaagtacaagagggaagagaatctcaaaccaaaaatgatctcctgggtgctgtgcaatggcttcaaaattggggtataccacccaaagaaaaggctcaacttt

SEQ ID NO: 105340 - DNA, 2167 bp, Oryza sativa
ataacgacttcctaccaacttaattaatttctcttaacatgcatacgggggctatgtacttatacaaattgaccttgatacttttaaagcaatcttttttggagataaataaatgttcttaagaaagatgatcataacatccaaattacacatatgatctatgaagtcattaataaattagagaaaaaaaattaagtgacataattttttaatcataaatgtactcatctagcattatagacaacaagttgaaaataaaggtgcagtcagttgaacatcataccgataagcatgtgaattgcacctaggaatcttaacaatgaaactttgaggtggtcttagaaatatatcaagtcacttccatataggaattaaagaccatgtccttatttttaattttaattttgtggtaaaacttactaacattgtaaatcatgagtcctgatgtagaacaatatataaaagtgtatttttttatcagacacttcagtatagcgataattccctaaaaatactacgaccatgtcttcaatatgtcgagagaaaattcaacacattttcctttacaccatgccataaatgcatttaattttcgacccaaattgcaaagatctcagcatttcaatggtgattcatagaatggaaatctcaaaaaaaggacatgaaatatattgacaattgctaaaatgttgctggatttaaaacccattataaataggaaaaataaaatgtttaacgaagactgtctagacgaaaatatataaaacttaaaataaaaaaatgttattattggatttcttttggggttgtgagatattcttctgggagtcaaaataccctaaattttctcataggaaccgcctccattgtttcaacatattttttttctcataaattcaaaactgcatgatcttaagtaattttattttagaatttatatgttgcaagtgtaattataagaaaataagtagcattcaaagcacaataaataagcttaattttagtttagaatatagtaaaaatattttaataaaaaatcagccacacataaatattgataataaaatttcactcatattatatgaggtgcccgcacatgtgcgtgggctatctttctagtttttcctaataagtagtagtaaatatgaagagaatgcaaaaggtattaactagagataatagagttagcatcagaatagatatatattttttagatatagtgaggacattacagcatttttcacaggaaacagtttagttcccttaaacatcctctaaggaggcctaaacagttgaatatcaaatgctagcagcaacaatttactagtccctgccagaaaataattagcaagatcagtatgctcactgttcttctaaatctgcacaaaagttacgcataaaaacaaaaggtttgactaatctgaccagtgacgacattgataaaccctgctccatcgatctgcagaaaggcttgcggtaacataggcgtcggcggcaggccattcaagagtggtggccggcagaggcttgaggagccataaagattataaaaaggagtactctctccgtcttataatataaaggattttgagtttttgcttgtattatttgaccactcgtcttattcaaaaaaattttagaattattatttatttttttgacttactttattatctaaagtactttaagcacaacttttcgttttttatatttacataaattttttaataagacgagtggtcaaacaatctaaacaacgactcaaaattgagtggtcaaacaatctaaaaaaacttaaaatcccttatattatgggacggagggagtacttaataagcacagcatgtagcaaacggcgagaagaagataattaagcaagtctccatcgatcttacgcagcggcaaaattaacctaaaagctttagtttattgttgcgaggcctatccggttgtcgggcctgccaagtgcaatgctagctttcaaactaatcctcttagctggatatgtatcattcgctaatctgacaaatgaaacagcaggagcacagctgcgttattatatggaaggccgacctggctcggcaagggatatcccctctcgatcgctcgtcggctatctgtcatatcacgcacgaaattgcggctgcaaatgctactttacgctctg

SEQ ID NO: 105341 - DNA, 1280 bp, Oryza sativa
ctcccttttagaaatagcattttctaatactcgtactaatccatcacttatacaaaaatctttaatccactggattttagaaataacttgccatatcctgtgtcttgttgaatttatagtggattggatcagaaactattcttccgttctcattcctaacaagtaatccaccccccatgtttgtaattgtggcaccaagatttaattccatctccatacaaaaagtgctccctgaaacacacatatatgactaaaggcatgtttagatcaactggtaaaatttttcaccctatcacatcgaatgtttggacacatgcatggagtattaaatataaaaaaaataactaattacgcagattaattacacagattgcgtgtaaattgcgagatgaatctttaaacctaattgctccatgatttgccaatgcgatgctacagtaaacatttgctaatgacagattaattaggcttaataaattcatttcgtaatttacagacggaatctgtaatttgttttgttattagtttacgtttaatactttaaatgtgtgtccgtatatccgatgtgacatgccaaaatttttcatccctgtatccaaacacagcctaagcaggtcacttcttcacaagttcgaagcctgagcagtactacgaaatctcccaatctggttgttctgacgttcatttcgacacagatacatcgaggggttgcttggtcgaatgtatttgttgccgacctatgtcctacaacaattgcctaacacttttaagcaaaatttagcatatccacagattaattgcctccacagattaagcaaactacagattaacaattttacagcaatgccttatttcattgtgaatgtttcgcaaaagccacatgtttgcctatttgatgagcaaaatttggcaaaaactggtgcccaatttttttttggggtgggggtgggggttgggggggggagcccatagtacacatgttaattagatctattcttgtgtacaggtacaacttattgcttatcaacttatcactttttatatctgtatgattatgagattcagaggttatttgccatattcaacatctacgcgttgcgcgttttctgtgtattgatttatgcttctctatctttttgaagtgatttgtgtacaatctacatcaagctcttcggaaattgctaggtcacttcaatctgatttctggagcgatgcattgtgctaaaaaggcaaaggtggaatcacaatcagctgagagtttagatagactcagcagccta

SEQ ID NO: 105342 - DNA, 940 bp, Oryza sativa
tgaccttattcatttgtgaaacataatgcttgtgaattgtgaacaataatactgtgaatggattctgaaacataatgttgttatgggatcatgatgtaaataatcataacattggattgtgatatgttcatatgttataaatagataatggcatttttccttttctgttagaaatatgtgctcggataatgatatgctttatgagatgaatctatactactttaaaagaccctaattatggtggtgaattatgaatttgccaccactcatcaccactgtcttgtgggtcccccaaacaatgaggttttacaagccatcaatcaagggtaatttattttaaaatgagatgcaaaacaatgacaaattaaatatggactaaagattttacaaatgggaataatttttattcccattgcaacgagcgggcattcagctgcattgtgataaaatctgggtgtataaatctataatttatgtatttgttcaaataaaaacataagcgggtacttagataattatatgtgtcactcatcatgtttaggccattcacttaactaaacagctcatgaaaatactttttcacaggtggttacttgaatgatccgccattgaaaattgtttcgcatgtaatttcttttaggagaaacacccgtgaaaacatgtttttgtgtgcggttatctttaggaaactgcgaaaaactttttccacgaatggctgacttttcacatgcgtaaatagtttattctcacatgcccttcactacatgcatattggataccactagaaaggataccatcatctcaatcagatggtaaaccccatctcaatcgggcacggcgtccgtcacaggcaagaagtcacagatgtgaagagttatctcaatcgggcaaatggccgtcacggatgaatctatctcaatcgggccctaattaaagcccg

SEQ ID NO: 105343 - DNA, 591 bp, Oryza sativa
gtcatctgtgacgggccacatctttaggtccgtttgagatatggaatgttatctcaatcgggcctaaactacggcccgtcactgataggtgtcatccgtgacgggcttaagttttaagcccatctaatatgtctgtgcgaccatatctcaatcaggcatttttttggcccgattgagatgacttccttgtgacggcccgctatttctaggcatattagagcccgtcacagatagaaggatctgtactagtgtacgcccgtataaacgggttatcagttgcttgcacaaatatttttttaacaaatgtaacaacattacctcctgccattgtcaatcttgggccttcctacaaccttgcatgccttggattgtcatgtcttaccagatattattttgttctagcctacagagatataatagttcaccgcttgccctagcttatacaagttttaggtttgaaagatcaaaattaatttcttgtgtaagatgggagtaccattcaacttcttctaaatgtgcatgcttaaggtttacattgacgatttgacaaaggatattgtgaaaaaaaaaacaatctgcattattaataat

SEQ ID NO: 105344 - DNA, 955 bp, Oryza sativa
cgacgactaagatcggcagggttcgagtcagacagggttagctgattgagccgaatctgacaatatggcacggcatatgttgtcgggctaggttaacgtgcttcatgatgattgccacgcatggatagagtcctgagaaggcaattgtatctattaattaggatattttatgtaatttacttagagatatgtttgggaaaaagtctgtcgcaaagacttatgatatcttaggcagcgtttgttccagtgagtttgaggaagaaagcacatcgttttccgcgtgcacgcttcccaaactactaaacggtgcgttttttgcaaaaattttctataggaaagttcttttaaaaaatcacattaatccatttttgaaatttaaaatagttaataatcaattaatcacgagctaatggctcacctcgttttgcgtatcttcccaatctcctcaatcctctcctcctcaaacacacccttagagtttgttagagataagagtcgtgtccgatatggacatattttgtaattctcgggtataaatagacccgagccccatgtaatcaaactaacagacgttcaatactgtcgaggagtgatcctctctagcaggagatcgtgggatccccctttcgtgagtttggccgggggaaaaggcccgcctctggaaatcgcatctctgcccccaaggctgctagttagcgtgtgcacaacgagattatacaggttcgggccgctatgaagcgtaataccctactcctgtgtatgggatttagactgagagttacaaaggttcctaaactccggagagcgctcttgcttcccttctcctagagctcaggttttctgagagtcgtcccctttctcggtgggcaaggtcctccttttatacctcaatgggataccacatgcaccgcctctacctactctcctatcgggtggggacccaccctaccttgac

SEQ ID NO: 105345 - DNA, 683 bp, Oryza sativa
cgttataagcaaaaatttaaaatcccttatgggactgagggagtatgtaaaacctgatcatgaagttgacattaaccaaagctaattattacacctctggaagcataaactaatttggacttctagagcatctatccattggtatgaaacaagacgtgccgtcctaccgccaggccataattattaagtcacgcggtttaattaccaggccatgaatccagtggacatgtttggatcgtttcttccaatgtgatcgaatttactcgctgtacttgtgtttggagcagttgcattgaatggagtatggacttgggctctagcagaggattaatgcactgtctgtctgcacgttctgtcctttctttcttttttttttaagtctgataatgctccccaattaataagtactccatcagctaaaatatactaaaatataagtaattttggatggacgtaatatattctaatactactaatttggacaaaaacatatgttcagaaaacctcttatatttttgggacggagtaagtaatactccctccgtcctattttaaatgcaatcatgatttttttatctaattttgatcttccatcttatcttaaaaaaattaaaaacaataaaaatactaattataaaaaaaataaataaaatggacgattaaaagttaggtaccaaaactcg

SEQ ID NO: 105346 - DNA, 591 bp, Oryza sativa
ctccattgaatgcctgcggcaaggaaagaagaaaaacaagagcaaaaatattcaattaacttccctgtgaccgaattgccgttttcaccccatcccccctcaggctcgttcctgtgaaaaggtaaatccgcgcttggtccgccatatctaagtggtgaggggcaagaccgcagccccgagggagccgccagtgggactggccagaccaaggctacgacgaccgggggtcggggacggccgtgcgtaggcccttccgagcccccggggcgcggcccgcgattaggctccctttcggcagttttcaagtcgcccaacgccacttagggttcggagtaagcgcgaaatgtcctttgaaccaggacgagccagaggaaagagtaagaaaaaaggcgtgtaaaggcctccactttaggtgggaaaaaatttattgcttggaaagggaaaaaggtacaaagtaattcacagtggtagcccccggccaagcctgcacaagccgaggggttgtgcgggggttggcccgagctcctggaaagcaaaaaattgcgacgctatggatagaagcggcggaggtgtttgatattctaggggtta

SEQ ID NO: 105347 - DNA, 1018 bp, Oryza sativa
gcatcaattaggtatcaatcaagagttattagcttaatgctcaaaaacaaagctggtgtattattattcgggtacttgctgaactgcaagtcttcaccgttgtcggatactgtgataacttaaaagcctgcagcttgacttttctgatggagaagaaaacaactgcaggactacctaactaacatagccaatataaagttgataactcagcaagctgtaatttttttgtccaccagaaatcaccagcggttatgtagattaacacgagattaaaccactaaccacagaagctgttttaattttttaccaaggtgcaaagtactacttgcatactccctccgtttcagattactaagtttatagacaaatataataatatttacattacaaaattagttttattaaattaataattaaatatatttttaaataaatttatcttggctttaaaatattattattattttctataaatttgatcaaatttgaagcagttagattttgaccaaagccaaaacatcttataaactgaaacggagggagtacatcagctaaaattcagagccatgtattgctttgttcgtctatggcatgatattttcttgtactagttatgtaataaagctaagctatagctaatactgaagataagaagaaaccaaaacaaaccaagctttgaagagaagatgtcgaagaaaccaagacaaagaggaactgaagaacatccaaaagttcagagaagctagctgagcacaatctttgcttaccgttgatccagttcatcgggggctggaagtggtatcctgtcctgagcagggggctgacaatggaggccggcaccgagctcggcgcctgctcggcctcgaggctccggtggacgacatgggacgcgccggcgagctgcaggaggagcagcagcagccatggcgcgagcgccaagagccgagtccccattgttttgtactagacaggccggccagggagggggagaagacgaggggcagaaagggatgtgcgg

SEQ ID NO: 105348 - DNA, 1495 bp, Oryza sativa
ttcttcatccgacaaagtgatatgtaagattgttcacaaaatgtacatatctcttatataattttataaactataagagagatgtaaattttgaacaaatgttactatcactttgtcggataaagaaatgaccaaaatagaagttatagatcttcatgagttatacaactttgttattgatgactttttcagcagaatcatttagtatttgaaaatattgtttgaagttttgaaattcaaatttttaattataaaacaaagtcacaagaaaaaatggccaaaataatagcaataagaacataataacatgatagagcatgattttagaaacatttgggaaaaagaatcatccaatttggagttcatatgagtgagatacactagtttcaaaatttttaaatttatttttgcatacggctgcttaagacgttttgatttttccatgcaggtgcttaagtgagcgcatgcaaaaataaggtcatttttgcatgcggacctcttaagagacccatatgggaaaatcgatttttccatatgggcgtcttaagcagccgtttgcgaaaatgccgctcgatttttgcagacgccactagttatagtctgtttgaaaaaatgaaggagtctcgtacagaaaaatcacttttgtagtagtggtagtgatagttctcaagcctgtttaagtcatatcactgtgggttcaagccttcaaggctcaaacccaacagtgattctatggttcggataatatgatcatgctatccaaaccgttgtagacccggtgccctagcaacctatggaaaatttatatgtggctttgatcgagttcatccaatctctttcacttccttgagttatactcaatcccatttatgcatcatcaataaagaataattttcataaatgagaaaaatctcagtggcacataggaaatcttctcccatagctaccatccaagtgccacttagactctatcaaatattgagtgtatgccctattcgtgatacaagattgtagggctaaatatgtatttcacttatatgtcgattgataataaatacttggactatagtatttcagtatatagggttctgctagtacgaggacgcaaacgatgttatagcaaggaaataagagacaaagatttttatacaagttaattgagatcccggtgtgtgtaataaccctattcatgtccataactgccagtcaaaaattgacactgatctcgattatgatccacagttatgctctgttctatggtagtgtttgtaactagccaaaatttatgtgcaactgtattttcctatttgaaataaagtgttcagcacacaaatcttccctacttaaacatataattctggtacctacaaaaattacttttaatcaacatgagtctagttttggttctaacacatgtgatcaatggttttgatctttacattattttatccaactaacctggtaacttcttgttattgatgtcaaatgtgttggc

SEQ ID NO: 105349 - DNA, 902 bp, Oryza sativa
aggggaggcggcagcagtggcgacaccctccctgacattaggccattgttagtgtttttagtgttcttagtgtttttggatattcttagattggtcgtatttttttaattcgtgaaacctcaaatatgtcggttcctaaatcggcacctatttcccctccacatcagtgacaccttctatgtgccggtcgggaaaccagcatcaattaaggtttttgcagtagtcgttgtaggcaaaaaaaaaaaaaacacgagagcaccagataacatcaggtattagtaaagattgatgtcaaaacatataattagaatgtattagtaaagatttagctcaaaacaaaaccctttgtagcattccgcttccatggattgaatacgtaagagcccacgccggactttacttttgaatatgtcctaagttttcttttacttaagaatattccctaagttatgcgtataagagccatcaatatacgtacgttattaaaaggatttagactataatcagagatgtacacaattctatcgtatgcatatactatatactaagttaaaacaattttcaaagtcaaaattaactaatgaacgtcgttacacgcctcatttaagatttagaccgccgtacatacatgtattctcctcatctaggtagactgaggagttgtggactactcttccatgccctactgatcaccgtgcaacgtgcatggccaaggaaatcgtaacagttcccatgacaaagagacgtgcctgcctgactgactgattcctgacctacgtacgtcggcgtcaagctgacgttctgatatgattgctctcatgtagtactaaatccgtcatattttaagtgtaaccacgagttttcgtacctaacttttaatcgtccattttatttattttttt

SEQ ID NO: 105350 - DNA, 700 bp, Oryza sativa
taaaatctagcgccctaactagattaaaggaaggagtaagttcacaataggtccctcaattggtcagcgagtttaaaattcatcaccaaaccgtaataccgtatataacacgtctctcaactttctaaataaggtccaaaggcggtttggagtgaggttttagctgacgtggcacctacgtggctagtttgacttggtctgcatcctacgtggcggtgacgtggcgatggaaacaaaatataaactttagttttttattaaaaaatgtggggcccacatgtcagccagacaaaaaaaataaaaatagtgggtcccacccttctctctatctcctaatactgctacctcctcctcccctctctaccggccatctctcctctcgcctcttctccctcttgcggcggcggcgctccccaagggattccggccaccgctcgcgcctgcgccaccacctgaacccggagctccggccgaggacgcatgtgatgaggtccttgtggctggcgcgcacgcacatcttcggcggtgggtggccgacgagacgacgaggagcagctgcgtcgctctcctacggcgtcctcaactgccgttgtggcatgggggaagaggggagaggaggcggcggtggtttggttgcgcggcgtcttcgtcctcgtcctcctcactccggatctacgcttggcccgccgaccagcccacc

SEQ ID NO: 105351 - DNA, 787 bp, Oryza sativa
ttcatgaatttacaaaactttaggtataattttcatgagtttctaacacttggcttgttttcatcggatatatcctctacaaagattatgctcatactccttccatcccatattataaggctttgtttcaaggaaagtcaacatttatagcttttgactagtaattaaattaaacttccgagatatatatttggtttcatgcatgtgacattattatgcttgtacttggaagtactataaaatgttaatttttgtagtttttaatatattgtgtaggacaaaatcaatggccaatgttctatagagaccatgtaaaagaagtatacaaaataaattttgagatggaagaagtatatataccctaaattcgaggtgtgcattgaatcaaaccaatcgtagtagtgacatttatgtatctaatgctacttaaaatggggagtttcgttaatcctctcccaccgaccacgcgcagcgcacttccttctaataaggacatgagggccaaagaagtccagaactggacttgcattggagagaaagggaggggcagctaagaagaggtctacggtctgagcaaggccttaccacaagggagccgcgtaggtgcttgcgactgataagtaataagtgattgacggcttaagaaatgactcaataaggacggggacagcgagtcattgaggccacaggggcaagaaagaagttggtatttttgctttaatctaattgggcttgggccagtaggggtgccatgctaccaacactattaacaacaacttcccgagag

SEQ ID NO: 105352 - DNA, 624 bp, Oryza sativa
cacatctgctcgagtcagagagtagttgaatagtggggggaaattaagcaacgaatctagaccatcccttgtatgctggatggttagatgatggatactgctaaagttacatgatccgaatccatctacccctggcttctcatttcaccggcaaatgaaaacagtatatattattgtcctgtgcgtgcagcgtgcgtacgtgtctcactcttgttggtgtttatttaccggcgtccgtcgccctggtcccgacgtagtacgtggtgttatgttaacaggcggccgaatgtcgggggtgattcgtcccctaacctgccactgacaaacaacatggcagtagaatcgcagcaggtacactggtactggttacagcaacagttttttttttaacaaggctttccagtttccacatgcgtgtgtaacttctttgtaacatccagtgtgagtgccggcgcgtctttacatacatatacatacattatacatgcacatacgtacatatacgtgtcgtgaatgggcaggatctcttagggtgtgtttgaggagaagggaattcaggacattggggagttacgcaaaatgatgtgagccattagctcatgattaattgagtattaactattt

SEQ ID NO: 105353 - DNA, 759 bp, Oryza sativa
aaccctggtgaactttctgttgccaattcaagaatcttgatgtctctctcaataaatcgtactatttagcgataaatcgcaaatgatatcgtaacggctgagaagtcaaaagaacgaattgctgcaatcattaattatatatgatcaatcaagcaatgtgtactaagattctacaaaatcacaaaacgaatcaagatttgatcacaacaatcttgtaacccaaaaaattttattgcgatacaaactacacgtcgatcacttgatgaggttggttatggccgtgcagatgatcgacatctgcacggagcaccagctacgctgcaccagcggcgacgggacggcggccttggcgaaggcatcgtcgcactggcgcgcgagggggatggcctctcccaccttctccttccccgcagcgtagctttgcgcgttgatacagtcgtatccttcggcgaacacaaaggacatctcgttgtacagctcctggcaccgcgcaagcaacggcttcgccttggcaccggtgcctggcttggctacaagtcccttgatgtcgaagaccgtgtcttccgcgttggagatgcccaaactagccgcgatcaaggctaggccccgtgtgtccgcgtctgggctgaggtggtggttgctcagcttggacacacagaacttgtagctgatgcggctgtcgatgccggccgcggccttgcatgttccttgcacgtccgcgtgtgcggcgccactcaacgtaagggggtaccgagctcg

SEQ ID NO: 105354 - DNA, 607 bp, Oryza sativa
cgctgcgcgtaaccttcttttgactaccagaggaagacgacgagacgatcgagcagaaggaacaagagatccagcgagagcgaaagatcgattaggagccgacttggttgtttttctttgggaggggccccttctcgcgtaaaatggcgcgatgaattaacgtatgattagttaagcattagcttaaaaaatttagaaatgggaggagcatactcgtgactttatcttatgattgtattttatctgtaagtacttattccgttagggatatggactgtattttgtaatacggatcccttctcctatataaggaggggtccgggtgccttgaggggcacgattttctccagatcatacgatcaataatacactcggcggatcaatccccagatagaagtagggtattacttcttgattaagaaggcctgaacctgtataaaattcattgtctctaaacccatccacttgtccagcttgatagccaccccattttagtattgccgaaatcttgttttgacagtggacaagcccgaaatcgatatactcgaagagtcgcatcatctggcatgaagatgtacacgccgtcgtgacgcgcgcagcaacacgt

SEQ ID NO: 105355 - DNA, 1144 bp, Oryza sativa
ttgactaattaaacatgtgttcacgttgttgtgatatttaaacttacggatgaattacattctatcataatgctgtgtaaattaaagttctctaccggccggtttctgaccttgtagaagcaggattgatatgaattattaaaaaaaattatccccttttgaaatggattgttcgttggactgttctttgaaaatacagtacaagaaagtgttttcagaaaatgtattttagcaaataaactgtgacaacgtctgcagccttctacaactgggcttaccatgtattatactcctcgttttggccttcacctaccacctatctacggtcgaacataagtttcttattaaaaaccaccgtaattttgataaattgacaatttggaaaacttagaatagaccataccaaaaacttattaaaaaataaaccgccgactcaacaccatagatattggcgctgaggtataacgctttaacgccatacatattggcgctgatattttatctgaggtggcaaaaatttgctaggtcaggaggggtcaacgccaggctgtttggggcggagctttttaccatctaaaattgttttctggatcaaaacattcatgcgtgcttgcttcgtgtggtggctagaagcctactctctcacctcaaggaccacggttcgattatatagcatttattccctccgtttcataatataaaggattttaagtttttgcttgaactgtttgactactcgtcttattaaaataattatacaaatataaaaagcaaaaagttgtgcttaaagtactttggataataaaataaatcaaaaaaataattccaaattttttataagacgagtggtcaaacaacgcaaacaaacactcaaaattccttatattatgggtttgagggagtaatacttaaaatatataaaaagagttcttgggaaaatgtgtagtttcaaaagtgtagaacttggtgaaaggaaaaaaaagaaaaaaaaacattgaaaaaagtgcaagctagagactcggacagtggtctatgcaatgagagcaatagcatctaaccaccccagcagaggtatacatgcaatagagaattctgtagatatcttttatttgttaacaactcaggcccaagtacattagtgctg

SEQ ID NO: 105356 - DNA, 812 bp, Oryza sativa
ttcgtcgattatttcggcttatacagtttcacattttgcagggtaacgtcccgatgcccatgtattacgactgaacacgagtgcaatgcaagcagagagaaattatttgccaaacttttctatcagaaataatcgagtggtgactctagtgcttaaaaaaaacacgatcgtacagactagtacttgtttcttgtcagtatagattgaattaataaacttttttttgagacaaacaaacccaatattgcttacgcatctcaatcccctgcaattggtcatcttagtcattagtccttaaagagatcctcacacatttgccttgatctgtccttagtccttacccacaaatcctgaagtcgttgagttaacccaaatattacgatacgtctccgtgaaacgtgtcacacgccatagaaatcacttataacccctcggtgaaaacgatatttgagctgccctctaatttccctgtcattttaatttgccttgtcaattgtcataccagcgttggaagcgcacgcttgcttgcggcgtcgcgcataagcagcaatccaatccacataaaaaaatcattgaaaatactccctcgttctccttccctaatatttgacgtcgttgactttttaaatatgtttgaccattcgtcttattaaaatcttttgtaaaatatgtaaaattatttatatatatataagtatatttaacaatgaatcaaatgataagaaaagaattaataattacttaaatttttgaataagacgaacggtcaaatatatttaaaaaaagtcaacggcgtggaatatttacgaaga

SEQ ID NO: 105357 - DNA, 591 bp, Oryza sativa
tagacgatcgagcagaaggaacaagagatccagcgagagcgaaagatcgattaggagccgacttggttgtttttctttgggaggggccccttctcgcgtaaaatggcgcgatgaattaacgtatgattagttaagcattagcttaaaaaatttagaaatgggaggagcatactcgtgactttatctgcacatgccgcatcatatgcaccggcaatgggagatcgatcaggagattcagagggaagctcaagtttaggcgacactagagaagtcaccattaactaatgctgtactactactatatgtataaactgagcctgcagagcagagtgtagctagccggacatcgtgatgtaggcacactaattataattaaacagagttaaccgattattagtataaaaatgacccatcctacaccaagacagagttggaggcaatggaaacaagaaaaagggctaaacaatgtatgtggctgtggcttcacgagtgatgaattgatgaatgggccatgtggtgtcaccaagagcttcaactgctcctatgtttctttctgcctgaatcgtcctcagctcctttcgttcactcgaa

SEQ ID NO: 105358 - DNA, 972 bp, Oryza sativa
aaatgaattttttcctctcaccacccacaacattttagattaatttaaaattgtggcacattgaaatattttggactcaatgttgttggtttttttattaaaattgtgaccactgtattctaaagagaacaccagaggatgcacatgacatgttctccttgcaaaaaaatgcttatcttcttgagaaaaggtgctataggtcaccttcccatatattctctctatttttaatatatgccaccattaactttgacgtgacgtttggttattcatcgtactaaaaaatttatataaatgttttattttgttgtaacttgttttatagaaactctaaacttaattaacttatatttttatatatttacattaaagttttagaacgttacatgaaaagttaatggtaccatataaaaaaacagaggtagtacttatatcggatggcgagataaagagctagctagctagatctaactactaagtgatgatatattccaaccaattcccaatggaccaggaaatggatgcagctagccattctgacgcatcaccacgtacaccacaaactcacatgaagagatcagaaaaaattgtggctgtttttgctagagggaagggtagcttcagcatcccaaagcatagcccaaccgctctgcatgacctcaaagtgaaagcaataacacaaccaacataaaggaaagaaaatgcaactcatgtttatccggaagtggtcgatcaaatgtcaaagagatatatatatatatatatatatatatatatatatatatatatatatatatataaacctgtaatatcatgaatcgtcatatattcaaatggtacgatgtaccagttgtgaattaatgatgaagtatatattaattacaattcggtatccatcggctaataggttaagttgttattaatcccatgacagatcgagttgttgtatgcttgctttaatatttttatcca

SEQ ID NO: 105359 - DNA, 1099 bp, Oryza sativa
caataaaaaaaaggaacaccaataaaaaaaattctatgttctatctagtgattgcttctagggtttgagaaagagaattatttcacaatcgaagcaataccttgtgagcggtgctcctccatcacccaaaagatgctcgcaagtggggagatgcactattgcgcttgttcttccacaccgaaactaccaccgaatccgttgccctggtcgaagcagagattcgggatgggtaaccacgggagagactgagcagtaccctccacatacccatgtagccaaccataactagtgagagagatgatgtgagaggtaaagatgctgacgatgctgcaacggtcatggcatcttgtcatcgtcatcgatgaagtaggaggcgagccccgtctcgcaccatcctaccgttgaccattggtcccgccacgcgatctgctccctccttttggccctttgttgacggtcgttatagaccaatttcgaccgtcagtataaccaaaatataggagaattagctatgcttgcaatgcatatttgttttagaataatctatttgcacttgcacttggattctatctgattgtagatattgctacataaagagaaggagaatcgacggaaaataaacgaacaattaatcggaagccatcaagaggtagacttacggatgaatgggcctataaatccaaataaataatctcaaagtgcccaaaacaccttaccactggattgaggaaccatcagagagggggcctgccaaaaattgggccgtttgggctaggccagggttggccaaaccctgggttcggccgaacccccatcacagccgttcatcctgtggtttggcgtggacatccaggattcactcccaatgatggttagagggcgttttcgacccttccaacagtcattacaaggctatataaaggggttaccttcttcattatttcacacacttaagcaagaagatcaagagctctctctcaagtttagttagtgttctagtgctagtggaataggaaatagaatagttctcttaatcctcgagtcttcaggaaaatttgggtatggctctagtagcttctctcccgtttgtaagacttgt

SEQ ID NO: 105360 - DNA, 3819 bp, Oryza sativa
cgagctcggtacccacatctaaaagaacattaacatgcaagtaacagagattaaatcgagatgaggttagcagttaactaattactaatagtcagtgatgacacgtcaataacatgtcacatatgccatagatgcaccgacaaatatgtaatcctgttggtacacaatgatgacatgactgtcatgactggtagggctggtagcctgatgggaacaaaagggggagagagagaaaggtggccctcattgattcaggttaagattgcacccaagttctaacaacttaaagctggtgggtgtaatatagcgcaataaccagagaattgaacgtccgggtgcaacaacttaataaactagacgataccccgcgcgttgctgcgggattttgtagtagagaaatggaggtgaaagataaatataatggataactgcgggaattggtgattttattctatttcagcaaacaaaagccaatattcttgtgatacaatctttaaactgaagcagcaacaggatgtgaagattgagacacaaatttctcaacagtaataaaatgcaagagcaactaattttgattattgttactgacgacctcttctcttgaaacgacttgtatgtgagacctgcatgcatgtgtgaggtagcttcagttgaatcttttggctcgtagaagaatacatttcggcaagtgtatccaggtatctattgccatttgattgtggacaaaggataaaaaaacatttgtgaatgtttgggtggatttctgaagaaaaagatcagtatatgtgatgaagtacagaagatttgataaccccactcctagttagcacgacaacagaaaatgctgaggcgtgaggaatagagaaatgaatgtaataaaatttgttaattaattagtggtgacctgttggttggttattcttgttcaagatccatatgtcgcaatgagaatagcgttgatgacaattaggagaattgaaaaaggaaagtcgatcttgcaaggagaaacaaaacggtgtgtgtgatactttagataagtcgatcaataatggtgcgaataaaattatggatattatagtaataatatgtttgattcgttgttgattgctgattgcattagcattaaacgctgcaatcggggtagttaattattatgttttcgaacttacagttgagacactaatgaaaatttggaaacaataaaagaatagatatgtatctagctagagtaacagttccgagtgaatggtagccaacaaagtaaaactaagaaggtgatataatggttgtagaaattttagcagagtcagtagcttaatttgtgtgggaaaagtgattgtttaatctaaatgattacatgtagctaagtgaaggatgaaaaataaatcaaatttaatcttcaaaattttcatgtttgttcatatggtagaaataatatcaagagaaatataaaaaggtaaaagctttgcatgcatgacaatgatcttggtgactttcgctaaatttatgctttattatttttatccattcttattaacttattggatcaatattgtgcaatccctttaccatgatgtatattcagagaaaaaaaattgtttgtgttgtaagaaaagtgtatgtaattaccatatttgaataaaaatatcagaaaactctcaatcttaattttctctctttcttgagaacactaatcatgcattagagctgaaagatcgtgtttatagaaacaaaataacttgtactactttgaactgaaagatcaataaaacaaaataaatacttgcactaacctgatgaatctccgaatgtttgattgagctattacaaagaacatcctttatactccagtcaggaagaacagaaatccaaagaattaagttgaaccaaccatagaattgtacctgacaaacccaaatataattaggaacatcatataacaaagaaggatgagcatggacagatccaggaactaatatgtacctaaattaagttcattgctgaaataatcaatctgacctttcagtctgatattctaatgtgaaaatcttatacatagtagtgttgttaaggaaaaaaataatacttagtacctcttgcaaagcaggtatcgtagaatgggcatataatatggtgacaacgaatatgatgcaattattcattacttaatatatcgatatattttcttgatagaggaatcatatcagtagaaatacgtacatgctgcagtcgctgctttagattggaacatcaggggattgacctcagctgctcagcaatagcccagagctactactacagcgttagcaggcaatgtacttatagcaatattctgcaatcagatttcagaaattaaccaaattataggtgcagcaatgatgtaaaattggtatacccacctgtgatctttagagtcctgatgtaataccatgagtccatgaatgaaatagatcctctaacaaagtgtacaggctgaataaagtttgaatccatttgaatagggatagtagaaacctgaagaatagccaaaaccgaatcgatctctctattttttaatgctttcataatctcagggataacaggaacggatcaacctagcatcagtacattttcagatttgcatcaattgccggatcaaccaaattaacacaaaccctgattactcatttggagtcataaaaatgccatccaatgaaccgtgcaggataagagaataaaacagggggtgatggtcagatcaattaatccctacaaagcagatcaaactaattcagttacctggtgcaaagttaatttctgcaagcagtgataagataacattctaacaatgtgaaagaaacttcaagtaatcagacgaaattaaagaatgcttcataaaagatagaactgattgaccgaagtattagagacagagatcacaagcaacgattcaaggattaggagatctagaactgatgaatgaaaatgagctaccgatcgagcgaagcaaatgatgcagattaattccatcggttcctgcatcggcgtgtggatgtggacggctcacctggctgcactttatagttgggtgtttttgtcgagtcgaattttattcccatctagtggccgacgattcccagaagaagaggcggcggaggagaaggtggtgcccgacggttcccccaagagtaagcggagagacaaaggaaaggcggaacggcgtagggaggagaagcgcccggagggggagggggggtgggggtgaatgagaacggcacggctgggatggggaaagcgagagcggcgcggggatgcgagaagaagcgagacgaagtagcgcacgattggggaggaaccgcgcggggagagcgaccggcggcgggcccgcgcctggcgcgcgcgggggctggtggggagggagaagtcgcgcgcgcgatgggggagagtaggggtgggaaaaaaaagacctagaccgagaaattcggtcatcaattcggtcctaggtagtgaaagaccgaattttgttaggtcaattcggttagtcttctcgggtaaccgaatagaccgaaaagaccgaattatcaaaaaatgtctaaatacaacctacaatccactatgtttaataggattacactctaattttcacatccctacttctaggcatgcaacataataagagtctttactcataagtgcttacgaattttttttgtgatttttgtgttgaaaatttccattatttctttgcatatatgaaaatgttgttgaatttcggtcaggaccgagaccgaatttgtcggtcttgacattttctcactgaaattcggtcttcacttttta

SEQ ID NO: 105361 - DNA, 1998 bp, Oryza sativa
cactctaattttcacatccctacttctaggcatgcaacataataagagtctttactcataagtgcttacgaattttttttgtgatttttgtgttgaaaatttccattatttctttgcatatatgaaaatgttgttgaatttcggtcaggaccgagaccgaatttgtcggtcttgacattttctcactgaaattcggtcttcactttttaaagaccgaaaagaccgaaagaccgaagaccgagaccgaaattttcggttaaaccgaatgcccacccctaggggagaggaccgcgcccggcggcggaggaggaggattcggtggctcggtggaggagggaggcaagagctgtgggatagaacgcatcgaaccgttggaaccatctgatcgaacggttgggagtaaaagggtgacgtggcctcaccagaactcagcaaaatcctaataactacggatcacttgtatagtattataggatgagtgcgttctagtacaacaacttgacaatttagtattttggtgcatcaacttggctaagtatatgttgtgtgagtttttttttttcacgatgtcaatatgccattacatagtaatcctacggatattaccttactatattgaatttaatctttaaaaattatactacacatacaatttacatctaattacctttaagattttttttcttcaccttctcaaatatcaaccgaaatataataatttctacatccaatttaattgactttcgattattagttattagaataaaatataaatatgcttatacaaatccacaatagtatattgtcaaataagtacttaaaattgaatttatataaaaaatgctccaaataattaagtttgttgtcgcataacttcttaaattatatcaaaatcgtacctaccttgtaagttgttgtatttatatgatcgtttataaagttcttatactaaattgcatctacatgctaagttgttgcactaaaacgcttatatctcaagttattgcaccaaattgcacccacctgccaagttgatgcaccgtgggtgcaatttactcctattataatctagattattaggagtaagctgaaacaaacagatagtttattatgatatattattacaatctataaactggattactataatatggtaatccactctaaaggtgcttttttggtagattattgggtggctaacagctaataatccagataaacaaacaggaaaatccttccgttcgggcacctggccaagttgaaataaatcgggcgctctctcagccacaccatgtatgtgcacacctttttctctcctcaacctgtcaactcactgcatacatgtaagaatggcatgtaactctccctttttctctcatgcaacttactgcggctgcaacaaatcacccacatattacagaaccctctaataagggaattcgttttatttttttcctccaacaatgtttcagcaagtgcactcgtgatgtttcactatgtatggattaaatgttacagtaaattaaaacattattttgcaacaaatcactcacatattacagaaaccctctgttaagggaatcattttattttttgttccaccaaaaatgtttcacctagtgtacttataaggtttcactatgtatggatcaaatgttgcattgaattgaaacattattccgctatttgctgaaacattgtttttatataaggtgaaacaatgcacgattttttgagaaaccgttgtttcatactttgtagcaaaaatttttcatgaggtgatttaattgtgtttcagctttttaaacaattaaaacatttttgatctacttagtgaaataattccgatctactttgtagaacaacgtgcaacatttaaaaataattcaataataagctaaatatttttttcattggattatatccatgtgtggtcttgttttaaagatttaattgcaacggatttaatggggtaccgagctcgaattcgccctatag

SEQ ID NO: 105362 - DNA, 1136 bp, Oryza sativa
aataattacattggcctatttgtacatttgatgatatactttgtacacagagtctatggaacgtggggaaaacattgaagtgaatgtcgatgccaagtctgattcagtactgtaagttgttccctttcctctaagttttgtattttttttcttctacttaggaaaattgaccttccacccgaagttagttgtccaagtggcttttgccccacggtggatatattggacttatgatttactccaaactgtagtgaaaactagtcgttttggcatattttaagcttttaccttccatagatgccaaatttgcccttgtatatttctcttagttctccacatgcacatctattggtggtgtcccacataggcacataatttactgttcattagtaggaatggatgtgttttgctctgaaggtaacctatcatgagcattgggccatccatggtccaactgtccaagattcacacagtcaaaccaacgagactgatcagagcgctgccaaggaggcccgcacgaagggttgtacatgagggacatgttagagaggttttcttacaaataggatatatgttaaattggattgttaggtgtggagaggttttcttagaactggggtatatgttaaattggattgttaggtgtggagtttaattagtaatactaagcaacctatcaaaactaaattattgttttcctcaagtagtatggggcaaatcatcaaaacaatttgcattttgggttggggtggaacctaggttaaaactaaattattggttagttccttgtggtggaacttaccatggaaagaataaatagctggtaggtgacattcttgttgacaatgagacgtccgtggtgggtgtacgtatgtatgctcatatgggtgagtgtgcgcgttgtgaacgtctgcgtttgtattgtgtttcttgaaaaaaaattgctttgggggcaaaaattgggtgacctacttactttggcctggtcaacagaccgcattttccaagtgcaaaagttatttcttctgtcaatttttatatgctctcaaatgttgctttttgtttcttagggcacatatcgtgggtaatttaccagtgggacaggtaatttcacttgaacttagatttcttcaaca

SEQ ID NO: 105363 - DNA, 1859 bp, Oryza sativa
caagtagtatggggcaaatcatcaaaacaatttgcattttgggttggggtggaacctaggttaaaactaaattattggttagttccttgtggtggaacttaccatggaaagaataaatagctggtaggtgacattcttgttgacaatgagacgtccgtggtgggtgtacgtatgtatgctcatatgggtgagtgtgcgcgttgtgaacgtctgcgtttgtattgtgtttcttgaaaaaaaattgctttgggggcaaaaattgggtgacctacttactttggcctggtcaacagaccgcattttccaagtgcaaaagttatttcttctgtcaatttttatatgctctcaaatgttgctttttgtttcttagggcacatatagtgggtaatttaccagtgggacaggtaatttcacttgaacttagatttcttcaacaaaaatcatatgagtacatgcatgcagataacatttgatattcttttgtgtagatcaaagttgaacaaagaagttgtgagttagctattgatgatagcaagattcctgggacatcactacatcgtgcaacatgtagcacaggaccctgtgttgcaatctcaaaaccaattgaggaagcaaaaacgatataccgcattctgtgccaatgtgaccaccccaacgtgctgaaacccataggtgtctggaagaatccctcggacgacgctagtgcatacctggtactagaggaagttgaggcatctcttggctctaaagacagagaattcatgttctctgtcgaggactctttcatatatggtttttcaaatattggttttaaaattttcaggtatgattctgttgaaatcaactagaacaatataaatcatacgtaagctcatttattaacatattatatacttgtttaaatattgtagggcgctatgtaatgtggtgaattacattaacggactttacatgaatagtgctgctgggaccagtagtagtgttgctggagcaattccgttgacgcccattaaacttaactccagcatgatattttataagcttatggtagaaggggaggtggaggttgtggtgactgatttctgtgtaagacaaccccgagaccttgtaaagaaaaccaggaagggtcgcccaaaaggtatgtttattgttaattgtttctactaagccttggtttcacttatttaggtccatactgtttcaaatagtaaaaaaagtagaaacaaagattatttgcaaaggtttacaaatgtgaggggcgaatctagaaaattgatgtcacatttggatagaatttgttattattatattgtattatcttctaatcaagagagaagatcctgaatttccatgtatgcccttggaacacttgaacttggaagaccctccttatcctcggtcctctgtgtatactgtccacagtcaagtgaatcattatgagcgtgatatttcttagttctcccctcccccaccatcttaattatcagcattcttcttcaacaattatggagctagaggaggcgggtaccgatgcacgaacaggccattacacttctcttctcatggattctttgtgtcgaaataccatcttccatttcctggattccattcttttagataatagaaatggccacaaaagaatctctggcctctaccattaggcacagtgccgttgagttctattgctgaatatcctggattccattaagtcaaagtcctatattctattccctgggattcttttgtgtcaaaacctcatcttgttacaagggcatgtttggtttgtttcccaaaccaaccctggggcagatgttggattaccaaagtttggtagagttgggatatgtttggtttggaac

SEQ ID NO: 105364 - DNA, 1650 bp, Oryza sativa
gttgagttctattgctgaatatcctggattccattaagtcaaagtcctatattctattccctgggattcttttgtgtcaaaacctcatcttgttacaagggcatgtttggtttgtttcccaaaccaaccctggggcagatgttggattaccaaagtttggtagagttgggatatgtttggtttggaaccttgccagatttttgttagagttttaagagtggaagcttctagaatatttattgtgtcttggtatggtagcaatgatttaagtgtcgcggttggttgtcctaccaaaatttggtaaggttttatgtgccaacaaaccaaacaagccctaaatcacggattaagttaattcttgagctagtatgatgctccttccatttataatcaatcaccatataatttttctgatgttattcccaaatgatcatatattagtatgcattccctaagtcttttcgtcatatgcatatgagagtaaatggacattggtgcatgcatccatgcacacaaccctttacaaccaacatgcaatatcttggtttgttattggctaggaaataatagggatggtgcatgcatcaagtttgttatcggagtaaatgtagtatgagagagttattggctttccttggtcttggtgtactcatgtaatatgattatcaattaggaacggagggagtagtgtgtaagtgagttgctgtgagtttcatgggttcaagaaggcactaatatggtcctcctttttagctagttcctagtttatggtgtaagcatttaagctctagcttatgtgttcctgaaccaatagcccaccaagttcattatatttgatgattacagcatggactttgatgtttgccttgtcgatcatcatgctcacaatctattcaatgaaatgaccgtgcacaattgggcaatcgtaatcatggctggcccccggcgattatcataatttcttttcatgtgttcatggggtgccaatccgggtcttcgggatactattgtggtggtatcacgatgtttggaccaggtggtacaggagttttttacccaggagcatggttggcgatctagttctacggattgatagccactaatatttctgttttgtgagaggggtcttcataggtctttctttgtgtgtggctgtgtgcattttatgcagaggccgggagtgggctcaattgaaatgtatcatcttggtgtatttgactgagtttttaataaagctttcattatcaaaaaatggggtgccaatcatcccttaatcgttagatgtgctcaattgttgttaggtgttggggtgacagtacatgatctaccataccaagggcaaacctccctgtatggatggagagccctatgctatgtttgttcctcaatgccaaggagatgggaaagaaacagaaaagaagggaacaatttgggcatatattatatagtctccaagatatttgaaaacaatatttctaatagctcagtgttttctagccaaagaggaacagtttggagtgtctttgagctgagcatgattttcagtgtcacaatgtgaataacaagttaagcccttaattgccccctttttttctatgttttcctttccttttttatgtggaagttgtataaaaaaccccccctaccaag

SEQ ID NO: 105365 - DNA, 607 bp, Oryza sativa
ctggttaatctgtcagtgcaaacctctttgtgacagtgcaccactctatctgaaaacttgcagggaagcagaatttcaagcagaaacctggtctccatgaagacgatgacagcaaggagaggcctcgtctccctcagatcccctcgcttccgcgtcttctgcgcggtaactcgctcgctagtgatgcaatgcagatggcctttaatttctttcattctttctttgcctgaatgttcaatgatgcaatgcaacgggcctttctttctttatctaaatgttaacgatacaatacaatgggcatttctttctctgtctgaatgttcaatgatgcaatgcaatggcctttctttctttgtctgaatgttaacgatgcaatgcaacgggcatttctttctttgtctgaatgttcaatgatgcaatgcaatgtgcctttctttctttgtctgaatgttaactatgcaatgcaatggggcatttctattgtgttgtctgaatgtttttctgaacctgacgagattttaggcgaaggcggagacggtggggaaggtgatgcagatagtgaagcagcagctggcgctgggggaggaggcgaagctggcgccggagt

SEQ ID NO: 105366 - DNA, 1238 bp, Oryza sativa
tatagggcgaattcgagctcggtacccattttaggtggattgaacacatctagtcctatgaatctggatagactccgttcagatttatagtcttaggatatgtcacatccacctaaaatcctttataatatgggacgaagggagtacatgttttttatatctataataaagcacgtgcatttaggctctcgtggatgtgacccatcatttctgtccaacctcgtgacgtacaaagatcaccatgggcttctcatgcaagtacagattgaatcacgagtaatctcacaaaccatgcacgccgtacgtacgcattgtcgtcgccaaactaattagctcgtctaatcgtggtttagtcgtgcatggtcagcaatagcttgcctaagcaagctttacaaaaaaaaaaaacgtcagccataagtaaaaggttcaagtcctcgtcataagcaactaaccaccattagttagtgccaaagcttatctccaaaacacactgttgattgtcttgttccatcttagttcccaccttcacgcatgttgccacgcttgcacggcgcagttcgttcatgcgaaaaagtttctttcgcccctcatcggttgctgatggttgattatgtcgtaatgacttattagcaataaaaaataatttgtaggtaaatttttttatacgtgtgtccctaccaacttagaaaccaatgtaaaaaattcattcaaaaaaacaaaatcaaatttaaaaattcaaattttggcaacgaattataagtaatagagcaaacaatgaggcccttcatttccagataaagtagagtagaaacagcgttgtcatgtttaggttaacccagaagatgtttaaaaaaaagtgttcggttttgttgtcgtgttttttttaccaagtatagtaaatatttacccaaaaagaattaccatccctgcaaaaagaaaaacaaaaaacatgaaaagcatccctcaccatcccaatcttttcagttttcacccatccgagttagtagtagtaattttcagcatgagctccctgtgagccctcctcttacagttgttcaccaaaccaaccacatcttccacgttcttcttctgccacacccattgactcctcaagttggcacaagaagaaaggtatagcctcaaccaacaagggaaattctccgctgtcgcaacatgaatcctgcatagtacatatgccctctccctgaaccctcctcatctcttttgatgaagagagg

SEQ ID NO: 105367 - DNA, 625 bp, Oryza sativa
cgcgccgccggcggccgacgactccttcttgaagtcgtcggcgctgatctcctccagcgaccccgacgagtccccgtcggacccctcccctccccctcccccaccgccgccgccacccgccgtaacgaggtctcccccgggtgccacgaccgccgaccgcggccgctcccgcgccatgagcaccaccagcctctcctcgtccttgggcgtcaccgtcacacgcatatgccgtccctctctctccctctccctctcccgcctccggcgaccgcgcgcctccgcaaaaatcgagtcgagctcccgttccacgcggccaaatccgtcgacccggagctcgatccgcagcgccccgcgccgcctccccgaccaaatcgccgcgccgcgcccgtgcccccgccggattcgccggattccgcggcggattggcgccggatcggaggcgcacggggggagggggagacaaggcgatgcgagatttgggggaaaaaaagaggggggagatgggggggagtgcgtgggcggggtatttatagggaccggccgggcccgatctgaccgttggagtttgatttggacggcggatgatgcggacacgtcgtcgcgatggggggtttggtgtgggggg

SEQ ID NO: 105368 - DNA, 634 bp, Oryza sativa
cacgaatgaaaacctaatttcataactcgcctggaaccgcgagacaaatttattaagcctattatcccatcataagcacatgtgggttactgtagcacttatgactaatcatggactaattaggctcaaaagattcgtctcacgatttccatgcaaactgtacaattagttttttttatctatatttaatgctccatgcatgtgtcaaagattcgatatgacttttttggcaaaaaaaaatttttggaactacacaaggccatacttaatgtccaatgttgacacattatatagctcgtcaagtaatgtctaatgttcttcatacttgctgattcattccctagacctttttaagatacagggtacacctagtagatctcggaatacaagaactaattgttgttctctgtaaatgctgtttgaacaaggtaaggatcgaatccaaacagtgccgtgtgttacactcgccatgaataatgaataaatgaatgaagtacaacctggtacttaccatgttaggaaagcagcccaaaaagggacttcatgtcatttccatgttaagcaaccaaccgaacaagaatacaaagggtgtgttcacactaaaattgaaaatttggttaaaattgaaacgatg

SEQ ID NO: 105369 - DNA, 647 bp, Oryza sativa
caaaagaaccaccattttctcacctctctctctctcttgctcactctttgttggtgattcttgaagctgcttctcctccatcctcccttcctgcagctgctgctgcgcttgtgttgtcttctactgctgctgctagtgaactcccaatccaaatcctccgacgcatcgaggccggtggtggtggccgacgcggtgggtggcggcgaggtcgacggtggtggtggccaacgctgccgcggcagccgggggcgcctcccaccgccaagaactggtggctgcgggcgcaccggcgagccgccgccaagaacgagggagaggaggtggcggacgcaaaggacgagcgccccgaggagagagcgggttccgaccgacaccgcgcctccccatcggcgccagagatggcggcggcggccgaggaggaggaagaaagcccccgcgcgtggaggaagagcggtggggcggaaaacaagcggcggggaggggcaagggcgatgtaatgggatggaaacgagtccacgcgcaggcgagggtaggtgaggaaaaaatttcgtcgccctcccccgtctcctcgtgggagggtcacgctcactgtgggcttggtaccttttacccaggtctccatccaattaagccacatatatatgggt

SEQ ID NO: 105370 - DNA, 1168 bp, Oryza sativa
ctcataaactacttgcgttactaaataaaggtcttgtgcaaccaagttagttcaatctgttacaatacctctgcactgtcgtccatggcatcaacttcttgcaacatgttaaaataaactggaagatacctttggaattcatcttcaaactggaattcaaaaccaataccaacccagatgacggttcaacattgagatgtcaaagaataaattgaagttaagagaatcaacctcccagttccactccccattaaactccattggagcagaacagaatgcctttgcacggagatcttccttttgctttgccaaccaacatgtaaagttattttcaacataagcattgcctttctctccccccatcaggtcctagtacgattaagcatacagtcagaatagtgatcaatttaaaaaataaaattcaactgattgtcacttgcctggctttgtgggtacaaattgctggaaatatagatgtatatttcttcacagagaacaataagatccttatcaacagtatcatttgtactggagttgaacttgaaaattaggtttctcattgcacatggtagttgatcatctaagcgccgaattatagatggaagcaattcatctgcaacaaacagcttgcacctctcattgtcggtactgcctgcaagtcggaccatagcaaggcaaaaggaaatagcacttgtagttgcttcatcatccacccaatacccaaacaagctcatccttgaactcccaagacaatcatgggttaaaagataatgtaaaagcccattgtttgattctggagacgataaaactcccagcaaatgagacacttcacgggtgaactcaagaagttgagtatcttcaaacttctcaatgttttctgttggcccagagagtttcccgaagtataaggaactttagctcggccatggtgcataaggctgaaccacgcaaagtaaagtaaatcctcacagtgatcaagtaagggtcgtagtaggttcaacatccacttcttccagaatttggaaggacaatatgttaccaaaggaacgaaaacaagattgataagtttgcttaaatgcctaaactccattgaccctaaatcttcaaagatagcatcattgaaagatgaaatatccaatagatcagaaaatgccccttgaatagataa

SEQ ID NO: 105371 - DNA, 557 bp, Oryza sativa
cagccacactggcgccgtgcccgtgccaccgtggcaatagggctgtcgtggaggtgctgactaggccgaaagggggcgccagtcaaagtggcgccgcccctcatagcacggcgccagcatggctggcgcgcccctcctctgcaggccccaccaactttctcccccccccaaattttcgccaagtctgttctgcctccaggcaacggctggcgcccccccccccccgaacgcggcgccagggtggctggcgcccccctcctccacccatcgaagcccttctgcctccaggcctcggctggcgccgccctcatggaccacggcgccagggtagctggcgccgccctcccccagcccgaaacccttctgcctcgcggcactggctggcgccgcccttctcaacctcggcgctagggtggttggcgccgctctctgcctccctgcaaattgtagatccatattgcacaaatgtaccaattcacagttcgcaattcaaatcacaattcacagattcgtacagactaaaacaggttccaattgcacaaatcacaatgccaaaa

SEQ ID NO: 105372 - DNA, 1123 bp, Oryza sativa
atcactaagaaaacgatcccaaacaaacataactaattcatgcacccggtgcaggcctcatgtgccaggtggagtggctgatgttgccatagtagacctgttggaataagtattcctgtaaaggagttcaccacatcaaattgcaaaacataatttcatcataaaattgtttaatttatattcttagacattcatgggcatagttgttcatccaggcacagtagctttcaaaggagataaccttcatcagaaagaaattgtgacagtggcatgatatgtcgcttttggttttcattctgactcgattttattccaccaagaaatagtatctccaaagtttaaaagaatggttagcatatgaaaaatgaactaggaaaagtatatttatttgctcgactaaaactaattaaatattactcatgagcagagaaatataaaaaatcaattaaatggttgacaaaggaataaaggacatgaatactttatacaataccatggacatcttcagcttagtctgaatgtagaaacgtgcataaggcttcaaatgtggcgcaaagtctccagggtctggtgtcagtggctagaggaaagtgaaaatcagatttcaatgaagttccaagaagattcccatatgatatgtatatatgcatacctgaaactgcttgttttcttttgcattggttaattgaccaactatctgcaaaagcaagtccttgtgttcctaaacagtcagatcattatgcaggccattaaaaacaatcataaaatggatggatgaagatatagtactctaaaagacccataagttacttctcgtatcagaggatgaaatcgaggctcccagaaatacagcacatgacaaagtaggacctggcagtagaagaaatattcagacttgagaggagaggcaacagcaatatcatatttattgcctgtttgggattccaaacaagaatgttgcaagtacttcacagaaaacatggtgcccacattaataagcctcttataaaaaagtaaataaattaagatgacaaacactcacaccaaccgactgatccacttcataagcatcaaaagtggattgtatctccaagttttcttcaagacgttcaattacactata

SEQ ID NO: 105373 - DNA, 596 bp, Oryza sativa
ttggtgagcatttggccaacctaacaaactaaccatgagaccatatatagagagagacatatgtgttatgtttgtatatcgtaaagttgtattttgtatggtctgcttagtatcacatttttgctgtttttatggctttatacctttagataaagtgggatttggttttttttggctaccatgtactctcctaactgaattccatggattctcatgattttgggcaaaattttgttcaaatttattttgaattccgaatccggtgaaaagcctgaatattcaagaaggggataattaataggaaaaagtccaaattaccccatgaactattgcggtcgatcaaattaccccccgacaaatagcagacatttttcactgtgaactattcaaatcggacaaataaccactcaagcactgttctatgcgattttggcccaagctggtacacatggcgccgacgtggcatccaatcagcaaaaagaatttttaaaaattggggggcccacttttcatatatctcatctctccctctccctaaccatatcttttgttaattgggatcgggatggccacatgggggaggcaactggaacaag

SEQ ID NO: 105374 - DNA, 715 bp, Oryza sativa
caggggtctatttgtaaaataaatttttaaaaaggaccaaattgtaaaaatttcagcacgcgagatcctgtactccaggagctgcacaggcatcgacacagagctccctgcgagaagctgctctgcccagcgaatccctccgagaagctgctctaccacagacctccatcacctggccttccttgctgctccatcgggctagccaccgtcctccctcgctgggtcgtcgatccaccctgagccccaacctcctgagccgctctctttatgagcaacatcgtgagagaccgtgagaccctcgtcaatcaggggattttggatctgagcgattccctttttggacacagatctgatttggtgaagaaggaaaaaagaggaggaagaagaagccctccattgccatgcactccactgccttgcagcgccagcagcggaggcccctggcgtcaagacggtggcggtgacttggaagccctcactgatttcgctttgttgcggtatggatatggatggcacctgcaggccaacgacggagggagggaacgatggccactgccggtggggatgatatgcgtggcgaggatgatgatgaccaatgcagcaataatgatgggcggagcatgcatgcgctgcagtagggggcgtcatccggggaggagggcgcacggtggcggtgttagtgcggggcatggggtggcggggattgcgcagccga

SEQ ID NO: 105375 - DNA, 623 bp, Oryza sativa
ggtacccaggggaaaaaacacatgagcttaaccactgatcattaaatgagcttcagttgttagaaacgaaaattcaataaaattatagattgatactttacactgaaattaaatgtactgtttagtaataaattcacttaagcactcatataagaagcaaattatagcgacaagggacaataacaatgtaaacttcaggattgtaaatttcagatggcccagttaatattaaaaacaacaatatcattttttttaattttcatttcaacacagcgattcatcaatctgactactgttggtgatctaatggagagcggtgaccaactcagcagttcgaccatcatgaattggttgtagagttttttttttagataatcaagtgagtcatatttgcattccgcactccactgctcacctattcactgtctatcagtatgaaaaatggaaccactctatggcgaggagaaccaaattgcactggagatgatatcattaattacctatagctacaatgatataattgccctgagtaagcattacatctattgcctaccgtgcaatgtgcataccggaatctaaataatcattaagcaataacgcatgggaactgaaaaggggaggag

SEQ ID NO: 105376 - DNA, 603 bp, Oryza sativa
gggcgaattcgagctcggtacccatagccagtgaaattgaaagggctaggctaggcactcgtcggcgtccgacgcgtctgaaaaaggagaaaaaaaatatttttaggatattttatccatgttcgtttctaaatgatgtaattataataagtcttttaaccatctggcgttaacccatcacatgtttacaatcttatattaaaaaaaaagagacggagagagaaatgttaaaaataaattggttgaagggaactaatagcattagtttttcatattttgctaaggtataatgaatttagggtaaattttgaagtcatggggatgacaagctcctgctcacctcccctgtctctgccctcacattaatgcttccctatatcctggattacaagctcctacagtccataattcttacgttttgaataaaattgagatcaaattttttaacttcgattatcaataactttaaaagtatttagtttaaaaataactagaacaacacatatggttttgtctttcaaagttctaaaataaaagtaaacatatatttatttattgtactagaaaaaaagcctgtgcgttcaaccggtaaaaatatttttg

SEQ ID NO: 105377 - DNA, 1005 bp, Oryza sativa
atcttcccacgggattaaacaaaatatgatacccttggagtactctcgggtgaacttctacaatcgtatatccggcgcttgcggatgaactctgtaaccataatataccaaaagtatttctgcgccattgctaggaattatacgggcttaatcttaggcccgtcatggatgatgtcatctctatcggtcattataagcccgttacggatgagtatattaccaaaaaaaaacaaaatttgttttttttgctagcctcaggcctttgctagccatgctcatcttcatcttcctgattttgtgcaccacttctgtctgtagctgcgccacttcctgattcttgctctccatgcttcactcaacatgtgtagccctccataaatcctcgttatatcagatgggcgtgtacatccactctactatcaaacatattttcattcttgcaatctgcacatggacaacacatgtaatcgttgtttcttcttttccaatcctcctccgtggcatttataaaatttaatgcgccatttctatactccttgctatgatgttttacagttttcccatacatccaactttgatccatcgctgcaaaaatgaacaaaatattagagaaaaatcttgtaaaataagtattactaatttaatgataattgattagtatttttcacttacttttatgaattttctgtttttcttggaaaaaagacacaaaaattcatccccttcaacctcccaccaaaatagtgaatagtgggataactacagagaatagtggggtggagtatttgaagtgtgacatagatatcggtaacggccaatgaacggacatcggtggcgggttcttcgttatctcaatcgggcatattattaagcttgtcaccgataaaagacataggtgacgggccatagattaatctcaatcgagcctagtttagcgcccatcgctgatgtgtctcctccgtgatgggcttacatcttgggcttgacaaagattatagaggtaat

SEQ ID NO: 105378 - DNA, 643 bp, Oryza sativa
taaaatcccttatattatggaacggagagagcacaaagttattacatcaatcaataaatgaatactagagtctggcaaattctacaattgtccacatttgaatcattgtaggagtacttcactgcaagtgtgtacaaccaaactaaacatggttaattatgagatatgaactaccatgtaccatcaaaggtcctggtctcctggttaattaaccatcacaggggctccctgccctttcgaaggattccctaaaaaaactaagttggttttgaggacttcagaattttgcccagatttctgtagtgttctaaaaattctagaaaaaatcatgagtgctccttagtgactcctaagccaatggaagtttcataattttaaacttgtgtagccacctgtagaaattcgcagaggacctgtgttgaaaaagtcgagcttaaagaccttcttgccttctgctgggcagaacattggccacggcaaacccatgtcagccaaaaaccctgcactgcacagaaactcactgctccactccaggccatcctcaccggctcaccatttccctctcactgttagtccggtcccacctgcagaggtcgtcctccacctaaaactgacacgtgtcagctccagcttcagaagattg

SEQ ID NO: 105379 - DNA, 631 bp, Oryza sativa
caattggtcataactcgcatccttgatactataaaaattcaagttcttctctcgttttttactctagcttcataataaatttaatgcacaaatgcaaaacaaacttcatgtttacgtacattcaaacaaaatacacgttcgatctgtttttttttcttttgaaaaaatacgttcgatcggtgcgcatgcaagtggtgcatatactgacatggttttagtttggaataagttcactttgtgaccctcaaaagtgatcgaaatctaattcgtgaccctagaccacaaaaccggatatcttgatccccgaactcttaaaaccggtgcaagttgaccccctagacggttttgctgacgttgcgcctacgtggtggtattgaccgggtctcgtttacatatagcgttgacgtggcgtttaggtggcatttataacttaaaaaatatgtgtgggacccatttgtcatcgacacaaaaaaaaattgtgggacccacatacatgtggagcccacaatcatcctctcaccttcttcatcctccctctctctcccttctctcgccacggtcgggttcatcctggggcgtcgacaggcgggagggcgttggaatcaccttctgctcatggttcttcacaaac

SEQ ID NO: 105380 - DNA, 515 bp, Oryza sativa
atcatgcataaagaacatttgatgataaatcaagtcataataaaaagaaataataattacataaattttttgaataagacgatggtcaaacttatcccaaaaatttaacagcatcagaaattaaaaaaagaggtggtactaataataagtaaccttcatagtccctagtataaaatagtgagactaaatatcacgcaagcgacttaaagaacccacagaatatatatcagggaattagtaaacgaggaagaggataatagcgtcagttcagaaattggcttactgtaaattccttcaggtagggcaagatctgatcaggctccacagttggtttgatatacttcgacttcgatgctagtatgaaaacgaggggcacttcactctctttaagcccaaaatactggaacattgtgcattcaaaaatggtcagacagcatgcattttcaactcttggacattggttttatacgaaatgttggggcaaagcaatgtactaataaagattgttatggaaa

SEQ ID NO: 105381 - DNA, 735 bp, Oryza sativa
ggcaatattgctatctaacccacaatcggctaacatctgtcggtagagggcagccgattaggttagatatcgatgttgacttagattatataggatatctaccactctatgaaatttccagcggcttgattgtctagatattgttcttctttttatacttaatgctgcatcagttgagtttgatctattaagtcgtgcttagaatatcaatctctagcctgccttctggttgccgattagggtagcatcggggtttcagccgatcttatctgatttaactacatttgctctatatgttttattgacatgttaaatctgccctttacgtcaagatcttattgcatctaaatatattaagcttctgtttggtatattctgtttgttttaatatcttaccatagagttgtatcggagtattagccgatacatgctagatctatctgatcggctatgctatgaacatatatagtcttgttgttaatatatattttgatctaagtgatttatactgtctcggcacggcgaccaatctattccaatcacttgatttaagtatatatcgacaccaggattatatattgttaatatctacagccgatcgagtagatttagttctttattatctattcataactgccgatcgatttacatatgacatcggctcaaagataaatgatacgtcatcggcacctagccgatcggctatcatttatgtacttaaccacggtatctttg

SEQ ID NO: 105382 - DNA, 518 bp, Oryza sativa
atttatttgaaggtatgcatggctcaacatttgtagattagaactggagagacaacagctccatgctcagccgccactgctgcctcttgagtcttgatatcccttcctctctagcaagaagaaagaaagaaagggaaaaagttgcatgaagaagctggatggaagcaacagaaagggtacgatcaattttatgatgataatatcacagagtagaacatgcttatttctaggtgacatgacaaatttgaaaaagtatacagtaatttcagaaatggatcaatccaatgattgggaacttgctaatcctatttgtttgaccagttgtacctgtgggtattcaattttctacagtaacctaggattttttctatgccacatatctcaccttgccacatatctcaccttacaagtacaggtccatgaatattttgtccctagataaccatttttactacctccgtagtagggcggtatttttcttagttgcctggagttattccaatggctaccttcttacg

SEQ ID NO: 105383 - DNA, 522 bp, Oryza sativa
agctcggtacccatgaagggtcttgtcacaatcactcgacatggtgacgtgtctgcacagacacggtgacatgccggtggattgtgttttgtgggtacagttgtgcacctctggccagagtaaaactattcgaatagccgtgcccgtgattatgggcgatcgaccagattcaccatgattagtcacatccttaataattggttaatgaactggtgtagttcaagaggtttggttgggcctgttcaacgtggtgtagcgttgatcagtagagatttattgttaccttaattaatcaaccattttactgttttgctcaataaaatgctttgcaaccgcctttatgcaaatagccactagccatccttgtttccctttgcacgtctgcatttttggtgtggcttgctgagtacggtggttttactcagccttgcttttatttccccctttcagaagtatagcgcttctgagttgaagacgaagttagaggaccaaggctcatacggggatcctctagagtcgacc

SEQ ID NO: 105384 - DNA, 521 bp, Oryza sativa
aatccttaagtctgaacactatgccggaacttggcaattgcatactggatgcatctttggatgtagaggctggattaatatcaattatttaaaaacttggcaatagcagaatttcatagttatgtgtctgcatatagaacaggttaaataaaggaacacacatatataactaataccaaagccgcaagggttctttttcataggaatggaaagtcgagtttagagtgttctgaatgttatgtgtaatttagaagtgctgccaaaaaaagaaaagaaaaactacatctttgtttatccagggtcaaactgatctgtagaactgtgttgaggccatccggtccaggtgatgcatatctctttatccctttcagtttcttcaggatttcatgttcatcttcgatagatatagtcgatccatctttactgacttgtatcactgagtagcaactagaatctgttcatcattgaatcagtcatcgccaatctgcagttacatgccatggactctttttctggccatt

SEQ ID NO: 105385 - DNA, 1484 bp, Oryza sativa
tccaaaagccatgccttgctggaggccataactgagttgcttaaagtgcagcgtcgttatttgtcactaccaatatagctgctttgcatcttagtcggagcttcaaaattcgccacaggctaggacaattcttgttgtagttgttggatatatggtctttcctagtgtacatgttataggcagcagtaaaatggggtggtgtagttgagaagagtgctaagggaactagggactttgtttttatctccctaacagaaactgaatcatattgaacagttggtttgaaagttcatgtatgctgccatcatcatttgcctgtatcagcatggcatgtgtgactaacgcagggaaatattgtcaagaggaattttatgtgctgaacagttttagcatctggaatcattgtattgtaatgaaacgaatgaagagtgcttaggtatgcccaagcttgtttacggttatgactgaagtaaattagcttatgcctagcactctagcaacaattttggccactaattaacagaaaggtaaacataaaaaaaaaatctcacaaatataagctccatattggagaactgtataacataattggagaatgctcttaaaactctcgatattggagaattctctcattatgaaattatatatgagattgtatacataattctcattttttttcgtcatttcataccagtctaataaaaaatgtcaaaaacatagttgaggaaaggtcactgggtagcctgcttttagttggttgcttctgtatgctcaatgaatcatgtcagtatttgaatttgtatgtggtgctgcaacggatataaattcttttatagttttaatgactatcacatagaagcaagtaaattgagtaaaaaaacaaaacttaatggcctacgtggatcatgacactctaatctggtcaaaatatgaagccatcaccctttgccattagattccattaatctcagacgagtataggatatgtcttattctcaatttaggttttgcagcctacatagcattttactgtacattcattatacaatcttgaatctgctcgcctaatatcaccaattccctatgcaagtttttcattaaatgggtaagaaatgtgcctatgtcttcttaggtttaaatgttctagcggacgttttaacattaacagagctctgtgttagaagttctcgggtataaattagatcagtaagtacgggcatcacatgttataacttataagtctagtgattattttttatgaagtcatttctttgtaaatgtacgggcatcacatctcactcttatttgtatacatattatctgcggaactacattagatatcagtgatattgtgtcatttgcatcgctgacggtgatactgttctgcagttcgactgtcatgctttgttttccattaccaaagaaattataacttgcacctgttggtccctaactgtttagtgaagtttgttttagaatcttga

SEQ ID NO: 105386 - DNA, 1435 bp, Oryza sativa
aagaatgtccggttgtatggttcaggggtgcaattcggacgaccacaataattcgagagggtaatttgtactttttcctattaggatcaactagttactccattgtctcatttttcgaaccgagcaggacgttgaatggtgctctccttttaaatcaaaaccgtgccttcctatcttgtctggagatgagaaatcatagttcacgtcaaaattaaaagtttgtttaaaattgaaacgatgtgacggaaaagttagaagtttatatgtagaaaatttttatgtgataaaaaagttaaaatttgaagaaaaaaattgaaactaaactcggcctcgggcctagtgtttggcctgttcggccaaaatttaatttactccacgcaggttcgacatgcattaccgtacggaacgcttttttttcccttacctggctataccccttggttggtttctgacacttaaaggcaatggaataataataaaatattttttaaaaaaataataatagtgataaatttgtcatctattatcctgcagaaaaaaaaaatcaaattcgatcaaccgggtgacaaaaaagagaatatttgttattttgtatatgttgaattttaaactttatatgttgttggagtgatatatcacacaattatatttattatgtttctctataaccattatatgacacataaaaaggatggatgtacatcccgaggtaaaatgactttcccttagcgtactgctatgtaacaagaaagtgtaggagatatatttgtcaaatgattgaattatacttttaaaaattgcataaacacactgtatgtatgagtagaactaagaatactgggttttatttatataagtggtttattaaaaaaaatccacctgtaataatagaaaggaaatcatgcgatctaaattcaattgtaaaaatatatgatccgtatgtgaaaatagcccatattttcacaggtggtcctcttaaatgtttgtccataacaatcacctgagagtccatctgcaaaatcgtgtgaccataataaaaaggatggccggccgccctaccagtaataagtacaagaggcatctcttctcctccatctcaaatctcctacatctttctccgtttttccctcagctccctctcacgaccagcctcctctgccactgccagagccaacaagccaccatcattgtcaagctccacctcaccacaacaacttccttcaacagctcaacctcgatctcctcttctccacaacatctcagcctcttctcccttcccattgagcgttgatcctcaatctctttctacaatcgttcaagtaggggggcaaatggatgacctggctttgaaaatgcattctatttgtttggagaaatggttttcgtaatcttaatctaggttagtgggcttgagcttggtcatgttccaggggta

SEQ ID NO: 105387 - DNA, 535 bp, Oryza sativa
tttttaatgatatttgttagtggtggtaaatgatgaatacattcatcattgtgtatgggatacgtttgtttagccgccggccatacatctgttgatttgtttcagtgactaaactgacgcccaattaagctgggtaagatggacatcggttgagccctatttgatatttgtttcagtgatgactaggaatgccacacagataggggatatcttgctggacgtacaaacttgtaattcagctagggaggaatcctatatatcctatcctatatatttataaaagtcctccccactcagtgcaattaaagctaatttcctatgctgtggttgttccacgtcatctgaaatatttttcaccgccgtaagattgattagatggattcgctatgtcagtctctcaattcggccatgtttagttaccaaaaaccttttctaaaaaacatcacatcgaatctttgaatatatgtataaagtattaaatatagataaatttaaaaactaattacacagttaggggagaaatcgcgagaccaat

SEQ ID NO: 105388 - DNA, 1022 bp, Oryza sativa
tttactatatattcataaaatgtaaaatttacctatataaaaaagtgatatttagacaaagctactaatataatttttaaatatcaaatttaataatgatatcactgtgagtctctatgtggcctttgttaatggacagattaaacacaaaagatttactttagagaaaacaattcaacgctcaaggaggaacctgatgtgtaacatgcaatatgacaaccgcagagtactctttacacctctttttcacatgtccctttgctcaagaatgctagaattacactagccctaaactggaatctaaacatggagttcataaaacaatatacaccacaagaaacaacttctcacacacatccttcatggaagttatagcaatcgggtgttagaatatttggagcaaagaaatgatctcatattgaacaatgtgcaagttaatttcgtcaaatggaaagcagatttcaaggaggaatttagtcagcataagcatagagtaaaagaattagacaaacccttctggcaatcatggatacacaatgttacttaatctattcttttttgtaatctcttttgtaatttcttccatttcttcttcttctttgtaaatcctttctgtaatcttttgtgtaaattttatatcatttttaatatagcacagtagaagtttattctgctgtttataccatcaaaaaaaatctaatttaatattttccaactattgaaaagtaatattttgaagtccggtagcacacgaaaaactcatatgaagaacacgcaacaacctaaatttggttccttctaataagtgtgttttcattcctgcatttcaaatgttaaaattctaaaccaatttattttattaactccatcttttgctcctcagcttatcagtcgccaccaaaatttaatgttttaaacataattttagagtttattttgatgtttatagtagtttattttacagcattggctttaagtcactaataacacatatataaaatttttccacaaataatttttta

SEQ ID NO: 105389 - DNA, 1265 bp, Oryza sativa
gttttgagaagctctcatcatgcagcagccttaatcatggacggtgtttccagaaccatttttgatacacttttttgagacggttataggaacgcgtatatgtaatgaggcatctctcgtatatgttgcttttccttttacagtgagtaaaagatggcaataagacggaacttgtggatgtggtcagacaattataacacgcccatagttgatctcaagtgagtttgctatatacggcggggcccactcccgtaaccccgttctgatctactacttgaaaacttcctagcagcatcatatccgtccttgttgactgatgtcactttcgtgaacccttcgatctatgaaaagtcaagtactatataagtttaacaaaacgtgccactcccaagtcctaaataggagcaaattaaattaaagcaacaggtaccacgatgctagctatatataagacgagaagaacgttaacactagctaagccgccatgcatgatttgtacatgttttatgcatgcgtacaaatatgaaatattatattacagtcgtcagaaaagtgctccgtttttttgttaattgggagtaataagtattgaaagcaaaatatgcgtcgccactaactgtgctagctaattccggaataccttttgctatatttttcattatgcagattagatgggcaatattgttcattggatacgattaatctactccctccattttataatataaggttgatcaaatttattgaaaacacagtagtattttcaacacaaaacaaacatattattaaaatatataatgcaactttagatttaataaaattaatttgatcttttagacgttggtattttttttaaaaaaaatgatcaaactttaaaaaataatttactaggaaaaaaatcaaaaataactgataatataaaaatgaagagtgaagtgcatgggcggtctctaaatttgttcaggtgtgtcactaaggtctctgaactctcaaaataaatttttgagtctctcaacttgtcttatgtatcatataagtccaaatgagctctaacccgctttgtgagaagacgtggaataccacagtgatggttacgtgtcagtgggatccacatgtcagacacatagaaaaaaatgaaatttaaaaagagaggagggagagagagagagaggagaaaatgatgtttttaaatttgaaaaataaatgaaaaaggaaaggagaaaaaaaatatgttcttaatttttttctatatgtgactgacatat

SEQ ID NO: 105390 - DNA, 508 bp, Oryza sativa
ccatacccaagggcataaaatctaacccacacccatacccattacgtgtggtacgtgcggtactcgtgggtacccggtcccataggtaaaattgatatccctaaatgtacatatgtagagtgggtaataaggtgggacccacaaaaattccccaaacatgaaccatagcacaattaaaaaaatagataaaacccaccaaaaaccgctaatacctaataataagcttattacttgctatttcatcacattgtggatgcctttacagagctggagaacttaattagttgattaattaggagtagcattacacgtgcttgctcataatcttaacttatgatatgttctattaatatcattttcacaaaatatagctacataaaagtattttactcgactatgcaacagctctattaataccattttcatatataaaaccttaatattttttttactaatgagatttcaagatctcactgcattgcacatgtccgggacggatacaacttct

SEQ ID NO: 105391 - DNA, 527 bp, Oryza sativa
ctctcccttctaaccttcgtacccccgggcccatatcaccggcaagctgtgatgatggacggatccagcggaagcggcttctcctgtgcgcagggtggtggcagcggcggatgggtttgtggttttgtgctttggggatgttttgggggtttgtgatttgtgctaggttaaatcgtgttttgtgtgatttgtgtcgtgttgttggatggatctatggtggttttgtgttgtgtgctttggggatgtttatagatggatggtgatgtggatgtaatggggagccaacttttatttgcattcagtaccgcctttgtgatgccaattgggaaatcgatacctatggggttttttcaaccggcaccagtggcctttttttttagtagtgccctcttctttctcttggagttgctcatcttcatgtatcttttgtgtagttcttggtatgtaatacccactaaagctaacatattatcatccaccaaggacatgcctagcacaaactgactttatctatatctatttagggg

SEQ ID NO: 105392 - DNA, 717 bp, Oryza sativa
catttatttattgtatatattataatataaaaacaaggtcaaatatatattttaaagaccttgtcattcttcaaaacgtcaaaaattataaaactggagagagtatatagatagtaaatagtattaggaggagagagaaagtagaaacaaataacatattttattctctataggcaactcatatgtttatgggtagcttttgttatttctttgctatggactagttacacaatattgctatgtggctgaatgaaatattgtattacttatagattatttttgcactatattgtggatgccctacaccttatatacacacgcgcacacacacatacacacatataaaaatttgtagttacatatattctcttaaatattcatatgcacgtctcaccggattttgctaactcattaacccttgagagttgagatgttatgcacgtgaagctagctagtggtcaccatatatgcatgttcatcaaattggtacccatctgttgcatactaattgttcttcggaaaaatatattaattattagactataagctggttttaattagtttctccgctgcaagcataggcaccaacaaaactgatcagacatgcttggtcaagcatatttcttctaattaagacccctatgtgaaatagattgttcactggattattatagtgaattatctacacaattataataatattgatgagctactgta

SEQ ID NO: 105393 - DNA, 849 bp, Oryza sativa
catatgcttcatttgccacgaaattggccattacatgagacactgcccccaaaaaccctatatggatgcactactacaagctaatatgagaacctcaaggacgcccttctatccccaaggaagcccgaattcgcaaaatgttaatacagtacgtccaacctcccctgacgacaaaagagcaaaagcatcctgtgacatgtgccaggacatccaagaaaagaaagagatgcaggaatacaagaaacgcaaagtatcgtcggtagagattcaagaaagagaaagttcacgtcaaaagaaaaacccgccagtgcagcacaatcaaggagcatctcagtatcccaatagttctggttatatgcctcgttcgacagtgtcagaatctagtcagcacgccacaatgatcaacagtaatagccatgaaggaagcaactccgtatcatgccctccaccttcaaaaagacgtggctataaggcaggagtcgaatgtttcatctgccatgagatgggacactattcgtgggattgcttgcagaaagtcaagtcaaagaaagtacaaccaacaacaagccttcctaacgtatttggacaaaaaaaattcaaagccaccaaacaatggatttgtctcgttaacctcaccgcctgttgagcagaattgtttgaaccaagtgcaagaggaaaccaatggaaaagttatgaatttcaagccaggtggagaacagaaaggcccaaaagaaaaaagccccccggtaagttaaggcatgttaagttaggtaaaagtaccagcccgttttgtggcgagtatgcagtctcgagataaaggggtaccgagctcgaattcgcctatagtag

SEQ ID NO: 105394 - DNA, 690 bp, Oryza sativa
tttcaaaactgaagaatttacaatgacatggatccaatattaaagtggcatagttataatatcacatattatcatagtatatttcaaaactgaagaatttacaatgacatggatccaattaaaaaaaaggggaatttggggaatttctatttttctatcgcatgtttttgtggaccaatactttcaaatatctaccagtacaccttcgtgaagaagaatcgaatccggaacacgtaagttgcgtgcaagcaccttaaccaacgagctactcatttgtttacgaatctttatacaccagttacaattacataatagttacaataatagttacatgtaactacaatgtaaatcgcctgtagttatgtatgaaagttttctattaaaaaaattgtcgaaagttttatagatacacccttaaaaaaatgaggtttattcttgagtcagctcaaatttgggggaagattaaaaaaagcaaaaccttctactggaatttaaaacgttgaaatcaaaattcataaagtttctcccaaactttaaaactttcatctcactttcaactcaaattttaaaaagttttaactcaaaattcaaaattttcatctcaaaattgaaaggttacatatcaaaattgaatacttttaactcaaatttcagaaacttttaacccaaaattcagaaacttttaactca

SEQ ID NO: 105395 - DNA, 740 bp, Oryza sativa
tcgcaagcatgctatattatctatatttttataattattaaattttagagcttttaaaatgcaagcatgttaaatgatcatctaccctataatatcctatatacctatatagtttatccttagttaattttacttttctcttttctcattaagccatatcacatcaattgcttttagtctttagatgattaatttatagtccaaattatctctctccttttcttctcattaagtcatatcacgtcaattttctcttgtttttagcccttagatgattaatctatagtcaaaactatctcattttttcttctctcataaagccacatcaccttacttttacatttgaatcatcattgtatatactatttatatttaaattatcataaaccacatcaacttacgtaagcttatgttgtttaggctattttacatattatttttacttattattatcatactaaactcccgcagtaatgctagaggtttcacctagcagtaaagaatgttatgagcaggcaatagtacacggtttcctccataatggacatttgtacatccggacaaaaaaagttcaagatagataaaatcatgtgtgaattggacacaaataactcgcatgtcgtcccttcatagcatatctcccatattctcactactgaatctttgatcaaatttcacttgttcaaagccatgccaataaataagcgcgagtcaaacgtacatatcaccattcttcagga

SEQ ID NO: 105396 - DNA, 1006 bp, Oryza sativa
ctctataaaaaatatttgaattcaaattcaaatttgaatcggatatataaacttttgacttataaactttgggtctctaaactttagatgtgtaaacttgaggtgtataaattttaggtgcataaatttactaaaataggaaaataatgcggtgccaaaaaatgaaaccaggtggagggaggggggagcgaattgatcgctgcccccatcgccaggcgagcgatcgcccattagccgtttcgtgatttgacgtgcaccaataataatgtcaacaaggaaatgagcacgtacggaatagtgataagaaaaagaagtggaggtgcggtctgaacatagtggataaaaagaaaatctcctgtgagacagctatacatatctctgtgcacaaatgtgagaatttgaccctttgcaaaaactaattttacaaatgaactgtggccaaaacttattttaaaaaagatccttttgttcagcgtcaaatcgtatagcgctgaacttagacacctcgacgctaaatagcacagcgctgaatgcacgttggcacgccgaatcagcctcctatccgcagtggcacggcattcaacgccagttgacgtggcgctgaggtgtcaaatttcagcgtcatacgaaggttatttttgaaataagttttgaccgcgtttatttataaaattagtttttgcaaaggatgaaattgttaaaatttgtgtatctatgtgtgttgatttctcgtgatcgatcaatcgcggcaacatgatttgacatgcatgcaatgtggttccatgcacgatatatagtgaacgactgagactctgagagttaggtaggtggtcaccttgatcgagatcgatcgatcattgtgcagatagttgaggcatgttacgtgttgcgagaggttgcaaactaaagcgaaggtgacagccgtcgtcgatcatcactattgagatcactgtgtactgtattgaattgaggcgaatgcagacaattaagccgacgcatcatatat

SEQ ID NO: 105397 - DNA, 915 bp, Oryza sativa
aaacattgtccttcatgagtccactccggtcctacaaacgagctgcgacagatggatatctgatttttattatatcctgagtaaggctaatcctcaagttttccatgaaatcaccttaataacgcaatgtcaaaaaattcaaaatggtaatccagttaagacaaccttcccgacggaggcacatctcagttcagagaaacctgccccgcttttggtcgtgaaaaatgaatcacatcgagacattctcatcgtgaagttccttgtgattagccagtcgccacccatctttactggacatagccgcagcggtataaggaggctccgcctttcaggctttttgctcaaatcaacgttttaccggcaagccgagattaattgaactggaacatagtgcttcaccacatcgaggatctgattgaactggagcatagtgcaaataataataataataataataataataataataataataataataatgatgagtgctattttgaatgtttcatttcgtagggtactggtgcgtcagaatcttattaactactccacctgtctcagaatataagaagttttaaagcaagtttaatagtatagccaactacgagctccaattcatttatagtcaatctaatagatcattcatacaatagttacatactacactattaatacctggtcctacctgtcatacacacactgcgtcttggagtctgtgctatagccagctacaaatctgtagcccgctgctcttctctctcctcatttatctccttcaaatatgtttgtagctggtttatagcttggtattgtacatgctcttagggttggacacggttattaagaaagttggtaaaagtgagcggtggaggattgtggttggatgagtagtggaggtaggtgggaaaatgaatg

SEQ ID NO: 105398 - DNA, 693 bp, Oryza sativa
ccctttttgggtgaaattgcggccgggtaacaacattacacaggaaacacatcaacttgttcctctccactaatttggatccaatcagaccccttctctttgaaaaaaattgagtgaggatgtatagaaggcttcgaaatcaattcttgtttgtgcctaataatattatataggcagtgtacggatcccgtaggggtatattacccaaccatatgttttacaaaatctaatttgagagccatccttaattgtaaaggacctgtgtttggcctccgtataccacgaaaagataatcaagatagtgaaattacagctgaaaggatttttaatatgtagaggaaaaaaagggttccgaaatggtctccaaaattattgcacgcccgtttggttgccacggcacgggcatctctttgacatccgtatagcacgaaaagataagcaagatagtgaaattacagctcgaaatggttaaatatttctccaaaatgatttcacgcccgtttggttgccacggcacgggcatctcgtttttttccctgcacaatcgtatcaacgcccgcctttcgtgggggcaccatcaaccgagacacatccttcaaaatgttattgcttgaaaggcgaactaatgttgcaagaacaatgttgtcgccaaattcaaagaactagctgaagataaccatccacaaatattta

SEQ ID NO: 105399 - DNA, 1105 bp, Oryza sativa
atttgaaaaatttgtgaaaaatttgaaaatatttagtcacacataaagtactattcatgttttatcatctaatagtaataaaaatactaatcataaaaaaatttcaaataagacgaacggtcaaacgttgaacgtgaatagtgcaaaactacacttattttgggacggagggagtagtatgttactattttttttcaaaaacgcaggagaactgcgcttcatttcagtaagaagaaataaatatttacaaaggagggatcaacaaatcccaaaacacatcacccatgggtgaggcccgactaatatgttacaataactgctgctcaaaatatcaaataggttaaatttgatgagaacagaaacttattttccactcaaatcgtggaatcatccacgaatccagcttctggcaagtttctagtgtttttcttttcaatttaactttgtaagcttggtctagcctgaagattggtgctccctaaattttactgctttccttctcttgttacaaggtcttttgtgggctcgtgtgtgttttggctgtgtgcatcctagttatgcaaaggccagaagttttcttagtatggttctatcaacttgatgtaatcatctgagattagtaaaaagcttcctttatcaaaaaaaaaaattgcaagctctcagttcttttacaccttggagtgttgaagagtgttagtccttgtcttgttttggcaacaaatggctgcaaaacattctggcatgtacattacctgcctagaactgattcctctaatcagctgattctaaaacccaatcaagaatgtattgccaatcttgttatcttctcttgagtgaagctcaatcttgatattatttcagctcagtatattttagtgataacggagaagatcaatctcaaactagaggcaaaagaatcaattatgtagagtaggagtagctaatcacatacagcagtacaccttgcaagttgtctgtcttgacaatacagctatctaatttgagatttggaggttctatacagccaacgccccacccgtccatagttaaatcaagggtaagtaccaattggagatgcctagattaccagtagcacgaaagttgt

SEQ ID NO: 105400 - DNA, 757 bp, Oryza sativa
atgctttttagtgtttgcgctttcgtcctacctgtagtagtactgcaagatgttgcatggcaacttgatatgttcattacgttttcgttttatttggtgcgcatcgatatcctatgttgttcaagaggccacaaggtttcattaattaatgaaattaatattccattatattatctgaaaaaatacttgtgtaggatgggttttaactccaacacaaatcaagttcatatgtggacaaaataacaaaaaaaagcatctggattatatgtccttcgtagaatcagagaaaagggtgtcagtcaatatacgcgagaggcaataattacacctgtaagcagccaagcctagctctccttggctcctgttgacaaagcaaattccctttggatgtaatgcaaccatcagcagcaggccctctggctaggctgagtaggctctgtatatccttgtccctttccacaaacaacggagtcaagttattgctaatgctcccagccggtccatgaaaacgagttgatgcgtgtgcttgcccttaatttagataagtagatagagctagccatgttgctgattgaggccaaattgcccgcccaagaggtcatcttttccctggcggtatcatgaccttttcgccaacgactgctgtttcaggtcgtcgaacttaccaacctctttttaagacccctactttgtttcctccatgcatacgcacgaatcgatatgactaagtcttaaataaattaaaaaaatatactcc

SEQ ID NO: 105401 - DNA, 508 bp, Oryza sativa
ggcgaattcgagctcggtaccctacttgactcgttgtatggtagctaaagccaaatttgaattttggaatttggttttacaattaatttaagttttttctttcaatttggtaccttgatatttggactatcaaactatttttcagcttagtcacgtgtctttggcttataatccatgcctataaacctaacacagtaaccctgaagattaaaaatccacctttgaaatgcttattcatagttctcaaaaaaaaaacgctaatggatgtgatgcgtgcctatcaaaagtgcaaatgtgaaacatcaattttacccgttcactaacaatagtgtcttcctaatgataaactgatttaagatgaaaatagtgctaattatccccctttctttttataaaagggttttaaaaaaggaaaaaaccccggcccccaaaattttcccctgctatagcgagacgtgctgacctaattttctgaaggtgctcatggaggtaggatatacgtgtgtgt

SEQ ID NO: 105402 - DNA, 673 bp, Oryza sativa
tcacatggtaactcttgcaagatggatgttcggtagaaatggcagaaagggattcttggaaattttctttttagcatcatggcacatatgtaagcagagtaataggctaatttttgataatattattccatcatttcaatcttggaaggccttgttcgccaaaaaaaattattctacatctgtgtaaaatgaaggatctttaaagcaatccgtttttgattggttgcaaactttgtagctttaagatcttgttgtatgtaaacctctgtaaatattttttgctttaatgaaaatacactgctaggcaaagccatttccaagtaaaaaaaataatgtaggctgcaacaagcggactatagaggccattgcattgcaaactgtcctagaaaaagagatagttacaacctgtaaaactgagggaacacaacattttatatttaacaaattattttatttgaatattggacaaatcatataagtttaattattttttttggcaaaaagaggttaccaatgagagtgaaaccatttgaaacatcgattttaattatcgcatactgcactgctgcacactttttgggtgaaaagacgagaaattttcctcgcagagccgtagagcttatactttttgatgaataataaaaaaaactttgatgcatggaatcctttacca

SEQ ID NO: 105403 - DNA, 712 bp, Oryza sativa
gcattccctaaaccaacatctaagtattttaatacccaagttatcaatggcataaggtaaacaagatatggctgagtagtaggacccatcccacatgatattataaaacaatgcaatatttaatagaaatgagggacatttgtaaattgggtacaatatgatcaatcgtaatgcatgacttgccttgctctcgcactgatgagaccatagcaacgtcttcgaggaaccgcggattgacgaaatggccgaaatctacgcgacaaacaaagaacacaagcaaaacacactataagtctaattaaacaggaaacaaaaccattttaatggattctatgcatttttatgaatttactgagacttgaatggacttaatcggagctcggatgaattagatatgaattttagaagattaaatgtgtttttactataaaataaaaggccttaatggattttattgcgcaataaaggtccctactgacatcatcaaaggggggggggggttgcgccgacagatgggccctacttgtcatagactcaagggcgccggtctactgtggaccgagtccacgggaccgcggagaggagcaccacgtggcgcacacgtggcgccgacgtggcggccacgtggacagccacgcgggcggcagccgaatggccccgatctaccgagcgggaaatcaaatggctgcagcggctcgcggctgggcaatgc

SEQ ID NO: 105404 - DNA, 682 bp, Oryza sativa
tatctatgtgcccacgacaggcagaagacgacatgacatggaatggttgattggctagccggccaaatgtatgttttgttccttctagtagtagttgccaagtagtcagaaaagtaaagttaatccctggaaagtcaacatttggtttataaatctgatcccacaagcaccacgaacgaagaacaagctagctagagtcaggaagaaagcaatcagagtcccgagccaatgtccaatatttttgtttcgaaaggtaacatatccaaatctaataattaagcagcaatcgtgcacgtggacggcgctcgattaactgtttttttaggtgatggttgaacatagcagccgttcttgcctatctatatatttttccaatcgacacccagatagcggcactgataagaacaatcaaaggtgccagttctataaacgatacctttgaggtctcaagaatcaaaaaaaaaaagctggctcgatgcatcggctcgagccgatacattgaacaactccccttcaccccaaccagatcaaacaacacatagacatcaacaacatacaagaacacatgacttcggacaaaaacatcaagaacacgacgttgaagctccaatggacgatgttgaacacatggtgtcggagtcctttcccacccctgctgccatcggcggatggagaagaagag

SEQ ID NO: 105405 - DNA, 659 bp, Oryza sativa
actacaaaagaccgatggaagagcaagaccttaaggcgaagcctccaaggaggtgaacaacgacataagccgctgtcgatgcccgcccaacaactggactgggttttcacccaaaagtgggggggggggaatccacaagacaacatctccagggaggaaacggcacccgcaggcgtcgatgtcgccgatcctgggagaccaggcaaggctttcgcatcggactcccttaaaagatgcaagacatccacaaaaccagagcaagagtattgagtgttattgttgcccagctcatctgctaacctgatacagtagctccgactccgccttaagtacacaaaaactctcgcaccttagaggtaagcaaaccgctccaaacttggcactacaacaggttcacatagtcacagggtacttgaagcaccggtgagaactaagagccctgaatacaaacagacaggacaccaacatggacaaacaaactcctcaaccatcgaaaggctccatggccggttctggaagcagatggctagaaaaagggaggagcatcaaggcagcaaggaggcaaggccggcctggagaggaactaagaactgaagacagggcaaaagacatcggtgtccaccatgtttccggggaggaactccgtaattcacgtgatg

SEQ ID NO: 105406 - DNA, 555 bp, Oryza sativa
caacatatatactatatggtccgtatgtatattcccaacgtattatatattgggctttgctcggtgattgcatgtcagagtctgagaattgagattggcgtacgtgtgacagttttccattttgctcgaaaaaggaaaaaaagaaaaactccgcactgttgcaaaaagattaactgaccggctatatgatgtttacaagttggagtatcagaggaaaagacaaccaaaatgtctttcgaatgaataatcaacaggtaattttataagatttgaaactataaatctatcgtaggatcaacagataggccctcgaaaaaataatcatatcatagatgcatgctagacgtatattatggcctatggggctgtggtgactatatgaataatggaataacaaatatctaggactgtgagagtcctgatttaagtagcttattacacgaaaccaactaggaataatactgtagctactatacgtggcacacgcacaaactatataatccaatacacataacagatcgagcaacacaactagctcaactaaccctaatctca

SEQ ID NO: 105407 - DNA, 524 bp, Oryza sativa
actaaagacaagaccttaaccaggttaacactgatctgatgtgtgtagaccattatattgttcaagttgattaagcaagcaacctagtatagttacacactcatcaatgaactactccaatgatgggaatgcaaccatacctacacacaagcaagcaacaagcgttctaccctactaactattcttcaaagacactttggcggcataggttctaaggtaggatccaaacttcattccatcttgaccacttggcacttcggttcttcctcgatccacttgactgacctccataagtagacctcattaacatcttctagtttcaacaactagttttagaactactcaagttgaaagcaggaggggagaggatgataaaatgatttatagagaattctagagaaggaagaaaggaaaattttcacacatcatgttttcggaaaattagtccttaaggtttgaccatttggcttatcctacagtcgagatggctctgataccaacttgtcacgcccggaaattcacta

SEQ ID NO: 105408 - DNA, 774 bp, Oryza sativa
atagttaacaatcaatgcacagtaaacatacgggagtggcatgagtgggtatataaatttgagccagtggcatatagaggaagagccaattttgagtggcatacacaggaaccgaccaattttcagtggtatataaggaattatctcatctatatctctattatcaatcgcactgttttattttggtccaccaaaatctaataatttctcggcttccaaaacgaatccttttcgacctatctttataatataataatataatagataggtagatgatatacagtttgtatgcaatttattaaaggaaatcatgcctacataaatctgttctgtattggatatgatagttttcattatatatagtcttaattgacaggtaaatatgtatacatgtacaagagtttttatgaactctttatgtattataagccttttctgcacctatataaattagatattgtacgtgcttgatgcttacctgctcctatatataggctccttgcggttatatgcttttcctgtattttactgacgtaccaattcatggcgtcatggacaccttccacttatttttgcaatttattttcatttgatgtttctatttgatttggtagatagaaaattatcagttcgcagttaaatcatcaagtccttgtatacatagtcacttatgctttgccttggggagttgggctattccattcctcgcttacattacagccattactggtgcctcaacggggataacttctgtggtagaattaaagaagtgag

SEQ ID NO: 105409 - DNA, 542 bp, Oryza sativa
tcggatggttgagattacgtgtgtctgtcagatgcgtctgctatgtcaggaatcaagaccaccactacgaattttttaagtagtagagattaaacgtagactaataagaaaacaaattacagattccgccagtaaactgcgagacgaatttattaagcctaattaattcgtcattagcaaatatttgctgtagcaccacattgtcaaatcatggcgtaattaggctcaaaagattcgtctcgcaatttacatgcaaactgtgcaattgatttttttccgtccatatttaacgctccatacatgtgtgatgtgtccaaatatttaatgtgacggaaaagttgaaagtttgaaggaactaaacaattatttttttcgagaaagcaaggctgcaattactcgtgtgtgaaccccgcaaatcaaagccgcactgtcgtcgtcgtcgatgttcttgcgctgacttgaaaacgtcaattgaaacttttctcgggagcccatttttttttagagagctcgcatcgatatcgaccagtagttttttctgt

SEQ ID NO: 105410 - DNA, 1241 bp, Oryza sativa
caattcaaagcttagaaggatgtaatttacttcctccgtttcacaatgtaaattattttagcatttcttacatttatattgatattaatgaatcattttagcatcactatgaatatggaaaatgttagaatgacttacactgtgaaacggagggagtaggtgatttcaaaagtaagaattgtcaaaaaaaaaaaagaattgtcatatgaatgaaatctagcaaataattaattataaataaggcactcccccgtttcatattataagtcacatgaactttttttctagtcaaagttgaaaaaaatttacaaaaaatagcaacatttttaacctaaaataaacatattatcaaaatatatttgaaagttagttttaataaaactaatttggtgtttttctaagctttatcaaattttaagaagcttgacttaaaaagtcagagcatggagggaatagaaacgattgaatctgtaaggactgattttaaattttttagcagttatttcaggtgatttttttttttttgcaagcggttgtagaccgagctattttttttttaactacgcaccttgtgcctcgcagcagtagaacccctctgtttccaaccaatcaaaccgttccccagccggctcttgaacggtccacttcgcaaagccaggagaagagccacggccacccccacgctcgctcccaaaattctctaatcgaccgatttctcctctccacacgaacaggtactcatcaggcttacctagctctgacaacttcatgccgaaatccttccttcttctccgtcgacggcaaaagaggcacctcggcatgaaacacccgacaagtacggtaaaagaagaagggtctggctagctatctctggctctgttaatatgctgggcagttcgcttcaatggcagccttccttttgtagtgacgagtagctagctaggtcgctgcataactgtataagcaatagcggcatgcaggatgcgcacgcacggaacttgagagagaaagttaattagaggcaagtggtgatgctcaccttaaatgtcaacgaatcaacgcgttggtgatcgtgcattttctgctcgatcgactagaaaacgtacgaacaaaaatgtcaacgacgacttggatgaccaaatgcgtgccgtcgcgctgggtttcagatttttcagtgttttcgtatcaccactatttcgctagatttgccaacccatggcggcggcggcgtcgttggaagc

SEQ ID NO: 105411 - DNA, 1181 bp, Oryza sativa
tgagttcttgacggagatgccatttgacttcgctagctagcaacgaacgtgtcgtgcttttctgttcgatcgactggagaacatgcatgcgcagaaaaatgtcaacgacgagtagcatgcatggattccatggaactgtgttcaggccagtgtattcctgtatatctgcaatttgatttcataattcacgaatgtgcatttctctatctgcagtttggtttcataattcatcaaggtgcatttatgtatctcaagttgcacagctatgcagtactatatgtatatcatcacttggctagtttttgggatccttacctttctggatttttcacaatttgattcttttgaaaaacttatttcataaatagaccctgaaaaaaacttatcccaaaaatagttctttttgagcgccagagtcactggtgccatcctcctaccgacgtggcagggcggtgctgaggtggcgggggagcgcgccagtgtggctggcgctccacccccacaattttttatttttttttattttttttgatattttttcacacttaggaacacacgagaaccaaccataaaaaataaactttaatggacgaaaaatgtgacttgtaaaatttttcctctcctctctagtactccctccgtcccaaaatatagcaatttttgggtggatgggacataacttgtccagattcgtaatactagaatatatcccacctaactagaagttgttatattttgggacgggggagtatagaggagagagatgtgcagcttttttatttttattttattttttgattttttttatacttagaaacccaaaggaaccaaccatagaaaagtttaactcaaatggatgaaatttgtggcctgtagaatttttcaaatctctaccgaaaagcttctcacctcaaaaacacaatctttcaagcaaaatttagaggttctaatttcaccgaacccggcaaagcaggagagaattggttgtaactttttctgtagatgtccgtggatatattatttgcctaatttcgaatacgtaggagaaagttacgcctattttaagaaatgatacccggggtgctttgttagagctttggaaaattctacatgtcacatatttcatctatttgaatttattttttctatgcgtcggttcttgtgtgctcctatgcgtgaaa

SEQ ID NO: 105412 - DNA, 650 bp, Oryza sativa
tccccagcatcccttggccatttgaagtcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgatttaaattattgcattatcgctttatttaaattcccgcgttatcactattttatctagccatgtctatttacctttgttatgaccttattattgttattgttattatttccttgttcaccatagaataaacaaaacctcaactagtggacactctactcatggtaccactagtatgattttaggtagatgcttcgctggttgattaggcaacattaggtggttttacaactctagactttgggatattcatatcacctggacactatggaatggtttgattattggggaattggattcacaccttcccctctattcaaaatcctcaaaatggttttaggcttggcttcggatgcatggtttttgtagtagcacct

SEQ ID NO: 105413 - DNA, 1452 bp, Oryza sativa
aaaatctaagggtagaaccgtacttacacagttgtttctctctccaatttctccggatataataaaataatctcacgggcgtccagcagctaattaccaggttttcatggtgtcctatagcaaatacacgtttttgtggtgtctcacagctaattacatgtttttggatgtcctatagcaaattttgccttggttaatcatcattgccgggtattcagataaaccagcactaattggacactgaataatcagtttcctctactagagaaatgatctttgctgggtcactcaaaatccacaatagtcccggttccttaaaagaatatgtttagtcccggttcaaaattcctacggaactttttgatctttagtcccggttgaaaacaccaaccaggagtaaaagatcatttttaatcccggttcaaaaattttcaggccttatcaggacccctattatctttagtttcggttggtgttatcaaccaggaataaaaatcaatacaccgtatataatctcttacacttatccttaccaactcctcctcctcatctgtagcttcttccttttcctctctttccttctcctctcctctctgtcttatcctcaggcttctctctctcatcctctcctttgcgcagcagctatatagagcgagcgagaggagggcagcgggttttttttgcacagagcgaggagcgagcgagcggcaggcggcggcagcctcctctgcgcgccggcctgcggcggcctctgtggcgggcggtgcttttgtttatttgttcacatgaatttgcttatttgtgatgtaaacttgtcatgtgaatttgtttattacgtggatctgtgaatttgttcattgtggacctataaatttgtgatgccaatttaagtatgttcattcgatctgtgaatctgtgaatgattttgtgatgttttgtgaatggggatgatttgttgttgagttcggtttgaaatcaatataagtagcaaaaaaaaattaaaaaacggaaaaaaaaagactaaagatgggagcgctagccacgtggcgtgccgatcttttattacctgggactaaagatctatcttgagtcccgattatttcacctaggactaaatataaccatctttatcctggattcgtggtcccagtttacaaccagagactgaagggggctgcaaaccaggagtagagagggttttccagtagtttttgtttgttgttgatgatatgatccagcactgatgttttctcaaccgtgctagatcttgcctctgcgtagcgtaagagtacgtacgtattttgttggtcggaaaatcatcatcagtgctgggttttgttgaaccgggtgttgagatgatgacagcacttatgtactcttctaaagtagcgtaaaaggatgattgatatggaagaaaaaaattagtaacttaataaaaagataaacttaaga

SEQ ID NO: 105414 - DNA, 612 bp, Oryza sativa
aattaacccaaaaatatgaggtttgattttatctataaaattcgccggtcgagacaaaaatatattttaatgtccgacgaattttatagattttaatgaagatgaaaagaagccgtgatagactgactggacagccaattaaaggattgggtgtggaccatggtactttttaaaattattaaaattaagaacccgatgcttataagggttggtttttaaatattagaacaccaattggcctatttaatattttttttaaaaaaaaatatgtgtaaaaatagataattttatataagtgccgtccacctagctagtttactctacgtgattggtacggtggtctctgtggaagatacttgcttcgatatgctcgaccctattctttttcttcattatatactgggaagatgcacactgtatatacatacccacaagtacggccctcttaatgcacgcaaagcttaaagttattacgtatatttggtgataaatcaatgagcttccaatatccatgtgtacgtaactacaaacacgtgaatttagcccgtggtggtacgactcctccgtcaaacatttttacaataataaaataatagtttttacctccatgtt

SEQ ID NO: 105415 - DNA, 708 bp, Oryza sativa
atttttactaaaattaatatgcccaccactccgatccactagattagattgatttgttccctttctcaaaaaggagatgtccccttttcccgtttatttctttatgaaagtttttttttttttttgctatcggaccaaattatacattatatttctgtaattattttatttataattaaaatcacaaattagaatttaatgcatacgttgactataatttaacttgtatattctaagaaaaacatatgaacatctaaccattaattattttaacttaaacacggtgtacttattattttcaactgatatcttaacaatataaaaacggaaaaggtccacttccaacccttcacatgtaatgtatatcttcacatgaacatccccacgcgtaccttatctctccttctctcccctcacctcctcttatttttttcaacggacaacatcagataaaaaataaataattagatagcttaacgattataattttaaaagttgtatctgctttttagtttgtttcaattgttgttttatttataactaaataaataattcaagttccacattatctatattttactataaattacaatacatcatttcaagtagactccaaattttttttcacggaaaccaaataagaatgagacattacaaaaaagttgactatatgcattatgtcataaatcagtctagatgacaaaaatt

SEQ ID NO: 105416 - DNA, 1092 bp, Oryza sativa
ggcgggcgcggcgcgaggtcggggatgacaggtgggccccacccgtcagcgagggtggcgggcgggcccgcctgtcagtggcgcgcgcgcgggggaggagccgatgggccgcgggggaagagagagagagggactgggccgagccggcccaagaaaggaaaaagggggggaaaaagactttttagggatttttctttttataaaaccttttcaactttgtttatttcttctcaattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagaagatgatttttatttcgggatgaatttatcaggacgtgacaaatccaccccccttacaagaatctcgtccccgagattcgaggaggctagcaagaagataggttaggcggtcttctcttcttgtctgacttcttccgttgcgtcttgacgaacttccagcaaaacttcaccactcggaactgcttggcttgacctcctgttgcggatggaatcttctcttcacctgacttggaccagggtgcaccttttggctgactcagactaggttgcggtagttcagtgatgcttccgttccagaacttctcatgattcaaatcttcggagtcaacctcatacaagttaccacttcatgtcatgcgtcgtaacctgcttgtcattactaggataccatgcttgtcatcatgagaataccatgcttggcgtttccttccagcttaccaccatacgctttagactatgatatcccgcttactaaggataccatgattggcaacttgccattaactgtctcatattggctttcctggtctccagtgctaggtacttctgctattcgatgccagggtcaaccactctaactataagttatgcttcccaagagaaccaatttatcccgcttgacatgctttgacgtcttcccgaatgactttgctgctggacttgttattgtctgatcgtgatcctgccagatctg

SEQ ID NO: 105417 - DNA, 651 bp, Oryza sativa
gatttagagtaattttctttacttaattttttttgttacatatatttttatgttttacttatttaatgcaaccaattctaccaccatgtgatgtataaatcggtgttagaagagttaatgttttacttatctgtttaattaaaaaacaaaatgaagatatttgatttatatagttgtacacatctaaatcttcgaaaagtatatactcttgtaaaatttgtacatatattcacgatcgttaaatttccgtataattccgattaattgtccatattctaattaattggtgaacggtaccatttccgtccgataaccatattccttcttccacaacattgagaagtaatatggttatcctctttaaacttttataggcatataagcttctttataccaaaatttaacgtgtacctccagtactagttggtctaactactttataataagttgagaaaatcttatctatcaaatactaagactaattggttagtctaactactttcgtccgaaaaaatgcgcaccgctggcgcgcatgctccgactagcctttccccatccaggcacatggttcgagctgggaggtgtgcatggacacgaagcgggccgtgaggacggcctgcgggtgcatgcgggcgcaacaagtagggttga

SEQ ID NO: 105418 - DNA, 638 bp, Oryza sativa
caacaccgcgtacacacctgacgcgtgtcccatcacattagtgcagccaagcgttttccttgagccaagccgatgtcttcctcagctcgcgcgttggaacggacaccaagccgcagttagcgactgcacatggagttgagccgttgtttcattagaagacagaacagatagtaaatctgccgctaaccaagaacagatgaataatatatactccctccgtccctacatatttaacgccgttaacttttttaaatatatttgaccgttcgtcttattaaaaaacttttgagaaacatgcaaaactatatgtatacataaaagtatatttaacaatgaatcaaatgatatgaaaggaattaataattatttattttttttaataagaagaacggtcaaacatgtttaaaaacgtcaatggcatcaaacatttagggacggaggaagtagattgtaaaacgcaaccgtatggctacaaccagggttagaaattccggaatgaattttagtcatttcagacccttgatacaatattatttcggccgaatttttttaatttttttattcttttgtgaatttggtaatattttgtttaaatttaaccaatatttgatcaaaattttgaaaatttcggactgaaa

SEQ ID NO: 105419 - DNA, 3163 bp, Oryza sativa
atgcagctcaacccgaaagaagaactcgtcgaaacaaaactaaaacaaaaaggtggcgatgcgctgaaattgtattgaacatgtgtgttctttttttaaattacatagggctcgggttctatttatacccgagaattacaagatatgtccataccggacacggccactatctctaacaaactctaagatatcataagtctttgcggcagacttttgcccaaacatatctctaaggaagttacataaaacatcctaattaatagatacaattgccttctcaggactctatccatgtgcggcaatcatcttgaagcacctcaattcaacccaatatcatacaccaaatcatactgtcagaatcggacgcatcggctcacctagtccgacttagacccagccgatcctaatcgtagccgatctggacttcagccgattcttgctctgttctcggatcaatctccgccttcgactccaccttgatctaatctccttttccgatgctgatattaccaaatttggtcgttaacacatgccccccaagtccgggatatttgataatgttccgaatttgccgtgtaccgattctgagcaagtttcgcactctgccgtttttcaaccgttattctattgctttaaataccaaccattgccctcgagaaatctcatgccgtgacttccgttttcaccgctcaagcgaaaccattactctccggcgattcctccgacgcaaaagcgatcccctggcgatttcgcttttgatcagatctccgcctgcggtgatgtcgtcttccactatcccgtctactgcgccatcggccgagtatgctgaggtaagttctcaccggctagatcccttttcctcgcatgaaatcgatttcttcttttctcattatgttttctgcttcctgattcctttggatttgcagcacctttccaacctagttgcgattcccagcctatcgcacaaaaaccattattttcttggcccaatcgacaatcttgactccactgatttcatcattggtgaaaccaacagaatcccctttagactagccaaccctaacttgggtcactggaagaataccttcaagtcttggctatctcttgaaaagcctatccctgataagagctagaccacctggtaccaacgcatatcggctagtaagaaaacccactgggatgagattgggatcggccaagcgcttgctctcaccatagccaattctgctaaggatgaacctctgatggctgccgccacctatttctggtccaacaccatcaatgccttcttatttaatcaagggccgatgactccaactttgattgacatcatcatgattactggattagatgtaacttcatcggctaaccctataagtatgaacaccaagaaccaatttgacttcaagaccaaaagcataggagggtggtctggttatgtagcgacatacatgggcaaagggcctgtcactcctcgggagcacgtagctttcttgctaatgtggctagaaaagtttctcttctgtggatccagctgtggtcccacaaccaattggcaatttgtagccgaagccttaggttcaaagaaacaatttcccttgggcaaaatccttctcggctatctataccaaatgttgaacaatgcatcggctaagatagccgtcggctcaatagttggagcaggtggaccatggtggctactgcagacctggctaaacctggtagtcatgaaagttgtcaatcggccatctgtaacagaagctgaattcccaaggttggagccaattgtagaagacgatggagaagaacgcacccatcgcagatgcatgtcatatggagaatatgcatcgacaccagccgatgctggtgcaaaactatcggctgagctgctcaaagattggttctgcagcttttatgaaggcttccagaaacatgcccgggtttagtttctttatgaagacttagcagaccttgagctcccattagacttcagatttgaaaacatcaatcgtgaatgatatcaaacgtccagggaagtctttacagctgcaatcagcccatgcatcctacctgtcggtattcaccaaggaagaaatatccaagtctcctacgaattctatcaccctataagttcagctagacaacttggattaggccaactcccaatcggctttttctttgctgacaagatccaatgccgaggagaaatttcttcaactctaatgatggatcgactgcttaacctccaaggacctcccttaggcagtatcgacaatattgagttagcaggattcaggagcaggaactttgacagatggtggggaatggaaattgcatctatttcatcaatcggccacaatgtacatgtgtcacgtcccaaaacgactctaaaatatatcccttaaatgatgcatagaataattaaaatccgtgtgaaagcctccaacaattaaaatgtgcaaagttaaaagccaaataaggcttagaggatttttgtaaatttcctaaaagcctaaaatgcgtaaataaattttagtggaattttcagagcacaaataataattattaagaaataaacaaagttaaaatgattttataaaaagaaaaaccctaaaagtcccccttccctcccttgggccggcccggcccatctctcctccccccctctctctctctcctctccccgcggcccactcggcctctccccgcgcgcgcgccgctcacgggcgggcccgcccgccatcctcgctgacgggtggggcccacctgtcatccccttcctcccgccgctcccgttgcctcccccgcgccctagcgccgccaccgccgtgaatcccgccgcctcccgccgtccccgcgtgcaataaagtgggggggaatcactccccgtgatcccctctccctttccccctatttttccctctctctctctcgcattcaaacgggcggatttgcccccgcaaatctcgccggcgccattgatggcggccggacctcccacgccgattttcttcccctccggccgctctctcccccttccaaccctatttaaaccctccccgcgcctccctcgcccgtttccgccccttgccgcaccgtctccccaccggaatcgagctcgcgccgtcgccctctctctcctccgtcgccgacgacctccggt

SEQ ID NO: 105420 - DNA, 1857 bp, Oryza sativa
cctttcaaaatagtaaaagaatccaagatttaaaaggcttgcatcatgttaggttttactaaggtagttgtctgagtcagccaagtcgtgctgcaacttgaggacgagctgcttgaaaggagggatgtaatctcgagctgctcaaaaggaatgatgtagtatcataggtagtgggtcgagaggtcagttagtgttccaagaggttgaggccctagtatccctagggaacggttccctcatcttatggtagctcagttggatagagtttgttacaaatgattaaattggatccttccctacatctatataaggatggattgtattgtcattctagttaagcgacgaatcagaattagtctcccatatcctaagtccctttttcattcctagcggtcgtcaccgcccggctattctcccggtgatatttacccctatgaaccctaaccaataacaactatatatataaaaaatatatcacattttccatatgatcatattgctctctttggtgccaaagtccttcaaaatgtcagaagatatatgtcatgctttaaatatgaataaaggagactcctttatgtcatgcttaaggaacgacactatgacggtgaaatgttcagctgactaacttattacgtgtgtgggtagcacacaagaatttagcgtgtgatccacatccactgatccatagaaatttgtaacattagttatagtcttgctttgggtagcagatagagagaagatatatctcgtttttcacgcccgcttcccaaattgctaaatggtatatttttttgtttttttaaaaaatctataggaaagttgctttaaaaaatatcaatccatttttaatttaaaataattaatacttaattaaccctatgctaatagctcatctcatttcacatatcttctcaattttctcattttctttcctgtcaaatacaaccttaatttgcagctgattcctggttattgatctctgcccactcagttttagctaagatcaaaactgattgctggaactaagctgatttattgctcgtttgcacaacaacctaagatcaaaactgcatctctcaaaggaagattattgagtaattataaatcttgcaaatgcagtggttaatcttcagaaatgatggttaataataagttccggccgtacagtcggacagaaattaagcaggcgtcttggaaagaagcattgaccctggctgcatccgcatctgcaaatatattcatattcagacaatttcgcatggtcctgtccagccaggccggcttcaattctcttgtccgatgtgtatgcagggcgtgacagtaactgtaaatctgtaatcgtgcagatgtcgtcatctcttgccaggttcagacaaattcagagccacaggcatgagcagaggctagattcatcttcgagtaaatcctaagccgatatgatttgttgctgtctctctgcatattcctcacattttctgaatatttcacatgctgcaaatccatggtcattagtgaaacattgtcatttacttttttgagaataacattgtcatttactttacatttggaagcatcaagaattcagatcatggaactagctaaactgttaataagttgtttctctggctagaaaataatcaatcattttgtagagagagagagagagagagagaagaagaagcctttcttcaggcagtgattatgcatgtgcataactatgtatgtttaaacatctctaacactgaacctcagaaagactggtcagtttgtgttaagctggacagctagctctaagttgtaggatgtgattagaccatcatcattagcatttaagacgctctcaagtcctatttc

SEQ ID NO: 105421 - DNA, 622 bp, Oryza sativa
tgccgcctcaattctacaaccagtttgagcctataccacaacaaacacctcagcagcgaccatgggccgacgtgatagctgatgtaatgagggagcaatttgggcttaaaccaaaagagactgggaatttgtatcgacaaccttatcctgaatggtttgaaagagttcctttacctaaccggtttaaagtaccagacttctcaaagttctcaggacagaatactacatcaacctatgagcacatcagccgattcttagctcagtgtggtgaggcatcggctgtagatgctttgagggttaggttattccggttgtcattagctgggtcggcttttacttggttttcttctctgccacatgggtcgattaacagttgggccgatttagagaagcagtttcacagttatttctatagtggggttcatgagatgaagctgtctgatctcacgtcaatcaagcaaaagcatgatgagctggtgcatgagtatattcaaaggttcagggaaatgaggaataaatgttacagcttgagtttgactgatgcccagctagccgatttggcttttcaagggttgatttctccgatcagggaaaaattctcatctgaagatttcgaaagctt

SEQ ID NO: 105422 - DNA, 1500 bp, Oryza sativa
actttgctaatgcactttatacatatatctatctattatctatctatctattatatactaaaagtccattaaacttcctacaaacgtttctcaagccaccatgtggcacttcgacaaacgctcctataccgccacatggcaatgactaatctcaccgttgattttcacttaaattgatggacccgataatttagaccattagattaggagaaactaataccttcctactgtggccggaaaaagaaaaaaaaaagtaactaatccattactccgtaagtacacacgtacggcagaaaagcaattaatcttacgtactgttcatcggaagaaaaaatatcctatgcacagacttacttaaaaaaataaagccaaaaaataaaagtccttagtaccacttaaaaatactataaaaaaataaagccaaaaaaatatacgtacagtaccatttaaaaaattgatgatctttaaaacaaaaattttctactatttagagataaaatatattacgacctaaatttaagcaaatatcaccgtcgatttttacaaaaattaatgaacccaatactttatacaattacattagttgtattttattttctaaaaaaactaataccttataactatatgtacgtatacgggacgctagaaaaagacaaaaaaaatcataagtaggccgtacgtatgtacgactgggaaaaagaaataaaggtttcctactgtccatgggaagaaaagaaaaatctacgcacggtgaaaaatactataaaaacaataaagcaaaaaaacatacgtacatagtaccattgcaaaaaacgatgatctttaaaatagaattttctactatttagagataaaatatatctatataactaatataaatattcatatttttccggtcgtcacctcatccgtacaccaatttttcgtccatcacctccccccctagaatcccaatcggaattcaatcacccccaccccaaaaaaattcccaatcgaaattcaatcacacaaataaaatcagaggaagcatatacacacaaatatatcaaaaaaaaaaaggatcgaaggggagtcgctgtcgaacaaccgccgccgccgccgaaccgccgttgccgtcacaggccaccgccaactcccctcccgctggatccggtggagaggaggggcgctgccgccgcttggacgccggcgggccaccgccgcctcccctcccgctggatccggcagaggggaggggcgatgctgccgctgggacgtcggtgagccgccggcgcctcccctcccgctggatccggcggagggaagggcgctggcgcccctgtccgccgcctcccctcccaccagaagggagggcgctgccgctcgccacggtcgagccctcctggagccccatggcgagggagaggaggccggtcgctgctccacgccgccgcccgtcgccgctcagtgtggggaggggggcgccgcgccggcgacggcgatcggggtgggggggtgggc

SEQ ID NO: 105423 - DNA, 1830 bp, Oryza sativa
gtaggggggcacgtgaggggagcattttagttattacgcaccctgcgtgcggtttagcgcatatatatatatatatatatacacacatatagagagagagggaaactcaaatgtaaaccgaagttatgcttatagcacgattgagtagtacttgttttattgattgctgtagcagcctgttatggtggatgcatacagggtagtatggctgatgggacgcatgggctccaccgttactattttccttttgacgcttcaatttctgccgtgtgtttagttaacatcaaaattagaagtttgattaaaattagaacgatgtgatggaaaagttgaaagtttatacgtgtagaaaaattttcatgtgatggaaaagttggggactaaaccacactctaataagttggctgtgacttgtcatgtcacatggacacaacttttttttatggacaaacagtgcccgggaggtttgcctcttcatgcatgcagtgttttgtcttgtcactgatatctttgaccaacaggacattgcactgattcctccctaaataaggacatggcatgctcagtggatgtgatcgaggtttagtctgtgtactagtttaaggctttgtttagtccacacaaaaaattgaaagtttggttgaaattgaaacgatgtgacgaaaaagttaaaagtttgtgtgtgtaggaaagttttgatgtgatggaaaaaattggaagtttgaagaaaaactttggaactaaacacggcgtaaattgttttttttatttgattgtatatcaatactcctcacctcggctgcacaaaactgtggagataattttgaaagcctttcggaagatagctcggacaaaggatctgacattcactctggaaaattaattttacaaatttatttgtatatttaagtgagcaaatattgctagttagttgctctagagctattatcaaatttgcaatagatttattcgatttcacatgtcaagtactattatcaaatctcaaaattagctctttatcgtgtggtcaacttggtcagattacattaccatgttaattacaattggaaaaaggtatatatattgtcataaacttagatattacgatgtattggcttatattacattaccatattaattacaattggaaaaaaatagattttatgatgcaatggcatatattcataggaacaccagtcacgtacttttttaagtttataataaatgccaagtgatatatcattttgcaatatcatttatacatcacattgcaaaatgacatttctatgcaaatatcatattttggtggtgagtggactttttttttgatatattttttttatgtagattgtaactaaatcatattttagaatgtaacatatatctgtaaaatattaaccacatgtttctttattttcaatccatggcaagcgaataagcgatataccctaaatcatatacctagtagacatgacaactaagaaaaagagctgaaagtattttatgaatgagatttttagcttgtagtgatgatgacgtgacattggtgtcagaatataggtgtggcctgcaggtgcagggggtcattgggaagcatagaagcaagtcaacttgtaccaaggaaacaagcatgcatatccagccctacataggaacggagtggagtaggtacatcttatagctgcattagtacataatgaactccccgttgcaatgtgcatacgtgtcagccatatgaggtgggtgcatatgaaccttatatatatatatatatatatatgtgtgtgtggagatactatactacgcatggggtgtagtataatacaacac

SEQ ID NO: 105424 - DNA, 826 bp, Oryza sativa
ccctccctaactccctcttctccttctgaaggtcaagagcgaccccgtccgccctccgtcctcgcaagccgccatcaggcaatcgtcgtcgccgtcatcttcctccgcgccggccgccgcttccggtgaggacctctcctcccttcccttttttttcccgtccccctttcttgccgaccgccgcctcttggggtgcgtcaccgtccccgtgcgcgccgatgtactccggccgcccgacaccattccacgtcgccgggtgctgccaccggtggccgcatgccggcgccgcgccttggctaggccggaccggctaagtgcccagcctgcgcccctggctgccactccccttggccgcctgatcggctcaggccgatctgggccgtccacgtggcggacacgcacccgaggccacgtgtggaccatgtgcaccgtgcgccctccccctttgactcgctgacatgtggggccagcgtgtcgacgccggccgccccttgctgacgtaagcgaggtgcatgtcctttgcaaaaataaataataattgcacaataaatcgagtataattcttaaaaatcatttaaatggctcaaaacttctaaaattcatatgtaattcatacgaactccaaattgggccattcaatctgcaaaattcatctaaaattgatctctacatgttagacaaatttttatgtactatggccttggttattattagaggtgttacttgttatgcgtgccagcgtgtaactaccgtcgtttctgaagtccgcggtcgcgaggaaaagagttcggaagatcaaagtgaagaagcaaggcaagtcacacat

SEQ ID NO: 105425 - DNA, 733 bp, Oryza sativa
tgtttatccgtaccaatccctggatctgtagttggtacacacatacatagttggatcacaacatatcatgagtgaatttaggctaaaagagataaatacttacattagggccaggtaggccaacaactatcagagaacaacagcagaaaacaaaataatataagggcccggttaacatgccacaggcagtcgactagggaacgagacttagaacaagaccgcactctgatcatcttgtgggatacgcaagcgtacctacaagggcttctcttcaacactctcctaaaagatatataaatagcaagggtgagtaccaaccgtacttagcaagccaccacaacaacaatgcatatgatagaggatatttcaaggaatggcttcaggttcttctacataaagctaattttacatttcttttcacaaacctaaaatctagcatagactgatcaaattttagtaccagtgttcactttaaataacgacggttctgtccaccatctattgtgatccaaaggatagcttcccgccattgaatcatcgtggttttctaaggatgtccaccttccctcctctcgggaagtggctccatcagcataaaattcatcatgcaatatcccatcccccacaagttaagaatttagagtgtagccaagtgtaatacatgtcccggtgctcaataaccgcgagcacggctattcgaatagatttggtttactcacactgcagtggatgt

SEQ ID NO: 105426 - DNA, 760 bp, Oryza sativa
ggacgaacgttaacgtgaaatgcaatatatatatatatatatatgtatatgtatatatatgtatatatatatatatatgtatatatatatatatgtatatgttacttcgcatttgactatatacatcttttgtatcttgcagaaaagacgtgttgtcggagtcgtccgtcaagcctgagtggaagagctagccctagaaggaattggagcacgcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcagacatgactattttagtcttagcatgtaatattatttgagttttaatataagattactttatttgagattagacttagtatataattattgactacggaagtggtgcgacaagtagcaattgactattgcagtcttaattacacttagcatatacgcacgaaacacttagcagacatgactattttagtcttagcatgtaatattatttgagttttaatataagattactttatttgagattagacttagtatataattatttactacggaaatggtgcgacaagtagcaattgactatt

SEQ ID NO: 105427 - DNA, 2619 bp, Oryza sativa
atccaatacaacaaagaagtttacttacaacaatgggagcatgctcaggtgtcttggctcgtcccgaggattcagctcgtcccgaggacacggggcaacctgaatatgatagcttgctggtaaaaagcacttaatcccacgaggccttagctctaattagggtcccgaggatgccccaggcaacccttggaagatcccgtgccggtaacaaacacttaatcccgtgaagcatgggtgtcctcatcatcggtcctcatggcctacctgtattggctacaccagctaacggatgggcccggggactattgggacaaagacttttaactcccctctccatttgtcaggtgtgcctgtcacatccgactagctagcttggagggataatgactagactaagcatatcaaatttcgagttgtaggccccactcttgcatgtatgcaactgtattgtggactccccttcacgtataaaagaggatccataccacctagaaaggggttcacaccctgatataatctaggttagattaaaatccaatgagcaagcaattaacttcacctactcacttagttttcatttccacatcactttgtaattccatgtaacatccatatctaccacacatgaataggatataacgcatctgttcaacatgaacttgtataatcacttgtgtttcatctcttccacacacaatcaaaaactcgggctcaaaacttgtaccccggtcgaacttttctatggggagtacctatcttccatgctagagtagtcccataatccgacagcaacgaaatcggcggcgcacgtgtcacgcctgtaaattcacaactaatatgtgtattaaaccctcgttcaggaatcggtctcttgctctctcttgactttctcgctctttctctctcagaggagtcgcttggcagtggcgcttgcccctcgatggagtgtggcagaggctcgctctcgtgcggatctggcggagcgcggtggacgcccgagcttgcgcggatccgacggcgtgacgttggaggacgtacgtggcgacgatcgtcagtgtgaagatggggccacctaatctgtatgcctagaggtcaagggccactggatctagccgcttcgagccttcatggcgatggtttgggaggtgcgacaacaacgacgggtttggaggtgcgatggcgtcagcggttggtagatcctcctcttttgcctccctctcgtgattcttgtgattgttgatgcttattcatgtttgtttgtctcggtattgatcttgaggatcgagatgtgttgtttgtagttcatgtgttgatgtgttcatggatttggggcatcatttttgggatttgggttatcatttaggatctagggatttcgaggatatgcagactcgatgcattgagctgttttttttttggctcgtgtgcatctcaaaggtgccggttgtggaaccaacaacagtgcatgatccggggtcattagtaccacctctaggatgctaattaggaaatccagcacctatggaggtttcccagccagcatcgatgactcttttttaagtagtgagggctacttttgaaatgacactgagaaggtcatcactgcacgtacagcaagtgagaaggtcatcaccgaggatgttctctgttgaccttgaggctatggaggtaactaaatgcaaagatgtgtgtgaactacttatccatgtgagctcccttggttgcctactttaccagcatgtgtaattcattgtgaaagacggggcaaggttcactactacaaaacatcaaaataggtgtcgccactatatgtgctggtactactaaaaccagcacctataagccttttcccacctccacaggttgaaattgtaaaaaaccggcaccttttaagtaattataggtgtcggttctaaataaaaaccagcacctattatattttgtatcgattttttttaaaaaaggcacctataatatattataggggtcggttaattaaaaaccgacaccttttagatattataggtgccggtttttttcaaaacatcccaaaaatcgagccgagacggagccgagccggcgggcccaccacgataggcaacgcgaggggataaggtcgagggctcgaggctcagtctctcttctccgtcttttctaccttcgcctcttcttcgtctctcgtctcgcctctctccctcccttctctcccgctgccggcggctggacagcggaggcggcagtggcgaccacgccctcccctccgccagatccggtgagaggggcggcggcggcggcggcaggaggggaggcgatggcggggtcggcggggttggcggcgggcggggaggctcgatgtggggaggcagcggtgggctcgctggcggggaggagcccttccctccgccagatctagcgggaggggaggcagctgcaggggcagcgggctcaccggggctaggtggcggcagctcgcggaggagacgcggtggcggccgacagtggatccaggcgtcgtcgccatcgtcgtcgcggccgtcattgttgtcccggccagcggtcgatctgcgcgctcgaggctagttggtggtggatccagattttgtcgtctttacggtcggc

SEQ ID NO: 105428 - DNA, 612 bp, Oryza sativa
agcaatacctccgaaaaagttggcaacccagtcgactctaaagccaatgccatcgatttgattgtcaacaaccatcagacaattattaacgcaaattataagcgcaacactatattaatatatgaattgatatgaatgcaccttccaaattacttgtcttccctatatcagtacacgttgatagtgactacaatatactactccctccatccaaaataagttctttttcatccatcatatacataccaatataaaatataaaaaaaagagctaaaaatactctcactttatcaaatcgcaatgcaattgtttctctctttaactactccgatgtatatatatatatatatatatatatatatatatatatatattctatttttacaaatcccaatgcaataattgcttaaaaataaatttattttgggacgaactgaagaagccaaatataaacttattttggaacagaagttctatataaatggtacaaattcaccatcattaactttcttccctcgattagcacaaactaataggggataaactacattaatgcaaatagccaaattgcaaaattggtacaaatttatagtggctacaatatttattata

SEQ ID NO: 105429 - DNA, 1794 bp, Oryza sativa
tagtatcaacaatttatatatgagaaccgtagagaacgtccaaactaaagttagggtgtgtttagttcacgccaaaattggaagtttggttgaaattggaacgatgcgacggacaagttagaaatttgtgtgtgtaggaaagttttgatgtgatggaaaagttggaagtttgaagaaaaagtttggaactaaacaagggcttaggagcctagcagtaattttccctccttcaaataggggttgccctttatttgtgcatactgacagcacttgtagctagggactagagtggtatacactatatattataagttttctcatttggtataggactgtagttatgtttaccttttcaggttttcatacacggatatgtagaaagataaccaaggtgtaatatttgtaagaattagtttgacccactactttagttctggtctcatgacatatataagcattgtaaagacataccagtactaaacatcaacatatatttctttcttaatgtcagaactaagtatcgataatattcattttggaatatttatgcagcataaatcaacagaccatttaccttcagaagctggggtcatctctacactgacttcactagttttgttaagcaattccccatcccatggagaaccaggaaacagagtaatagctcaaggtccaggcatgtcatcaagggtttgacatcatgactcaaattgttcgtggcatgtcatttaagagcgcttcagcaatcccaggatgacaaaatgatccatttattgatgcttagtaagtcatttttttctttgaacctatcattttctttaccttttctttattcagtatcaaagttactgttttccttttttccctgcatcaacagcacttgtcactttactagactgttcttgtggcaaaacagccctggtaaagaatgaatagctatttaggctaaactgagacccccattatatgcatttaaatatttcatgtgcactgaaaatgtaacaaagcatgatcaacatccactagcaggaggcatagtattttagtcagtttggccctgtttagatcccatcccaaaatttttcaccctgtcacatcgaatgtttgaatacttacatgaagtattaaatataggctaaaaaaataactaattgcacagattgtgactaatttgcgagacgaatcttttaagcctaattgctccatgatttgacaatgtggtgctatagtaaacatttgctaatgacggattaattatgcttaataaatttgtctcgcggtttactgacgaattctgtaattagtttttttattagtgcccgaacaccacatgcgacaccctatataatacccgatgtggcacgccacacccctagatctaaacacccccttaatctgaaaaaaagggtcattttgcagctccaagctctcatttcctgatttccttttgttttctgtatgttggcatgcatattagacataaaaatttgagacatgataaggtggaccatcatcattgatgccccttcagcccttctaaacctctccccgttgggctagattttcctaatttcctgtatcgtatgcttcatgaaatacaataataagccctgctatctgttgtatcttggggtgttatgaggctgttaaatgatattatcctaaaaataattttgatgcatgctctgcactaaagtatatctatgtaatggatcacataaatagtgaaataattctcactttgttctcatatcgtctcatttttcttggtaatcagttggtacagactttggt

SEQ ID NO: 105430 - DNA, 697 bp, Oryza sativa
taaaaacaaaataagggaaatcaaataacatttgagaatggtaagctcattttacctctttttcgctgcccgagtggatcgcaagttgtattgcgtgggttgcgtcccctgaggcgcgtcgggaagctgtgacatgtctatctcctcgtcgtctggtgcgacgtagtcgtcatcctcctcgtcctcgtcgtcatcgtcgtcgctaggtggagccggcgccttcccctttcccctcccttgcttaatgcgtgacgacgacgagccaccaactccttcacgctcttctatcctgatggagtgtcgagccatacttggacgcgcggattgaggtagtggtagtggtagtctccccggttggtacacgtcgtccaatccaaccgacctgcaacctaattttgctgcaagtttccggcacctttgacgaactttctgcatttcaaaaaaaaaaaagaagtttgttaggcataactcaagtaatgcaaagtgctaaataaattttacctctaaaacattgcggagtgtgttctccgtgtcctcaccacccctcggagcttggagggcatgccccatttcattcacactcttgaggagctctctcgactgaaagcgtgagaagatatatgttagggtctagggtgcaaatggaaataactttgacaaatgcaagaaaacttacgactttgtctctaagtggggc

SEQ ID NO: 105431 - DNA, 798 bp, Oryza sativa
atcttcaatttttataaccgactcaaacacggatgacggaccgcggaaacatcttcaatttatatttccaaaagcaaacgaacttaaaaaccgactcatacacggatgacgtaccaaaataccggcaaaaacatctttaatttttataatagtagagatagagatagataagagatatagattaaaaccaaaacataaaattaaaacccactcaaacacggatgacgaaccgtggaaacatcttcaatttttataaccgactcaaacacgaataacggaccgcggaaacatcttcaatttatatttccaaaaacagacgaacttaaaaaccgactcatacacggatgacgtatcaaaataccggcaaaaacatcttcaatttttataatagtagagaagagatatagattaaaaccaaaacataaaatttaaaccgactcaaacacagatgacagaccgcagaaacatctttaatttttataggagtagagagaagagatatactaaaagaatccgtaatggtggctagagtcctgaagatctaatggctaagaactctcccaagatcctcccgcacaatcaacgcaccagccaactccccatccgtgctcgcatcaatcatatacataggttaatgggatacggcaatatcatatactcgctctttcccgtagtataacggattttgggtggatgtgacatatcctaatacaaatgaatctgaacagactgtctgtccagatctattgtattattaggatgtgtcacatccatctaaagtctcttatactatgggat

SEQ ID NO: 105432 - DNA, 4983 bp, Oryza sativa
acgatcgatatcgatggagttaatgattagtagtgttgatgacgatgattaaaggcgtactagtgattgatcgagatgatggatcgagtgtagtacgggtactggtactagtcaatgtgagagcaagtttaataatatcacccgctgttagctgcaatttctttccatgtcatctgtagccaacatacatactaatatatacaatagggttagctatgtatttatcctccttttactgtagcaaatgatatttaattgcgttgcgccaagcatctcctctcccgcgcaaaacggacgcacttttttcttggagtacgcatatcggcgggcgactatttagtcgccggcctgtactctctctcatctgcgctcccggccaagtcatcaacagaacttacgtggcttgtttatcgccggcttttctacccctattgaacctgctctgatgcaatgcaaaatggtgtgttatatcatttattaattgcaggaatatgatggagcaggacataacgtgtatactccctccgttaaaaaaaaagacacacctagatttccgtgtccagcgtttgatcgtctgtcttgtttggaaaaattataaaaaaaatttaaaaagacaagtcatacataaaatattaatcatgttttatcatctaccaacaataaaaatactaattataaaaggatttcatataagacggacagtcaaacattggagaaacccatagtttgtctttttgtaggacggaggatacgatcaatgaaaagacgctccatcaaacatactagtatacgtatacacgacacgacgggatcggcctgccctacatcattattttgctgctttctcaaatcattataaagacaacttttcatgatgaaaaagaaaatccattttactccactacactatttaaatgatcacttaatcacacttgaactatttttttctcagtttacccttaaactattaaatatggtttactttacatattaataatgtttctcttttcttgctcttcatatacgttgtattttaagtttattttttagagctatagatgacatcattattaaagttcaaaattattttcaaaattttcttggttgtttgcttcaactttgaaattttaatatttaaattaaccttaagtgctttcgaactacataaatagttagacaaatttacaaagatgttcagacataagttccgaatgcatatgcattctaccgaattttcagtgcaaaatatgatttgtacagagtgaaacaaaaaaaaagagaaatagtgttatgggagttaactgaaccgttttcaataccgataaatagtttaggggcttaagtgatttggtggaatagttcggaagagtaaaaataaactttttcctttcatagaactacatagtttcatttctaccagcgggccataaaaaaggttctacctatattttgctttctcaaatcattataaattaaagatggcttttcctgacacgtaggtttaatttctaacatcggaccataaaagaatgattttcgtagcggtgattatttttcttaagtagccatgaaaatttatgaaagggtcatcatgaaaccttatggacgacctctctctctctctctatatatatatatatatatatatatctcttttcttgcttatatagttggtacccactatatcatttattgctataaagtttacaccatgttgtgccacatcattgtttattatgagccgttggattgttctacgaatcctcagatcaacgatatcgctaagttgggccggtattggctcagctcccgttggactttttagcccagcccacatcacgcatgcttctactgtgatggagaaaaaaaaccaaaacacatctgcatcatcagcgatgcttgcgagggagaaatttgtgatgaaccaggatgagtacggcatgggagtggggacgcgagcggcctgttgcatggtccctattggctttccccctcattggcccgattaattggatgtcactccatgtcttgccttagtttatgtctcttctttttccttggaaactgccttaaaaattcaccggatgaaatccgccacctttccctcttcccctctcattttgttaataaaaaaattgataatttattggaggatatacttttagtccaagtagagtgagaaaattttcaaatagatgagaatcgaatgtctctgggcgaccacatgcttctaacatagtgttggaataagaatttaaaaattatgcaactctaaatcttccatcactatcccaaatatgttacttgcatgcattatatttcatcttcactctaatactaagttagaagacatctttggtcttagggatatttttgtcttttaaacaaattcttatccaattaggttgaaaatgacctgtaacaaattatcttttttaggtgtcctttatccgcgacacttttttacaacgtctactagcaaattacataaacttaatttgatcatcctatagcaaaatttacctcactttacgcatgcctaaaataacttatatatgcttgtttgatcaaaaaaaagagtgagagacaaactagggagggaacgtacgtgttgtgccaaaagataatcattttccccaggccctagaaagctaattataagcttaactaatttcagcgtcaagtcggtcatgatcagtaccaatgattaattagccatcatatcaatatttagcgcagctagcgtaattcacataattaagctaataagatgtgtttgcctatcccttctaattaagctaacgtagtaatcatatatatgatccacgacatgtaggcccagttcttcccttgggattaatattttagctcatgaatgattaattatatcaggcatggccgcattagcagtcaatgatatatgaagtatgatccaaagctagactagaggatgattgtgagcatgctaatttggacaaactatgatacacacgcacatgtacacgtagtactaaagcttacgatcatatcaggtccctaactaataattaatctatttgtgctgtttgtccgtacccgtaatatatacactataaccatcatatgctgtttccataaaaaaaaactatatttagttgcgactatgaagaatctctcgtgctaactaaaatgcatgattttttttcattaattatttgttagatgaatcgtataattaccaatacaattaaatagataatagaaaaaccagtacgaattcatgggttaccgatcgagatgggtaaaatttgatctaatcaacaaatgagtgatgacatacccctctgtttcataatatagcaaccgatcgagtacaaatatatcacgtcctatattatattgctatattataaaatggaggtagtatacgcatgtgttggaccatctcactagcaccaactgaattttggttctcagtcaggcagaatcagtacgtatattggcatcgattgagactgtcctaattgaggtttgactggtccaacttccatcttagctagcttgtccctccacgattgatagtactattacatatatgtacatagatcgtttggtacagatcatgcatgcatgtacgtactcacaaattaattgatcgctagcatagctccaactaatttgattgagctagttagctagctaaatagacacacatagctgaaatataattcatttctttttagctcgaggtagcatggaaattgacacgtacacgacttgtatatatttttcttagatatacaatgtatatatatggctcaactcgcatgcatgcatgcatgaatctgcaattcatgtaagttaagttgcatgcatgatgcatggtgctgagattagccaccatattacacatagctaatatatatagtcctctccgtcccacaatattataatttcttgtatctatgtacatagccacaaagttgttacatttgagatgaaggtaggtgcactaacatgtatgtccaacaacgaacaaggacagatccaaatttgatgaggagggggcttattttcttctttctcctacaactccttgttattctttccttccttatgtcctctctatgacgatgatctaacagggtaggaggggcttattactggagatcgtgtggttgtaacgcagaaaatccgaaggtgccaaaaccatgtgagtcatgttctagtagctaataaggctcaaatggagccccttacgaagttctggctatagaaagcaattgtaatttcatcttacaacttgttggtgaggactctttagttaagtaatatacttatgcttttctccacaaaaaagcagggtgggaggggcttgagctccccggcatccatgttcgatccactacccctactgacaaaataggtaaaatagatgttaccagtctcatattaaaacttaaatatgtaactcctccatatctataaaccttaatttcccaagcagcgtaggtatagatttaagtatgggcaaaggatatagccctacttacaagttacaactataattagttatgctaactacccaggtggcgaaggacgacgatgagaatgagatatatacaagcaacaacctatttcctttatgacaaagtattagctagctgctgctgattaatcattacgttttttttatgatatatatacatgcaacaagctaacaagcgaggcaaacgtagacatcgatcgttctgttgcgcttgatttgatcgtgtgagtgtgtactgatctattcttgcccgaaatgggcctaatttgtttgggccctaagactacagataccagatccttgaaaagaaagccttgggccgcttccccttacctctctatattgggccatgaaagcgataccaaagatatttggaaaaagtacaccgaaggtccctcaacttgtcatcgggataaaaaacgtcctcgaaccgtaaaaccagataccgcgggtcc

SEQ ID NO: 105433 - DNA, 667 bp, Oryza sativa
tgacaaaaacgctcatatcttcaagggtgacttctatgctgccaacaacttgctgcaactgctcttgtaaactatggccactgatcctgaagaaccggacactcttagcaggattgaacttggattgcgcgaaagagttactcacctggtgatcttttgcatcatcttcttcatggccacggcatctgaatctgtcaagagcgtaataccctctgaacatctccttcctcagtatattcagttgcagcagcatgcgttggtttgtgatgagccggtcctctgcctcctccacgatgatctgggcacggagcagcagccgttgcagtctctcctccatgtttgatgctgtcggtttcgagcacttgttgatcaggaaagatatggatttagtggcaagatcactcagaatcacagacaaaaatgtctccataagtgaagtatgtaatctgaagttctgtagatcactcaatggatcaacaagaactgggagctgagagaaaactatgtagcctggaaatttttcagtgtgaactgttttgagttcaaagtgtcagtttctctctacagtttgcattaatataacggtacgaggctgaccacgtggtggagacaacgaaagcaagagaattgtacagattcagtgatcagtcagcaccatctacaatgg

SEQ ID NO: 105434 - DNA, 1214 bp, Oryza sativa
gttttaatctatatctcttctcaactattataacatgaagattgtttttgccggtattttgatacgtcatccgtgtatgagtcggtttttaagttcgtctgtttttggaaatataaattaaagatgtttccgcggtccgttattcgtgtttgagtcggttataaaaattgaagatgtttccacggttcgtcatccgtgtttgagtgggttttaattttatgttttggttttaatctatatctcttatctatctctatctctactattataaaaattaaagatgtttttgccggtattttggtacgtcatccgtgtatgagtcggtttttaagttcgtttgcttttggaaatataaattgaagatgtttccgcggtccgtcatccgtgtttgagtcggttataaaaattgaagatgtttccacggttcgtcatccgtgtttgagtcggttttaattttatgttttggttttaatctatatctcttctctactattataaaaattgaagatgtttttgccggtattttggtacgtcatccgtgtatgagtcggtttttaagttcgtctgtttttggaaatataaattgaagatgtttccgcggtccgttattcgtgtttgagtcggttataaaaattgaagatgtttccacggttcgtcatccgtgtttgagtgggtttaattttatgttttggttttaatctatatctcttatctatctctatctctactattataaaaattaaagatgtttttgccggtattttggtacgtcatccgtgtatgagtcggtttttaagttcgtttgtttttggaaatataaattgaagatgtttccgcggtccgtcatccgtgtttgagtcggttataaaaattgaagatgtttccgcggttcgtcatccgtgtttgagtcggttttaattttatgttttggttttaatctatatctcttctctactattataaaaattgaagatgtttttgccagtattttggtacgtcatccgtgtatgagtcgatttttaagttcgtttgcttttggaaatataaattgaagatgttttcgcggtccgttatccgtgtttgagtcggttataaaaattgaaaatgtttccgtggttcgtcatccgtgtttgagtcggtttaattttatgtttctgtctcaatccatattcctcctctatctctatctctaccattataaaaattgaagatgt

SEQ ID NO: 105435 - DNA, 2044 bp, Oryza sativa
acgaatccaagggagagaggcagggaaaaatggggggaaagggagaggggatcacggggagtgattgcccccagtttattgcacgcggggacgacgggaggcggcgggattcgtggcggcggcggcgctagggcacgggcgaggcggcgggagcagcgggaggtcggggatgacgggtgggccccacccgtcagcgagggtggcgagcgggcacgctcgtcagcggcgcgcgcgcggggagaggccggatgggccgcggggaggggagagagagagagggggaggggagattttagggtttttctttttataaaatcattttaactttgtttatttcttaataattattatttatgctctgaaaattccactaaaatttatttacacattttaggcttttaggaaatatacaaaaatcctctaagccttaattgacttttaactttgcacattttaattgttggaggctttcacacggtttttaattattctaggcataatttagaggatgtattttagagtcgttttgggacgtgacattgtgtaggtctatttcatcaagattgaagcaatggggaaactacccttaaccctaaagattgaaatagaccgatttgagagcaatgcacaagagggagagggatttaccggttgaaggagttgaatcacaccaagaaactaccctctattggtgcaaatcgatgaacacctcttccttcacctagggttccatgccatggatcacaaactcaataaaaactcaaatcaatccatggaatagagagaggaagaggaggggattcacttacggagtaaccggagtgattttgacggttgaaccggacggatttggtggagggaggtggctagggtttgggagaggagagagcagaagaaatttcgagttggagaagtgaagagatgagatgggatgaggacgggtcgggtagaaggaggaggaggaagaaaggacaaagtcctgggccctccatccctggccagtcagaccgccagggtgcagccggtcagaccgggccctagaggccggtcagaccgccgccaccaggccggtcagaccgcgcatatagcgctggtcagaccgcctggcccccagccgactgtgcactgcccttgcatagttcggctacccccacacaataaaattcaataaaaatttgaattttggagcaattttgaaatgtgtgagttgaaatattgccaaccattcataatatttgaaatttatgaagatttgcaacaaaactcacttgagtgctaggaggtgaccatttatggtctataggggtttttgggcgaatttgattttcaaacaacttttaaaatatttggattttgaatatgatttgaataccaaaaacatttcaaatcttcttctctaccaactttgttttgaaacttttctcaaattccttctcaatctcattttggggttgaatttcattttggccaaaaacaagattctagtttcttcaaaagagggccaaaatggcattttcattaaaaaaacatttttcttgcaaagtgaaggttggaaaacatatagggaaccttttgaaacattttccaagagatagttttcaaattacattaattttgcaaaaattttgacttatgttgacttgggcattttgaaaacactactagcacttttagttgatttgctcacatataaaaggaagtggagcacatgcaagagtgcaaacctcccccttaatgtgacatgctccattttcgcaatgaagaaccaaatggcaataaatctaaagcataagagcaaaaaaggagcaaataaacaatatggaaaagaagcaaccatggtgcaccatctcaagccacattagagaagtctatgatatttaactcattcctcaacttgcaaaagcgggtttcatcaagaggcttggtaaagatgtcggctagttgatcctcggttcttatgtggctaatgactatgtcacacttggcaacatggtctcttaggaagtgacggcgtatgtcaatatgcttggttctagaatgttgg

SEQ ID NO: 105436 - DNA, 746 bp, Oryza sativa
tgtgtgtgtgtgtctatatatatatatatatatatatatatatatatatatatatatatatatatatatatatatatacatgataaatgtatacgtatacatataaatgtatttgtatacatgcatatatatatatatacatatatatatatatatatatatatatagatgtaccaggcccttatgcacccccccatacacctacatgtatacgtatacatttatacatgtatatatatatacgtgtatatatatatatatatatatgtataagactattctacaccccctccctcctgttcccccctctcctccccatcccatcgctccccctccctcctgatctttcttttttctgtttttcgcttcccctccccctccctcctcccatctctctctctttctttttcttttccttttttttctccctgaaatattttttctcttttctagaaaattttttctgtttttcgcttcccctccctcctcccatctctctctctttctttttcttttcctgtttttcgcttcccctccccctccctcctcccatctctctctcttcttttcttttcctgtttttcgcttcccttcccccaccctcctcccatctctctctctttctttttcttttccgttttttttctccctgaaatattttttctcttttctagaaaattttttctgtttttcgcttcccctccctcctcccatctctctctctttcttttcctgggctgcaggaa

SEQ ID NO: 105437 - DNA, 672 bp, Oryza sativa
cacgttatcgatgccatcattcagggccgtcagttcgatgttgttactctcatgatgcaagagattgccatctctaaggggaccttcactcagggtatctattatgccccttacatcatgagattaattcaagacaagcttggggctgctgggccaaatttgaagaagcacaagtagtacaagcccgcctacagcttggagctccccgtgctcctaggacggcgccctcctctcatcctagagctagctcatgctctgcacctccgcctcctcatgggtatgatccaaatgccttctttcatcctcagtatgcctattttgggatgcaacccaacgagtacttcaacccggtacttggggctattaataccctaagtgaaagcattcaacgcttgtctaccgggcatgacgctttgcatgaggatgttcgtggcttgcgcacggacgttggagacttgaatgcttccgtggggagattgcacactcgagtgggtacattggactctcgagtccaaatgttggagagctcccaagcattcgtgtatcatcgtcatcgtgatgcttctcatccttccacttcggcgcgtcctcctttttctccacaagagtgaagacctttttggtgcttgatgccaaaagggggagcaaagtgtgttttttgttgggttggga

SEQ ID NO: 105438 - DNA, 2257 bp, Oryza sativa
agctgtacccgaaaggccaaggcttcctgcccaacctccggtccttcctttcggtggccttcccctaactttaaccctgtttaacctgtaggtttggccgtccaaggtaggggtgaaaaaaaaaaacctcggcctcgtaagctaagctcggccttggttcaactgggttggctgggctcaactcgaaaccccaacaacccaaccccaaccttttttttaacttcgtggttaaaataacccgacccaacttactcgcgagcagcttgttttggctcgcaagcctaggctatcgtgcgtttatattgattattttactttatattacgttattatttgtcaacttgaaatttattattaagattttgaagtattgaatatataaacttatttaaattttacatgttgatgatttattcttacttttttaaataattacaaaataatatgaagatgtgttttaataggaaggcttgcaaggcagctcgagctaggaaacgagccgagccgagctcaagttttagcttgtctccctaaccaagccgagccaagccaaacctaatttattgtgggccactgcaagccaagccgagctgttcagctcggctcgtttccacccctagtagcaggctccggtcgcttctgtagccgatctgtacgcccgaaccatgcagggcgtacgtgcttttccgtgtgtagctccgctgtctcggccgtgtatgcatggggagtgatttgaacctgcccgcatcggtgctctctcgatcgggggacgtacggaggcgaggaaagtgggggtgtgaagacagtgacaagacgataggaggtagggccggccgggatttccattttgcaggctttgttttcgctcaaaaacccttggagtattattcgcctggtcaatggttatgaccgatcacgggaccaaacccattaccagtactttttttttatataaaaatctttttgcgcctccgatccaccatgcatggacatgcattactgcattaattgcagacttcatagtctaaaaaatgcattacctagcaccgcaaggtgagcagggtccatgattccattcgaatttcatcacctgaatttcggagatttcccaagcagctcgtttgtgttgaattccgttctagttccatcaaatttcatgaaaccatcatctccctagcgcggcccgcatttcaacacgaaaacaaaattgcaaatcgtttctgagtagccttagggtcaaattatatatagggatctttaaatgcatgagtttcaacttttgaacaattttttacccagctagaatcaggtgaaagaccgtacatttcgaccaatttttagtattttaaaacataaaactaaacgagccaaaacaagccaaaataggattatctaagctaagagcatcaccgacaacatcctaaaatttcttttttagaaccctaaacatattaggtgtgaaaatattaaactctccaaaaagttacctaaaattgatttttccaaaactacgaacaaatgaggccctataaaaactttccaacaaaaatatgttttttttcactcttttcatggtgattgcaatcaaccttgatgcctcccatcgccatcacacgaatgcgcacacacctcccatccctgatgccactctccccgtgagatgggttgggagcggaacctcttccctataagcataaacaatctggacttaggattttgacctattaagagcaatatagaatatgttggaatttttttaccaaaatttcctaaatttccagatatggaaatatgtatatttagatgctagctgttgttgatgctctaatcctttagtctagcccttgaaggttagaaactaccattagtcggaaaaaaatgagaaaattatgccactctcattatgatatgtcggagtttatagccatgtaaatcagttgcatctgtatgctacgaaatatagatatatttttagaaatagaaataaggatcataaatattaagctttgcgttcaactaagatcttcagccgaatgaggaaaatttgattggaccgcacactagtttccaggactatatatatatcggttgacaaaaaattccacctctcatctttaaaattttggaccatcggatatgctttaatattcatgcagaggcattaactctaactctcatcctcttgttcccctcccctcgcgcattccaccgccaccactcccattgtgcattctgccgtgacctcccgatacccccc

SEQ ID NO: 105439 - DNA, 579 bp, Oryza sativa
ttgggtattggtactgacctgtccaatccaatactttggtaaaagttaattagttattttctttcattgtaatccacattaaaatttcatgggatgcactgtactctgtcttcagggcatctgcaatattaattcagttttataaaacagcctatgcttatgtaataagtaactggtatgatgcattttctgtggaaccatggaaagtaataagtaatgtacaagggccgaatccaccatggggtctacgggggtctcaaccccaactactaggcttcgagccccactacttgccgtgtaacccggggagccccccactaatttttttttgtcatacattcaataaaaaaaggggctatagttttgtatagtttggttagcctctccttttatccggtccttggatccgccctggttatgtaagcttttgcatattcacatattttcatggctttttcttgcagtggtaattttgcaaaactactgaaaaccgctctgttttttttcctattgggtccaaaacatgtgttgaattatattctttttcctttttatacaaaaagaaagggatagcttttc

SEQ ID NO: 105440 - DNA, 3075 bp, Oryza sativa
  unsure (1)..(3075): unsure at all n locations
taagctcattttaccgtttttcgctgtccgagtggatcgcaagttgtattgcgtgggttgcgtcccctgaggcgcgtcgggaagctgtgacatgtctatctcctcggcgtctggtacgacgtagtcctcatcctcctcgtcctcatcgtcatcgtcgtcgctaggtggagccggcgccttcccctttcccctcccttgcttaatgcgtgacgacgacaagccaccaactccttcacgctcttctatcctgatagagtgtcgagcagtacttggacgcccggattgaggtagtggtggtggtagtctccccggttggtacacgtcgtccaatctaaccgacctgcaacctaatcttgctgcaagtttctggcacctttgacgaactttctgcatttcaaaaaaaaaagaagtttgttaggcataactcaagtaatgcaaagtgctaaataaattttacctttaaaacattgcggagcgtgttctccgtgtcctcaccacccctcggagcttggagggcatgccccatttccattcacactcctgaggagctctctctactgaaagcgtgaaaagatatacgttagggtctagggtgcaaatggaagtaactttgacaaatgcaagtgtggctggcgccgccacggtggcacgggcacggcgccagtgtggctggcnccgncatgtgggggtacggcgccaggcactctggctcccgaaaaaggactaagtcgggtttaagggggggcacgggtctatttgtgaaataaggtttgaaaaaggaccgcactctaaaagattgagctccttccgtcccataaaaaccaacctactaccgaatatatgaatctaaacatacatatgttagattcatagtactcatccagttttagattcgctttttatataacatagggagtaggaaatgaatacaatgatatacaatgaaaaacatttagaaaatgaaaatccatgaaaggcatacctgaaaattctctaaatttatgagaaaaataataacgatataggcaaggaatacattcatatttgctctgttcagaagctggatactgcagctggactgcagcagcttgaacagtgtttctattattgatttacagagcaacggctgcagctgtgatgcagcgttgccgaacacaaccattaaatctcaatttcaaactcaactttgccgaacacaaccattaaatctcaatttcaaactcaactttatttgataggacaaaaatataaaattaacactattcacccaaattttatattttgtttacttccaaataaaatttagtttaaagtttagagtaagaatgtattttcgtgccaacatctatatttaacattttcttttaatttataaaacttttagaaccggttttcattggttttccttttatcacatatgtccctaagtatctatacttatctatgtactatttaggtgtccgtgttttacagtaagaatttagccacctttttacataatttagctctagcctctgtttgaattattacctaaatctaaatactagatattatataacatcaattctttaaactagacaaatcatcccccttactaaatccggtgcgttttgatcttacatgccagttcaatcaaccaaaaaacaataggccccacctgtaagtgattcccctcccctctcttcctccgtcgtcgctcttcgcctcctgctgcatcccagctcgcccagcgctgccgcctctaagaccgagtttccaaatctacgttcatctgtgccattacaggcaaatttgggaggggagagacaagtgctcgcacccagcatgcaacgacggcgaggagggctcactcgcctccactcctcttcaatcttccccttttccaccagattgatttcggcaggcgaaacaagttttagtaagacgagtcagccgccgccacttatcttcccctcttccatcagatcaaactcgagagacagtagagactccgacgaggtgacttatgcatgagacaggaaggtaggctcaaggtgctcaccaagtgtggctacttccacggttccaggagaccgagctcgagctcaagcaactacactatgctcatgaaagcaacgatggtatctagaagacggcgatggcggtgaatctggagctcgaacttaagcttcacatcatcgtgctcactcctcttgctagtttcctcaacatccgtcatgctgcctgagggactgcttggttatcgcccgctaccaaacgttgtccgtccgactccctttgctccatttcgtgcttgcggctgaggcccccctcgatgtcgtcttcgttgcgatgttgcctactagggtcaagctggggaggggataaatataagaaaagcactggcgatcgggtcccacggattttttttctaactagactgtcacgtgtgtgccacctagaaccaaaaccgatttagattgagtgaaggggataatttatctgggctgaagagtttaggatttaaaatttctggttttgtagcttaggagggtgatccggtcaaacataatagtttaaagggtaattctaactttttccttattagattcgcataaaaagatacttttgtatacttataattttattatgttacataattgatatattagaaaaacaaacgtcaattaattaacgttttaggtaacagaactaaatatgtccaatattttgaaatggagtgaaatagaggaagtagtattattcgaccccgaaatttagctcaggaaaaccgtggagcgaacacgtggcaactggcaacaaaataatcaccaatcaccacacgcgaatgggagctagatttcgttaggaaaaatctcaacccacccaccccccaacgaaatctcccatcgaaaccccgtcgaccgcaggccgcaacccgcgacgcggacggcctggaaacgtcgcgccaccagcccacccaaggtcgcgtgatttcaccgcacgcccatcagggccaccacccgacacaattactaacgccgacctgcttccacaccccccgtgctctccaagaagagacgcgacgcgaacgca

SEQ ID NO: 105441 - DNA, 1232 bp, Oryza sativa
ctatatggtcctcttgctgctccgatttaatattccctattgctaaaaagggaaggcgaaacttaacacaattggccctttttcactctctctatatgccataatccttaactccttctacgtcctatcaacctacttttttttaatccatcacccctttttgcccaaaaaaaaattggggttccaaagtttaaaaaagttttttacaattggttctaaaagtaaatcgaatgattgaaaataattggccaaatattttacttttttctttgaatttctaaggtttttttctaattttttagacatggtgattattattattggttgacatgtaaaggatatgggctatgttcaactgatgtagtttaattttttataaagacaaatatggttaatcttgaattatttgtttcattataaataaaacaatagttaaaaattaaagtcatatataacttttacaattataatcatttagctatctaattattgattgttttatattatgttgttgttttggaaatagaaaaattagagaggaggaaattggataggagaggagatatgtgcatctacgtatgacaaggggagaggatgatagtttttgttctttcatagagatccaattaattggttcattggtccgagttatctatatttaaacataaatataatattagcaaacaaaataatgtatttcttttactacttattattttaatcttattatttaattctttgtgtttcatattattctaatataagctacgtgttgttaataaggtgtttaaatatatatatatgatattcccttaaaaatgtgtctcaagtgaccaatagctagtccaaagtaatatttttgtacttgttaaatatagttaatttgagccttcaatatacgacaaaatctaatgtacatatgcggataaaaaataattataagattcagatcagatagttatgtttgtgtctaatacatcatagagagagggaaccgaatgggtggagggacaaatatatacatgtaagtacgtacgtatgtacatatggaagggagggacttggctcacgggggcctttcaatttttttaataacaaaaataaatctaattggtccaccatgtttaaaggaaaatcaatggttgtgatatggacttgaattatttgttttcgttttccatctaatctaaatgagaaaaaaaagaaaaagaagtatggtaggatcatatgta

SEQ ID NO: 105442 - DNA, 601 bp, Oryza sativa
acacctaattcatcaaataaaatactccattcagcccagtaaacaaatcgatttttaaaacaccattagtaataaataaataaatcaaattttaaaacaccaaatcttagcgtggatgcgtgattaacactgaggatgtcggagtaaatgcaacgacgacgacgacgaccacgcagttcttctcagacaccgcgcgaccccgccggtcgcgccagccaccgccacctatctacagtttcccgctgttcctccccccacatcggccgcccgccgccgccgccgccgcgtgccttgcctgtgtgactagtctcgcgcgcggtgacgcgccgccgggagagagagggaaaaaaaagaagaggaagaagaaagaaacagccgttactaccgcgcattcgggggcggctgctctctccctctcctctcacgttttccaccccccaccgcctcgcgggctcgccctcgcgtcactccttggcgcggcctcctccgcggctgctgccttccggagtgttccgctgctggcgttaccactcgcggtggacgacaaaagggagggggggtggtggtggagcggagcgggggtggagcgaaccctaaatct

SEQ ID NO: 105443 - DNA, 755 bp, Oryza sativa
tgactgctgtaccttaggaggcggcgtcttcatggcgctgagaaagaccttgcagctcaagaggtcgtgattctttgtcttgtgaatagaacaatagacatcacgagttggagaggtacgctgaatttcacgctctttgcaggcacgaatttcagcatggacgttgagaaagactcagcaggcttgcaggaagtgtttcctggttttgtggataggacaccaggaccttgtcacctcggaagtaatcctcgtcggctcgtgattcctattggaaaaacaaggcttggccgcactaggatccttctcgggctcggatgtcgtcgacgttccgatctccgcttcggcgggaggatccttcgacatggagtcgccccgggttgtagccactgcgttctcgtttccggctattggcggaccagctaagatcggcactgtggtgtaaaccggaaagacaatttcgccgacttgagtccacaccagtgttgttgaagtaggaactccttagttgaggttggtgttgacgctgttgtcgacgaagctggatgtcatagtagtagaaccttgagcaccaagtgcccctacctagcgcgccactgtcgatgggggatacccgtaaaccggatatagagggtattggggtacgctggtacgaggatctacatagtacgacatcaagcaaacaggaaacatggattatactggttcaggccccttggtacgtaatagccctaatccagttgatatgggattatatg

SEQ ID NO: 105444 - DNA, 675 bp, Oryza sativa
aaagaaattatttaatttaatttagttggggtagggttaatggccagtcatgatcactttggtaatcacttttagctgcctcaggtccgatggctttttgtcacaaatatgaacacatgttgtgcagagtactgaaaagaggtctttaaaagcttctttttttcaatttttatgaaagatatatatgacttcctaattaattaattaattaatacgtcataattaattaatacgtcatcagtttaagtgaaaatcgatggaaaaatattttttattaaaaatagtatactttttagtacatatttgaccgtacgtcttataaaaaaactttcatgaaatatgtaaaattatatgtatacatataagtatatttaacaatgaatcaaatgataggaaaagaattaataattacttaaatattttgaataagacaaacggtcaaacatatttaaaaaaatcaacggcgtcaaatatttagaaacggagggagtataaattagttaatatagatcataaattgataattaatggtataaaatgtagttgtgtaacctttattttaaaccgtgtgtttttaaaaataatggttctaaataaaattatgttatattgttaatataatgggtaaaataataaatcccaaaaaaattttatttccaaagattatggatctaa

SEQ ID NO: 105445 - DNA, 703 bp, Oryza sativa
ccaaatggtagccaacgttctaatcgttaaaaagtccgggtccggaaaatggcactggaggctgaaagcaatggaccattaaagatttgcaaatagcggactccacctagcctattattgaggatttatttatttgtagggaaacatatggataattcagaggattccaatcttataggaaaaattgtaaggaaaatcattgaaacctttttttaaaagaaaaattctatgaaatggataattctataaagattttgaagaaaagttagcaagtgttacaatctcctaaaattttttttgtttgaatctattgctatcatctaattcctgaggttttttccccaatggtctatttaaacaaccagtgttttatactcatctgttttacaattgtattatgtaaaaattttatatttttatatttctcctttttttaataatgggtttcaaatgagccttaatcgtactccctccctcgacctatttcattctttggtttttttccaaaagtctaagtcttatttgtagttatcatgtactaaactaaattgttgatcggaatctaagaagtcatcttagtacttattggttacatgtccattgattttatcacatggtgaataaattaattgctccttagtcttggtgcagtaagaaatactccctccttcccaaattgatcatcatataatgaaaattaaat

SEQ ID NO: 105446 - DNA, 592 bp, Oryza sativa
gctctctgatgcaaagatggacatgtttatgagtagattttgggatttctccctgatgtgcaatcatgccaaagatgtctaaattgaatcctaatcatttaagattgatcgtaaatattaattagtttctcccattacaaagctcgggcacatttgctagttccagtctaatttatctttctttactcttctaaaaagaggagttgaggtgattggtgtgttctcacccccacattataagatctttagtggttgcatatacgtggtaacaggatatttatacgttctttgcattttttttatgtgaaaaaaaggcattccatggacgtatgcgctaattggttttatgtaaccatgtaaacaatcttgaggtccgaggtatttttttttgtatgtgtgtaatcttatgtggccactgcacatgccattttctgcaactagttgaggaatcctatacttattgttaatttatgttgctgcacttttgcagtttgatgttacgttcccagctcttccttgttcacttgttgctgttgatacaatggatgtcagtggagagcagcactatgatatagtatgtacgacagttttc

SEQ ID NO: 105447 - DNA, 1002 bp, Oryza sativa
ggcccgtgtaggcttgcaccgcctccgcgatcccttgcgccgccatttagggcttggggcgagagagggaggagggagcaagaagagactagagcctgcctgagttcggagtaaggagggtaggtaggtaggtcgcccacgcgatgaacacgtcggctttagcggaaagggccggggaagaaaaggtgggcgcggcggccaacacggcagagtagcagacgggctccgcgtgcggagaagagtggctcgccccggggcgtgtgcgtgcgggcgagtcgacaccgaccaccaccaccacagtaccacaccactcggtcgcgggcgtttattgggccagcaaacacggtattgggcttggtgcgtgccaccgagttgtgggcttgtgatctgtaggccttggcgtggctgtgggtttcggccttttcgggtcgcccgaaggccggagtggagcggatcggatcgtgatggaagagcacggcccctttggtgaggagagccaatgacatcgtcgtcgttgcggtttgttagtgtttggggttctggccggcgccctcgccttaggaaattctggtgagcttcattcttcgccgtcgatcaatccgaggagggaattctggtgagcttcattcttcttcggtatgttgtgtgattttggatttgcccttctgttgctgtgttttgatttgagatttgatgtgttctctcattcatatttcgttcaatactctacttttctctctttttttgagatggttaaatattgtgcctatgttctactttgctctctttttttgagatggttaaatattgtacctatgttgtgtaccgcagtaccggatagagcttttggtttttctacgatgtattctgctatgcctgttcatctttctttaattctttacaacaaggtttactatttcggcacgaggttaaccatgtggtcatagtgttgtaaatcattaggttctgcctgaacataagaaacaagttaatatcgtcagt

SEQ ID NO: 105448 - DNA, 599 bp, Oryza sativa
ttaaaaaataaaatttatttttaaattttataataattactcaattaggcatgctatatgttaatggttcaccttatatggtgtgccgccttaaatcccaacccatcctccgctccgagtcaactgaagtttgtttgttgaccaacttcatggcggtttctgtttatttgacccatattttatccatgtggaagaatcatcaattttgacattacgtaattctttgggccctgagtccctcgtggtttatctgaaattttctggtcgatctgttccaatcactgaaagattaaccatgatatctaatctactttgccttcatatttcaaggaagggaataaacactactacaaaataggttttttctggcattacatcttttttctccaatggataaaatttgaaacgcttgtaaaaaataaccgaaggcttatggttaatgaccgcttatgaaaatctattatcactagcacttgtttttaaaacaaccgtcggtaaaaatagccctaatttcattagtggcctttttggacaactgtttctgaaaataaatttcgcaaatgttctcctgcatagccacttggaaaagaaatactttg

SEQ ID NO: 105449 - DNA, 784 bp, Oryza sativa
caataatttgacatcttcagaaacttaatcttgattacaaggaaaaacttacacttgactaccatcaagcaaactgcaaacagcatgctcttttggcaacaaatgaaccactgatcaatgcttaacttgactattgagttccaatgcgctgtggagatgtattatagttgtttgtcagacattttaaatttaatgaaaagggtatcagacgatttgcctactgctttaatgttcaggcattcagggctcacttcataatattaatccgttaaacgagtgtttcagtgacacaagtaggattggtatttggctattagagaaatggtcaaataaattcctcaaaatgatgtcataaacctgactggggtaagcagagacagatgccacttacttagaaggaaaaaaaaaaactgggccataacttatggagtaaaaaccaaagcaggctacagtacagattggtacgcaagctagtgaaaaatttaattaacaatcatgcttgcactattgtacagctcaatagccccatttcgtatttgcgccaagctcttatttgtggtgtgcctcatttccagtagtaataattagtaaaggaccctaatcacatgaatccagcaattccatctacacgaattacttctgcaaacgctcgctcaagttcggtttaaagagacagggaggtgttcgaatcaatgatctcccagcgtactagaccatgataaactagtgatgccgcaatctgccaatccatgagatcaagaagcacacacgagtactacactgc

SEQ ID NO: 105450 - DNA, 654 bp, Oryza sativa
cctatagttattaaccagaggaaaagagagaaattttcctttgtgcaagatgcaacagaggacaagacggaacaccatttgattggacagaactgtatcgtccgtgcatcgccagacgtcctctcataaccacttcagagcgaggccaatcacgcagagacaacgaaataaaacaaaaggctagggggtgtttagatgggactaaaactttttagcccatgtcacataggatgtttggacgctaattaagagtattaaatatagactaataaaaaaactaattttataaatgagagctaatccgtgagacgaattttttaagcctaattaatctataattatcaaaagtttactgtagcatcacattgtcaaaatcatgtcgtaattagacctaaaaaaatcgtctcgagaattagtccaagcttatggaatgagttttgtaattagtggatgtttaatactctaaattagtgtccaaacatccgatgtgacaggggcttggaataaatccctgtaaaccaaacagcgagcgtacgggggtgtttcagttgaaggcaggcagttatagtttctgaatgcttgatctgctagcacacctaccatctgttgccatttctttttctcaagcttgcatcatcatgctagaaaaagaat

SEQ ID NO: 105451 - DNA, 625 bp, Oryza sativa
atgttatcaatatataataggctgcttgggctcatatgttcacacttttggctagcagctacaaggttgcttctatcactttgtccgctgggataatatcacgagtaaagcagcaccatcaatgcccagtacaagcctacaaggtaattttatcgtcaatacaagtgtcagaaaccatataatgctcaccaatttgtggtttatccttttagacaaactgacgttttggtttcttaccgcataaatggagcagaccaatgtcctctgcaaattttattcacaatctgcctattctatataattctatatcactgttcattcattcttcttactgcacaataatcattttgtacaaataaatatgtagtagctttttgatgttcctgcaatatttgaatagatgagtgtaaaggaatatgtttattctttgcagcaggcagctaaccactgttacatcttgattagtaaaaaaatattgctttatttgcatttcgcattttttgaaacccctatgagccatttattaggtttttgggcagcacatgcttttcatgttagatttcagagcaaaatagatggaatgctacaggttggaaaataaatatcaatgccctcagctaaggtc

SEQ ID NO: 105452 - DNA, 1004 bp, Oryza sativa
  unsure (1)..(1004): unsure at all n locations
agtccaagatgctctctcagcaaagacaagccctataggtgtataaaactatgttctactatacatgactgtgctggggaggagtgggtttgagctgtccattagtgtagcttagttaaattaattagtgaggtattgaccattnacatcgggcgacggaagagtgtccatgcatgtcttgggcatggttttggatggactaaatgaaaagatggtgcttgtgtcccttgaataggggaccctgccccaaaactggcctcagaaagagcaattaggtgtctccatctgcagcagtgtatcataattatcattattgcttgttttttttgtaaatctacccttcccaaacataacatgttcacaatcatagtcaacaaaggtagataatttgccttgttaattgtttgatgttctaaaataggacaaagcaagggtgtgtatgtgcaaattaatagcattagtcctcagtatagactgaggtggaattatttggttatttggactttgcacgtgggagtcagggggaacaacggaattaaacctctaattccaacttgctccaaatcccaatctctccattcttcttctattccctgcgatgctcccttactttatctcaccattctttactgatttatatatctgatctttggtgcatagtactattggcattggttactttacttctcccaattagggatctactgctatatagctagatagctagctaggcaaatttgaaacaagttactgacttttgtatgctctctctgatcttgaaaattttgacaggctaggcagttcgtcattgtcaacccaaaaaatcttgcaatccaaattgtatttcatcagtagatagtgactggttaattgtgtgttttgatcaaattttgtttgaaatcatattaatattattccagaaataccttcaaaagttctgcctcccacatcaaatcctcgctttccaatttttgagaatattgcatttgaaattcgtgatagat

SEQ ID NO: 105453 - DNA, 602 bp, Oryza sativa
tctccgtatctccttaagtaccatatatatatgatatatcctcttacaaaatatgtatcgtgcatgcgtgacacaaaacaaatcatataacacaagctagcttagtaatattgtgccaaaaaatattaaaaatctgtaaggtatcaatagcaatctggccaccaaatatttccggattcaacaaaattgcacaagatagactcctgtaactgacagaaaagggtggctagtaaagggtagcagctaagatgtcaatttcctagtacgacattggccaacacatataacttccaggcaaatgagcatgcacatgcgcatatttagcttaattatattaaaaaaaacctatattaaataacactaaataaattaataatcagcctgtcaccacgaaccacaccaagtctagtttgcactcctttatatgtttaattatgtgctaattaattagctctgattgagaatacaatactaccaaatggccaatctccccaaaataatgtctaacggttctaccagagtcgctctaacggttccaaacggcaaactcgtgagatttggcttgaagccataaactgttgaagattttcaccaatctgggt

SEQ ID NO: 105454 - DNA, 751 bp, Oryza sativa
catgatttatattttatatgcaaaatgtttttaataagaggaattgttaaacatgtgtcaaaaatcaacggtgttatttgttaaaaaaaacagacggagtagtatgcttatagcttagttgtttctttaagcacctatttaaagcgtctagcatttgaatactcgtgcctgtattgtggcacactggacgccgagctggcatgagtactgaagatgatcagtaaacacccgtacgcagatgtttacagaagtatcctgtgaagttacatggcaaacatgtgcaataaacttgtaacaaaaaacttttagctgcatgcctgctcctcctgagttgtaaaactatatctaagctgacagtttaattttatgattttaattgatgacatgacggccagagcccaaatttgaccactcaaatctcagtaataaagctatatatatctgaatatcaggacagaaacacccaatacatatgaaattgtttagatgtgtacatccctattgctgtagaggcctggttttaaatcaaatattaaaaaaaagaacatatgaaattattgatactcatatgtaccactattagccgtacgtaattttttttaacggaagacacaacgtgtccattcattgaatatagaagcagtgttatttacaggtaaaacaaaacaaggagatatttacagacaaagcagccttctatggcaacatctcatctaggcgtttggctcccgctagtgcccaagatcttgac

SEQ ID NO: 105455 - DNA, 513 bp, Oryza sativa
cagggtcacacatcctctgcacttgtatttgcatgcatccaactgctcctagaatatacggaggacatgaagtcatcaagtgaaggaccaaatatattttcatggaacatgttgccattttaagggattaaaaatgtacagtaaccacacaaagtggtgcgaagttcatgcagccactgcatgagacaaaacaagaatatatgagcccaccgttgcagcagcaggcaagaggaggtttcgttgtcagggcagcctatgtatcttctcacattctcaatcatgcaactgccctaaaaccccaacaataatcttcatggatgttcaacatgtcatgtcattcagtgtgaagcttgtcgcggatttttttttttttttagtttcaagatattgcatcttgaagcgtcgatttggatgattgttggagcaggatggtagtgtgaaccctctgttgataccggattatgattctctaccataacttctttccttacgtgatcacttatatgtgaacct

SEQ ID NO: 105456 - DNA, 1146 bp, Oryza sativa
tgaaattgaccatgccaaaagtaactgaatcagactctgaaatgaagaaactatatgatcccctataccaaacataactggctattactgactgtaagtatggaccatgttcactaacattcaactttgggaatgaaagttattgttttttttcagatgtggatgtatatgcaagcaaaggattaagacatgaaaacaaaaaaaaaaaaagaaaggaaggaaggaaagacaaaagcccagacagatatcctgctcacttcaccaatgaataaataaataaataataaaaagataaattgaagttacacttcaccaaatatgcaatataggaaaggggccttagcagaaaattttagtaagtgttccatgagtcatatgtatcatgactattcatgttacaagttataacagccttgtaaatatgctaactagaacagtatcacctaccaattttataaacagaaaaacattgagcagcaatgggaactaggaaaagttagatcaaactggtctgactgaatgggagtatctctgccaacacagtcataaactacaaatatcaaatcagtgaagagtttaatccttcataatgatgaagttctcatgctcccatgttctttttagataaaatggttatctaaaattgagttttgcaatacttttgcacattgcaaaaggactggttaacaaacctatcagattttagattaaaattaggagacgcaggcaggataggccattgtcaatattaagatattagtttaaaaggcaccaaattatgtgttcacatcatgttcccggaagaggcaatgatgatgcacaatatatattcccctatcattcttcaatatctagttgaatagttgatgtaagaagttatgagattaaattaagtatttccatctccttttggcatagtataaaaaaccggtccggactggcggttgaaccggagaaaaccggaaccaggcctctcaccggtttggttcaatagaaagaccgctcgtgcatttgacccggtaagaaccgggtgaaccggccggtttttgttgaaaaccggtgaaccgggctcataagaaccggcggttcattgcaagttgggctggacttgtaaggcccatcatcgcccatttacattttatgcaa

SEQ ID NO: 105457 - DNA, 585 bp, Oryza sativa
agggaattggggaggcattaataggagcatttcagcaaatctagcaatccaaatatacagcctactgcctacagcttaattagatatataaaacaggggaacccttatatgatgccaaagctccagaagaatgcgcactacagtaagccacataattgggggcacttagtacgatcaataagctggccagtactagttagtgactacataactgaaagatagaagagagatgtacaagacaatagaaaagcatcaaagcccaccatacctgagcatcatacattacgattgctgcgaacaccactgacataccaaaaatggagtctgcaaagcccctgcatactaaacacaataatcaagaaagacgtaaaaccacagaatctagggactaaacaagaatagaaatttaatgacctgttcactttaatgccattttcaactttaccaaattttggtaaaattgccaaaaagtggctacatttagtttgctgccaaattttggtaactatataagaaatcgtaccaaaattttggcaagttgccaaaatttttggcaactatgccacaattttagcattgcaaaaa

SEQ ID NO: 105458 - DNA, 1949 bp, Oryza sativa
tagcaactaggtaataagcctctttgtttgaccatggaatctcaactatttcaggatgcacgacttgatggtcaatagtcaggaatcgcaagtcagggtttcatgggccctgtgtatagtagtcctttcactgtcataactttttcaaccaattttgccttcttgtttatgcaattgttaactatcgacattgttattacaatgtcaccccaaaactccacacattaggtgccatgcatcccctcaactattttcctttaattgaatccatatttcgttgaactacatatatgaatgtataataactgcttatacatcttatttgattatatatatgacgtttacaacaagatttgatcgaatttttgaaacttcaaccactaattttatattaaaatatgtttaaaaaatcgggcgagttattatgattttactagttttctaagtaaacctgtacaccactgctctggagtggctgccgaggcactcgtcagcacgaggttagggcagccgaggaacagctataaacaatcaaaacttaaagtatcaattactatcaaattggttcttagtacgacgaagatcattccataattatttagatgatgaccggttttaaatttctcaaagataaattttgttaaaggacatcgtgacttcacagttttacctgtaggacccctatatcgtatgacattaggacccaaggacataaacaccacatttttagtgaattaggagtatggtttagcttagctattttatcctttggaacaaaagaatatattttaaaggaaatactctctccgcttccgcttcatattattataagtcgtttgacttttttcttcgttaaatttctttaagtttgaccagattaatagaaaaaatatactaacattttcaataaaaaaatactatcaaaatatattcaatattagatttaataaaactaatttggtattgtagatgttgctaattttttctataagctttatcaaacttaaagaagggagtataatatggaatgaagggagtataaaaaatcatgagaaaaatggctacatgaattattttacaactaaaaagtatagaaaattcaaatatacataactaattcattttaacaccaaatgaggtgaaccaagttttgttaggtttattgtaatattttatttaataccatattgacaaaacgtgtatcactattatgaaaaatgtcaccaactcattaggggaatatcagggtttacaatttcgaaatgggcatttctaccgtggggtccagaatctcaaaagtttcaaatgaacttattattaaatttgaagaaattgtgattgaatttgactaaattttttaaaagattgaaaattccacccagcataatttttttcgtgggatgggggtttgaaattccaaaaatttcaaaaattttgaactgaaatttgaaacaatagggagtatataaattctgtacctagacttttaccagcaatatctgtagcattctaccttcagtaattgtaattcgtttcctgaattcatctcaaatcaatgtctacacactttataagccctcgtgaatgttagagcatttgaatttaatttggtatccattttctaccaggtttaatttttaaaaaacgttgagctcgaccattgacgtgagcaaaaagtcaggtatataaggaaccaccagaaaaaagcaaaatccttttcttttataaatttcatctgatagtgtgaaatgtttgtttaaatttgggttggtacaattatcatatttgttgcattacttaccttgaatatttatatcctttaattgttgttgctaaacttataatgagttgtgttctggttcagtgctagcatggatacattcaagctactaatatttctacttgctttgccaaataataacaaataaaatttgtggatcactcatttt

SEQ ID NO: 105459 - DNA, 1100 bp, Oryza sativa
tgtaaagatacattctttttggacggaggtagtatatatcagtatctgaaatgatatattacattgatttgggggcccaaagtccgtataaaggtacgtgtacagtattcttctttaatttgctaccttataccacaccaactatgtatttacactggctggcgctatcacagtataaccctgtttattttagatcattgagcgaattattccgtggactataggataaactatttaagaaataaacataataaataacttaacaagtgatacaaataatgtaatagaagaaatgtattttaaagcatggaacaaataatctatttcaataatcggataaataatctgaaaagaacttgcatgtgatttctaagtgcttaaaacaatgagctcaaacggccgggtactttagggacttttggacaaatatctaactagatgggctaatctttgatgattcttgaacatttaatgatttactaatatttaacaacaacataaatataaaaaaaatccatgccaatgccaagtgctctacatggtcacaaattccatgacattaatttgtgcgcgtgcagctagtgagaatcgaactcagaaatctctggacggtcatatatatggcgagaaccccgatttgaagagaaaaaaaaaatcaggatccctactactgcatgtatgcaagatgagtactaactaatcttttttctcatcagtttaaatatttttctcctaaattatttatccgatttacgatccaatcgtaccattgaatttgttgcaattaaatctttacaattaaacattatatgattatattttgataaaagaaaaatatatgtttcagaccgttaaaacttaatgtttcctatatgatagcgacatatttcaaagtgtgcattcatagtgtttcgtaaaatttatttaactacttgccctaactctctctctcctagcaacttcaaaataattttttctcctaaattacttatctaatctataattcgataacactattgtattcattatattaaatctcacaataagatattgcataatcatgttctaatgaaaaaaaagtttttcaatccgttaatact

SEQ ID NO: 105460 - DNA, 590 bp, Oryza sativa
catggaactagtgcattaggttaggctacgaggtgcagtggcacagtgcacacataatgactagtttatctaccaatgcagttcactcacctatgcaggttatctaccaattgactccttttaccggaaggtcggtatactaacgcattagccaaggttcttttatcccacattaggtggtttagcaaccataggcttagttatagagatgttttaacacaatatgcaatagaggaggtccctgtggtactctttttctttttttctttttttttccatgtggttatgtttttggccaagtgcaagatggtgcaaaagtcagacgctttcatttgcttaatgaaatcaccattatctttaaaatggtggttggtttactactttaatgttgctctagtgattttgatcagattgctatttgaataaaagccaatttttttgtcaatgcacaacagcttctattttctatttcccataatactcagtagttagtactacctacagtgcctcagcataggtataattattctagactagccatgtgccattttcaatgcatttgaacaaacatttaatttttctatgccctt

SEQ ID NO: 105461 - DNA, 681 bp, Oryza sativa
cataaaaaacggcatctttttctctgaatcagctgatggtgtatttgaacaaatgttcattcctagcttacatttgccatcagaactgtcatccagactggccttttctggagctacactgtcttttggcaattctcattgtcagaggtcttttcacaattcaaatgatttataagagcaccattttcacttttctctatgtcaccaaggcttgaatttccattcataacagttgaattggtagtctcagcttgtggtgcagaactctgcttattagatgcccaaatagtatccggatataatttcaagaaatagcacttaggtgagcatttggggcatatgaaatcctcgtagagtggctccccttcctcatctcgtggtatctgcaaggtaaaaaaaaaaagcaattatgaaattacgatgtgcaataaagtacataagtaaattgaagatgccacatgtataccatggacaaaagttggtttgactaaacgaaaagaatgaggctacaacaagtaggtatcaaattcacagcaaaatgtgctacatcaatatatatgcttcgatggccaggaaaaaatgctaggtttgaagtatcataattatcacatgggcaattgtcttctgaagaacaaaatttatatgaacaatacttgaaggcattgatcatgcaatgcattt

SEQ ID NO: 105462 - DNA, 555 bp, Oryza sativa
tgaaataagaatcatatcagaagtactaccaatctatttctccatcatgacttatggtcaatacgttgattcaagcaattatttttttcaccaccattaatttgcatatgcacgagttatttggttcatcacaaatacaagccttacccaaaaaaaaatgtaaactatatattaaggcttggtttgttgtcaaaaattaaacttttgaagaagatcttagttgggtttggttaccaaaattttgttgttgccaattttttgggtgaataaccaacatgatccttaaactttcgcttaaggattaatttagtccctgacatttcgtattatcgaaacaagtaccttaagttcattgtgattcaatatgctcctttgaccctctaaacatgttatgcgtacatgccacatcatctatgcatgcaaatttaatatttaaatgtacattccacccttacgttttcatagaaaataaagaaaaactattgaggaaaaaaatattttggccattggcaaaaagatgtagcattggtaactaaaaaaattggcattttcctt

SEQ ID NO: 105463 - DNA, 995 bp, Oryza sativa
catgcattttcaatcaccaatgtctgccgcacatatcaggccttttctgttagtgctgccgctgcttattctcacctcttccattttattattattattccattttgctcctactatactagttcgtactctcaaatgcagttatctcaattttatttactcctacatattacgaaatatactgcttaaaagacaatcaacttttcttcaggtaaaccttgaacgaggaggataaggagttcctgttttatattaaagagattaaaggagttgatatattttttagaaaccagactccaaaaccttcgaaatgcacggtcaattaaaacaaaaccagcaatcaactttggtcccgtcagatatataaacaaaacttttctttttcgttttgccaaaatttaaatggaatcgatggattatttgtttgtgtggggacagagacaactactagtatgcatatagattatagagatatatatacatatgcacagcaccaaaaggcaacagtagtacgtatgacaacaattttaggccacaattaacggaacatataccgcacccccaaaaattaacaacctgctgcaaataattaatgatcccaagcacacaccgatttaattagctgtataaacaaccagatccaaaacctgataaagttacagcttttgatctgtgattttgccatcccatcacaagtatgtacaaaacagaaacagaaatggagcacaccacatggcaaagtggacaacaacaacaacaagataaagaaaaagagaagattataaaacaaaaaaagaaacaagaaaaaagaaagctaatctgtcaagcaacaccacacacactagatcaaagatctgctagctctatagactatagagtatagtattaagtgtttgatatgatatgatatgatcctacatcacctcagctaattaaacaaagctgttgttgtttgccttctaacagggtcactgactgactgcttcatcttccct

SEQ ID NO: 105464 - DNA, 1365 bp, Oryza sativa
catgataatgataacatgatttgtgaaattaggaaagaaaactaaacacttgttttagaccggggcggacggtggatttggtggtatccgggaaaggctagtaccgtccccggtcaattaaggaccgagccatgaagttaagtacgaaacgaccccgtacaaccacacttctcgaatggggatagacctagcggagtaaatagccgagcggaggcagtatccatgcatagtggtttctcatgtgtaaggcaggggctctacaatggtgtcgctattgttaggactgccatgtgatgagttgaacctaattataacttaatacgtgggtgtgaatttttccttcccgggtgcgccagaactcctctcactgctagaaactgtgtacgcatagagtgcatgaggatgcaaagttcatggagcgggtactgccaatgcgaggctatcgaaaagctttgccgtgacgtgtctcatgtgttgagacaaggctcatgtgttgggcagtcacggagtgtgggtaaagtgtacatccactgcagtgtgagtaaaccaaatctattcgaatagtcgtgctcgcggttattgagcaccgggacatgtattacacttggctagactctaaattcttaacttgtgtgggatgggttattgcataatgaatttttatgctgttggagccacttcctgtaagggggaaggtgggcatcctcagaaaatcataacgactcaatggcgggaagctatccttgggatcacaatggatggtggacagaaccgtcgttgtttaaaaacaaacactgctactaaaatttgatcagtcaatgctaggtcttagcttgtgaaaagaattacaaaatttgctttgcgcaaaagaaccatagccatcctttgaaatacccctatcatatgcattgttgatgtggtggcttgctgagtatggttggtactcacccttgcaaatataaacttaatcagaggcgggagatgaagcttcggaggatccctatgcctactaccaggagggagatgaagacgatggcgctcagtaggtcttagtacggtcgttgcgtgtggcaatggcatgccgctgccttaattccgctgccttatctatttctgcttttggatgtattccggaccgctcggtccgatgatttaagacaactaggaaggtagcccgtgcattcgcgcgggcatgcatcataggatgcattgcttatataaatttttatcctatttgtgaactttatgccatataatatttaattgtcctttaagaaattttctataatcttcttcatcatctaaaataagacaaatttagtatatttagaaaacatatctacaatttaaatgcaatttaaaagg

SEQ ID NO: 105465 - DNA, 1080 bp, Oryza sativa
cttgcttgtgtttgcaataatatgcgaagaaattcataatactatggcatacgatagagaaaaaaatcattaatctaagcacttaattaaaaaattgatgcgatgcaagaaaaatcattaatatctaagacaaaagaatgaagcaaaataagttataagattgcaccaattagttcaattcatgtagatcaaattggcatttatttttctattttatgttttgttttatacaagtcaacacgaatgcgcggccatgcatcgtaggttggatttgagaagcttataaggatagaatatcaccggagaaaatttacgacactttaaaagtatgatatattcacaattttttttgttagtattgcttatatattttaacctattagttacctttataccatatcatattcaaacaatttctataagcaattatttataatcttcttcatcatctaaatagaaggtagacttattttatttagaaaacatgcctaccaaattaaatgtaaagtaagcaaggtgcttttttgtcttttaattggattactgatgttagctaggtcgcccattgtttattgagtattgggtacaacatgaggctacactacattcatgggtttgtaatatgattgcatagtttgagagataatccatctgtgaacatttcatttagagtgtgtgcgagactccacatagcctattatgaatacgattagatggttaaatataattgtgtaataattattttttgaatgcgatgtatcataaatacatggttgtataatatatgtaggaggaggacccgtaagatataatatgacataatagtaaagcgaatagccaacatggtcttgaattgttgatttgattaaaaaaaaactaaagctgctcaagtgtatcttaaattaaacgtatagatcgtctaaaaataattgtttatttacagcccaagatcactcctattgtaaatccctagcgcttgcacgttcacacctaaatcagtctccgtgagaaatagatctaataatttatgatgataaattatggtacatgtatatcgtgtatttagaaaaaaaaatcagg

SEQ ID NO: 105466 - DNA, 817 bp, Oryza sativa
ttcatcgttaaatatactttcatgtacacatatagttttacatatttcacaaatttttttaataagacgaacggtcaaacatatacttaaaaagtcaacggtgtcaaacattttgaaacggagggagtatatacgtatttgaattgaagggctacatggatgcacattgctcaaggtcacattgggaacaaaagcaacgtagagacacagtcacagcagctatatagaaaggaagacatgaaaatttccacgtacgcatgcatgaatcagattcgagatctgccttgtgttcacgcaacatcaatggtctaatgtacgacgtagtgtgctttaattaattgatcgctctacatcgcaaacgaaaaataatctctctaaatatatctgaactgatgaacatcaattttcttgattacacatacagcatagagggagagagatgtatatgcagtagcattattctcttattgtatcgcaaaaacagaaatttaatacatattattgcttttttaaaatcctttacaagcaaattgacccaaaatttaatcctgcttttgagatgcattgttttgtagtgctgttttaatttagatgatcgtgctttatcaagacataattatataacatactgtatatatggagcgtcctttttttccgaacgcgcgaaacgattgcacgccaatataaagagagtagagttttggttacacaatgcaatcggtcagaaatgccatcgccaaggtacaagaaaaaaatggaaagggaaaaactgtgaaagaagaaaaaaaaatctctttaaggaaaagaaaaaaatctc

SEQ ID NO: 105467 - DNA, 799 bp, Oryza sativa
attgtgcatgtgacagaaaatctcacatttttgttttttatagttcattatcatgcaagaatacgacgtgattaattgctgcaataaattcaatcaacaaaggggtgccgcgctggtgaccatcgcagccaccatcctcgatggcatgttctacatcacgcaggagttccatatcgaggaacaatgagggcctcgttatcaccttgccccacatcaaagccatgataatcactaccttcgccatcctagcctctgctatgttttttttttttggggggggggggtatctatcctcattgatggttttagcattgccattgttgtcatgctcatctttatctacatctcttgaatggtacaactggagatacgttggatcggcacattgccgcagttcatctgacggcatgctcctatcatacttcatgatcttcaccatgacgcttgcattgtagtacaactaacatgtcatgctcggcgtggcatggtatccatgcttgctcgttcgcaagggttggatgaaggaggccagagctaccctcgatatgcttcttgcttggaaggacatctcttgtgtgatgacactcatcattgtgagcctcggggctagcatgacactgtgatcgtgcactatgtcattcatctatccaatggcaacactaacttgaatgaacagctaatgaacatagtcatgttgtatagtcacgttgtatgggccggagtagggcctctgctgggtcactcctagaattttcactgatgataattgaagtaggtgcttgtattcataactttgggg

SEQ ID NO: 105468 - DNA, 526 bp, Oryza sativa
actgtaattcccagtaaaatccatgtgagattgtatggaaattcctgaattgaatgtctggggtaagactacctatgtagtttggactttggacaattattcctgcaaagttcttttgaattacgtgcttagattatgcctataaaataccaatggatttttttttcaaggaaggaaaccaaatgaacagtggtggacttatggtgatggtttcatatatgattattctgtaaatattctactattaatatgatcgccactagtataattagttcttttgggatgatgttaatttttaagttctactataacttaaaaaaaatattctactgttatagtagttaatatataagattcattaaattagaaaatatgatcgtccagttcgatataaaatcaggagagaccattatcaaacaccttttcatatatttatttttttattcatagtatactagctaggtccagctctcttatgtacactgtgtacctttactttacataaacactggtggataaagcgttt

SEQ ID NO: 105469 - DNA, 708 bp, Oryza sativa
attcctgcagcccttttagaaactccgtcccaacactgccttcccccatgagacacctttcccacacacagacaagaaagtccccatggcgaacctaaactcctatcatctagccacctgggctgacagtgccaagactcggaatccctactgggccaggttcttcccatgagacatgtggttgcatgttaggctcaaatccataacttatgaagtgaagtccttaattgaccaaggcaacttgccaaactacaatagcacacagctcaacagtaggctcacacagagaccatacccggcaacgatcacacagatacattaccacctaaccaggttcacacagaaccacccatcaccccggtcaaaaatgttttatctgcccgtttttttacacggtgcaacacatgctaccgaaaagatagcacacagccacacagttcatataaaagtgattataagtatatgattaatcaaaattatattttgcttgtaaaacaaccttgagcaggctaagcataactactctaccatgagttgagcccaatgttcaactcacaaagactagggtgacatggaatcatgggcaatcaataattatgaaaggtaggataataataacaattaggtcacgctacccatcgatagtttataaacaaaacaatgcatgtattcaaaacaaaacatttcacaaatgggttcaatatgttc

SEQ ID NO: 105470 - DNA, 654 bp, Oryza sativa
cagagagtcctaggaagcagacagaggaggtgggggtcaggtagccatgaaatccggcaggaaacactatggatttacgtgctctccaatgcagcgcgagatcacgggaagacaggattaagctagagcttaaattagcttcctagctaaccatagaggaatcaaaatagaaccatgaatcatcacaagcaaacagtacacacaatagcccccaaaaagggccatctggtccatttgtctgatccatgcttatatatgcatagccaaaacatgtggccagcgacgtgtgaagaccaaacactagcaaattcagctatactactagtacctaactagacactaaagcatatatattatgctctggacttacatggacaaggcgagctaaactacaagtaattaatcaggctaattgtattaatgctaaactttaacatgcatgctttgtacatgttcagactaattcagaggatatctatatatatgttcttcacctaatccccacgcatggatcaacagaagcaatggaacactgacactgtatatataaatgacttcaactagcagatcagatcaaattatatatcgtttactcgttttgcaggtttaaaccagacttcctaggccgtctcgagagcacaaaccgttcagttt

SEQ ID NO: 105471 - DNA, 717 bp, Oryza sativa
cgcgccccctccccccccacatgtatatttggacccacctatttcttcctctattttttccataaaagatgtttcaactagtgtatttacaatgtttcactatttatatatctaatgttgcagtgaattaaaaatactcttttgcaacaaaaaacccacatattttggaaactctctattaagggaatttggtttattttttattccacaaaaaatgtttcacctaatgtactcataatgattcactatgtatagatctaatgttgcactgaatgaaacattccattgcaacaaaaaaacccacatattttggaaactctctgttaagggaatttggtttattttttattccaccaaaaatgtttcacctaatgtactcacaatgtttcactatgtatagatctaatgttgcactgaactgaaacattcatttgctatttgctgaaacattgtttttatataaggtaaaacaacactcgatttaaacgagtaaaacatttttgatctacttagtgaaacaattcgtggaacatcgtgcaacatttaaaaataattcaataataagctaaaattttttttcgtcggaatatatccatgtgtggtcttgttttgaagatttaattgtaacgaatttaatggtgcaaccggatcatgatttggataagtaatttaagagataaatcagtttaaaataattttacacgtaaaatgggcgct

SEQ ID NO: 105472 - DNA, 3240 bp, Oryza sativa
catggcccgatggacgcccaaaagatgttcaacctcaacacccacctacgagaggaggcccacaaacccacattggattggctgactacctagtaagatgtaacaggttaaccgtttagcttataactggtaaaccataaagcagtttattagcaacaaaaaataataattaatgaacaaaacacttatatatatatatatatatattcttagcgatttaaaagctaatgttgaaaaataaactataataaaaaaaaaactcatcaaatataaaagttttaaaatttaaatttttgttgcgcctcataagtgccgttgtattcttactaatcaatcgagttcgatttgattttacaggttctatagggtgcctacgtgactttttatgttaaaaaaagttctccaaaagtgactggccggtcaaactctgatgaactccaagaacagacttgatatgttccagggcccacatgtcatgcacggctagaaaatgacagcagctgaagacaagaaaaacaagaactagtgtctgatgacaggcgcctcctccttttcatttgcctcctgaaacgattcctcagagcccatcattcctacgcatgaacagttgagaaagagagcttcaaaagccatcttgcttgcaaagttgcagtgcatttgtaacctagtagaaagcaactaagctatctagacatgttggctcattgtccatccaatctggagcacacaaaagaagaggttgtaatctctccaatcacaaaaacattttgtcttggacattgacgcggtcagtgacatacaaatttgataattaatttctattatagaatatatgaagatctgataaaattacaaattatagaagtattttgaaacaaacgtatacatatgatttccacacatccgatctaaacaactaaaatatataaatgttcaaagtttttctgtgaccagagagtggttagcatgacacctcacaatacaacttaagcttttctgtttttttttccattttttttttgctcagagattacttgacacatgaaaggggacagagttggaggcttggagcaacaactactcatggttttcttaggccatctccctttcttttcctctctggctttctcaatgatgcattcttgcttgctccaaacacttatccaggcatgaagccatgcatgcttgctttccaaccttttttttttctctgctcaatgctatgctgtgtctgtggcttgctccccatgattgcccctcaagagggccatcagtgagagacaactgcaattaggcaggatctatgtcgtctaatgagacaaaggcccaaccaaagccacacaagctaataaggctgaattaatatgtccattagggctgcagcttcctgcaagcttctacatatgtttcttgttccaaacaagagtgcttgtgcttggagccaagaaagggttagtgtagttaaattggattttgtgtctacggtgcacaagtaggacaagtgtaaccgtgtcaagttaagtgaataaataatagtgtaatcaagttggaagtatatatatctcccttaattgccttggcctgcaagacgtgttcagacattctttgcatgctctgtatgaaatgtgattttgccgtctagtgaatgtcaggtccagctagctaggtcacataatcatattaataggatctacaactcaagataatctacttgattgtcttcttcagccatctcttgaccatgatatcactttcaccagcttcaagactcttcctctctttttttttcttcttctatggcaacattgagagcctgtttcgaacgcagaattgtcacagaaatttctgaagctcaaaatgtttaaatgttgatttcattttagaggtctcgtcagcgtcttaaataacagcatggccttccaatatctgataggcctgtcctgtgactataaagaatcttggaactagaccgggcaactacaggcaaaacatgccaaatttatggccaacatagacaatacttgtaccacactgttccagctcttcaatataaggagccttcttgtcaaaaaatatatatatttggataagcaaaagagggagaagaaaaagaaaattaattaagcagcaggtgtgatggaaccagcttgtctctagccattaaataaggtgagctcatgcacatcatacaaaacaaaacattgcttgtgtcatcctaactaacacccaaacagtgtctctgcatatcgtgtgtaattgcaagatatagggcaaatggcaggattaggtatgtgttctgtcactagccaagtgtagatgccatgttaggattagctttcagggggacacagaaacatataaactttcactgaagcaatcctgtaagctgccggacatacatattgcatttgatacctacgttgccaataagcattgggaagtttggggaggaatttgatgtctggcacgtacaatttgaaaacactggaatcaatttaacaaaacatgttgtttggatactccatatataggaattattgcttaaattttagagggaaaaaactattatctccatcccaaattatagtaacatctggctatgtatctagacagtctaaaatatagtactccatatgtcctaatataagagattttggagggatgtgatacattttggtactacgaatctggacatgctccaaaatactttacaaaagtttctcaattttccacttaagttatggtttccacgtacatttctccatataaatgagaaattcttatcgggttcgaatcctacggaaatactttataaacagaattgctaaataacatttgatagaaatttagagccaaaatgttacatatttatgacattatattcttcgcgattcatgctaggcctccttctcctctaactccggtaaccctgacgaattccaatgaccggtagtagcccaatgatatgatttagagtttaaggttgaggtaggattagggtagcaagagggaagacggaagaggggctgttatctaggcttagagtgatatttatgggaggtggggcgcatcaatggtggtcagcgaaacgggtaggcggtggcggcagtgtcgaagtcgtgggggtcagtgagtagtgggctagtattggtactggaggcaaaacacaacaagtggttaggagggagtggtgtctccagcgacggagaaccaccaaagaatagaaagacagtaggttag

SEQ ID NO: 105473 - DNA, 683 bp, Oryza sativa
gagtaataatctcactaacatgagttagtgggttttgatattattatggatctaataatttttagatactttttaatacttatatcgtaaccctgcactatattaaagaaaatgtaaagataagctatatcaaagaatactcacggcgtgtgtcacgtggttgttatagatctaatttagcaatgcatgttggtgagcaaatggttgtcaatactatttgctacgtgagaaggacatgcaaaagtatataatgtgacattttttattagaatataggctatttcactaagaaaggctataataaaatatttcgacaacgaatattacgcacatgtaggtgcactttcaataggattatataaacgtgtgttagaaggtgcatttgcggagatgtgagtgtgaagttgcgtatgtggtggtgtgtgtgtgcgcgtgtttgtctactttataaaataaataaatacattatttcatatgtgaacattttttaattaaaatgtagttagtataaaaatatagttaatataggatgcaatatattttcttctgttttatattgaagatagatcctattttaaatagtgaattatggtttaaataatcactatggtagaaaataaagagagtaaaagaaaccatagaggagggtgcggatcatgaactgatcatgtgtatatatacaa

SEQ ID NO: 105474 - DNA, 3070 bp, Oryza sativa
atcgttttgttttcagtcacgtgcatttgtacgtagggaaagacaagaagtagcgtttgcatcgtgtagcgcttgtatgttaacatgagaaaattatttttttaataatagatctaatctaatggtgtaaaataacaggtccaccaatttaaatgaaaatcaacgataagattatatagtgccatgtggcgacttaggagtgtttgtaggggtacacgtggcggcttgagagcgtttgtaggaagtttaatggacttttagtatataataactaggaaggcagcccgtgcatatgcgcgggcatcttatttaatgtgcatgaaactttattacgaatgtcatgtgtgggtggctttctatcaaaaatattcttttactttatcctaaactaaaattgaacttatttaatgtactttgaatattggttatgatttttcttctaattacccttgcaacatataaattgtgaactaaaattactttaaaccgtgtagtttttaatttatgataaaattttgtgtcgaaacaatagatgtgtttactgtgaatgtccattttttttgttagattctgtttgaaattttagatatattcattttattagtcctatcaaaatgtttgaatatttctatttaagatgggttttaagcccagcaaaaaaatttagaattagataaattttgttcaattttaatttcatttcttttcatctttatcttttatttttttgggggagaattccactctatgaggcatccttaaaatgctttgatatctacaattcgggatgaaaatataagtgagttgatcctgcaacctggcatggggtaaaggcatctattctaaattatatctctctaattaagtaaaaaaaaattaaaatagaggtcgtagtatttttttggcaaattaccactaaattggagtgtcatgtaacaaaaacatgtttattgttctatgctagatgtcaggaattcacgatgtatcggagtaagttttaccaaaaagaaataaatatacatgatcttttaattactgtctaaaattgccctttatattcctaaggcaacatcatggttgtttcactgttaagattccaccgacgttcttagtacgatcggtatgttcaactgaccacgtgacttcatagagaacatatataatttagatgctatgatcattttaagattatttatttatctctaaaaagacaatttattgataaaagcatcaatatcaaattgtatggatgaataactcctatatacatgttgagagaaaaaaataattaagtcgatagaaagtcgttagatgtctaacaggatataagtaatgggtctaccaattttgtgaaaaattaaggtgcgatattttttatttttagtgagaaattttagtattttcttatatttagtggaggcctcaatatggatgcgggttgcagaatgtaacttttttgttagcatttaaatatagtcaatatggttattaaattattgatttcacttaaaaaataatgtgtagttcaaacagatcataagagacatatggtggctatacctaataggtgaaggttcgtttgtggtcttctctttgcccactaagataattttaattttaattatcaagaaataaaaaaaatatagaaaagtaacacaccgcgcacgggggatgggaatggagggagggttgggatgttttttttcttaaaaaaaagcttgatctaatgacctaaaataatgtgttcatgtttaagtcaaaaccgatggtcgaatgttttatttttttctcagatttattaggattttctataatttaagcgggacaaatagcaacttaccatagcgtttatgtgctttaatgcctatagggatggagtggaagggaagaaggtttgtgatgtttttttaaagaaaaaaaaatctaataacgacgtaaataatgtgtccattgatttaagtggataccagtgattgaatgtatctctaatttaagagtgacacacaacggtttagaaatatttatagaatgtttaatggattttaatgcgtatgatgtctatttgtgggttttggaaaatttaagagtgacacacaacggtttagaaatatttatagaatgtttaatggattttaatgcgtatgatgtctatttgtgggttttttccaaagaagataattttaattttaattgtgataagctttcacatggaaaactgtatgtattataaagaagatgaaaggatcagattaaattcatttagaaatggtagttttaatcttggcctgggtagttaatagccttaaattcattatttaagatgaagagcaggaaccgtaggatggatatatatatatatatatatatcaggttgaatgctccatcaagcgaccattgatgatcctattcattgttaatttttcttccagttatattctgatttgcattcttggtctgggctatgatcaagtaacggtagtagcgtattggccgctggtgccgaaggaaccgatatcagatgcgagattatttaattctctccaaggacgaacataccctttctaattgattttcagactgttaagcaccttctaatcttagactctcatctttaaaattcgtgcagtttttttagtggaagagcgaagcgcatctcgatatgaaaacagagaaacggcataaaaatcactacgtgcggggacagtgggaggttttggttttctaaaatagatctaacgatcttaaataatgggtccaccgatttaagtaaaaatcaatggttagatttctctattttattaaagtgccacgtggcgacttgagagtatttatagtagcccgcgcattcacgcgggcatgcgtcgaacgctaagtttgagacacatttgccatgatttctccataatttttttcatcggtattaattaattatttttataagtttctaacctattagctttatattatatcatatttaagtaatatttataagcaattatttacaatcttcttcatcatttgaaaagaaggtagacttactttcttctttagaaaacatgtcaacgaaagt

SEQ ID NO: 105475 - DNA, 591 bp, Oryza sativa
tgctaaaatcagtactgtgtattccaggagagcactagcatatacaatggtatatgggccaacagtaaaataagtctaagactacatcgctatacacatatctaacaatggcatggccaatatgtcacgtgccatccgagcaaccgttggataggtcaggttatgttccttccaccagtgaagaacatcacgctcacctccagagaggcatggctcttgcaagtactgatcaagctcagtcatcggtcgctcacaaattggatatccataacgacggtaatatttcaaccgatcatcatctctgctcacattgatttcatttctagtctccttagtacagttagaatcttccaccttgccagaatattcatcaaagagcctgagcaatatatcatccatacaacgaatataatctgtgtcagtgtgcaggtcaacatgaagtttgatgttttccagacgatatgaaggatcaacgatcatggccatatagaaatgtaagcaacaaagtttccagcatttcttgaacttctcttgcatcttctttaccacagtagcaaatgcatcatccctggggttatcaactctgcgttg

SEQ ID NO: 105476 - DNA, 1063 bp, Oryza sativa
ttccgttagtacgcttttcaaactgctagacggtgtgtttcataaaaaaaactttatataaagaagttgcttaaaaaatccaacaaatttattcatcaaaatgttataaactaatactgaattaatcatgtgctaatcacatttctcattttacgtgcgggtaatcagcccatccaaacctccaggaagagtggctctccactgtggccccaaattacgttggacctgctataggtccaacataaatcatcatttgaagtcataagactacacaacctaaaatattagtttttaaaatacagaatatcgccttccccccaaaaataatttttaatataaaactattaacaagctcccctatcacatcaacccatataactatagacacttgtttcgagccaagcctaataatctgtgctgagcccatgtgaccctagaaacttgttatcatagctcctcctatgtgatccatagaaattgttttggaatactaaacatgggttctaataccacttattagagtgcgtagttcgacccaccaaccgtgggtcatctagatcatattgggtcttttaccacacaggtctaactagagctacaacttttaagtcctagtttacacacacactaatcttttgggtgagtgctatccccataagttgtgctccccactattatagaccctagcttgtctttttcacttttccacttgctggttagggctcgattttctcctacttaatccagtgttttttccccttccctttaatcctccctaactacgtcagcacattgcagttataaacatcttttctttttctaatatattgacttgcaaggtttttgcacattcgaaatagaaatgtgggagtaaatccaacatggtgctgcagtgttagttggtacagttctcctgggacatattcattcagatatgctcaaatctcaatcagcattccacttgtaggatatcagttaacatgcctccagcgagcggatgcggcttccctgtcccgatacgctggttcctttcctgttcctggcgacgtgtcatcttcttatt

SEQ ID NO: 105477 - DNA, 884 bp, Oryza sativa
cccaaaaactcaagctcaacatgtagcattttacgtagctgagaatggttatcatgggatatggatataaaataagatgtaaattcaattttgatttagaagtatttggatggttaccggtaaaatcccttcaaatattggatttgatcaccccaacccactcactaacatatgtttgactagtttgtcactgctactccattcgtcccaaaatataaaaatctagaattggacgagacatgtctaaaatatactccctccgttccataatataatggattttgagtttttcttgcaccgttttaccactcgtcttattaagaaaaattgtgtaaatataaaaaacgaaaatttatgcttaaagtacttttgataataaagtaagtcaaaaaaaataattttaaaattttttgaataagatgagtggtcaaacagtgcaagtaaaaactcaaaatctcttatattatattatgtgacggagggagtaagaacttagacgtactgtatatccagatttatgtgacggagagagtaagaacttagacgtactgtatatactggaaaatattttgtgacagaggaagtacacggtattatggcatgtgtaccgagccggcgagagcgagaccaaaacccatatacaccgccgccgcgccaccactttcaccccttgatcgatcacgccaattaccgggtgcagctgcaagcctgcaacggccaaaatgtcctggaggctggagttacggttttacctctccgctccgctgcgcgcgtccagccgcggcccgcccgaccaccttttcacctccggatcaccaccgcaatggctcgccgcaccacgcgactattttacggctccccaggcagccgcctaaccacagccc

SEQ ID NO: 105478 - DNA, 670 bp, Oryza sativa
tattgaccaaattattgtaaaactatagatgtaagatggtatatcacaaaactacaaacttaacaataaatttatcataaaactacagttttattgtcttgtagttttattgtccatatattttattataaaattatcttaaaatatattttggggttgaaatttttagcattaacgttatctttgagttataatgtccaaactttgtgattgaattgatataaaacctgtagatatccttttgtaataatccaccttatatttgtacttatgtgataaatttagtgttataaatttgtagtttgtgatacatcatattaaatttgtagttttgtgatgatttaactaaagtacctgtagtattatgaaatttactcaaaatcttaatacaaagatacatacaacttatacatattctccaaaatcagttaacccggtgaaaataaccaaatcatcacgttatgctaataattcgatacaatgaaataacctgcgttttttcttcttctcaaacatacccctccttaaaaaaatatattctagcaacgaacctacatgtatgtatccagaatcgtagccagagttagctatcactgtaaccacgcatgaaaggcgcaacaatagactttcaacgagacaaatagctggttagcacggtacatgagacaca

SEQ ID NO: 105479 - DNA, 629 bp, Oryza sativa
ggaaaaaatgttgatgataaaatctgccaaggacaaatttgaacatctccaaaatcagtatgtaaatttgatatcagaaaacaatgctctccaaactgaaatcgaggagctgaagtccagaatcatagagctgcagaaaactcaagagattgtcatggttcaacatgtagaagaatgccaagttgctgaagataagatcagaagattggagtctgaagcagaaatttctgcctccaacattagtcagctagaaaaggtagcttctgacctagaagggagggttcaaaaacttctggaggattctagatctgctgaaaatcacaaggtttgtgtcctagcctgttcagtgacaaaacatattgctatttaacctgtaagattcatgaggtttgaattttgcagcaagagttgcttcagaagattctgaagctagaatcagataatcaggagcttctaggtcgagtgcaatctgttttgaatgagaagtctaatgatacggaatctctgcaaggagagatagctaagcgtgaccaacaggttgagacacttgagaaccaggtcaatcagctttgcagtattattgatgagaaagaacaactacacacttgtgctgtagaaagagagaagaa

SEQ ID NO: 105480 - DNA, 922 bp, Oryza sativa
ggtccccacctacccgcattaatggcgaccggagcggtcccgccacgccacatttaatgcggtgtgcagtgcactcaaccgttctgtgaccggtccaatgactgatgggacccaggatgtcagacgcaccatcgcgtgtgtcaggcgatgtgcagcccgacatatcccatcaaataatgatggtgagaggttctcatcctcttatcccagccggagtcagtcttcccgctctggtcaaagcaatgctcccgtttctcggtgtaataggagcccagaagtcttcacccattaaatggtgactgacaggggcaccccccgtgtcaggcggtaagatttgacaggccccatcatcaagacgacgtgcgcttagcttcccaagtcaagatacaagacatgcatttaatgcaaagattataatacttctccaccagagctaggttaggttgttgggcccatgtggtaaccccttgaggtataaaaggaggtccaggcctagtggtggaggaggggggacttccgagcgaactggcgcttgagtctcgcagccccagacacttgtgttctacactcgaccataattccaaacacaggagtagggtattatgcttcttagcggcccgaacctatataaaccccttttgtctcatcgtctttgggggattgaatcccctcaagatcacacagcttcgctcaccgaatcctcgaatctcacccgctgcccccggccgaactcacaaaggggggcctcacggttccctggtggaggagttcattctccgacagattgctacactaccaatttataggtagtgttaaattttaggtaagttttggcactaccaatattttggtagagatttctattgatttggcaagttttagcatccatccaaacatcacacaagtactatttagattaaaa

SEQ ID NO: 105481 - DNA, 989 bp, Oryza sativa
atagtgatgaaagtttgactctcaaaatttacaggaacatatttttacagagacttttcactgcaccccttttactttatgtaaaaaaatataccatctcaaaactgctgcaaaaccaaatggaacatcaaaattatattagaatagatgtgtaagtcctacggccataaagttgtgtcaaatacattctctgcagctctgctcaaatatcagatgacatttttgacttattaaatcttaagagaaccatgaaatcaaccagtaaagtccaaataccatttacattaacaatgtatattgatgaaatatgatagatcatactttgatgtcatgttttgtgcctagtgcaaattaaataaaagacaggcaaggagagcattacctaaagcaccttcaaagaaactttgcaacacatataactaccaagtgggtgttttggacaaagcatattaaaagcacacgtagaaagaccttgagtaacctttttaggttactaatcctctgtagcggaatgcagcatagcagaacatgaacatccacaatgcaattatgtatccatgctatcaacaccttgttcaaatactagagctaacatttccaatggaaactggcgcatgtggctccacttggctcagttttttcccttaaaaactgcagcttttttcaattttaggatttgatgtgagcattaattttaaaggttattattcacttttattgcctagctctcttttcatgattgctaccaagacaaataaacaaacttcaacctaaaataattattaataatcattttcagatttcaaaattagcattgttatcataactaattgtaaacttcacttttttttttcaaaacagcttaactttaatggacagatccaaccagtaccacctaccattgagccatgctcctcctttagacacatcaaatacctctcagaatcttgcctgttttctgaaatcttttcattgcatttgttttccat

SEQ ID NO: 105482 - DNA, 680 bp, Oryza sativa
cacagttcattggttttacctactgctggtttcagtagtccacaaaatcatgataggattccctgacagaattgggaatagaaaactacccctatgttacagtggagaatccaaaacaaaatttaccggggtctcaaacatactaattatttaattatttaccgattatactaattatcatgacataaattagctagaattagataatctacccggggtcctaggacccctctagactacacataggtacacccctgcctatgtatgtatcatgccgccaggattatataactgaaacagccctactaacataaacaactttgcaagtttgacattgatcaatcagaagacagtttttctgctattaggcattataaccacaattccacaaaggcagtgccagatatatcctaatatccagaaatcgaaactgtgacaggagcacaagacaaccgaactatataccccatccagtaaaatttccataaataatggtaaacgctgaaaaatataccgtcatttctagatcagtcttcactgaagcctgctccttaaccagcttttctgtgatcaagcaataaaattgagggaaaaatcagtgaacgcacgaagtagccagcctccctctaaggaaacaaggggaaaatgaaaccaaaacctgctgtgatcttaagattggc

SEQ ID NO: 105483 - DNA, 546 bp, Oryza sativa
tcatgcagcttttcctaaaagctgccccaaacagtccacagcttctgagaatctgtagttacagattctgaaaaatgagctaagaagccagaagctggagaagctgggtttcagagcttttccagattcgcagaagctggctaccaaacagctgcttctcagaatctaaagctcccccaaacaggcccttaatctcttcatcaattccttgccacatcataaaaaatattgacatggcactctatttagtgagaatgaaactcccattgggagtggccttgggcggctaaccatccatgtgggctcctttagctgctaatttaatgtcctactgtctaacatttatatgtaatatgctggctaattgcttggatttcacaagtcatgttggacctagatgctagctaagtgacgcctagggcgcgccctgctgaccctctagtgcctagcgccttcttgaaccatgatggcaaaacacataaatacaagtggccaatatgcaacctcttctgacttctttggtaattaatttccctttttcataaa

SEQ ID NO: 105484 - DNA, 548 bp, Oryza sativa
gcttggggcagcctacaaaagctaatggatggtttcaatcagaactgtggttcttcaacttctcgttctcatcaaacttgtttgggaaaagaaatatcaaatagaggatctagcgagaaaaaacagctatctattcggaaaattcgaacttcaagatgttcaaaatataaaaacacatcactttctgatattggatatttagcaggtgaattgaatggccaaccgacctgttcagtgaggattgatactaatgtttcttctgatgcattgttcaattctccgaatggtgctcacaaagctgcacagtgtgttgaaggtaatcatactctaaaattaacatctagcctgactgacacacaacagtttggcttggagaatgttactcaagaaacatgccctgggtacatccatggagagtgtggtacttcaacttctgaacgttctctaaataatataggtgggttttcaccagactctgttttggatatagcttctgttacatgtgaaagcaacacttctgcaacccttgatgttatagtgcatgaaaa

SEQ ID NO: 105485 - DNA, 674 bp, Oryza sativa
ctgcaggtcgactctagaggatccccaaatacaaatttatagagtaaattttatttttatccatgtacatggataaaaattacatgaatttaacatgactaatgacagctagagctagctatacaagagctcacctgctgataaaggtggagacaatttgcctatgtaggaactaccgaactagaaagaagaatcatgttctgatggagtgacttagttatctttgttaagaaaaaaatggaaccttaattgcgtaaaacatacgttcacatcatcatcacgagtttcaattctttgtggctagctaaacaaatgaagagaaatagaaggtgatccactctgctttggggggctccgcctccgtcgaaggacatattcaattcttcatgttagttgtatataaggtgtcctttgaaacacgggagttataaaaattttataggattagttcaattctttaaaaagattttttttcagaaactttgtattccaaataagcgctaacatgcttatataaaaatgtcagatccaaaggtgcatgtcaagattcatgactccatcatgttccaaacttacaactcctgtatatatttataacagaaggtgtacaaaaatattggaggagatgctgtcgatcacaccgggagagaatacccctatgcagagtaccgaac

SEQ ID NO: 105486 - DNA, 636 bp, Oryza sativa
ttcataagaaaatagtattactggaagggtagatataaagggtattaaaaaaatacaactcctcgtgctaggattatgtaaggaagtaaaatggaacttattttgggataaattatagaggctaagggctctccttaaatcgtcggaatggaaaaataggaatagaaaaacacagtattatgttaggaatataagtgcaaaacatagaattacaaaacacggaaatgactgtttgattggatagtaggaaaaaaaatatgagagagatagactcaaaagaaaattttcaagaggttcgagctcttgctaaattttctccaaaatctttataggatttatcaatcattccataggaatttcaatgtaggataggattcaatcatttgtttcaaaaatctttatagaaaattttcctatagaattgaatcttctaaaattcttatatttttcctccaaatcaaaaggcccctagaaaatgaatttattttagaaagaagcatgtaaattgcagcttaaactcctgttattcttttttccacgaaaaatggattgatgggcctaaagcagcaccgaccagatatttgaagtgccccgagcggtactgcggtagcttttgataagttcaacgtcatgttt

SEQ ID NO: 105487 - DNA, 648 bp, Oryza sativa
cacgcccagaaattcacgaaccagaatttctaagctgaatgtgcattaaacccctgtccaggaccagccagggtacacaaacgacaattgttgacatacagatccacgtcttacaaaaatagaaaagattacaaatgcagcggaaaaagataaaagcgagctaagcctgaaggcttgacttctgcagcgggcgactccattccacaggcatccttgacggcagcgacgaaaccaacctcttcgagacatcttcaactgagaaggacttcaattctggtgagggggaaaagagcaagactgagtactacccacggtactcagcaagtcataccggaagaggaggtatgatgcaagatatatccaagggaggctaaaggttcttttgcataaagccggcatttcaaagcagtagttgaaagcagtaaaacagttgtatattttgttattcttccaatactaaaattgagtctaaaagaaatactaaactgtggttgctatctcgagctttgccagcggaacgttagttggttcgtgcccgaagctctgattaggagaagaacaggctgtattttcctaggtgtctagaagcattccgggctacgttctttaagccccagcttccagtttttaccgggtaccgagctcgaa

SEQ ID NO: 105488 - DNA, 2979 bp, Oryza sativa
ggggcggcgcggagctcctcgtcgactcctcgtgctcgcaagctccccaacacgcacgacggcagaggagggcgagaacgacgacgaacggcgaggcggcagtggtgtgatggaggaggggaagcgagaggtatgggagggggtgtgggttttataggtggcgatgtcggtttgagagaaccgaccttggggcggtcaaggagatgaggcgggtggcgcgagcggtcaagcggggcagaggtggtgacgccggcggtggtcggggaaagggaaaaaaagaagggggggggaaaaagggggttggtcctttgccatattgaggagaggggaagcagctgcttctcccattcttggacgatgcggcgtggagtggcaggggccatggatgacgtcggcgatgacggcggcggtcggtttgtcatggagcgggggcaaggcggcagctcgtggcgtcggcggcgcaagggctgatggcggcggcgttcggccggtcggccacctcgcgagcgagcgcgcgcgcgcgatgcgggggtgcggccggatttcgaacggcggcggcgggaaatcggcgccgaggagagggagaaaggaagcagagggagagagcgaggaaagagagaggaagaagagaggcgatgcctctctctctctcggcgcatgcagcgcacgtgcggggaggaggtgaagcgggctgagaggagatgggccggggaagaagagtcggcccaccgagccagagggaggtaaaatagactttcacagagaaggcgatttggagagaattggagtttggatttggattcaaattcgatattcgaactcgagggttcagggaggaatcaaggaaggctcaagatagggtttggtatttttcggaattgggagcgagtgtttagcgaggattcaaaggatgcgactgaatttcggaatttgatttggagacttgaatcggaagagtaatttgaggtggaggattttgatttcgatgtgagggaacaacgggatttgagatgagatcttggcacgacttagactcgcacacaaagaacgaaaattttcgcaattaggattttgccgaattagtttttaacgcctcacgaaaagcggagcgttacatatatggactctaaacatatctttcaatatttgttatgtttctgtttcgaattttagttatttctaaatgctctagagtcttcttccaatagttattttttaatttttaattttagttagttctaaactgtatttctataatgactctaacatccacttttattttcttttattttttagtttcaaaattcaattagttctaaattgtataccgatatggactctagtctactcttcaatattccttaaaaaatatcaaattttagctattttgaaattgtatttctatatgaactctattttttttctttttctccgattaatatgagaatttctaagccgtgagagcaaacgtggaggctttttttttctattactttaataagttaatatatttgattgcaaccacattgaaaagaaggatttgattcttgtctgtcacaccttgttataggtttctaccaagtgtgatgtgcttcctagctagcgtagtggcaagggcatgttgtttcaaccctaaagactcatgttcaactcgctcacactttcttcttaactacttggcgccatgcttctcttagttgcccaacgttttatttggatatcatgtgacgctagatatacaagctactccatataaaacacttatagctgcatatttacttgcaatacatacttcttccgaatatggtttacaagtaaacgcttataattcactactacaaaagtgatttttctgtacgagacctcataatttttgcaaacggaccataactagtggcgcctgcaaaaatcgcgcggcattttcacaaacggctccttaagaagcccgtatagaaaaatcgattttcccatacgggtctcttaagatgtccgcatgcaaaaatgatgtcatttttgcatgcggctcacttaagcgcccgcatggaaaaatcgatttttccatgcggctcacttaagcgcccgcatgcgaaaataaaatttgaaaaatttgaaaatttgaaactagtgtatctcactcatacgaactccaaattggatgattttttttcctaaatgtttctaaaatcatgctctatcatgttattgtgttcttactgttattatttaggccattttttcttgtgactttattttatcaatttaaaatttaaatttcaaatcttcaaataatattatgaagcaataaacgatttcagctgaaaaagtcaacaacaacaaagttgtataactcatcaagatctataatttctattttggtcatttcttcatttgacaaagtgatactaacattttcacaaaatttacatctctctcttatagtttataaaactatataatagatatgtacattctgtgaataatcttacaaatcactttgtcggatgaataaatgaccaaaataaaagttatagatattaatgagttacaccaatttgttattgacgactttttcagttgaaatcatttagtatctgaaaatattgtttaaagttgttataatttgaaattcaaattcagactgttcaaacaaagtcatatagaaaaatgaccaatacaaaagttgtagatcttgataagttatacaactttgtttttgataacttttccatttgaaatcatttactacctaaaaaactatttgaatttcttatattttaaaatttaaattttatatagttcaatcaaactcggatggagaaatgaccaaaagaaaattggtagatctcaacgacttctacaactttatttttggcaactttttcatatgagtttatttatgaccataaaatttgattcgaagttctcacatttttaattaattttttaatgattatttttacatgcggaccacttaaggag

SEQ ID NO: 105489 - DNA, 3306 bp, Oryza sativa
cggcgggcgcggcggctcggcttcctcggctcggcggccgacaacgacgatggccgcggtgggagcggcgacggcgggcggcgggagcggctacggcggcggcggcggctcggcggccgacaatgacgacggccgcggcgggggtgacggatctgatgccgccgccgacggatccggcaccggtgacgatgatgggtggcgggggcgatggatccaccgccgacgacggccgcggtgggagcaacgacggcgggcggcgggagcggctacggcggcggcgggctcgcagcggggtcgcggcggcggcttggcaacctcggctcggcggccgacaacgacgacggccgcggcaggggcgacggatccgatgccgccgccgacggatccggcatcggtgacgacgatgggtggcgggggcgatggatccgccgccggcgatgacgctgggcgacgggggtgacggatccgccgccgacgacgacgccgagcggtgggggtgacggatccggtgccgctgccgacggatccggcgccggcgacggcggggggtggcgggagcgatggatccgccgccggcgacggcgtgcggcatggatgtggcgctccggtggcgggctagggtttggtttggggttttttcgattttattttttttgtttgctcaatttattttcgcatgcggccggtataagcaaccgcatgcgaaaataagattttcgcatgcggttgcgccggccgcatgcaaaaaggatgatttttacagacgatttcgtccatgcggttggcacaaccgcatggaaagatggttctcagccgtatggaaaaaccatatctgtagtagtgattaattggaagtgcatctaggaccctattgtaggttattagcttctgcatttaattttaaattagtctattcacccggtcaaaccccccccccccctaggcctaagtgatcctttcattaataatcagggaaacaccattagtttggtgttgaaattatgtatgtaactctaactaccaggattcaaatcctagtgttcataaatatagttgcatgcatcttagttggtgcagggaccaaaagttacactttatttgtaaaagaaatctagtaataatgcctataaaatacatggaatggcttgttaaatatgctttttagtcttttgtgatataggtcggataactgtttttttttccaaacatagttacattttatcgactttgaaatcatcaattagtcacgaagctatgtgttgcacgggcttatattattttttagcataaatattaaaagtttaatcatgtaataaatatgttgttggctgtttttctttttttgaaatgcagtaagttagataaaaaaaggtccacatatgttacatcttgctaactgttatatatttttgaaattaaattaacaaaaccctaaattatgaggccttaaaagtccatgatataaaaattgcatatatatatatatatatatatatatatatacacttcatataactaattcttaaaatgatatagtgctctacgacaaagacgatctatttaatcaacatcatatttttatgattcctcggcgtgcataattagttggtatagtacaccgttagttaacccagaaaataaatatgttttcgatgtaaatgtgaacatgtaccttttaattatgaccaacagagatcatagctcattctagcaccatcccttttaggtagtatatagaagtagatatatagatactggtattggtccatttgcactaatcatgcgtaccaccatatgcattgaaactaattgatgatgaatgtcttttctcaacctcatggtacatggaggaattggcgccattatcctcgctctacgacagtcaaatcaccgacaaaatctcaatttaaactcgcgcgtgccgatttactcatttttaatttaaaaaaattgagagtgaaagtgcgaatatatgtatagtaataattacttggctagattaacatgtgcactatgtgtaatcacaagttcacaaaaaaaaaacatgtgacgcaaatgctgcttaccctaaatagaaaaccaatgcaattttttttcatacaataagtatatatgacgcggttatacaaattgaaggaaaatggttttgactgtgaacagcttgcacacgtacaagaccccttaagaagttaagaaaagcttatatgttaatgtgtacagttagtataatcatcaattgaagctgcaaacttaattgtaggaagtatttgcataatctctcttctggaaccatccaatctatagtttctagtaccctatatgtaaatgtgagaaaaaaactctgtaaagttttaccttggacatataccctctccctgcctctcgggtgcaccaggacatcgtgacggtgtacattatactatcagttattgcatgtatggatgtggtggatatatatgttatggctttaatagatgagagcatagcattatgatacaaaatctgcatcaccaattaattaagtaaaaatgtagtactagctagattcagagaagttctatcgtgcttagtttggaggtatcggctagctatatccatttttatgaaatacacatcaaaggttaggatgttttacacacacacacacacatgcttgaaattaagggttttagaggtaaacttcactttaaaattaaacgttgtcggttgatatatgttttaggccctatttgaaacatattttgcgtgcattatttagacagactgcttacttagttaacttgataaattatatttttagaaataaactttacaatatcttaaaataactggtctaaacaatgcagcagaagaattttatttttaaaaaaatattttaagaagcatggaggaaataatccgtgacaaaaaaaaatctggaaaaaaaagctgaaaagtacacggctttaagcactgtaaaacatatcgtattattagagttgttaaactacagtaatacacttctagctactctttgcacgctccaaggataatatgatcgagtacatgaagatcagtagatcacccacatcacaatgctaaaaatagttctagggatctcttaattaagaaaagttttatgccaggccagatgaacaaagagtgtggccttgtattgattgctgagagatgccatgcagatatacagcaccaagattcacacacacaaagcagtactagtataaaatcaatgggagagaaaactaaaattaaagaaatggaaaacggttgtacttggggaacatgtgatccataatctagctagct

SEQ ID NO: 105490 - DNA, 943 bp, Oryza sativa
tttttttctcgtatctgtatggaaattcctttaaattcagccttaaatatatgtaaaaccgacctaaactttttttagaaatcgcagtgtgaatttaaaaccaggagtttttaatccaacgcgaaaatcctgagtgcaactctctgtctcgaatatcaaatcggaagttccgttatgagttcatgtttgtccataaattttggacttaatgttcataaattttgggtgctaaattttgatctacgtgatatgaaaaaaaaatatagaaagacaaaaggacttcatctatagaaaaaaacatcatcttattccgataaaaagatggaaaagtttccacaaggaaactttcaactgtaataaaaactttctataataaaacttatttataaagaaactttaataacgacatttttcatcgtagattatatattacgaattattgggcctaactaactataaataaacctacttccaaatggcgcacaatagagaaatggcgcacaatagagaaaaaaataaatatgtcatgcacgtacgtaaaaataccgcgtaaaacaaaaaaaaattaacatatttctttacttacaaggaagatatacacaccacactcacatgtctaacgattatgttcctaacgtacgcttaaatagacgataccattagcctcataaatagagaaatgtatccacgagacatctctaattgtagcgcccgttccgtcgtggcgcctagcgggaaaactatctcttaaaaaccctatttgcaaaatccgtttctttgcttgttgtctagtgtccgtgccatctcagatctcaaatcctcgatctatcgtcgagttcaatcccgaatccaaatccttcccaaatcaaatccctccgcaaaagtctattttgcctccctcgggttcgatgggccgaactcctctcggcccatctccccctcc

SEQ ID NO: 105491 - DNA, 649 bp, Oryza sativa
gaagccaaagcacaaaatactattggatcatatatggttggttcgggttgggattagaatccgacatcaatagaacttctcatgttagtatacattttttggttgctttgcatcattgcatggtttcaatccattttgttcccttctgatgatattctagctgattagtttagtggctcaggaaatacattaagaccttcaatattgtggacacttactaatgggttgttgagtcgccctaggtccaatagcggtttcagaatatcacaaccattctgtgattatgttagcggttgttgaggagcagtagacaaatgtggcaactctatgcaatgtggaaatatatgtaatataagcaagaaacttcctcaactttgacagcttcatatcagccaaatgagtaaaacaataatgagatgacgtccatttagaagaatagccactggaacaaggcatcttggattggagtttaatgttttgtacactttacacccctgttctttagaagcaacttacaatgtcttttgtggacagttagtattttttactactgtttggcctgctcttgtcttgatatgtttgttggacatgtagatcctagttactgcaattgagtatcctaattacagatcaacagaagcactccaca

SEQ ID NO: 105492 - DNA, 1321 bp, Oryza sativa
  unsure (1)..(1321): unsure at all n locations
ccccggggtagatgggccgagagagattcggcccatcgaccccgggggaggcaaaatagacttttgcggagggatttgatttggaaggatttggattcgggattgaactcgacgatagatcggggattcgagatctgagatggcacggacactagacaacaagcaaagaaacaaattcgcaattagggtttttaagagataattttcccgctaggcgccacgacggaacgggcgctacaggttgataggtatgattcggttctttagccaccagtaccccacttacccatgggtaaaaaaaaggtgtgcctaaggtaatagctctaatccagtttatatgagattgatatggaaaaccatatagtacaaagacaacagatgaatccggcgttactgacgagatccttgtcgagatggttagacgagatctcccgacgaatctggcttcgtaaactatggtgggtatgttagcgctataattcgatgatctgaaccccttagggggtgtgtcttttataacgtgagttgccttagtctccaagtagatcttggagagaatgaaccctacacgatatagaatagacccaattctctccgagtaggactctgttaatcaccggcctatgaggatattttctataatatcttatagatttccttatcacctacggtcgtatgaccgatggtataccatactcgtatattccgtaagtcataggatatgaggtatgccttatccgtaaccagtcgtatatgacataattcttacatgattttttacttgcttttgaatgttaatgttaaaactaaggttgcctaatatgatgttggtgcttgccatcgtcatcatcggattattgtaaaaaatttaagtgctctaaattagtgtagtggtatggatatccattacctgtatgggtatggtttggggagaattttgcacccgcggttagatgtgggtattagagcgcgaacttttaatcataagtttgagtatgaggtaagaaaacttgcagtagaattatagttcatgtggatcaatttatttgtgtactgaagagaagagagttgtaccaaaggtaacctagtaaccagattatttgagcaggcgaccaggcatgaggcatccactgtctagctttagtagtactactattgatcaagtcaatgtaacaatatgtttggtagcatatgatgtattcttgatcannnnnnnnnnnnnnnnnnnnnncaagccgatgcatatcaaagaaatgaatacaatgagttccacttaccatcttgggaccacaaatatcttttaatctctctgaaccagaga

SEQ ID NO: 105493 - DNA, 1376 bp, Oryza sativa
cttttctatgagaggaatgatcaaattaatatatgtacagaaatcagaattaatagatattgatttgggggaagaaactaagaaaatgaatactttttctttctttttggcgttggaaacttaggtgcacatttggaataaaagtctactagatagttatgatgtgatatattctaatactacgaatctatgaatcgggataagaattatataaatttataatactaagatatatcacattatgtgatgattttttttacgaaagaagtagtatatttttcaaggttcagaaagttgaaatattccaatatacagtggaaacgtatggtttacgtggttcttttgttacctcgccacgtaattttcagtacctatcagctttgtcattcttttttggcatagtccaattggtaaataacctagcaacctccactacgtgcgattcgaacttgtaatttttttagtagtcttgcatacgcactggacacacctcgtcatcagttgtcacgttgctagctagctagaccttttttgacacggaagcgcatacggatgggtgttaacgttgcgcacgtatatacgaaatcacacacgtacgtgacattgtgacaaccaatctgtggtacacatgcatcattcatgacatcaggtttacaaaactgacaataaccatatacagagttactatggtactcacgtttataccattaagacatgataaattttagagccgcggtaaccacactaaaattttaatagtaatttaatttttttaaaattgtacacggtttcttacggttttaacacgattacccgtccgtgacatacttcgtcctcatatactacaccaaccgtcgtacgtcatgacacatagcgataggtgtgtgcgtttgatcgatcgatcgatctctctcgcgcgcgcgggcaatagacttgagtactcgacccgatccgtcctttaattcttccgatcgccgggacaaagatgtgtactcatgtaaggcagtttcctctctacatctgatcgatcgcgtacgaactaccagccattgatctgtttgttgcccgcctaattaaggaactgttcctgcacggccaccaccaccattattcaccaacctacaccgctacaccttagatgtactagctactgctgtagaattgaagctagctagattgggaggacaccaacaatcttaatttcctttgtggaccaagcaattaatccaaaagaaaaggaaagaaagaaaaaggcaaaaaaaaaggggagggtaagagtggtgtggtacactacttagagcaagtttaatagtgtagccaattattggctccaaaacaactatagctaatgtaatagcccattcatacaatactta

SEQ ID NO: 105494 - DNA, 628 bp, Oryza sativa
caatatgattgtcattgggttttctggtcaattaaaaggatggtggaataattatttaaatgaaactcaaagacaggagattctttgcgcagttaaaagggatgatcaaggaaggccattgcccgatagagatggtaatgggaatccaaccggtaacatttctgatgccttagccactttaatctataacataatttctcactttgccggaaactatcatgatatctataaaaaaaatagagagcaattgataaatttaaaatgtaaaacaatgtcagattttagatggtataaagatactttcttgtcaaaactatataccctaccagaacctaatcaagacttttggaaagaaaaatatatttctggtttacctcctttatttgctgaaaaggttagaaattccctaagaaaagaagggggagggagtataaattatcactatctagatattggaaaaatcacacaaaagatacaattagtaggggctgagctttgcaatgacctaaaaatcaaagatcaactcaaaaaacaaaggattcttggtaaaagagaaatgggagattttttgctatcagtttggttttcaagatccttatgtctatagaaaaagaaaaacccattccaa

SEQ ID NO: 105495 - DNA, 568 bp, Oryza sativa
gccgtccactggataactcacggacgtctggggaaataactaaccccccgtgccgcctaaacaacggctaacgtccaccccaatccacgcgacgctatacctcgcggttctcccacttctccttcctcctccataaaccgcgaaagaaaatggaagctctcgctatcggatccgcacctccccgcccgccgggcctcgcactcccacccctcacccgtcaccaccacctcctcctccaccgctccaaaaccctagcccctcgccgtttcgtcgccgccgcgcccatggacgccgccgccgccgccgccggccggggcggccccgcccctccccgctgcgcccgcgccgagacggtaattaagctacgatcccctcctccttgccgcctcggagctggatgccactcggagaaaatctgtgagagggttattaatttgtgtggcttagcttatcgttgcaggattcggcaggatgcggtccgcgacgacaagctcgccgcactccgccgaggccgcgggcgcggcggagcaggggcaacggggccccggccccggtggcggatgccgcc

SEQ ID NO: 105496 - DNA, 809 bp, Oryza sativa
aactatacttgatgtctaagtgatgagacttttttccaaaaaatttttgaaaaggagacctttttacaatggaatgagcaaaagagaacctggttacttctgctgtcatttctctttcatttcagttgtactgtcatttttactcatttgcaaacacggattcttttggctgtgactgactcaaccatcttactgcatcataaaggtggaacataactgtgatagagacaaagctgtcttgttggttaagtaaggggttgttggtattattgaaagaacgtaataaataacaacccaaaacgttaattttgggatgaaattgacaatcttcctaccaaacatatcaaggttcaacaaatcaaatcatttattttgggtcacaatcaagtcaatttgatgaatgagaatttaaatgaaatggatggataatgcagccgtcagtagtcagtactgatccatatcatacctatcaataaagacatctgtcacagcaagtcactgaacgaatacatttttcatttacaaaacaagatttcataaaatgaatcatctactaattcttatgagggcattaatctccacaagtccaaattcacctcagaacatatcccaacgccatagtgtgagataatgcaactgtaaagactagaagctacaccgtagaaataagatcagctctttaaagccgcacaaactgtgtatcatctttaatcttctgttgatgaatgatgaatagtaatgttacgttcaaagcaaaccaatctctggaatatcctacaaaccaagcaatcaccgtgcttaatttctac

SEQ ID NO: 105497 - DNA, 946 bp, Oryza sativa
cacactaacatgcatagctggtcatattgcaattgcaaacgacgacgactcatcctcatcatgtgagatgtgtccacaccgggtgtggtcatatgcgtgaaaatatcgtgaaatatcttggggtggtacggtgcaccgtgcatctagataagatgcatgaacttaattaagtgttctgctatcggtagggcgcgcggtaggccttcagctattataagccacggctaaatttaagtattttaatattattaaggtagagggtttattcgccgcttctttgttagtgattttactccctatgacttaaaaaagggcagcctacgagaggatgtgacatctcctatatttagattcgttgtactaggaggcctcgatcctatgtcgactctttttttttaaggacagatcgaggaacaaagaagcggctaaaagtagaagtataaaagtttgacgttaaaaagaacattttttactactgctttcgtttataaatagtagctcaaccaatttgatattttttactgtataaaaatttggacattaatagcaacatggatgcatgcatcagagctgtttagcgctggcggcttagtagccggaatttatggccaacatacatcgagaaaaggagtctacactctaaccctgctagtttcctgggaagtttgaaacgaacgaaacaaaaaaaaaatcatttcaacacaaagagctctcgacgaaaataggtctcctagctatatgatcaaagaggaaggaaagctttggctcttgctggggcaaagcacctttctaagttaattaaccttcttacatatgtatagtttttttttctagtttcaccctagcataggggatataaaactcttctatattatattcaatgaaattggtatagtctcgcgccggttcgtttaaaaaaattgacactcttttacttggaaattca

SEQ ID NO: 105498 - DNA, 736 bp, Oryza sativa
aagttttaaagtccaaataacatgtcaaaagtatgaatacaagagaacattcgaaaataaagatatccaacaaaaagcataaaattttaaatgaaatgcgtaaaataaagcgtcaagggagaaacctagaaacgtttgatacaaggaaactgtgattgaacgtgcaacaaactataaggatccaactcataacaaagttagttgttttcaataaactgggagactcaactctacaactcaattaaaagatcaatattaatgacagagcaaaacaaatcggtcagggcataaagcaaaagaataatttgtttttataaactagaaaacaaagttcaaacaaacttaagatgaaccgtgacaacaacaaaaattggaaactccaaaagggatatttgaagaattgatgaagaagaatgtttcaaaataaaggaatccaattaaaagtacaaaatataaatttctcaatgaaaaatgaagcctcaacggagaaaccaagatattgtttggtacaaccaaactacgattttcataaaatcaataagatgcgaccgaataaagacatccagctcggaaccaaaatattttttcgataaaaaaggaggcataactctagaatttaaatataaggccaaaattaaaacgtcagagcacaaaaaaaactgcaaggtttaaattcacacaagtatgttcttgtcaaaaactattaagcataagttcaaacaaaatttaggaaact

SEQ ID NO: 105499 - DNA, 530 bp, Oryza sativa
ccaaatcaacactcaaaaatgaaactgagcatattattggtgttccaattatccagtacaattggatccagcaaacaaaattagtgaaggaattgaaattgcaatgtaaaatttaagtcgaacttcctagcagacatgaagccaagtctgccttgaatatgcagataagcaatatcgtcgattatatctcatatggagaaaaggagctagtggcataaaagcttcattccacacgctactagtcacatctgacaaaaactaactgaatctgatgttttttttttagtatgtcaaactccacattcctaattttagaaaaagtgtgatcatatgctgcatgacatggcccaaacatgtctgctagatactgctaagatcaaatgctggaaattaaagagaacaagaacaagaggtatctgattctggctgatgaatttcaggggtattagtaataagtaactacttgcaaactcacatgtttcctgacaccgtccatgaacaggaagaagtcttcatttttgcaggattag

SEQ ID NO: 105500 - DNA, 730 bp, Oryza sativa
acaacttactcatctatctctgatcgaaaagagaatgagttcaaccattagatgtcacgtgcaagagccatgggccctagaactaggccacatgggtactctcatgcatttttcctttttcaggaatctggttcataatgaacaatacttccaatcttctccaaacaaatactctctttcaagtaaaattaaatcatggccattgcattttatataagcaaagtatgacaatttgtatagtaaaaacccttctacactggttctcgatttaccatgtccacagaacaactttggttgctacttggagcctcaaattatttagtgcatatgcaataatcagcgaaaatgggaaaatgcttgatccaacgcaaccatatgctgctatgctaaggaagctcaattggcaactcagctctcgcctcaaaatctatcagcatagcatactccattttgatttgcagacaaagtggaaatggccctgatggtgtaatccattacctcctcaacgacgtcttgacagtcatgttgcaaatgtacgggaagtcaagcggcggcgtgggcgtgggcggggcaccgggcgcgcccaccgcgtccagcgacacctccgccgtgcacgccatctccccgtagtcgtcgtcgtcctcgttgccctcgccctcctcctcatccccgtctcccgtggcggcggggcggtagtaccccacgagcacggcggcgtgcggggcgaggc

SEQ ID NO: 105501 - DNA, 749 bp, Oryza sativa
catcgatagagtgactgacgagatctggttatggcgcgcagctggggcaaagggtatccaatgcttaatgccaagcaacaatagaagtgcaaccgacaatatgtaatcaatctagtcataaaacccgacgtctctctttgtagctacacctcaccttgcccaccttccttttttcctctttttgtaaaatcctagcctatccggctattgtacagtgtttctctcttctttaatacaaatacaccccgcggggtttaaaaaaaaattagtggtttgatgcgtggaagtcgtacgggtgtatcagttaggattagagctagctaacatcaaaactaaggtggtgcattaccattgattggaaacctaggaaacttcaatctaacattgtgcattccaatgcttttaaagtgagaattcttggctttagataggctcctgtgcaccatataagttgaacgtgactttgcaattgttcctcggtctaacctaggatcaggcgaaacgtgttactacaaatttaaatataggactttttagattattagtagtaagatatatgtctcatccaataaagggggtactatattatgggatggatgaagtaattagttgtacgaaataccatgcagtatgctattagcatatgattaataaattattatttagtgtaaacttttaaaatatatttatttgatttttttaaggaaacattttaaccatataaaattttagcataaaacgtactcacg

SEQ ID NO: 105502 - DNA, 664 bp, Oryza sativa
aacagtcgccaacatgcacccaggtgttttgttgcaccttgaagattgttttttttttatcaatccggagggagtagcagacatgatatctgaaaggattgtttgtctatttattataaattttgtttttggtactcatacatattataagactagcaataatgtccgtgcgttgcaacgggttctaaataatattcattgacataaattaaaatcctaaactatatattatagttggacataaatgatgaaggaaataaaaacgtataaataacaatatgaaactacaaataactttgtccggaacgataattcaatattagaaaagttataagttagctaaatataagttacaataatttttagtggatcaaatagtgctaaaactaataatgtaaatgaaaaaacaactgaaattagttaagaattgaaaaaacttttttagcccacatatgaaaatctgattcattaatcctaaatggatgtctgtttcattgatataaattagaatttttcatgttatagtaatgttataaatgccattatatttatcgattttgattgcacatgttttctctgttcacacctagtcgatgagaatcacggatgcatgcacgaatggaaaatcgcctcaaacatttatggattatcgataaatgctttt

SEQ ID NO: 105503 - DNA, 555 bp, Oryza sativa
taggaggtgaggcgcaagacatccacctcaatgtggccaatctcgacatcgatgtcgcagccgatggctacatcaaccttgggacggagatgctccttgtcgcccttgcggacagctgtgacgacggggtattggggcagccaagatgatctagaagacatggaatcatcgaaggtggtgttgttccagacatagaccagcgggatgagcaggtccccctcgtctatgatggcttggtggaaggcgtcgggcgtcaagtaagatggggataacgctccacgctgaagctcgtcgttatcgctccacttcgtcagtggaaggcgtcgctggagaccactcctcgcttcgcgccaccgtctcaagggcaagacgtgttgtggctccgccttgaggacgacgagaggtagctccgcctcgatgccgcgttgtcgccgctccgtctcaaggcggcgcccgccctcctgctcgctgcgtcgctctggccctcagccaactgcctcggcgtgcagacaaggagaaagaggagagaaagagagagagaagtgagagaaaggg

SEQ ID NO: 105504 - DNA, 649 bp, Oryza sativa
atgtaaaactatattatacataaaagtatatttaacaattaatcgaatgatagaaaaagaattaataattacttaaattttttgaataagacgaacggtcaaacatgtttaaaaaagtcaacggcgtcaaacatttagggatggagggagtataaaacagaggtagtatattttaagttaagaagagtactgaattgctgctagtattcttttcaaattcctgaaagagttgttctattagggttccagattgggagagaggaaattctgtttatgccagttgataattttaataaaatcaattaaaagttttatgtgatacatataattcatttgattaaactaaaataaatcatctggcattaccaaatgctaacagcatcacagtaacattgtaggtagtagcaccaaccgaaaggctgtcacctagctgttacaactcagtcaatttgcgtgtctgtaccacaagcaaatgccactgtacacagtaatttccaagttgctccaaatctttctcccctattcaatccctgatctctgtgccaaaaatccgataccttctgcttccccagggatcgttcttgtccagacggtaagacttcaagcaacaccatatccaaggtgggttcctattcgatggagcaccttc

SEQ ID NO: 105505 - DNA, 726 bp, Oryza sativa
caggacacaggtgctgcagtacagttgttcatggagtgctcgcaaagaaagaatccatggctagctgctggccggctccggacacagcatgcattgcatgaaacatgcagtttcttgtgatactattcattgtctcattctattgtgatgcacctgatacactgtccggtaaaagactggctacgtagcaatcgcaagaaaaatccctcccttgatgacccataagtcagaacacgtccagaatcgtataagaacctccaacagcctcgtataagagtcaagaatcgcaaatgaatagtctaatttgcatttcactctaacggactcttttttatgtactatccaatctaaatgtgggtcccacctatcagcctctctactatttaaccccttcttcttcaccctctcctctcttctcttctctgctgagccactagccgaatccgcacgaggttggtggcggtggaggccgcgtggtgccattggtcgctgttgccaccaccgtccttgtcatcttgggcataggtggtggatgccgcatgtggacaggggacggtgacatggattcgagtgaacagcggtgacgcggattagggaagacgacggtggtgtggatttgggcggacggggcttgtgcggcaggggcgacgacggcgttaggccgatgaacaacaatggtggtcattcaaagcgtcacttcttctccggcttctcctgcaaggcgtc

SEQ ID NO: 105506 - DNA, 735 bp, Oryza sativa
gaaaatggctttgaggctgtctcggtgaaacaagtatatatgcaggaagtggaaacaatgacatgagaggcccgaaatgaacttccaaaacaaaatttctacatttacatcgggattcttacatggacatgtaggttgaaatgtaaacctttcggtgaaataacctatggtctattgagcagtctaaactgcaattctgttgcatcaaaaccaagcgctgtaccacaatgatacatggaccagtggaccacctcgttcccaacatgtgaacaatgcattttccggccacctgcaatagcaagatattactgtcaggcacgttgttgtcaaacatgacaaatctacctagtgctcctgagaaactcgtgtgtttatggcaaatcgtagaccgtttgggaaacataggattaagatagaatcgaagtgtgaaattaatctttgggtaaagtacagaccttcgtaaagtgttggtaacagctgaacagcagaggtgtatactggagtctgacgcaggtcggatggcacatatccttctgcccctcaccagtcaccatgtccactctccatcttcaccttcagttcgtcaaaattttcatcccgtgcagagtaaggtttcacattacggcagtacctatcatatgggatggaagtaagttcattcgtttttttaaaaaaaaacaataaatcaacataattagcaaacaatgacgaaggagcccacataccattagtatt

SEQ ID NO: 105507 - DNA, 649 bp, Oryza sativa
tcacaacactagtactatttaacttcccatagaactgaaatttaagttgatgttgtagagtgaactagtatcttattatgctgccctttcgttcatgttccaaatgtacaggtggaaagtgtaggaaaaaaaatttaatctgacacataaatactccatatgttgatgaacaatagctttccaaagaatcaactgatggtagaaaaatggcacacaaaatgtaactataatggcagttttttaacccccccctccccccccgaaaaaaaatatgaagactgagagagcatactgttgatggccgtctgatgagagttgtgtgctggcattggagggtaaaggaaaatctgctcaggagaatatgctgagagaacaagcacaagtagcactgagagcagcatcattcctagtgtttttcttccgcagggaaatacatcgcttgcatttcgaatgtaatttgggccatggagatttggtggagaattttttcccttagccatgagcatagtagagcttatactgcatcatggtaaaccagtttgcatcatcacctatttgtagaagggaaacgggggcaagaggtgcccaggtatgaaaatttgcaccattgtaaagttgactgatactcctacacttattgggactaccg

SEQ ID NO: 105508 - DNA, 743 bp, Oryza sativa
aaatataagggagtcagtccaaattcatattactaggatgcgtcacatctacccaaaatcctttatatttttggacggagggagtattcatgtaggatgtgcataaaacttaaaaaagcgtaaaagatattttataatacaacagtgtcatttccatatagtattgttcttccactgtattctaaactaaaccaaacaaatttccattaacaatcaattaactattctgattaaacattttccagtccacataaccaaaaggaaagtgcaactgtgacccccccccaaaaaaaaaataataataaaataataataaataataataaaataaaataaataaataaatcaacagttcattggagatagtaaatttgttgtttagtgtgttgtttcatgaaaaagctagcaagctagaaatgcatggtaaacaaggctaaattgtaaatgaatatagattaagttgagtggtctgatatgtttactgcagagctttctctggttatcttacaaatgaatttgaatttaaggaggcgtagcaacataaattgaatatcaaattagggaccaataaaacatgggaaacatgtagaagacttactacttcctgagttatcttcatcaagagtacatttccaaagttccctaccagaaagattatgaacctgtagacgattagaaaatattctgatcattccaatatgacaaagaaggtgtttgatacagatacattgctgaacatgcaa

SEQ ID NO: 105509 - DNA, 534 bp, Oryza sativa
gacagagaagaagtgcctcacaacattgtcacttgaatggcatgcttatcacgcatcctatgtcaaagctgacaaggatctacagctccaagtggagatactcgacggcctccaaccaccagagcaacttacatgcctcaacatctgccactacctgggtcgcacaacaccaagttggctgtcaagggaacatgggggcgtcagtaacctgcaattcctcgaactcagggagtgttacaacctggaaactctccctgagatcgccaagctcttcactgaccttcgcaagcttaggctcaatgttcttcccaatctgacaaggctcccaagacttccaggcatgctgaagagcctggaaatcagcggctgcaggcgtttggaggtgacatccatggatgaccaaaggttgtttcctgcatccctagaatgtctccacttgacaggatgcactgtcgaagacactgtcctgcgcgattcattgagaggatgcactgtcctgggtagcctgaaactaagtcaaattgactctttcac

SEQ ID NO: 105510 - DNA, 2266 bp, Oryza sativa
tttttgaaatatttataaattatggtttattcatgcaaaacggagaaaaaatggttattttacaggaaaaaaaagaacatagttggacacaagctcatctgcaagcaactctcccattgtactcaggaacatgttcacaaataatgtgttgctcttccaatgagattgtggtaccaatccatgcaaatgtcccttaccaggctccaattgatcacattgttcttatcatggaacacacaatttcagtatgcaacccaaaaagaggggatctctacccattctggtactagctactccacaacacaagattgcaggccaaacaaacagctgtcctctgaaactgtcccacactcctaccacttgcaaaaaaatgaatcaagcaggcagaaatcatcgagatcgatctggcattcatgattcaagcccaagaaattcagtttctttcctgcgatctttcgcggtggatggtcgatttttcaaacacttttggtggtcaaattttgtggacctagatagctagctctcattgctgaagttaaccaatcaatgaaaataaaatggttgctgaattcattggtacttagtgacaatatactatgcactatatatgtacccccccccccctttttttttctcacatgttgttttcagagaaagtagtactgttttctcacctgttggtggctaagctaactatgatgttgggatgtctcatgcaagcctgtacctacaaggaaatgtcaataggggcgatctttgctggagaggacaatacagtttatcaatattctatatttcttctttgaaaagatgtgcgcaaaccatttttttttcatttctgtttgagaatatagagtaacaattctaaatgttgacaagttaactttacaattggtccggtacttatgatcatatttacttaatgactatgtgtttcaaagcaaaaaaaagaaaaagaaaaagaaacatttacttcattgatttagtaaacaacaatcgtggaatcacatttttgactcacctaccagggatccaatagttctatactttttatgtctactttacatggttttttatgtgctgtgaatatattatttgcattccaaacttgcagaaaattgaaattgcatgaattacaaatgcagataaaaaattgatttttcaatgggccgattaccatatactcgttagggttgaagagaagttacaatacagtttgggatcaggttcctctgacacaaaaagtcatatgaccttgtcattgacatatagacccgaggtaacatgtatccacatgtcagaaaccaattcataatcgtgacttcaatgatctacacctatttagagttgctatattttttacataactctattagagttggcaatggatgcaccatcatctatgatctacacgctatgttgtcccaggtagaatgagatggcaccccaagtacaatacaatgcgctgtatatcttcattatctctgttaatttaccacaacacgcatttcaacagtcattacactgtagtactttgctgaatgaaaggatcatgaactcaaacatttcacactatggtccaggggtattttaataaatgcatccaaccccactaccctggtcctgaggttgcattaatgcccacttctccattaatttttttcagatccaaatttctcacacaatatccactgccatattaattaactacatgggaacccacgtgttgctgctgcagaattgcgtgaaaatatagtagatacaagttctaaaattttctttcttatctactatacgatttttttcatgtatttatatattttttacctttataaattatccaaaggttataatgattggattgtatggtgtgtcttttgaagggatgaaatgcaatttacaccctcaacaaatcatccaaaggctaaaaacaattaaggagatgtgaggagatgcaatttacatccttgataaatcatccaaaggctaaaaacaattaaggtgatgtgaagagatgcaatttacatccttgataaatcatccaaaggctaaaaataattgaggtgatatgcattaactatacttgggggatgggatggactttatagatatatatgatttcttctctctctttttttcacaaaagaaatgtttaatagggtggagagctgagccttgatatatatcacaccttctcccatgttgcactaactaggagagaagaaaatttattagtaccacctcgcttaccaagctagtatcccct

SEQ ID NO: 105511 - DNA, 2173 bp, Oryza sativa
gtcaaggtctcctcctaatccgattaattacttaattaagctcataattaacttgattagcgaataataatctggtgttaattaggaggtatccgaggccacgggagctgtgcgcatgctcgcagtgtggggaggtgttcaacaaggccgacagcttggagcaccaccaagccattcgccatgctggtaattaactaaattttgatgaaaatttctacaaatttcatcaactttacataaaccgtaaacgatattgatatcaaccatctccattctaacgaaaaatgacaaactgaggttcatgttgtgtgaatagtagtcaatgcttttggggtgtagaacaagttaagatagtactcctagctaatccaagttagtaacactaatgaggaggcattgagatctgcgtgtgtgggtactatatattgcccagtcaatatgattggtttactcatgacaaaatgatgatggatatttccacatagacaccaatattgtgataattattattataatcttagtggagtgacagtgttattagtttactagtttcttggcacatcaaaccatgtgagatgagatgagatgagaggagaggagacaaacagaaaggagaaggaagatgctgctcatcaaagctattaaccccatctttcttttcctcttttcctttgtcttttgtgggttacaaggaagctactgtcttgtgcacattaatcatctttggttaattattttagttaagattggatggcaaaaatacatcaaaaggtatctgtgcctagccatcttttgcatgcttgcagtcgcatctgcatctccatttgttgaaggtagatgggtagaagctttctgactactgatggcatctcaatgcatgtaggatactgcatgcacatgattagttattataaagatcattaattaacagcaatgacagtacagtgcctgattaagacaatgcaccagaagcaatagaatcaatgtaggagtactagaaagaactgcagagtgagatcccagtgcttctacaactacagtagttgggcaaagtatccatccaatctgccaatttattatattagttggtagcacacaggatctgcatgcacttttgtgtaccctcacaaacacgaacacactcacaatttgtgaaattagtactctgaaaggaacacaaagtttcagattgttcaggtgtcgtttactccttcggttccattttaagtgtagttatgagtttcgatatccaatatttaactgtttgtcttattttaaaaaaaatataaaaaaattaaaaaaataagtcatgcataaagtaatattcatgttttatcatctaatatcaataaaagtactaataataaaaaaaaactttcaaataagaaggacaatcaaatgttggacgaaaaaactcaaaactgcacttaaaatgagacagagggagtacttgcttgtcctttgatgcctttattttttttatgaagtttctagggcagctatagctccttatagaatttctcagctttcgaaacacatcagattttcacccaagtttaagaatatatagttatagaattcagaaaataaattaaacaccagaagccaggaatcaaactttaaattctcaatagcttgctactcccctcgttcgatatttgtttagaaaatgatcttttttctggtacgaacaagctacttagcagaatctcaagcttccaaatagatgcagaacatgcatagctgattatacagctttaaactgccatgggccatggcagccactaaggttagttaagtgatcgatgtgcttgcatgaacatgtacatcatcctcttgaactgtttaggtcaattgaagtgtcctatcacatgacagtgctgcactatttgcaatgccattattgttgttgatgcggccgagatgaagtactgatctcctgaatttcagtgccttgattgcacactgtctgctatgataactgtgagcttagcttgcacatgctgatgcactcactgcatttaatgcacttagctagctagctgtgcgtggttaatctctccactaattacattacattacggtagatccaattaattagcttgctccctggaggattagcgagtgattaattttggagtgcatgcaatgcatatgcagtgtcggagctggg

SEQ ID NO: 105512 - DNA, 593 bp, Oryza sativa
tttccggtgaaacagagagaaaaaagcattgaaagtaccgtaatgcccttggacattgttcttcttcggcacggtggcgccgccaccgcctccgcctgtgtagtgagagtgaggggagggcagatggggagagtggagaggataaggctattacttaaaattttgtggctcttttagatcttctatgggctacattttgagatttaatatacacccttcggcaccccacgggtgaaatgcctcacctgtcccctccccacaaaaatgcgggcccccggccccacctcccccgcgggtcaaaaactgaacccgcccccgcccccgtaggggacccggccccacgggggaaattgccatccctagctgagacaaatccttgagctccgaaaatcgtggatgttacatgagaaggggttgccattgataatcagcaattactttactatgtcaaaacgcttgtttgttaaacttaaatgggtctcatttagttaatgtgacacgattatcaaagtttgattgctcactaggattagaaagtcaacgtcccgcaatgatgatacttgaaagttgaaattaaccaaacagaaggcaaa

SEQ ID NO: 105513 - DNA, 1128 bp, Oryza sativa
ttaatttgagcaatctcttcatcattatgtggcaactttggaaagccagaaatggctttaagtttcagggtaccttcaaggaaccctctcaagttagctacctggcagatgctctgatttcatctttttcccagatttcttctcaatttgccttgcaggataatgagcaatcagaggcaggcacaaggaggatggacacaattccgaatggaatcagatgctacctggatgcagcctgggacaatggacaaactggcataggaatttttttttttcataatcctcaaaatcataatgccatgtttattcaagcctgttcaaacaaagctcattctgctctgcaagctgaacttcttgctttacaactttctttggaaactgacatgtgtttgaatttttcaggtgtcacttacctatctgacaatactactattgcggacacagcaaagaagaagaatttcatggatgatccaggccactggagtcttagacctttttggacgcaaatcacttcctctgttcctattgacaggatttaggtgcgatggatctcaagataatttaagaagatggcggataaactagcaaaataagctaagtcttctaccagaagagatttagctcacagttgccaaaatattgcgcatatagcctatcctaatagggaatgtcatgccacaagactaaaatacctcttcaggtcttctaattgtaccctcaaatatgtactctgtttctaagattcaatatattcctggttctaaaaaaaaaaactcatagcaatgtcttgtattgtgaatatggaatttttttgagaattaatattatttttatggaaaatcgcaaaagtagtggtcaaccggggaaaatcgcgaaagtaggtccctgtcgaacgggtgcagttcgatagggcgcctatcgaacggtcagagcgcgactggcgaggagatcggaaggctgccgttcgacaggacctgtcgaacagcccccgttcgacaggcagggctgtcgaactgcccctgttcgacaggatatccgtcgaactggcacagttcgacagggtcgcgttctccatttatttgtaataagttattttttttaataatttgtaatttattttagtgtgta

SEQ ID NO: 105514 - DNA, 585 bp, Oryza sativa
ccgcgcaccgccgtagccgccgtcgctcacccgctgccgccgacccatcgccgcgagctccgccgccaccgccgcaagctcgcccgcccgatctgttcgtcgggtggccaactccgcaggcgcggcctcgtgcccctccgccaccgtcgcggcctccgcgtcgtcgcgcccgtcgctaccagccgcaccctccgtcactggacaagaagctgccgctgtcaccagtcatcgtccggctccaccgtcccccagcaaacgccgacatcctcccaccggcgccgggcaccgccggatgcctccccgccaaatccggcacggatctggcagcctcgtcctccgccgccagcgcctccaaactccgccgccacccccgccaaacgtcgccacccgaacgcagtaccccaccgccggcaaccgccccgccaggtccggccggtcggcacggatctgggcggtgtactcctcccgacgccggcaggacccgctgcccttgtgcggtgagacggagcgaagccccgtcgcagctgtcgctcgcccgctgctgccgacccttcgccgcgagctccgactccaccgccgcaagct

SEQ ID NO: 105515 - DNA, 688 bp, Oryza sativa
tgcagtggacgaggatcgtagcaggcagcatcgatgaagcagcaaagaagataatcgatttcctggacgatacgagcaacaacagaagtacggtgatctattttgaggcctgcagaggattggggtcatcggccgtcctcaaagaggtggccaaacgactgagatcgtcgtcaccggagaagctgaagctgaagctgaggttggacaagatcatccacgtcgattgctctctgtggcagagcaagagggccctgcagaaggccatcgcccaggagctggagcttcctcggtcggtgatggccatgtttgatcagcgtgacaaggaggatgatctcgacggcgtggaccacggtgccagaggagtgataccgcacatagatgtgcaggagtgcggtgttcctataaatatgggactctcaggcaaaagggtactgtggacatcccaggtcaggtttgggccttggatgatcacaggcgatgtgcacatggttgccggaccgagcgatgtcgctatgtttgctgatcctatggatgatcaacccctgctgcatgaagaggctgaggaggttgctaggtccactggtgtcccaaaacctggcatgagccctgagattgtcaaggagtgcatcatgtactacaaggtggtgaggctgttagatggaaaccatggcattgactgggccaccca

SEQ ID NO: 105516 - DNA, 1034 bp, Oryza sativa
ggcgaacccaagggccatactgccgtgcttcgtcgtcatctaccgtgttgtccccgagtgaagcagcaaacaacactcaaaatcaattaattgtatcaaccttttgtattagcataatcgtccagcaatttcaacatcatataaatgtataaattaaatgcattttgagggagagatgaacttaatttttgtctagttgctgttccagtgtagtatctgtttgtattgtagtgttgtatatatggacaaataattaagccacttgattagacaaatcttcgatctacacgcttcttcaactaatcattcattcaggttgatgcttcttcattcgatgtacgtttaatcatagattcatactatgtcgtcgtattattccaatttgcaactattatttgccaagatacgtatacgtaatccaataccatttgacgcatcaactaattggtgaaggtataactttgacatcatatgttcatatgtacatgaaatttcttttgtgattgcattagttgggcaatgcacatcaccatcttgtttgcttaactagtcacttaacagtattggtggacctagcttagcttcttctcaactgtgatgcatgatcagatcaatcagacatgtatccatggattcatgcagatcgagagacagatagaatctcacctttgcaagatgtgatgcatgcatgcatatatggatgtgggtacgtttgctgctaacttttgaccaaattttatcatctgtcatatgttaaaaaagtcaaccacacatggttgtcttcaccttttccatgttggatcagatcaatgattgctagaggttaatttttgtggtgacttgacttgcaaatttacttgtacggttagttcattctcactctttcatactaagcatgtgtttcgattctaacttttttcttcaaattaacttccaacttttccgtcacatcaaatgtttggccacatgcatggagtattaaatatggaaaaaaaaactaattgtacagtttgcatgtaaattgcgagacgaat

SEQ ID NO: 105517 - DNA, 3052 bp, Oryza sativa
ctatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcatatacatataacattacaaaaatattttcctttcttacacactaaaataaattacatattattaaaaaaaataacttattacaaataaatggagaacgcgaccctgtcgaactgcgccagttcggcggatatcctatcgaacaggggcagttcgacagctctgcctgtcgaacgggggctgttcgtaataaatggagaacacgaccctgtcgaactgcgccagttcgacggatatcctgtcgaacaggggcagttcgacagccctgcctgtcgaacgggggctgttcgacaggtcctgtcgaacggcagccttccgatctcctcgccagtcgcgctctggccgttcgataggcgccctatcgaactgcacccgttcgacggggacctactttcgcgattttccccggttgaccactacttttgcgattttccataaaaataatattaattctcaaaaaaattcatacgtacgtgtatttctgagatactagatgcatgagatgatcatatctcatatcgatcggaacacaaattaaaaattcaatggaacattacaaaatctagcatagcagcacaaccctcttgatcgagaatcgttcgtaatatacggggatgatctgaccgagctactgcacaattattacgtactaactcccaattatatatattgcgcggttaattagacttaataataaactaatgaatccaaatcaagttattgcattcgatcgatatatgcttgctgattctgcatttatggtagcatcatatatatacatacataccatggcctcatgcatctccttcctagtagccagtgtgatcgatgtacatacatacgactgtcgatcagtatcaattaatgagatcactagcatgcttgcttgataaggtagtatcatatttggatcgagagagtagtgatcgaggagttctacactagtaacactacacaggccggtgcagactgcagagtagtggtcgtgcagtgcagtggatgagtcagtcctgcacggccgggcatgcttaattgttccaagtttccaactaataatgcaatgcaaaagctaacatcggcagcaaagcatgtatattcccttgatttatatataggggccgatctagctgctatagggagactagttaattagtggggcttaattaagatcgattagctaggagacttaaggagaatgaatcctcagtacgtgagagtgagagcgcaggagagggttggaaaacttactggttaggatccaatggggggtgtgcgtagtcggccatcgccggtgcggccagtgctgccgctgccaacaccagcagcacaaccggcaggcgtggggtggttgccatcgtgcagttgtgctctgctcggcttgtaggtgggtgctggaatagatataccgtgcaactctgcccccctttatatagtggtggcctggtgggtggcttgcttcatcgtgcaagccatacgcatgtgatccatttagaatatatataaagggaagaatatttacaaagagggagagagatagaatttacaaagttattacatcactctgtctatccatgatttccatataggcctttctacttcttttactctaaacatatgtagagtaaaatccaccctgaacctttgtttccaagagtttagattaagttgaacaccatcaaaaaattgtgcatttcttgtcgtccaaatgttccaattaagctgcaattgccaccgcttcaataaagaaagatttctggaaatatgctttagcatacataatcatattcatgaaactgaggtccattctccaatgtattccaaggtaaacccagcaactctttgcaaaggagcaggagaaaaaaagatgggtcgtgtcttcaagggctgcatcactgcacattacacattctggttcaccatgtactgtgaaatgtcttctctgtagcatttctctagtgtttaatctatccatcataagtagccacataaacattttcagtttcatagtacatttactcttccaaattaacgtactaggcaaattaaggaaaaataaccaactgctgctccatcaagctgtaagagatgtgatggagatggctatatatgcatcctccgatcccttatatgtagaaggattgcatcggcagagcttgcattgggtcgttgctagctttttgagccgatcactgtcttgatcgaggctgcaataagccagctagctagctgatatatataggatgggtgggttgcaataagccagctagctagctaactgattgggtgggtttgttgcacctgaaactttcccgggatatatatactcatctgtatgtgcaggtcgatcactgcattaattgcatctatatcgctcaatatggaagagcgcgtcctttttgcatcaacgcgttggggtacggtggtccacggctactgtgcatgcacctccgtcgctctctttcgcgcgtttcttttttgtgttcaccaatgcaagcttgtgcatgcggcagtgtcctgtctcgatcttgtgcaacggccggacctgaggcgtttcctgctcgagtttatttggatcagaggcaacaggctcgatcagctccacccacattccgacgctgcttgtggtcagatcggatggaggagcctcttcggctagactgcacgaaactctcgatcatgtcccacgcctcctccatgacatggaccaagtcgatcgaacgcgaccgagcactgatcgaggaaactagctagctagcaagtacggcgtgcgaagaaacggcagccgagttagctagctagctacgtaccactacgccagatcctcacacctctgacgggatacctgtgacaggcaaacgatttggtcactagtgaccattacctctgac

SEQ ID NO: 105518 - DNA, 1188 bp, Oryza sativa
aaggatttggattcggattcggatttgaactcaacgatggatcggggattgagatcttgagatggcacggacactagatgacaagcgaagaagcaaatttcgcaattagtgtttttaagagataattttacccgctaggcgccacgacggaacgggcgctacaccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtggcttgtaaccatgtactctccaaggacatccaccctgtatgcacttcaagtcatacgtcgtcctatttgaaaccttcaccctgaactcacgcttctggacaaatgcccacctcttcaccgcatcttgtaagtgacttttgtcatgaaacatctgtccaactttcacctgcttactatcataacaccagtgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtctgccaaacattttcagcttgtccaccttccaacggagtttcttccaccacggcatgacttgactcccccgatcgatcaacacatgttgtcttctgcaccactattgccaagctatagcctttctcccttactttactaacaaacttcctctaactcccagttgacgcaacctccactactctccactgccatccatgttgacccctcactggccacacggcatttatgacaaatttatcgtgcactagatctaccccaaacatattatacaaccaccctaacacgtcgttcaaacccatatgctccggtgcattcaga

SEQ ID NO: 105519 - DNA, 698 bp, Oryza sativa
gatgttttctttccaaaaaatgcatcagccccacggttagcacatgctcagtggtaattaataaagctcatctttaatgaatgaaattagtagacaaaactaatctctcttgactgaaagtttctaacaaaactaatcactgtttgactaaaatgtgcttactgacctaagtactattagtagaaacaaatttaatatgttccaaaactactttctggtataattcaattaaaaaataactagtttagtaggttgtaaaattaactttggtggatgaccaaattaatggctaacaaactaattaagtataaacaaaaaattcatagatgtgttataaacttcaagtagaagcatgcactagaactaaaagattacttctctcaggagcttgcactcaaaacatagtccatcggtgacaaaagcaaaagtcctatctactttgaactatgtgtattgtaacgtaaatcatagagccttcttgaaaaaagcacctactacaagctatcacaaactgcataaaagctaaaattaaaaaaagcacagaatcaataagcttgtcaagtgtcaaaacatattataacataaatcacagagccttcctgaaataatcacctactacaaactatcacaagctgcataaaagctaaaattaaaaaggcacagaatcagtaagcttgtcggcaagcgtcaaaactagg

SEQ ID NO: 105520 - DNA, 679 bp, Oryza sativa
atgttaagagacacattttaaaaataaataagattagctagaatcggaataattaacatatcataattgtagttctattttagaagagagaaggaacctcacactattgtgtaacaaaactgtacaaaataacaagcccccttgagtaatatttaacaaatacagcatgtataccaactcaaaagaggacatgtgtataattaatataacatgatatatatagttgaagacaccatcagaaatgctaagcctagatatatactactctagctaggctctagctagctcatacatatcaattaatataaaaatattatattaaagatatatagttaatttgcaagcatatgcatgacgcaaatggcacgtttaattaatactatttgtcaaaactgcatcaagtggaaacaatagcgcacatgattccatttgaaacttagccatgtcttcatgtttggcagtgctaaccgagaacacgacaatgcatcttctacatatttcacctaatagttaacacactgacaacttcatgaagctttcaccgaaaatatttgagatagatcacgtgtcacaggccggctcaataacatggtacaacttagattgggagtataattaaaatgggcatagctaggaaggcaacagcatagaacattgacaacataatgatcatgcatgt

SEQ ID NO: 105521 - DNA, 951 bp, Oryza sativa
acgtccaaacaatatcgttaattaaactttagtactaaaatagtacaatttgatataataagaatcatactttcactcaacatttatgtaatcgaagtttagttcaaaaagaggggaagtgatggagctaatgcagatttccaactgcggcatatcctatttatccaaaatgttcaagaaaaaaatattgtctgatttaacctattggatactcttataaatctgaaaacaacatactatagctttatgtcacaaacaaaagcacaacttcataagcattagtttactagctctcttactagcagtactaataatgtaagaagatgcctaaactcctctggtcaatttaagcacgtcaaagactgaccatatcatggtcacgaaaacatactatttaaagagttgacattgcaaacctaaatggccatgagttgcataaagtaccagtggggctgtttggaaggccagaaactgcggctggccttgtttctgaggcactattcttgctggctgcagcgcaacagcaaatgaagaagccgaacagccccagtgtcgccaatatttttgcacaacacccatttgtttcacagcatccttttgttaatttgtaagtacacagaaagtagcaccctactcttccctagaactcataactaatcttaaacacaaaaaccacccaaaccatgcccaaattgtctttaccagttcttatcgaaactagctcaccagaatcacagatagtcttgctacccaaacacccccattccattccaatatgggaatatctaccagcggatcaagagctcgaactcgccattcttttcaagcaaagaaataaataactctgaaaaggcaagaatcgaaggggtttctcaccggttagccctcctcctccttggcgttggaggcgtggtgctcggcgcgggacgggagggggttggagcccttgac

SEQ ID NO: 105522 - DNA, 822 bp, Oryza sativa
agcatctcctagataagctagccgtatattcagtataacaagaacataatgtaaagttggtactcatatactcggaaagtatttcaataccagaaatatatttagaagagtattctaataaaagtacaaagcttacaaaagaggaaaggaaagctactagagccatacacgaactcttctgaagacttccggactcctgattcctattctaattctattccaccagctagatactactaaactaaacttgagaggaatgagagagttcttgcttgaggtgtgtgttgaagtgaagagagtgagctccttatatagaggtaggtatgacggttgtagaaggggaattgtccgaagtgccctccaaccgtcattaggatgcaatcttggacgtccacgccaaaaccaggatccaacggcgccaggattggttcggccgaacctggggctggcccaatccaacccaatttcggctagtggcctcctctattgctccactctgcagacttgtgaattttggtccaattcatcgtgtcaattctgagttcttggcccattcatacataagtctggtcctcgacatcgtctgattgatttatcgttgacagctgcccggcgtcgtcgccggcggcggatccatctcccccaccgcccgccgtcgttgcccccaccggatccgtcgtcggctgcaccggaagcgtcgccccaaccgcccggcgtcgtcgcctgcggcggatccgtctcccccgccgcttgccgtcgtgcccccgccagatccatcggcggcagcactggatccgtcgccccagccgcccggcgtcgtcg

SEQ ID NO: 105523 - DNA, 2809 bp, Oryza sativa
aacgtgagttcgatcgattgcccggttaatttactatggccacgtttgatagggttccaactcctaaatttaatttttagagttacgtttagagtaaagttgtagagcaatataaacccggcttcatctggctagttgttttgtgatagcacttcagtccgctccgttttattttacgtggagatcaaactgtttgtttgagttccgtcttcagaagaggtagaaataaagttggagctctcgtgccaaacaggtccggcttcacttgcaatcgagagtcgtagaataaatctcaactgaagatctacttggtgtgttcaatttcctagaaacgactggatcagctccctagcttcaagacctagcttaggggtttgtttgtgaaagcttcggctctagctgcatcacttttggaactgaagctagtctaatcaaacaattttagctctataaaaaagaaatagccgagttgactagagtaacctaaaaaaataaattagatgtgtgagtggagttcgggccgctatatagaactcatctccttagtgatcgctccctgtttttttagccacttcaccatatcattactgtgaattatttgccccatgcctctaaaacaaatttttcttcatatggcattgcttaaaccactttctttaagttatttaatttatgtttattttcaaaaagtatttaatttatcactacgattaattaattagatgatctgataaataatctatttcaaacacataaaactgctgatatgaggtaaccattatttgaagtagagttcatccatcaaatttaattttaaatcttgatgtctataattacacgcatatgtgagattgtgctctcatcagcagagcatgtcttaagagagtgcgcttgcgagtgtgtacgtgagacggatggggtatgtaatcggggaaagaaaattcttaacctgatcaattgttgtatttcgatacgataaaccatcaccatcccaagcattgcaatgcctgcacagcttgcatgcaactctgctaattttcccgacctggaccacgaccatgttgcctagctagtgcttggggagctgaatccaactgctaaataatccaactttctagattatttagcaagtactaatgttagagaaaaatatttctctttagtcaactttagttatcattttttaatttttaaatcatctgattagctcaagatttattaaaatgatgtgtgaatcatgcgaataagtagaaatccttatattataatattaaatttgaatttataactttttgtattattaaacataggaagtattatattacttcttatattacgcaatagtgcgatgaccagaaaaccaacagtgagatacctgtttatcacgctcatcgatcaaatccatctagcgctggcacatgcaacaagttgcccagaggcacaataagagggcaagaatgcaactatgcaagatggcagttgttgctgttaagaaaagtgcaaagagatactgtaatagttaaagatctagtgctactatttcgtttgcatcaaattgcatctatcaaagagagtctgcaggagtactactattcatcaacaacttggacaagatatgtatgttacatttatatatgacccttaaattttagaggtgtccgggtgagctgaacccatgcatggatacatctgcatccaagctaaacaaagtagtataagtacttattttagtgccacgagtgtaactggaccgttttagttgacgacctagtcgtaaacaaacaaaggggatcgatgtacataccgagagggttcatgaatctgaacgttttagacccgataccaaacaaagctttttgccgggtgttttagtttaatttaggcagtcgctttggcacacaaattgtcgtaatctatatattgatatcaataaaagtatatatggcctggtaaagaaaatgaaaagtataaagcagtgaatagagagttctttgaaataacttctttctccctccgatcccttactttttaatcatagaaacactgtgcgtcttgtatatatgtcatgtgtttatacatatctagatagctaccacttaaaacatgagtttcgtcatctatccgtcgtgttaggaaaccggcggctcataaagatccagcttagttatacccattaattggactgatcactaaatatgaaaactatctatagctatgcctctatatagagagaagatgatgctcactattatactccttgaggatgaatgaatgaatgagtgcctcacctttaaatcttgtgtctttcactttcttatagacatctgtcatgtattatgcaaaataaacccacaaataaaacgatttagatggtacccaaggaaagacatgcataaaaaaattattttccgaagtgaatatcttaagagatcctcttgagaaaacgaattatttccacgggcctaaaagaccagccactatacccaacctctccttactctcagccttcttaaaaagtaaagaattatgctctccctcatctcctcatccttatctcctcgagcccctctctcttctctcactcacaaactcaactcctctctcactcacaaactcacctcatctctcactcacggcagcggtggtgcacgcacagaggcaggtccgacggtgtggtgtgcgttgatgacgaccgccctccctcgtggatccaacgaccaagtggtggggaggggcgccagatctggtccaatgggaaagggcaatgacgttgacagtggctaggggcgatggcgtagatccgatgctg

SEQ ID NO: 105524 - DNA, 3761 bp, Oryza sativa
tttaggaggccatcatgtcctaacagaggtaaggtgtgcgcgcgcatttagaaagatacgtgagttagggtttttaggatttttctttttggaatttttatttatttattcaaaaattctttatttttcagtcgggtaaacgtgtcgtgtgtaaaaatcctattttcacgtgtggttgtgttacctgtctgggaaatccctatttctatatacacctgagggcatgcagttgctacatccatctgcagaaatgcattttagccgtttaggaatattgtttatattgtagtgtcttttgcaacgcatagacatattactagtaaagataaagtataagaattggacgagtcaagcattggatgatcgtagataagacgatgaagtcatgggtgcatatctccaatcaacagggtgtttaaatcaataatcacacatgtgtatgcacttttaatagaattttagcggaacgaatttgtgctaattttcgtttcttccaatgtgtggacttctcttatgtgctctctccgtctcaaaatataaacatttttaacaaagtgacaagtcaaatattttaaactttgactattaatagtaaaaaaaattaaaagatcaatcatgtaaaattgatattactagatttatcattaaacaaattatcataatatgcaaatctttttatttaaaacatcttacttttatagatattgttagtcaaagtaacatatcgaaaaccatgtcagagtcaaaaaaaaaaaaaaagcttgtattctgggatagatggagtaattaattaacaaaaaaatatgttttgattgataaattggtatgcataaagatgcttgcactagaattttaacactttggcccttcttacatttactttacaaatgtaaatccatgctgaaacttattttgaaaatgacatatgccaagacttgtttcacaaatgctagctaagcgtgtactcctaggacttttagcctgcaggccgatcggccgctctcgatgccggcgacgtacgagacagccaggttcatggaacgaaaatgagaggtgcccgggcggtatgacttttcagtcagactattattgtagtagtacgagccagtttcaatttctctacagtacgtaatttgtgcagactattattgtagtggtgctttttctgtagcagtaaaattgtgcagtactccctcacagccggaatgagttcatttttgggccgttttggtttgctataaaaactgggccataccaatattttagttatcagaacaataccactgtgagtttggattgtgaccaaatcactggtagtgcctaggtttaatttggtagcaaggcataggctggaattggcagccatccgtcgcccgccggaagtgcccagaagcaggccacacaacttggctaagcacaaactagttcacgcacttccgttaaaaaaaagaagctagggcttcatcttttctctacttcaataaatacccagccactactcccagccactactcgtctcctcggctggccgcctcaccgctctgtttatttgtgcttattctgcagcaaatagtaccaaaactattacaccaaaaaaaaatggtaatccttcattggtaccaatccaaatggaaattgacccataaaaatttggcacaacattggcactaatccaaacactcgtatttactgtgctaccataccaaaattttggtagtgccaaaacttaccaggttttggcactgccaaaattttggtagggtaccaaaccaaataagccctttatttcttcctatatgttctaagataaatttatttttaagtaaacattatatctcaaagtttatgaaagtagtgtggataatacattaggagtagataaaaagaaaaataattgtattgggatttgataaaatgggaatattttagtctatttggttttgtattggtttgtgtgaaatgggtgaaaaaaacttattttgagacggagagattaattgttactattcgttgggtgataaaatatggtataacaatttctagagttaattatgggttattaagaaagcatgtgaaattaaataagagaaaacaataattaaatgaaaaaaaatcattgcaattaggataagttgagagaggaagtggtggataaatttgattgattattattggttgtgataaaaaaagtagatgtaagctgatatattctataataaatttttaaatcttataggtttatttgtctctgaataagtccatttctatgcactcatctacttctattcgagtttcatttcattaataccctttactaatcattatacctatatgaaccacccaaaaatactattatttctattaattgaagacattttgatatgattggcagtacaagtttcccagtccaaattttcccctattgccaaaaaaaagaaaagaaaaaagaaacgcaaacacacacatgcacacccttactcctatacacatctctctggtcccttctactactactactagctaggtccgattcgatcatatcgacgcgatgcaagccgttcactgaacctgcagctaagtatacgtaatacgttggcttggtgggtgcagtgcatgcactgatgactgatcgatccatcgatcgagctatatctctcgacgagacgagatccagtacgtactctttcgtcggatgggtacagtttaattatcgattggtctaggtgcaggcgcattcacgtactacgcgagcaggtgcatcgctgtcgacgatgccggcgacgtacgggacagcgaggtttcagggaagcgatggacacacgatgccgatgcctggcagtgcatgatcacgacttctcagtcaagaccatcaattatcgtccgactagctagaggccgggtccttgtggtgtttttgctggagccgtaaatagtagtgcactccctccgtacttgttgactgaataactttgaataccaagtctgtttagctttaactggttgggttctcttaggccatgtttagttcacatcaaacttttcttcaactcttaactttccatcacatcacatcacatccaaaactttcctacacacataaactcccaactttttttccaaactaccaactttccctaaacttctccccaatttaatgaactaaacacagcctaaggtgaaaccgatcgtttgggtttactggcttctaatttaactcaggtgctcgtatttacggctaagtagatttaggtgcactagcgttcacgtaaattattattttagtggttcgcaagataccaatcgataacgagatacttgagatttcgttaatcccaaaataaaatataccagccatgtctttaggaggtgatcatgtcctaacagaggtaaggtgtgcgcgcgcatttagaaagatacgtgagttagggtttttaggatttttctttttggaatttttatttatttattcaaaaattctttatttttcagtcgggtaaacgtgtcgtgtgtaaaaatcctattttcacgtgtggttgtgttacctgtctgggaaatccctatttctatatacacctgagggcatgcagttgctacatccatctgcagaaatgcattttagccgtttaggaatattgtttatattgtagtgtcttttgcaacgcatagacatattactagtaaagataaagtataagaattggacgagtcaagcattggatgatcgtagataagacgatgaactcatgggtgcatatctccaa

SEQ ID NO: 105525 - DNA, 742 bp, Oryza sativa
aaccaaattattactagtatagtgaattaccacgttgatcataagaaataatatatactggactgtcttcataacagtgtggattatttatatattgtgttgtgaactaaccaacgttatacttttcgagacggagggaatatatagttgtattagaaaatacaacagaaaacctagacaacggtatcctgatagaacgaaatatgtctatcatgttgcaacgagattccgttttatagcagccctcaaaatacaaatatattcttgataatcccatacaatttggtggaaaattcgaccagtttatccgaaacagaaggcgtgaacacaagtcatcagcatcagcaaggcataaagcggacaacttgaaacactttattgaatcagctaaacttgcggctcgcttcttcttttcttttcttttttcttcccttcactttcttggacctgtgacttttagttggccgtccaggggatctgaatccatctactgtagaccatttgtacaatcaattgttacaaaatggaccacttaatctacccctaaatgctaaagcaatgactaattatgagctactcctagctgctatattcagctcagctcttgcaagttgccaggcaaaagggctactaaaaaccaatattaatttctagcaaattgctctagcaggctcttcatcttcttggaccatggcttggcgtttgtgtcccggtgagctgaaccatggataagaatgcggtt

SEQ ID NO: 105526 - DNA, 672 bp, Oryza sativa
ccccgtttttgtaagcttcatcggacaaaacaaatgatcgttttcaggaagttcaccactaaatctaagaaacactcaatgcagtcctgtaaaccaaggttacacaggtggatcgtgctcaatccgaatggcaaaccctgtatggtacccactatcgaaatgaaaaacgtcaccccatcgttacaagttaaccaatttttttaaccgataatcagcagtaaaaaaaacttccattcgaaatacctttctaaaattttttgtagcgggccagcagttagttccaccttttcagtgctgatttgaattttttggcccgctccgatataagggtgttacacgtacgtttgcttgtgcacataataatcgttagtaattcattcgtttgcacatggatgtacagctatctagcgagttgcgctgttgcgttccactgtcacgcaaattggcaaccaggcaaaattcggggatcgaatcaaataggacgtgtgtgcttcatgccttcatccaatggtggctgccctgctggttggtggtacagtgaagcgcgctggtgcatgattttaggatgtgagcattatgcagtgcataattaattaagtactccctccatcaactcttgatagtcatatatcatcttggcacaatgaggtgtgttcggcaccctctttttct

SEQ ID NO: 105527 - DNA, 687 bp, Oryza sativa
atttttttataagactagagaaaatgcatgtgcgacgcaacgggtgaaggctattctaatcttataattattataaggtttagttcaggtaaaactcaccgttagaattcgcttggatatattattttagaaaatcatgagttgttattaggagtccaatcgtctcaagttagcatgcgagttttttttaagagatttctatgcgactcctttggtatttctaaaatcgaacgaacttaaaaaccgactcatatacggatgacgtaccaaagttctggcaaaaacatcttcagtttttataatagtagagatataaatgggagaagttgttctgatatcgtgcaaaaaataattgtgtgaattaatgtgccatttggaaaattgagccaatgtggaattaatatatgtgtatatatgggtattacccaaattttggtaaaattgtttggcatatgtatatactccctctccgttttatattagaagtcattttgatattttactactaaatttatagaaaaaattatcaacatctaaaataccaaattttagattcattaaatctataatatgtttgttttgggttgaaaatgctactaatttttatataatcttattagtttgactaagaaaaaaaatcaaagctaaacttttattcagaaacagagggagtacaactttagcaaa

SEQ ID NO: 105528 - DNA, 1528 bp, Oryza sativa
caagatcttccagtgatgcttaattagtttcctggattttcttacagtggcacctggttgagaattttactgaagctgaccgccttactcttcaaacccttctgagaatgaaatccgtgcaaaattccaccgtgtttagttccaaaatatttcttcaaacttctaactttttcatcacatcaaaacttccctatacacataaacttccaacttttccatcacatcgttccaatttcaaccaaactttcaattctgacgtgaaaacacagccttcatgtgaaactcctacaaattctatgcatcctaaatgagccgttcaaaagattagaacccccataaaatacacatgaaattcgtgtattccaaacgacccaatgtttgaaagataaagacctggaaattccacgtgaaattcctatatttcaaaggagccatcattcgaaagatcctttgttccaaacgagctgcttcaagccggacaatcttggagggggtctctgtctgaaccaacttttccagagcatgaagtttcgctgccggattcgtcgtcctctcaaaattccaaagaaaatttttgctggtctttgctaaaactctggtcgtctagttcatctcacccttcctacctatgggctggcacatctccaaccctgcactcaccattgggttaaatgcatgcacttggcttttgattcccaacgctaacccactacgtcactggcgtgacgaaaccaccatttcgtctcttggaataataaaaaggactctgattttggtctgcattggaattattattaccaggcttcctctcttgaccttctttttggagaggctggacaggttcatctgaacctgggggaagagagagagagagagagagggagagagaagcaaagcaaccttttgggaaaggtttggagatagatttgcagtttttgagtgggaattagtttgaaggtaaatgatgcattggattagtttctgggtgacgtggccatggagaggagaggtagaaatttattactgcctccggttttgtaatggatgacgtcgttaacttttggatatacgtttgactatctattgtatttaaaaaatagtaattattctgctgtgagttattttatcactaaaagtatttaaaatataatttgtatcttatatatttacataaattttttttaatgaggtaaatgatcaaacatgtatttaaaaattattgatatcgtctattaaaaaatgaagggagtcctactactcccccgtcgcaaaatataagaatctagaaccgaatgagatattttttagtattacgaatctgagtttttatattttgggacgaaggaagtacaatttaacagccactaatttgattatggattggaaggattagttaaaggcttcttttaccgttctgtgtacctggctacccgccttgaatgatgtgacacaaaagataggatttttttttccatggttgcagtatgttgagtggcaattagattatatgataaaagatgcatgggat

SEQ ID NO: 105529 - DNA, 1253 bp, Oryza sativa
aagcgtgcacgacagcacgagagatatagctagaattcattttaattatattaatacatacttcctctgttttttttaataaaactttttagcattacctaaatacatataatgaatttaaacacatacatatgtctagattcattatcatttaaataaatgtgtgcaatgctaaaaagtcttacattgtgaaacggaggaagtaatatactaggtatactcacgcaaacgcacgcgattaacctagctagctagcactgacaattaataaaacagttagagcaagttggcacaggcactactgtttaattgtattttatacggctaaattagttggacgaggtgtattgcgtgagtgatatctgcttccagcttcccagcaattcgccagcacgtacgtttttatataagccatggctttagaaaagattatctatatgtgcgcatctacaattattaaattaagcacattcaatttagttagagcgaaaaaattcagtggtcctgtaggcatatgctaaaatgttggaatttttttttcatatcatgatttacgcatattagatatccatccgcagaatagacgtacacgtaactgaataaataaaacttacattatatatatatacctaaaattgtttttaagtgtttttggtaaatatacatttaagttaattttattgaactagacatatgatgggatcgatctaacttcgattttaatctattcactgtggtactgcctgcatggtactgcctgcattccatattactactccataagccttttttaagtttatcccaagtcaaactttttctctaaggtataaccaagtttttttaaaaaaaaggaatatttttaatataaaataaatatactataaagacgtatttaataaaacttattaatttgatcttatagacgttactacgccttttataaaactcattctaaacgtgaagaagtttaatttaggacatacctaaaacaatttttatgatacggaatggaacaatttttagctgcactgtaggtgctctctccagtcaaagacaacagtgtttcagttgacacttgatcactggtggagaaaccatatttcgtcggtcgggctaattccacaatagtcccggttgcaacaaaaaccgggactaaagatgatctttagtcctgattaaaaagggtaacgggcatatttgatctttagtcccggttcaaatgctgttagggcctgtcaggcctccccgggatc

SEQ ID NO: 105530 - DNA, 1274 bp, Oryza sativa
agagtgtgtcctagttgcggactgaacacataaagaatttgcaaaagttaacaatcgttttctccatattgcatcacgatatcacatcactaattcactatttgttggtggtttgtactacgcatttgcaaacaccacgtagctagctagatcaagctagatataacaccaaatctgagttctatcctgaagactagctagtaatcaatcgacttaattaggatataacgtgaaaatcgatctttggctgccgtttgtgtcaagttaaccattcattagcttaagtgaatggttttacttttcttttcagaaacgatactgtcatcaggtgaaactgcaactaatattgatggtgaagtctgaactctgaaatggatggtgaaatactgaaattaatggaagagtgaatagtttacctgacaaccagatgaggtcggcgaggtcgagacccttgctctggatataatctattaatcaagcagtatataatctattaatcatgtatccgtagaatagctctcgaggtgtggtcccgagaatagcagtcgagtatccgtagaaaaccaaacggcatattgcaatcatgtatctgatatttagatgcattggtgtattggattagaggaaaatattgtctctagattaaagccagctaacagtttgtctagtgcagtcttctccatatatactatttgctagtgtctggatataatcagtggacattaaatagttctttcttatgtatattggtgacagactttattttattcaatttaattgtcttaatatcgttagttgctaaggacttaaatagagaatggttgccgggcatactttttctttagtgcgttgtggtgccatggggcacacgtgcttgcagtgctgcactgcagaaaagaaactagatatatattttactgttattcctcttctgtagagaaggaactcggcttgtttgagcattcagagcttgcactaattagaaaaaaatagaatacctattttcttgaatctatacagtcagttaacacatggaactgtctttttcccttgtgttactgtaagcaggcggatgtactgtgactcgctagctagacacaatctcgaaagatgtgaatttaattttcaattcttagttttctgagccatgttataagtagtgtcaacttttaaactgcaacaggaaaagctgacatctaggccacaggataaggtagggtctgcaattattatgggaggattcattgacatggtcatatatatgggtaaacttt

SEQ ID NO: 105531 - DNA, 775 bp, Oryza sativa
aggtgggcggcggcggcggcggcggcggcggcggagagcgaagtagagtagtagactaggcggagtagggaggaggaagcaagtagtagacgacccccgatgacgatggctcgtgtcctgggccggaatgggctgccatctcgaggcggcccaactagggtttgcttcgttactaaggtttatcatgtaatttttttataggaaaaaaatatcaaaccctcttgtttattttatccatggaagaattattatatatccattcagataggataatgttttaaaaaaaggatatatgtatttaatattaaattccatggatgaaacgtggaaaagatatcttagtatttaaaagaaacaaaggatatatattccgcgtgctgaaattaatgttaggtacgttctctcatattaaggttgttttgaattgaagccaacacgtgtcctactgaatttttggtaacttcaatagttaggaaaaagctagatgtgtcaacattttcttgctaaattcttaattattaatattgatgggtcatgctatgggtgtatttagatttttataacttacatcttgatgaaattattgtcaaagggggagaaatatacaaaatgcatacttcttgaaaaggggagaattgaagttctagactcagtgaggagttgaggtccagacggtcaaggataccgggtgacgaagttggatacgagatggcatacggtggatggataccgtgtgggtgaaatctttgcaacgggcttcacgaggtgtgcgtgc

SEQ ID NO: 105532 - DNA, 529 bp, Oryza sativa
cgtactccctccgtccaagaaaaagttagaccatagatttccgtgtccaactttaactgtctgtcttatataaactttttttataattcgtatttttattgttgttagatgataaaatatgattaatattttatgcgtaacttgtctttttaaattttttttataaatttttcaaataagacggacggtcaaacgttgggcacggaaatcagggtttgtattttttttaggacggaggaagtagtagccaagatctcgtccgtcgtgtccctctccgcaagggcgacgtccgtagtcgcgcgggcgcgcgcgtagtacgtagagtatcgacgacttgcgcatgcgcgttgtttcggtcgggccaggttcgtgccacctgcaggcttgcagcccacagccacacatggagggaggcaacacgggggcgcgtacgcttgtcgcagataccgcccggtgcgcacgcgcgtgcacgtgcgccggccgttgactagctggaaaaaaaaggttaaaaatatagtagtattatttt

SEQ ID NO: 105533 - DNA, 696 bp, Oryza sativa
ccccggttcataacaccaaccgggcctaagtcccacccctatatatatatatgtcttcttcctcctccagcccgagcaagcttcacaatttctttaaaaaagaggggaggtcatgccaaaatttctagtgaatttattttggtgattatatacaaatcggaggtgcctaaaaggttagcaacttcatactaaaatgttttttttttcatattacatttggagctatgttttgcacacttttttgtctccaaaattttgttgttagttgataagagagaaaatttgtgtggagaagaaagaatatatagaaatttagtttatttgctaaagaatgttttataaaatagttgagaaggaaaatatagtgaaagttaatattgaatgatagaaaacaaagtaaaatgaaaaattaaaataagtacaacacattaatattagtttaaaactttataaatagtaaatatataattattcggtgtaatatttcataatatttgtatgaataatgatatgtcattattgtgtgagtgttgaaagagtttgtaattattttataattattgtatgactgtcattattgtacgaataattatgtgtgtatgattttttttcatatcatgtagatggatcggcaatggatgtacgctgaccggcggtccaaagagtttattgacggcgtgcattattttttgagag

SEQ ID NO: 105534 - DNA, 644 bp, Oryza sativa
tgtaaccagtgctaggagaagctggatcgggaacaaagatctgattggcacggagcagggggaccggcgctaggagatgtagtaccaattggatcaggaataaagatcgaattagaaatggtaataaaattggtcgctagcatgcacacattctccgatgttgcattaattgtattccgatgaaatccgcgtccataaagttatatgatgatcaatttgagaaattttagatttcattatataatgatcaatttgggaaggagagagtacagtactctttagctagttggagccactttttaaataaatggttcaaagctaataagaacgtgaattacataatactttaaagaaattggaactgctagagaatttatagtccgggttgcaacccctttagtcctaggttgcaaaccaggaatacgaatctgggtttgtgaagggagctatctatttttgatttcctattttttttcagcgtcattatgtcaggtgagatgataaaaacactacaaatattttaaaagactataaaaagtgcccgtgcgttgcaagggaagaaaaaacgagaaaattgaggaacaattgagaaagatttacattttgtagttaattaaattataaatttcctgagatatctaggt

SEQ ID NO: 105535 - DNA, 611 bp, Oryza sativa
tgtgaagttgccttgaaaaggatacaaattttgaagtaagaaattcatttggagctgtattgacagtgtacaaatcccgagtatccagctggttttgcacgttgtcttgtgcccgtatggctttctcacttctcagtcaccagttggcagtttttgtttctcgaatagagacgggccggtgcagctttggttgggtgcgttgcatgccagcatccagcgacgaccagcttggcccaattctccggacatccgacacgtacgtgcagctaaaaagtaaaactacacgcatttattactccatattttttttgtttgaaatacctgtcaatggttatactattctctttttaactttgatataagtattttcttaaaaaactgtgtagccaccgtaataatgtgattgtgtcatactgtaaatataatcatacaactatcattaataataaattaggaagaagtttgtttttctttcacgaaacaatacataattaataataataatacttgtctagatttatataaaagtaaaacttttctagagaggtagtaattatatttttcttaaaacacagtacatatatgcgctcacaacgtgtgcattctcacgt

SEQ ID NO: 105536 - DNA, 3434 bp, Oryza sativa
taaattcaatagaaattttggcatgacctcccctcttttttgaagaaattttgaagcttgctcgggcagctggaggagaaagaagacatatatataggggtgggactttagtcccggttggtagcaccaaccggggctaaagatcaccgggatcattagtcccggttggtattactaaccgggactaaagttaagatctttagtctcggttggtagcaccaaccggggctaaagatcaccgggatctttagtcccggttggtattaaagttaagatctttagtcccggttggtgctaccaatcgggactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgagcatttcccacgttcatattaatgttaatgaatctagacatcattaacatcaatatgaatgtggaaaacgctataatgacttacattgtgaaacggaggaagtatgttatactccaacgccatgccgatcgatcgatccccctgtgatgatgcaagcatatatatctaagcattatatatagtcaaaagtggctacatgatgatgcgagcatatatatctatagctcagttgctaattaatatagatatacagaacaccatgactggtcaatcaagatcagatcagttggcttaaaacgaccagtgagctgaaattagctatctgatcaggcacattgaaaaactacgtacccaacagctagcatatgttctagtgcatatatatttcacagaaatttaacttccacagaaactagctgtcattgtgttatttgtggtgtagtactagtctgcgttcgttccatatacaatgagatagaaagtgcatcgttttccgcacacacgcttcccaaactactaaacggtgtgttttttgcaaaaattttctatagaaaagttgttttaaaaaatcatattaattcatttttaaaatttaaaatagtttatactcaattaatcatacgctaatggctcacctcgttttgcgtatctttccaatcttctcaatccctatccctcaaactcacccctagtatagtagcatctagtaagtacattggcagttttccttgatctcgatcccttcagcttcccaacagcaccgaatccggacgtcctgtgaagtttcttggaattgattaaccatatgcacccctctttctttaccacaaggctatatacaagaactagtctataacaaggacaacaagagctagaaaatttaattaagcaaccaataatagtagcctcagtacatcaagaagtgtactattttacctatggttcccatggaatatttgtcagctactacatttggaatccctaaacccatgtcgtgggcatgcttgtcggcgctgcccatgtatccagatgtgcatatcgagtaactaattctatatatatatgatcttttttaatgatatggccggctagcttgatctatgggtcatgaagatttgattaactatttgatgattattcctaattaataaatatgcggtaaaccattttcattatttaaaaaataataaatatgctaccttgctgtatcttgtatcaaggaccgtaaaatttccttgtatatatataatcccgtgcactagaacttttacgtatggacatacaatatataagtgatataacggtttagattaattcgtcctctaactcaagtataatatattgaattatgtaattaaaaggggtaattttgtttttctatactattagatggtagcaattcaataaattcgtaacatatagtaaaacaatactaagtgttttccctactcgcgctcccattcctcattcctcatcatacttcaccatggcaaagcatcgccagtcatcacaagtccacataaatcaccaccacccaccacaacaagttaattatgtaggattaaaacacaagtaactaagtctaccggaggaggggagcgagggtgtgaatgctacaatcaccaaaaaccaaaccttttcgtggaagaaagagaaacccttcaaccttgatgaagtccccactccaccatcgtttatacgctggtctgaccgcccactgtcgtatctttgctggtccgaccgtctttgccgcctatttcccagccgtcggtcccactactagagaaaccatctttgctgggttggccaaaaatcacattagttccggttcgaataagaaccgggactaaagagatctttagcccggttcaaaagcagcccgacaatttatgatctttagtcccgggactaaagattatttttagtcccggttcaaaacgtggtctggccgtgtcaggacccatactatctttagtcttaccaaccgggactaaaaatgcatatttagtcccagttgtttataccaaccaggaccaaaattgaaaacaaaaattaaactacagccgcagcacacacgcgacacacgccccccgtccttatctactcgcgcggtcgcgcccctcctcctccacttatctcggcctctcctcctctccacctcccctgatctactcctcctcccttgcctgtcccctctcctcgatcccctcctcccctcgattcactcctcctcccctgatctactcctcctcccccggccctcccctcccctcgatcccgtcctccccttcctagccctctccgtggtgggcagcacgcggcggcaggcggaggtgggcggtggtgcgcggatgggagggaggcggcgagcgaagggtggtggcgggaggtggtggctggcgacgccctcccctctgccggatgggaggtgggaggcggcagtggcagcaccgttttttttctttttcttttttttgtagaatttgtgattcattggatctgagatgtataatccgtgatgtatttgatttgtgatgtatttcttttagaatttgtgatgcatttttttgtgaatttgtgatgtgaatctatgatttgtgatgttactttgatttggggatatgtagggagcaactcgatttggaaaaatcaaaatgcaagtagcaaagaaacaatgaaaaaaaagaaaaaaaatggtgaccaaccgggactgctgctaccatttttagtcccggtttcccagattcgtagtcccgatttgcaacccgggactaaagggggttgcaaaccgggactatagaagggttttccagcggtgttcgtctaactcattccattcggtcacaccgcttgcatgtctgaccgaccgcgcctccagtaccggtccaaccatcaagacttagaaa

SEQ ID NO: 105537 - DNA, 558 bp, Oryza sativa
ggatcatcgcgtcatccaccagaaggccgagggcgatgatcaatgcgcccagcgacacgcgctgcatgggatgccgctgtattccatgaacacgaacaccagcgccagcaccaacggaatcgagcacgccactaccaacccggcgcgcatgccgaggctgataaagctcaccaccagcacgatgatcaccgcctcgaacaacgcgctggtaaacccgccgacggcttcttccaccacttcggcctggtcggacaccttgtgcacgccgacgcccaccggcaggtcggcggtcagctcgtccatgcgcccgtgcagggccttgccgaacgactggatattgccgcccttctgcatggcgatggccaagccaatcgctggcttgccgttgaagcgaaacatcggccgcgccgggtccacatagccacggctgatgtcggcaatatccgccagccggtagaaacggtcattgaggcgcaggttgacgttggccaggtctttctccgaggcgaactgcccggaggtgcgcaccgaaatccgctccggcccagcctcgatcac

SEQ ID NO: 105538 - DNA, 1330 bp, Oryza sativa
tgaatcttcttgtatggcatgccaagactgtgcacaagctttttagacctatggtaatttttggggagtttatttccagcctcatctcctaaactatcatgtagtagattcattatttcattatagcaggcttctgacatgttattttgtgttttgatactcattagacgtgccacaattgacaaacgtgtttgtcttgtattctcatgcactggtgtgtctacttcctctagcaatctgtatagttctgcagctgtaggtgttggttcctcactcggattaacatcatgtgcagcaattgcatcagttaacatttcattcatttgatctaccagacctatatgttgttctgcttcatcttcctcaagtatttctggctcaccatgactagtccacctttcatatcctaattggaagccataacggcatagatggagtgtcatttcctctcttgtgcgtttgtggcagcaaacacacttactacatggacaataagatttcccatcaacagtaacttcaggcaatgaaaaagcatggtctagaaatttttctaacccctgcctccaagctgtactaatggacctgccctttttttcagagtacatccaaccacggtcttcctccattagcaggttgcctgagtgtatcattcaaaattttatatactatattgtggaagttaaaaatgagtatatatgggagttttctacattcaatagacaagcgcatgattgtgcagagaagaatgacagtatatagattcctaaaaaaaaatggacaatctgcagtggaagtaaactaaaggacaatagtacatgtcttgaagaattctacggtgccaacaggtgtgcatgtaatattggaatactgtgaaatgaagggcaggttcgctacatcccagtggatttggagatttgagaagaggagtattttcagaatttttatgacagagccagcactaggccacctaggcgaatagtagaggccacagcgcagcatccactacagatctttgataattatctgaatttagcacatagttgttcatccactacagatcattgctagaaaattgcactcaacaaaaatcgaaaatcagaataatggagagaataaggccattgcaggaagaaaactttgagggagggagagcaggagggagggatgaccataccttgacgtggagtggtgccctcgcgtgtgcccggcgaagcaaattccgccggtagggagaggagggaccggcgatgacgtacggagagaagggaattcacagattcaatctaatgaatcagttttgctaccaactatttcgaaggagaaaagacgc

SEQ ID NO: 105539 - DNA, 724 bp, Oryza sativa
tttaatatgacccaaaagtttggtgtaactctagcaaaagccattcctctatgtgctatggccacatcaacttgagttagaagccaggcagccacttcactggactgctcaaaaacattgtatcaggtatgacaatattttgctgtccagtggtctcttttaccaatcatgatggaaacggattgtcaggtttctctgcagttgcttcagtccaaggagaaggataggtctgatttggcatatgttatcaatgcagtcaaggatcttatgggcggtgacagggaaattctctttagtaaagtctgtcgtagtcaaaaccgggttagccaatgtttagcgaataaagctcggtgtgaatctctgtcaggcctgtggccggataatagttgtaatttcatttcatggttagcgaataaagctcggtgtgagtctctgtcaggcctgtgtttgagtaatatagatccttttccccgaaaaaaaaatgtatggcaatattagatgattaatgtggaatattgtaataaatcattacgtgtatttgtggggatatattgttccaataggataaataagctgagatttggatatttactttttcttccacttgctaggaaagcaaaaaacaaaaaccacaagaagatgaacacgacattaaactaattgtataagtggaacgacacggcaaaagaaggccaacatataaactatacagtgtagctctgaa

SEQ ID NO: 105540 - DNA, 724 bp, Oryza sativa
aggaggacgcggcggccgcagcagcggcggcgaggcccacaaggagcacaagcaagaggtggcggagtgagatccagtcggtcttcttctccaagtcgtcaccgtctctctctcccttcgcccgtcatcgccggatctggtaggtcacgcctcctactccccaccgtgctaccgccaactccgccccaacacgccgctgagggtgaaaggggaaactaccactgcgagagcgggaccacaagcgcaaggcttcgccacatcatcacccaacgcgaagccccaagctgtggcttgacgaaaagtagtcgaggagcacgtcccaaggagaggaggaggcgaaaagaagtcaaggagcacgtccctcacaaagacgtcgtggctctacgctggccgctggggaacacctccagctcgaaaaggtacggcatttgaacggcgtcgccagggataggcccttggccccatatccccatcacataaataggcatcctgtggaaggttagtagattgttggtgttagccccatgccccatcacataaataggcatcctgttccacactagagcttctcgatacagaagatcacatgtgcccggtacaactaagaaaatagctataggccgtgtttagtttcatttaaaaaaaataaaaatttaaagtatactgacacatcaaatgtaattagactcaagatgtgcaattgattttattttcaccatgcata

SEQ ID NO: 105541 - DNA, 2579 bp, Oryza sativa
atcccaatgacggttggagggcacttaggacaattccccttccacaaccatcataaccacctgggcacttaggacaattccccttccacaaccgtcataaccacctctatataaggagctcactctcttcacttcaacacacacctcaagcaatagctctctcattcctctcaagtttagtttagtagtatctagctggtagaatagaaatagaatgggagtcaggagtccggaaaccttcggaagagttcgggtatggccctagcagctttcctttcctcttttgtaagctttgtacttttattagaatactcttctatatacatttatggtattgaaatactttccgagtatatgagtacctactttacattacgttcatgtcatactgaatatacggctagcttatctgggagatgctttggtgcgggtatagtgtttgcttatgcaattactctatgtcatgacgatgatattagagtagtacctagtagtttagacgtggtgtctagattacgatatatcattatttggggttatatattgcggatgagaggtgggccgctgatggtgacagctcaatacgggtattcctccgcgcctatatataatcctaagttaatttcctagggagggttttcctccgtatttagccccggttggatggtcatgatgggctgtcgtaaggaactcggcagtcaggggtggcttttcgaagtaccaggagggcatcgaatagagggtgttagctagtatatcagttaactagaatggatgtatactatgtatattagaagtataggaatagatttcttttctcttttctttccacctagcttagattatttattatgaggatgagcagaaatgcttgtgtgtcactctacccttggattatcttaacccctgcttagaatatgattatcacaagtaatatataaattattagttgagttctctctacatgattttcccacggaataaaataaatacgacacccttagaatactctcgggtgaaatgctacaatggtataaccataatatactagaagtgtttctgcaccattgctgggaattatatttctaataatatcgttaagaaatactaacaccgattcggaggattcccgtaatatgttggctggcgagtttgattcattaacttcatcctaaccacgttttctaaattgttaaatgttaaatgatttatttttgtgaaaaatgttatatataaaaaagtttttaaatataataaaacaaatctattttttaagtgttaaagaaataatcattcattagttgttagtgatttatcttgtttctcatgaagcaaattaggcaagtgggacagctcaaacgcattctagccatacgagggtggcgcctcctgctgacggcacaactgctggcggacggccggtgtggtcggcgcagggaatccacacggcggtgccagcacggggaatgctgcttctgcgctcttagtggttggaatataaatgtaacggtgatgataaagtaggataaaattgtatataggatggtatctccgataactgacttatattgagtaattaattatgtgcttctcgatagcaaaaacatatatcttctaaaaaatagtgaggttttcttacatttatatatgtatagaaagtattaatctgaagcaggcaatcagtgaaaaccggcccgtttggctcgttggaggcagtcaagtaataccactgtccactgccaccaccacttctggagttctagtggctcatccaaatagcggattgatgttcggtgttagtgaatttattcgctcaagcaataacatgagctttgaagaagccattgatgtcgccgcagtcgctctgtcattatagatataggcattggtgatgcagaggttgagagtcggcatgaggaagtcctcggcgaagtgcatctttgagttagtgaagtagcgaatgtcagtgatgcctatgatcagcaacctaaaacaccggtcaaggaaaatgaaacactggtaaaataggatcactggagtggaaatttccttcgacctccctttagcgcttggttaggatcggaagggtttagggcttgtgaggaacaggaaccatgtcgagagagtagtcattttctcgtacgaggcttatttctcttattcctcttaattccattggagtttagtgcgagtgatccaatcaacgcgcatgttgtgcgcacgagtccatagactcataccttttctgttgtagagatcgtcgaactcacgtgggccatgccgcatgcctccatcttgctcggatagccagagatcatgacctagcatttgcatctcatagaaagaataagaccgaatcaatgatccgacgtgaccggcacctgtcttaaaaccggcacttatgtgtgggacctatttggatatcgaggtgccggttttaaaaaattttgcgcgtgggtgcaagggtgggaaaggcattatacgtgtcggttttacatactccggcacctatagtgccgatacctatttacctttctgtagttatgggtgcaaacagcgtggattgacaagaaaaaagt

SEQ ID NO: 105542 - DNA, 1038 bp, Oryza sativa
tccaaactttttgttaccttttaaaacatataatatttaattcattcatataaacaattatctatggtccgtataaaaacctgccatgtttcaaaagtatctatttaatttgtttggaaaacaatctacaaattaaacgtaaattaaaagcttgtttaattgaatgtttagtggtatttttcaaaaaatcctaaagaactattgttgttagtaaataaaactatttgtaccatcaagttagttctctttttagttggttcagattcacgcaagttgttacatacatataaattaacaaacacatatcatatagatcctcacttccttgtaatatttatgatctatagtatctcttctataagaaaatatagtcaacatgagtccaaaaaatttaaatgtaatagtaacaaatatgtaagcattaatatgtataggatagatgcaaggccattaatatgtaagcatttaaaaattattataaaaatggaacatgtaatggttggtccaattttagtgcaaagtacaaacttatttgatttttctccaaatagttcaatttagtgactattgatatgttatttttttagttttattttatatcagctcaaaacataggggttatggatctttaaattgttggtttagttatgaatagagcaatagttagattagaaatcatatgtgcaacttaaaaaatatgcatgttttaataacattattgattttctcgctataaaaaaaggagggtagaggagagagtggagaacttgaggtgagaggggagaggacgggtagtgctatgttgtgcacatgtgaggggagggtgaagtgcacgggaatatttttttctaaatgatttaattgaaaaatgaagatccttattttatcaaaatttctaatttccttttttttcaaaattttaggatgtaacacatgatggcttaagattcgggtagtattgtgttgtgcacatgtgaggggagggtgaagtgcatgggaaattttttttttctaaatgatttaattgaaaactgaaga

SEQ ID NO: 105543 - DNA, 1509 bp, Oryza sativa
cccgtagtgtatcctgggtattggtactatatcacaggtaatgcataacacccctatgtaaattagttgtgtttatggctaacgaatgtcggggcgttacaatttttggccaaaatttttggtatctaaacacacccataatttagatgttattgctgctgaattgtttaacagaaaaaattcttttctaactaacaaagtatgataataggagaagaaatatgtgcaaaaatatgaagacattaagagaagaagaggtggaagtaacgtgcgtacgtactatccttaaagcaaacgtacatacatatatagtaatatacgtacaggccggctcaaggtggaaaaaaaccgttcgtacatactatataatatacttacacgcccaaggtggacctggtctggggtcaggcagtttttcttttgataaatctaatagtggtaaataatggatccacctaatttaatgaaaattaatggctagagaatttttagaaaattctctaatttattatagtgccacgtggcggtgtaggaacatttgtaggatgacacgtggcgacttaggagcgtttgtaggaaatataatggacttttagtatataatagataatagatagatagatagatagatagatagatagatagatagatagatgatagatagagaaacatgttaattacatgagcattgctctagtccttcttttttaccacaaggtactagtaccgtgaggtactgaaatcccgtccgttgatgatggcagatcgaacggtcgcgattacatggtacctcggggtactagcttggtcatggggtggcaatcgcgagtgagccatggtgaaagggtataatcatattttctcgtttggaaggatgtttggatcggtggtttgtttggggaagtgccgcagagtagcaaaaccctaggcttcctcctgatggtggcgcgtggcggacaatacgacggcgacggctatggcggcggcatcagttggtctcgacgctggcgtcttccacttgtcccgtcattttccccttcgtggcggtgcctcatccattcctctcgacaccgctactcctgcgaccatgcggcggatagggtcctggagatccactgcagccacagcccttgcaacggcgtcgagacgactcctgcgactgcgacgatgactcctgcggctgcggctgcgactactcctgcgaccgcagcgataactcctgcagcgctggtgaggacacctgtgggggccacgcttccagaacgattgaggatctgcatctgcctgcggccgtgcggccgtgcggcggatagggtcgaccttcacctcgacttttttctcccgtgcagtgcagcggcgctagatgcaggagaagggaaagcgagagatatcgaggcgcgcacgctatttggaccacacgcgatagctccccatcgtacccctcagcaatcaacggccggatggagactggtgcctcatggtaccagtaccgcgtgctacaaaagtgag

SEQ ID NO: 105544 - DNA, 1257 bp, Oryza sativa
gagcatctcctgctccagtttgtctatctcctcggtcgtcatggcaaccttcgactgtagccaccagagctcatcatgcccgctgcctatctcaccattgccgaacacgaaagtgtagaaaccctagctcaaccgccagagagaaattgctaaatctgtctgtaccgttggcctcctccaaaactaaaggtacaatcactttctttataacacttccaccgtttcccatctccttcccattgtaactgttgttgaatctcacctaatcatcgcgaggccgtgtcagggggctccatgcatgaatattttccatgtcactcgtccatgtcagcgccggagacaagtcagacacgtgggtcaccctgtatttctcagtgattttgcaaaagcgccccactcttattcacattttgtttttttttctcacgatgaatcagtcacctgaggaattgagggcaaaggtgaggtggagtggttgcctgcctgaggaatcaacaacgaagtaaaggacgatggcaacttggcgatgccttgaaagtggacaacggaaatatcgctccactgagtggcgttgacgtggccaatgtggtggtgtcacatatagcctacaagcagccagtaggcgcacgcatgggcggggattaccaggaggccggtggggaggtgcccggtagatgaaactgaccaggcggctgcgtggggcgtgcttcaatgtgcttttgctgaactagtggtcggagtcgaattgatcgaacaggcaatctctgaatcttcttttgatttgcgaagtaggcattggccagaatctttttttatttattcctaattaatacacgaatcataattacctctaaatttattcctagttttgaataaactagcagtatatacatatttctagatggttaattctatttattttgaaagatacttttaacaccacaaaaaattacttctatttttctagagagttacttcatctaccaatatagctacttctgaaactgtgaagaattacttttaataccgtgaaaagttatttcgattcttctagatttagagtgaagagttagttctatttttatttttcttgattcagttatttttctttagtaatgtacttctaatactgtaattattttcttaattctataattattttcttagagttatttgtcctttgctctataggtacttttaatatcatcaacattaattattttcttaatactgtaattattttcttagagttatttt

SEQ ID NO: 105545 - DNA, 639 bp, Oryza sativa
ccaaagagaggtatattataacaactaaaaattaagcattatctaatatagtttacttgcaattttctgaagtttaaccatgttcagaacattgatccagaaattaagcaacatgctcctattcccccatgcatccatatggtgacattggtatacacaaataccattaactttaatctacagtacttcgaggaacttatgcaagcattgccttttgccatgccacacaaacaaaaaatgatttttttcttctaaaaatagcatataagctagttgtaaatgatcatcttcatcatgcatgattaatattcataataacactttagacaaaaacaaattgacagaggaattattatattcacatcacaaaaattaatatcttgtcaactttcagcattcttaaacatgttggagatgacatgtagtataatcttatgaaaacatgttgaactgaactaatgcaacaatccatttcttgttgtacattcaatcccataaaaataaaaccagtgaacattataatgcacaaagtttcagactaagtgtataacagatatatgatgaatgtagaaaaggatgaccacctcaacctttttctagtttctctctctagaaattagaacgtgtgggagtacaatt

SEQ ID NO: 105546 - DNA, 654 bp, Oryza sativa
atagaaaatctagtgagcagaaggctcttacgaaggtaataatccagtgccagtttagcatattaaagttgttctctgaagttctatttttcttttccttattttattccttcaacgtttttttactagcacctatttgaaccattcaatggactaggctttttagtggaatcctgattcagaaacaacagttcaagcgtcatgattgatgacggcatagaaagccatgagagcattggtggggagaggaatgttttgtacttaaataaaacttaaaacattctttctagtgctttggcttggaagttattttgcgcttaatataaaacataaagcatgctattttttcttgctcatattgctatttctgtaggttaaaacagtatatctggaacattttcctcgttcttgggatgagagaaatatcgaagaatgctgtgaaggatatgggaatattcaaaaagttaacattttgcggtcaaaaaagaaagttgtttcttttgttgaattctcatcacggaagagtgcgttagcttgtgtcgaaggaataagcaaggccaagatcaatgatagggaagttaaggtattttatatctttactcataccactgttgaatccaatccaagtaccacttttgctttctttgttttacc

SEQ ID NO: 105547 - DNA, 670 bp, Oryza sativa
ttggtgtgcgtctatgaattggcaaaggccagcattgcaacgcaatgaatgtaatatacgaactcgaaacatttatccccaaatcaagtcctcctcctccccacgtcagacctatgttcttctccgtttcctctactttttttaataatgcaaatgaattacatctccggtctctatccataggcacactgctaaacttcgtttcctcacgaccatgtaagatctggtcatgtaagagttctcaccgtacgtattaaccaagccgtgtaatcggaaattgggttttccaacttcacggctgggggctagggtaagcgttttttcaaccaaggcaggtcaagggtccaagagccttctcctccgagaacttatctccgatgacaagacgggggcttgggagagtgtatgacttaacaaactgactgatcgaagtcggtaaaaaagaggatgctcgtacatgaaacattggtctgtaaatttaattcatttttagttttccatggatattataacatgtcaccatttgagcattcgctcgggggttatttctatctaatattcttttctgagtattgatttcaggaaaattctattcgacattgtcgaaaactccatgtctctatggttcaacaccaagatcgactaaggcgagtacgacaaatgttgacaa

SEQ ID NO: 105548 - DNA, 539 bp, Oryza sativa
aaaactcaggcccgtcactaataacacctatccgtgacaggccgtagtttaggcccgattgagatatgaaatcatatctcaatcgggcctcaagttagcgcccgtcacggttaactcctatccgtgatgggtcttagtttaggcccgattgagataacattccatatctcaatcagacctcaagttgacgcccttcatggatgaccatcatccgtgatgagcaccaacttggggcccaattgagataacaactaggcccgtcacagatgactcatccgtgacctattgagataataactaatgcccgattgagatgacttagtatttttcaacttttcatatgaaatgtttatatttgtgagttgaccagtagcaaaagaattaactgcagtataataacattttattagtcaaaataattttttgggtagtaaatgatttcaaatggaaaaattttcaacaacaaagttgtataacttatcaagatttacaacttttattttggtcatttttctatataacttgaatttgaatttgaa

SEQ ID NO: 105549 - DNA, 881 bp, Oryza sativa
catgggattcctgggaggaggggacggcgacgtgaagacttggcgtcatgcactggtggcgattcgacggcgacgcgacacgaagtgacgcacgtagagcgggattggtggcgagacgtgggtgacgcgcagccgacggtggctacagccggaatttgggtggtagggttcagagcgaggcgacgggagtgttgacggtcattatcgaatagtttcgaccgtcaatattaccaaaatagaggagaactagttatgcttgcaatgcatatttatgttagaataataatattccactagtattaggtttactaaccttttgttgagaatgatcataaagtggaggagaattgacatcaacatagacgataaatcaatcagaaaatgtcgagaatcagacttatgtatgaatgagccaataacttagaattattgacatgacaaactgggccaaaattcacaagtctgtagagaagaacaacagaggaggccaccagccaaaccatgggctagttgggccagccccaggttcggccgaaccagggccctcgtcgccgttggatgcagggcttcttctggacggtgtggattagctcccaatgacggttggagggtatttccgactattccaaccgttacaaccgtcattgggaggctagataaactcctcaccttctcacttcactcacacacctcaagcaagctctctcatatcctctcaagtttagtttagtagtatctagctagtggaataggattagagtaggaatcaggagtcggaagccttcggaagagttcgggtatggctctagtagctattactctatggcaagggtagagtgacacacaagcattactactcatcctcataatatattatctga

SEQ ID NO: 105550 - DNA, 2141 bp, Oryza sativa
catatatatgagtgtgattttctgttataactaggaagaaaggccccgcagatgcgcagacatcttatttactgttttatgaaataatgttaaaataagtcatatctcaccatttatacgctgtgagatagaccatagactttaatatatttaagaatgcatgttagacttaaaaaaacatcttgtcctagttccatatagattcttctacagtcacacaaacttattatcactattttaaaagttgagtaatatatgaaactatatatgtttatttccaaatccatatataaatattctaaaaacaccacttctaccgattaataggatacaccattaaaattaaaccattaaagttaaacataaatgctgggtgaagatagtcatagtcatcgagactttcttactctagtgccttgaatgatgggtctctcattaagatagccgtgcacgtgctctctcgagatcaacctagagcacaattttaatgtctaatttactatcacacccttatgtagtattgcattgtcatactggcaccgccttaactcagtgtatatacgcccctgttatacttacgatagcatagcaaacactgttgtttatgcttggtgaccctaggaaaggacaaagaaaagataaaggtgatcgacatagttgtgttttgaatcgatttgtggtacagagtagacacggtatgcttaagattttgatcattgctactcaaatttttatagtatagctagaatactctcattcataaagaagcaaggtccatcacccgatggtagttaaataattagccaaagagagacataccatcacaataatctccagagcactattgtttatattttgacaaatacctatagtttagcacctgatttgttttaacacctactgttggcaacaacatgataaacctttactaatttaaatgatgtatttatacttctaaacctatttatcaattacgtagtatatttatcatgtcatatttgacaaatatgaaattattttaaaattataattacattaattttcatatattagcccgagatgtggtgatgcatttagaatcggaatacaaattttattagacacaaatattttatttaaataaaggaatacaacaggatcacaaattggatatataatttaaaagataaccgtttcgagataattgattttatatttgatatttatattaccgatctaatttatatttctgcatatttgtggagtaatatatattttatatggtaaaaagttatattttaaagaccattgattttgttccaatgtacgtatgttttttattaagtatgtttcttattggctttatccttttttatggtaggtacgtgctttttttttcctcataatagttatatgtaaccttttttctcattttacatacgtacttatgtttttttgttctttgaccatcgaggtgcatacagatctactaagcacgctatgttttattttagcttttgtcgtacatacaggagaaaggtattatatatatagagagatctgatttattgtataaaattatgggtccaccatttaagtgaaaatcaacagcatatatctaatctaacattataaaataacgggtctaccaatttaaatgaaaatcgatggtgagattaaattttgtcacgtggcatcctaatagcatttgtatacagatctactaagcacgctgtgttttattttatctttcgtcatatatacaggagaaaggtattatatatagagagatctgatttattgtataaaattacaggtccaccatttaagtgaaaatcaacagtatatatctaatctaatataataacgggtccatcaatttaaataaaaaattgacggtgagattaaattttgccacgtggcatcctaggacctatacatgtaattcgaataccttctaattataccatattttgtatgttattgatagtcagagtttgtaatagtttgacctcaatattgtccataatttttctacttattagctgacaaaaatttcctcaaatccccgttatatgtgcctagctttcgcattcaatcctctagtgaacagagttcgagcatgaaggagggagccagaataaatacaacggcagtggttt

SEQ ID NO: 105551 - DNA, 1499 bp, Oryza sativa
tatatatacatatatatatatattctacacccggggtatagaataataccgccctccccctcaagagcccaacccacctccgcatccttttattgggctcataacccacctcccatcccagtcaaagcatggtcaaaggacggtcaaatcgctgccatgtcggtcaaaccagtgtgctaacttcctcccacgtctacctatttgttgtcctcgtctcgtgcgaactgtgcagtaacatgacgaccaccatgcagtaacgctgtagcttacttgcagtaacactaataaaatatagttaaaatatagtcttgacggatctagttttgtagagctctttttttaaagcattatggtgcaaaaggttcaaaaatataatatgtggtgtgagagatattattgtttaaagatgtgaattcaaaagatatcactttcacttacattttactagttcaaagtgggtggtaggtcttgtacctgtgtttggttgttaccacctgttattgcagtaacgctattaagaaattgcagtaacacatgttactgtaaaaattatagttgttactgcacacatatagtaacgtcatgatggaatagtagtaacacaccataaaaagtagtaacaataatgatttagtattactacttatggagagataaatttcaaaagaccaatcttcgagaagaaatagtagtaacacactcgattactgtaaaagcacataaactattacaactctacaggacacacaaagttccatagttgtaggaagctaagtagaagagaaatatatatgttattacaaaactcataacaagttactatgttttagtagtaacattatcgtataagtatagtaacacatcacattactacaaaacatataggatgttactgcacttttgatagtaacatcgtggtgaaattatagtaaactaggaattgaaacaaaaatatatgagttaaaagtctacatgctaaccatatttttgttactgcacaaaagtgtaagtgttactgcatggtagatacacgttaccacaagtttatgcagtagcactattcaagaattgcagtaagacgattttttactacaaaacttataatatttaccacactttcataataacgttatgatgggattgtagtaatgtacaatagatagtaataacacttatgatatagtattactacttgtggagagttaaatttcaaaagaccaatctttgaaggttctctctttgccccatgagtaaaccgagccaattcatctctctccatgttactgcacctttttttcttactatacatattcttgcagtaacgttatcaagtaatcgcagtaacacactatgttactatgaaacttacaatcgttactacatcttgtagtaacgatattatgtgattgcagtaacgcatagcagatcagcagtaatacttatgatatagaattactcctcgtggagagtcaaatttataaaaaaccaatctttaaagg

SEQ ID NO: 105552 - DNA, 1196 bp, Oryza sativa
aaaaaacatatagacacttctcaactggagatgatagaattgcaacgcgtaagaaatgtggctatttacattactactacaattgacgcatttagatattctaagacgtaatggtcgcagtaatacatgataaattccttgttgttaccatgatattcttaatgacaaatcaagatatataaatccattaatgttatagctgtacttttgaaaaaaatatgttgagaacataagaactactattaggttttgagcgccaaacatatatcagcccaggccaaccccagcccacgtcccgtcatcccactactagcgttgtcggagtaaacgatttactcctatcgcatgtctctaccacccacctttattcgagtaaacaatttacttcgataataaaaacaacttccctgcttccgatcccaccccatgtcccgcatcgtgctctcaccattatcggagtaaatgatttacttcgataaaaacaacttctctgcttccgttatatattctatttttcccatacccaaccaaccactctcgcccatttttttcctttttttttcggatctgaatcgatccaccatcctagcccacagatcggcgacacaccatggaggacgacgatgacaccgtggcggttgatggcagtggctggcgagtggtggccagcggcaattgaggcgacgacactgcttcgggcctcgctaccgaacgctgggcagcaccttaacaagtaaggaggtgttcacctgggccaataccaacaaccagcagctgcttcacgtttgcgacattgatagaacaaagaagtaaggaaatgacactctgatttgtatctacatactctccttgaacttcacacatgaagccccaaattttttttgcaaatcaaattaacatgcaatctccaatattacctgatcttaattgttgggctgcataggtcctacatttgcacatcgtgctctatgtggctggacacagaggatagggtagagtccgctggtgatggaggttgtttgttatttttcttttgctcgtcatttctattgacatgaacgagaatgtttttgcaattttttcgtgcttgcaagatgattgatggctgctactgcgcaacgtcgagctcgtctctagaccacaccgctacatccttccatgattccatcatcgactactgctcaccacctagttgc

SEQ ID NO: 105553 - DNA, 591 bp, Oryza sativa
ccgaggtcagggttctgggattcaatagcgtaaaaatttcgggacctaccaaaatggatgaatctcggaaatttcagatgaaatttgaccgaatttggtgcaaaattcaaacaatcattaaaaaaatgggtaaaatgatcagagaaccatgacaagcatcaacacaccaccaaaataccatttaatacgcattaatgcatagatctaacaaccaagttcataacaacatacatagacttagcatgcaaattcataactgtgtagtccattagtctaattcatcaccatgtctaaggtctaaaataattacagtctatccatacatacacccaaaagaatactaaacatatatccataataaatattagtcatgtaactgtcgtcaattgctactgccactagctccatatgtgtagatgaattcaatcaccatcatacatgcattcataaaatactttgtcggtgacatggaaccgggagtagcatgactagaggcttgaggcagacacaatcgcccacgtggcctggcaccctcggggggcgtcgggcccgagggtgatgcgttcgccctcctcttagtccccccgagag

SEQ ID NO: 105554 - DNA, 665 bp, Oryza sativa
ggtccaaatgccaaacactgttcatcaatatactgttgcagaggaatactatacttcctccgtcccaaaatagccctcaggatctgtcccaaaatataataacttctcgatcaacattctcttcccaaccaatcacaaccctccaccgttcactttttccacctatcttcactactcatctaattataaccctctaccactcacttctatctattttcttaataaccgtgtccaatcctaaaactttttatattctattaatgagggagtagttaattagcaagaactcctagattatatgggatccttatacgtaacatctcgagagaaatttggtcaatgcttagcttcaattattttcaataaaaaactaatactacatgtacggcaaagtaaaagttttcaataggctagtctatattatctcgtctatctcacttgtactctttccatcttataaaaactcaacaatattagatatgatacattgtaatactatgaatttgaatgtgttaagattatattgatatttgatgggagggatggagaatttatcttcctactaccttggatgaatggatcacgtgactgtctgaacaggtaaaaacaagactacagatgagctgtgacctcgtgggttggcagataacagtcccggtgcgtgg

SEQ ID NO: 105555 - DNA, 696 bp, Oryza sativa
cttagtctttccgcgctgttcgcttctgcgccgtcgtttttatggttatttctgtaatgattgtgttgtttatctatgggcctgtccatgatgacaacttatgtaagaactactacccggtgatgtaataaagtagtttactttgattcatttattctgtgtgtaccagctagtgtatcctgggactggtactatattaaaggtaatgcataacactccggtgtaagttagctgtgtttatggctaacgaatgtcaggcgttataattttttgtcaaaatttttgggatctaaacacacccataatttagatgttatagctgctgaattgtttaacagaaaaaattcttttctaactaataaagtatgataataggagaaaaaaatatgtgcaaaaatatgaagacattgagagaagaagaggtgaaagtaacgtgagtatgtactatccttaaaacaaacatacatacatatagtaatacgtacggctcaaggtgaaaaaaaaaacgttcgtacatacatatagtaatatacgtacacgcccaaggtggacctcgtatggggttaggcagtttgttttcttttgataaatctaatggtggtaaataatggatccaccaaatttaatgaaaagcaatagctagagaatttttagaaaattctctaatttattataatactacgtggcggtttggaa

SEQ ID NO: 105556 - DNA, 533 bp, Oryza sativa
caaattgctttttaacctgctattttattttgataccgattggtctgagtattttgatactgattctgttagttattagggtttgccgttgttcttttacatgatgcctttgatactataactggaaattaatattgcacacagattttctgatgtcattaacattttaattccactaccagctttttattactttcaaacacatattgatgcagaggtactggagttctctgatatctcttgctgttatcttttcatttcacgtcttaacaaacacaatgccatatttgaagttgttgacatctggtaatgttgttgttctattgcatgtcataaagaaagttgtactgaaaaaatgcatgcaatttaccaccaattgtctaggttttagttcagtgctatgaaggtctgttttgtagtagttggctttttttgtgattgagttgtaattctggacccatattctagaatgcacatatgattgatatttcagattgattatttgcaattatatcattcctatgttaaactag

SEQ ID NO: 105557 - DNA, 627 bp, Oryza sativa
catttagttaagtttaattaataactaaactgagctatcaaaagtttataattttttttcacaaaactacatgtactttggaactatcacaaatttgtagatttaagacaatatatcacaaaactatttaagatggtgtatcacaaaattacagatttaatactaattttattacaaagctacaatgttcatgaatccaacgtaatagtaatgctagagatctaaactctaaaattaacactttagttttcatagctaaatatgtagttttgtgataaatttgatattaaatttgtagttttgttatatataccaccttacgtctcagttttatgataatttactcaaagtattcatacttaaacgaaaacagtcacattgtcaaacaaaatcaccataccatatattgtaagggtaatttgtccggttttaaaagtttactttattttagtgtgaagattgaaccacgagaaaatttgaagggcaaatgtgtatttctaaggcagaaatcttaaagaaaaaaaaaagccaagtgcccatgcgctaaacagaatatacaacttagggtttgtttagttcccaaacaaaattcttcacatcgaatgtttggacacatgtatggagtat

SEQ ID NO: 105558 - DNA, 727 bp, Oryza sativa
attcctgcagcccagcgagacacaacactgaactatctgacacttgatgtatcgtgatcaacaatataatgaaattgcaacagaccgacaacaggactaagcatgcatctaaaaccacaagccatataattatcacaaacaaaatggcatgtcagctaacgaggtgaaaaccactatgtacacgtttgtagccaaggaaactaaatattactcctacatcaactgcataacataaaagtttcgtgcagaattatgcatcgtcatgatatatgaaggttccatgacacgaacatgctctaatattagttttcttacacaaatcaacagacctttttgataatctcaaatggtgttccgaaactttgaatctctggaaccacacaacatctcttggctacttttgaagtcaataatcaacagtgtttaaatattccttacaatctacacctatggataattctatagttccacttcaaaataggtgtgaacagcagttatatacacctcctctctcagattgatgatgcacatgcgtattaatcctgaaaccgcttttcatgagtgcagttaaaatgaattcaagctaattgagagggtataaaaggtacagattgagaaacgctccatctcaacttgaaacaaatctgggtgtgatattcctatgaataagctaggagattgcatcaacaatctttccatgtttgtacagaaatagtaagatttttca

SEQ ID NO: 105559 - DNA, 609 bp, Oryza sativa
ctccaatatgccaaatgatgggctttttgtcagccagtgaaaaagagaataagaatgaatgtacatgggtactttattgacgggacaaccgaggtggtgggagaaaaaaaaaggagaaaacatattagggataaaattggcatgaaatttttacaatttggtcttttttgaaaactttatttatacgaatagattcttggaagaaatatttctaggaatggacagaaaatagatccattctgaaaatggtttttgaggggtctattttgtaacttttttataaaaaaaaggtcaaaatgtaaaaaattcagtgaaattggtagttagaaaaaaaaatccaaggtcatcctatttgttttctttaaaaaaggtagtaaagctaaataaaagcatcccggattcaaattttgaagcacatcccccttttacttttcagagaaaaaaaagaataaaaaataaagcaaagccggcgggcaggtagtcaggcacagacaggtaggccccgctcccgctccccttggaatcattcgctcgcaacgcacacccgcacgcacgcgcccacgccaacgccaccacgacccgttccgtctgttaaaaccgaaaccaggc

SEQ ID NO: 105560 - DNA, 1182 bp, Oryza sativa
ctagagagtgtaagaaatgattgcttgttatcaaagtataaggcaggcgtactttatttcgttaggatacatattttcttctcgtcttacgaggagaataagaggaagatattgcgccgactttcaattttctaaatttatattctttggaattattttccttcttttcgttaattaatcttcatttttataaccaaaccggcggcctttgacttttcaccggagtacacacatacataatatacacaattaatcttgtcgatcgatgtacgagattaatattaaccgaactacagtggtgaatattcgtagtgtatatatatatacttactactacagtatatatatatgtacatagtagcaagtggcgtgcccccaaattaaataccaatatatcacttaacatgtcgtcgtagcagcagtgcagtacacacgttgtcgtttgcagccatatctatctgcataatgccgcagtatatgcattatgcacgtacctacgtgtacgtacccgaaaaatccgggcaatatatatatttattcatacaacaacacatatatatcttgtctagctagcaatatggtatgtagatcttgccacgctgtgtactaccacaggtacgtgctcgatggataatgtcgctggcaatatttgcatatgcagcccttgtttagttctaaactttttttcaaaccttcaacttttttatcacattaaaactttattacacacataaatttctaacttttccatcacatcgttttaatttcaactaaatttttaattttgacgtgaactaaacgcagccgcagtgtggtagcaaaacgaaacattttgtgcagggacggactttgatgatgacgagatgtatctcctcctttcagcctttgaaggcagcggtgcgcgtgcctgcaatagaattggaattttaatcttaatagttaccgttcttttctccaacaaaagttatatggggattaagattttcgtggcacgtttttcaaactgctaaacgatgcgtttcgtgtaaaaactttctatatgaaagttgctctaaaatatcatattaatatattttttaagtttgtaataattaaaactcaatcaatcatgcattaataccacctcattataagtaaaaaaaacttaatattcatcttcaggagaaaatatccctccgtcct

SEQ ID NO: 105561 - DNA, 924 bp, Oryza sativa
gagaaaatgaagcagaagaatacatatgacttgggtagttcaaagctgcagggtggatttaattctagtggctgcaattttgatggccttctcaattccataatcaaagtggtatgaacctctaattttcctttcctttttccccatatagttttaaatatttatctacatgaatatgctcttccttctcattgagtaatttaaattgactccactgtatttaagcacaaagaacaaaggccactctaaatattaagctgtaaacagttgtaacctacacataaacaggatatgcctagcagtacctaatatttgcattttccatcttgttttatattatagaaatgttcttgagccacatttaacttggttctaacttatctaatctccatgggactttaccttttgcatatattcttctgaaagaaatgatggtttactgaagccttaattctaattccaatgcaggagaaggatgatctcccattcatggacaatgaattgggctgtgacctttttccacttggtgcctgcatatgaatccatcatttcggacaccaaagattttgcataatctaaaagagtcagctgtgctgcctgatctgtgctacttcatccaggctttgtgtatactaggatctagggacagtagtggcttgtaatcttgctttatctcttctctagggttggctatggaagtatggttagatcaagataagaagaaaatataatgctgtaatgtcagcgccttttctagtcaaaatctgtgtttgtttctaaccaagcaaccacatctagtgtttgctgcaccttctcagactgaaaaaatatggaaactcaccatggcatagataaatcaaaagggaagtctttaaccatccaagtttgctacaacattatggttcaatcttggtaaaaggtaaa

SEQ ID NO: 105562 - DNA, 2916 bp, Oryza sativa
agatgaataagccagtgatttcgtgatcaatcgatatcgctccacgttcattggtctcacatggtatcagctaaggttttgattcctggcttccgctctctcgccacgatcaactcccaacgacacgtgagacctctaatttctcaccgacttttgcgtctttcgccgcatatatgtgtatcttgtgattaaatctgcagttgcagagactagtactactaaattagttcaggttgttgattagttattcataaaaaaaaagaacagatctgaattacataattttgcgcttttcccttcccttttagcctctcttttgctttcttatgttcattagagtgcttcattttgtttgatgattcttcttcagtatcttgatttgatgatgatgtgtaagctcctgactcagaaatcctagttctcttgttcttgtcatcccctttttgataatgctacgtgcaggtagtccatgtcttcacagacatgtctatttcatcgagtctctccggttgatccttgagctctctctacatatactctaaggtgaaatgtttctcatttaacttgttcttgtatcatgcatgagctttctccatgatagtgtcatcaaagtgtccactggtatatgtattttttaacttgagcatagacactacaaaactttgcaatatcctacttaacattaccctaatgtgtcttttggcgtcgagattacgctagagatcatcacaagtgcattctctcttcataaaaaaaaagataatttctagggacgaatctaaataaccatttatctatgtttgtccttagaagttgattttttgggacggagggtgtacatgagaaaaggaagccatgttgccctcaacgtgcaaggtgttggcaatggcgaaaactgagcaaattgcttcaagaagtggttgcatttgctggtgaggtgcatcaacaaggtggcctcactcatcaagccatcacctctgtcatgtacatcgtagtggagcagaaggtgactattgtgattgtcatacatattgcattcacggcctgcatatgaggaagatgaaattgaggataaactgcataatttcaatattcttcagattttccctgtattagctaatagtaattaacgattcggatctattgtcctctacagcgacacgaaaaaaatcacatgaacatcaaaagatgtcgactgatgattggtaaatgatgacactcctaccctctttaaagaaaagtcaaaaacaaatcatcacattagttagtttttcatttaatatgtcgggatcctatctctcaatgtgtaaagtgttatatactcactatagtatttccaaaaaattcaaaaatagtgttatttgtacgtctttacggatatggggtgtgggtggtaggaagtgactagaaggctacgtatgcacacggaccaaaatatttcccgcgtatttttgcggatactacatcgtaaacaatatatatgcatgtgaatatcctagcttctacaaacaaatgaaatcaaaaggcagataggctacaagatctagaaaagccattcaagagttgttccttaccagagggaataggatcaacaagtagcagcaacagagtctccactttctagcttcttccaccttcctcatggtgatccgtcaaaaagagagcgcaatctatgtacatggcagagcagcaaaaagctgagctttttctaacagaacacctcgatgcgttttacccattttatacatgccaaaatagaaaaatatatattaggaaatattttttttaaaaaaatatttttcttaatactgccaacggttcagagaacacatgtaacggtattcatgatatttaatcagccagtagcccagcagcgatagaaatgtcaaggtgtaaaagaaacgagatacgatctccaattaactgagatgaatttcagttatatgggtgctcgtggaattacgatccgtacgtgcaatagttagatttcctcaagtgttagggaccgtttcacacgtcatgactgtacacgtggcacaacatgcatgtgtgcatgtttttcaaactgctaaacggtacatttctaatgttatcatcttgtgtataggaaatagggtgattgactagtgcataattaattatgtattattttttttaaaaaaaataaactaatatgttttttctacaacaactttcctataaatttctttacaaaacacacaatttaataattaaaaaatatgaaaactagagatagaagatgataaggggagcatgaaacacacctaaggctgagtttgtcaggaggagatggaaataaatattatgcacacggaacggtccattagcatgtaattaattacatattagctttttttttcaaaaatggatcaatataattttttaagcaaccttcgtataaaaacttttttgtaaaaaaatacatcgtttaatagtttagaaaacatgcgcacggaacacgagggagaagagctgggaacacaggctgccgaacacagcctaaggccccgttcacttccactacaaaaagtggataaagtcttggatattcgtggtacgcttttcaaactgctaaacggtgcatttcgtgcaaaaactttttatataaaagttggtctaaaatatcagattaatttattttttaagtttgtaataattaaaactcaattaatcacatgttattaccacctcgttttgcatgaaacacttaatctttattttcatcttcatgtttaggagattcaaacaccacataaatcgtatcctagacagggacagatgacatatcctctgcgttttctacaaaacttacaaatattcttttgtaccaaaaaaaacttacaaagattgtcgtttggcctttgctttggtaaaaatatcatgctatccatcacg

SEQ ID NO: 105563 - DNA, 681 bp, Oryza sativa
gttgatggatatttgatcgaatggacgatgcaagaaatgagaaaaatcaactattcgagaagtaatcctggtcttctgaggataattatttactccccgtgatgtatctagaacgaaaattatgagagatccttatgctaaattatcagggttccttagctgacccatgcagtagtcttatccaatttaaattggttagtgtgtccttcatgggataaatatgtactctatcggtcccaaaatattgcagcttttagcctttagaattttctcaaaatataaaaacttctccaccaatattcgtttctcaatcaatcacaacccttcaccattcgatttcttcacctacctccacttcttaaccaatcacaatcttccaccatttaattttacctaatttcttaaaaaccgtgtccaactctaaaactttttaggctatagccaacgaaaagaagtggcacttacctctagcctcccacgttggacgcgaggtcaaaaggcagctaagagcaagcgtctgcgaggaggctcgaacctcctgcccacgccatgcacccctgcgtgaggcgccgctctaaggcaagggttcgagccgtggctcgtgttgtgtagctcgaggcctctcggttgtgcagctttacacgctactaaaaaacggtttttcatagcgttgcacaataa

SEQ ID NO: 105564 - DNA, 645 bp, Oryza sativa
ttggctatactattaaacttgctcttaaaagagagcaacatgccaagagcaatggtggtgaataaggttgtcaggatcgggatactaggtagtatcgttttgcttaaagtaataccgtatcgtaggatcgtatcgtagtatcgggatactatgagattttatttttttaagtttaattaatatttatattaattatatatggctattctataaaaaaatatagtaatgatatatgtcatgcaaatagagacatttatcaagagaaaccacgttggttttgatatatttaaccgattttcatataaatttgagtatatttagttacattattttcaaaccatgttattttaaataatattttgtagtatcgtagggatcgtagaatcgggatatcatctaagatttcgtaggatcgtgtagtaatgaatagtaggatcgagatactattaagatactaggtggtatcggtatcgtttcggcttggtaggatcgtagtatcgtaagatattaggatacgaatcgggatactgacaaccttggtggtgaatgcttcatgcagcttggcctttaatccatggctgccttgtgtgcgtgcacacatgcgcatactggccacacgtgctcctctccgtgcgctcgtgtgca

SEQ ID NO: 105565 - DNA, 726 bp, Oryza sativa
attcctgcagccccatcaaatgaactgtgcaatggtaacctgtcagcagaaaatccaccatctattggaagagcaccctgctgggatatactagaatctcccaaattggtggaaaccccaagagtcctctcaagaagtgctgaactagaaggcggtatccgtatcgatggcggcatgctaactttggcttgtttgcactccaagagttcttgtggtggcaatgaactgcttggaactctttggagtgtgctggacaaagtgttggtcagagaactcccagaaaaaacatcagacagaccattaccttcttgatgaatccagttctgttgaagctgaggttgcccgatcgccgcggtcaagccttgtgctagatttgcctgctggttttcttccaagcaatggccaactgtgacatttcctgtagaagtctgaattgtgctggagggggcagcaagctcctgaagtccgaaagccgcggcggcgctagttcgggttagcaggccatgtggattgaaagatggaagagcagcagaaggtgcaaaaggttgatagctctggagtccttcaaatgctccaatatgcaagaaggagggatctctgcctccaaagcagcaacaatgctggcttgttgtgatgctacagcacctagtctcttgaggtaaagcctgtacttctgcatgtcacatgaaaatcaactgattagatatggacttgagtttttaaaca

SEQ ID NO: 105566 - DNA, 1043 bp, Oryza sativa
ttcctgcagcccctgggccaaggccaagaggctatatagcttgtgtaatggcgtgttggagtacaagtcagtttcgacctggacgctgtctggacgagaggagcaacacctcgacccggcagttattacgtttaacggatagtgatactaatggctactacaccctttggtccccagaaaagataatgcgaatccctgttttaagagttggagcgtgaacatttttgcgtgatcttatctggcgccgtcattgttcgtgtaatcatttttgggccaacgtggcacatgcgaagctgctgttgtattaggaccccgagtaaatggtattaagcgtacgtacttgtttttgcttgaaattgagctatgtgttgtttttttacctggatgaattacgcactgttttctcaaataattgtgtaaaattgtttagttgaagcgaacaagacatgttttgccaaatgttgctgcatgtgagaacctagaaattgttcataattctagtgtaaaatgaactgatccctgaaattcctacaagagttgtatatatataattcattcttccaaacaggatcttgatgcttaatttgtagtataacattaagcgaggtactgtgtgtgggggtatcattaacttggaaattcaactatgtaccaagaaggaagcaattaaattaacatgcaataattcttccagatgattgagctccaattttgaaaccgaagtagtgaaaattcgagatgctgccgaccagtgaaggtttcccgtgcagcattgatctcttcaattaattaaagattccggattcctccatcgctgaatctctcgcaacttaacaataacttcttgtctatacgtattaatgcaacagggtctctactccactctccacatgcatgtgtatttgcaaaatgcaaactagtatgcgtacgttcatgcacggactcctacgtaccccaatcctagatacacatatttgaatatcgtggcgcttgcaataagtgacagtcaattttcaacccacataattataaattagcatccc

SEQ ID NO: 105567 - DNA, 630 bp, Oryza sativa
aattaataaaaattccaatatatatatatacttagcatatatatgaatgatattattatattggtaaaaactctaattaagatatgtgtgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacata

SEQ ID NO: 105568 - DNA, 709 bp, Oryza sativa
agccaagggtagctaccattgtatgcctacattacaaggttttcaaattgcctgccaagcttttgtttccatgattggaaaagtttacctttctctttgctgtttgtttctgaatcgcatccatcatccatggatttcactgtgactgagggttgcggaattaagttgtgtacattttgggctataggctttttaattagtcccctgtcccctgcctgggtgaagatgctgtgcttggattttaaatgacatggtagtagtagtacgagtacatagtacgtagtattcatctgtaggctagccaactctcctggtgaaagctttttttatgaagttgtgagtagtagctgtaactgcatgcatagacaacgagtttaactgcagtacagtaacattggcttccaactcgcaatgctgtattgttgttgctgcgtgtaacagtgctctgggatctgcacatttctgggccattattgtgaatctcttgcaatgaagcaaaactgtgtcattatactgttccaatatagtagcagtacagatttacaaggacactggtttggagtgaggctccatgcttttttctgcacacatggtagaggtcagtaaattacctgtaaaaaaaaatctgtaacagccttctgatctataaagaatccaggccaatccaaaaggcaggaaaacaaatctcacttgtgcttgatagtgcaaa

SEQ ID NO: 105569 - DNA, 635 bp, Oryza sativa
ctcacgtacagctggtttgtgtgagtcatgtagctacaaaatgaacacaaaaaatgtttgaatgttttaaatgctgcactgttcctggcacgtaatataatcatgccacgacaaactttagaactggtgcaatttttatatactccctccatcccaaaataagtgcagttctgcactattcacgttcaacgtttgaccgttcgttttatttgaaaactttttatgattagtatttttattactattagatgataaatattttatgtgtgactaaatactttcaaatttttcacaaattattcaaataagacggacgatcaaacgttgggcacggatattcatggctgcacttattttgggacggatgtagcatttttttttgcctgcggatggtaactattcatagtttctacgaaaattgaactgattgtgtactccctccggtttcattttaattgacgctttggacaatgacatgctctacaagatatatctttaaccttatttttctattataatatatacaataaataaatgcatgttacttttattatagtgttttgaaagacaaatctatatatgtttttctagtttctttaaactaaatatttttaaagttattgatggtcaaagtt

SEQ ID NO: 105570 - DNA, 543 bp, Oryza sativa
cagtgacataggacatgtcgcaggcaaggcgaatcgatgtcgacgaccactactgggactacatcgagccggaatcataggacccaaaataagattcctaaggaagtctacaccataacagaggtggacgatcttgggtatccgacggctccgacgaaagctgtcaaaaagttccatacgatatgcagagtcctagggaggcggaacttcactattctgaaggaccacatcgatctggtccctcaagaagaaaaagaagaggcatggaggcagttcaaggaaagcttccgataccctgcagaggccgagctatgactgaagcggcaggctatccgcaagatggggaattgttggaaaaatttcaagacaacgctggtcacggtgtacgtcctcaacccagcccagccagaaccatttgtgaaatacccattcatcaccaaacccgtgtgggatgagttccatgccgccaaatcaatgaatgagtctcgggaaaaaagccagacctaccgtgatctgcaggccaggaaccttgacccgcaccgg

SEQ ID NO: 105571 - DNA, 645 bp, Oryza sativa
tttttgggttcgtcatccgtgtttgagtcagttttaattttatgttttggtattttggtacatcatccgtgtataaatcggtttttaagttcgtttgcttttgaaaatacatatccatattttagtcggtttttaagatcgttcacttttggtatacaaaatgaatcatataagaaatctatttaaaaaaactcgcatgctaacttgagacgatcggacttctaactgcagcacatgattttctatatatatatatatccaagcgaactcgaacagtaaatttcattttatctaaaccatataacaataataatattaaaatagacttcacccgttgcaacgcacgggtatttttctagtttaattatacatgcaaattaagtttgcatgcatgtaaattaagtttttgtttcttgtgcatagggacagttgaagtgtgcatgttttttatttttccccatcacatactcgcatacaatgaaatataggaaagttaaggcttccatggttttagcgagaaaaacttatatgatgactaacagagggagtaaacaacagtgcagatgcaatttgcaactaattgaggcactaataaaaatattttttttctaaatacatggtcctgccttgcagtctggcaaaatt

SEQ ID NO: 105572 - DNA, 742 bp, Oryza sativa
aaagatgcgccatataaaatgatctcatactgccactcccccccaaataaaatgaacaagtgtagatggtctgttcttattgaaaaaacccaaaaatcacaagtgtatatggtctgttcttatccattaaaaacccacatttaaacctaaacaagaacaagagtgaggccggcccaaaaatgcatccattttgcaaaacatcccgtactgccactccccccaaataaaatgaacaagtgtagatggtctgttcttattgaaaaaacccaaaaatcacaagtgaatatggtctgttcttatgcattaaaaacccacatttaaacctaaacaagaacaagagtgaggccggcccaaaaatgcatccattttgcaaaatatcccatacagccataaaaaacataccaaaacacatttcccccaaaataattcaaccatcacagcccacatcaattcatccatcccattggacccaaaatatcccaaaaatggtatgttcttgagcaatcatcactggccattcatccatcatagcccacaatatttcatcatcacagcccacatctaaacaattttcatcacatcccattctcccccaaattcacaaattcatccatcacagccatataaaaatgtatcagtagctaacacatatagaaatgcaccagtcatcacagccatataaaaatttaacagtagctaacacatatagaaatgcacaagtcatcacagccatataaaaatt

SEQ ID NO: 105573 - DNA, 602 bp, Oryza sativa
tatcactcgtcgacagtggcgcgccaggtagaggcatctggtactcaaggttctactactatgccatccagcttcgtcgacaacaacgtcaacaccagcttcagccaagcactccctacttcaacaatgctggtatggactcatgtcggcgaaattgtcttcccggtttacaccacgatgccgatctcaaccggtcctccaatgactggaaatgagaatgcagtggctacgaaccaaggcaactccatgtcgaaaaatccacccgtcgaaatggagaacggattaccgactacacccaagctcgggaaggattctgatgcggccaagccttatccttctgacataaatcacgggctgacaaagatgacttccgaagccaccaggtcttggtgtcctatccacaaaaccaagaaacacacccttcaagattgctgggtttttctcaacgtccgtgctgaaattcgcgcctgcaaagaccgtggaattctgtcacatcctgattttcgtttcaggatttataaattatttaataaattattaatagaatttatattaaatgtcctttaatttacaagtgaagtaaaatgtgggaaataaaattt

SEQ ID NO: 105574 - DNA, 974 bp, Oryza sativa
gaccacatgcaacattaaaaaaatcaataaaaaattaaaatattttgttgtcaaaatataattatgtgtggtcttgttgtaaagatttaattgtaacgaatttagtggtgcaatcagatcgtagattagataaatagtttacgataaaaattcttttcaagaaataagaaaagaaaagattctttgcatgctgcagtggcaggaaaaaacaacgtctaatttttctccaacccgccggtggttcgggtgtgagcattttcacgaagaatgggttaaatcaatagtgggccccacctaacttttcgtccgatattttgtttcgctccggacgctcgatacgaagcgttttcgttcaaaacaagccacatatctcatccagtcccaatctgatttgggttttgggcctcgtaattgtgtcgtgggcttagcccaagtggtgtgcaccctaggcaacactaggacgtccctaatcacattattcagtagccgtcatcgtttagagttgggttttgcttagattattatgtgaagaatagtttcgccgctagttcggtttgtggaaccccaaattctagtgcttaatcattcatatgcaattgtgttgcaatctatcttgttcttgcttgtgttcttcgattcgcatgaagggattagccttctcggcaaggtcaactgggtttcggcacggttgataaccagaggagacatggtgctgcgattgcggggctcaagagcgtgcacgttcaacaagccggatcaatttgtgtcgtgactccacccaaatcgttgtttatcagaacctttcagaagatcgggaaccctagtgcacatcaagtggtatcagatttagttgaaggcatctgagaacaaccaaggtaatgaggtggaagagaagaaagactaagagcaaaaagatctatccatagctccatgccatgcttgaggaatgtttaattgaccaagcgcttacaatt

SEQ ID NO: 105575 - DNA, 574 bp, Oryza sativa
ctgtttggggatttgaattcgctgggtgtagtatagatctgacgatctagttgtgtctcctgcccctggagggcctcctgcccgccttatataaaatgggaggcaggattacaatataaaaaccttaaccaatacggtatcggtttcctaaatctactttacaatcttatcaaaccaggactttagcccattccataatatacagggaaacgtaatacccaagtcatgatctgttacatattccatagatataagttatctcctataactagtcggataaccatgccgtgtgggtatagggtacctgtaatctccacagcacgggagatgcctcggacgtcgttgaccaccgaggggcacgcgttgctcattttcaagcgactgcctcgtcgatggccggaggagaatacgggttctaccgacggaggagatgcgagagcatcgtagccacaccgccttgtcgttgccgatgccgccactgcgcactgcgcgagtttggatggagaagccgtgtcaatggttcggatggagaagaaaacgagtctcagcccgatagcctaacgggcctgatggc

SEQ ID NO: 105576 - DNA, 724 bp, Oryza sativa
atatggctgtttcttttttgcataaggacagccctctacacttgttcttaatttcttttgggggtgggggcagttgcaaatggtgataattgaagcataatttctaagcaaaactgaggccaaacttattatatgtcatgacttgtgttattttaggtaaaaaataatatatatgtgacttgtgtagtatgggctgttttgggtcattttgagggaaatgggatgtatattaatagaaatctgttattaaatgaagttactgaaattatggcatttcggagaatacgaagtgtcctagttgccaaatctggtttggtcgggttactgcctgcacggtaccgaccaagacaaattggtaaacagaacattttgttcaaatacaacatttctagaaatcttttatcgttaccaacatcctagattgttttcaaggtcatttctttatggaaccccattcccataaattcagtatccaaagatggttgctgtatctatgggaataagggttccataacgaaatgatctttgacgcaatctaggagtttgctgatgataatgttagggctcttggataggaagggttttggttgcctgtgtgttctatctgcatccgcctcgtcagcagatatgtagcatccatattccttagggctggagcagacgggatctcgacctcgacatccatatcccactagaacttgctaccgttgccactatctaatgt

SEQ ID NO: 105577 - DNA, 2204 bp, Oryza sativa
ggggtaatccgtccggtataaaaagtttggggtgagtgatatctggttttcaagttcaagggtaattcggttgacagtgatagttcagggggtaattcgtcggttgacagcgatagttcagggggtaattcgtactttttccataaataaataggcactttgttatatgattgtcattttgcgaaaacctcaaaaatcttaaatgatcataaattgaaatggagtatgtattgattattgatcagataaagtgatcgactcaattatgaggattcacatacgctgttcttgtgcattactgtagttcatgagcactgataatcatgagccttgatccttaagtaaatagctccatatagttcagttgggttttttgatgtataatctataccatattaaaaagactctaagcgtggtgtccgttcccaccgaagcggcgaagccgctcaccaataaaagcgcctccccttctctctcgctctctctcctcttcgtctttctcgcctcaccgtgcgcgcaagctctctctctctctctcgcctcatcgaagcgccgccgcccctcccttgctgccgcgccggccaccgccgccgccgctgccgcgccggccctcccgcgcagctgctacctcgccgcgcaagctctatctctctctctctctcgcctcatcgtagcgtcgccgcccctcccttgctgccgcgccagccatcccccgccgctgctgccgcgcggccctcccgcgctgcttcttccgcgcgtcgcgccggcctccgccgccgccgccgcccctctcccgcgaagaatccgtgccgcccaaagccgctccgccgccctctgcgtgaaggagagcctcccagggcgccatcgccgccgccccaaggcgccggttgtctctccgtctctctcgtgcaagccgctgccgctgcccgactcccgcgaagaagcagagccgccccaaggcgccgtcgccgccgccccaagccgccggttctctctctgtttctactgtgcaagcaaatcaactaattattcactaatcactaactgattaatattgtggaggggcatttatgagtatatcacaagctaactccatgtcccacaatgatcagagaaatatgtgcagccagctactatatgtggtcatgcatagtacacatttgtttgtatcctttgacaatcagatagatgtggtcatacatagtacacatttgcttgtatcatttgatcagatagctgaatgagacaagctagcctttactatcatttgacctgtcatctgttgatcaaatgaaaatttgaaaaacaaaatgatttaaattgatgtttgttcttcccatttttaaggatatacagtcatttaacatgagctcatttttactgtttttaaggatatacagtcatttaacatgagctcatttttactgttgactgcccaatagaatataattgttgggtgtggactgaaagaatgttggagttggacaaacataataagaattgttagctgcaacttgtggctaatgtaatactgcaggccaggctacttctttcttatatgctaacatattactttcacctttcagtaatgacacgtcctcctaccaaacactcttgtaaaggaaaacaaggtgctttgcgccctccaaattatttataacagtacatttgcatgagtattaaatatttgtaacaatacattttatatgagtattgaatacatccccacgctcatggtggtggtaacgaattgttttggcagtggagaataaatccaacagaacaaaaggaagtacctttacatcggttcacgttttggaccagggagaaagctcaaatggtatcgacctaaaactataagcattcttcttttacataacacagtacacaaataaaattattcaatgaatctattttagcacgggaacattctcgtcacgtggctcgctatgctagccttacactggaacaaaggcaagcaaagttagatcgtcaaagagcaaagcgacaaaatgcaacaccaagtgagaggcaaaaagaaagtgcccgccgaaaagctcgtaggcaacgtttgacacctgatgagaggcaagagttgaatgcccgtagaagatcagctaggcaagtttaccgcctaatgagaggcaagcattgctagatcgacggaatacaagcgatgcagctagacgggatacaccatgtct

SEQ ID NO: 105578 - DNA, 556 bp, Oryza sativa
ccgtcgctcgggaagaccgccgtcgtcatcgccaagtcgccgccgtcctcgtccgccccttcgcagccgtcggaacccgccggagcttcgtcgccgtcgacaacccgaaggtagccgccgcttccttctcgtcgccgtcgtcgtccattccttctccgccgccgttttggtcaccggtgtgttcgccgtgttgtcctctacgtgctggtgccctccgttggtgccgtggtgccgccgttcgccggtgagtgtgcgccgcccgagccgtcttctccgccgagccgccgccgccgtcggtgacgtcattgctggcgtcatcagggccgttcgccgtgaaccaccgtggacccgatcgatctcggccgtccgatttggatcggatcaatctcgaccgtccgttcgtgtgaaccgccgcccatgcgccggtccaccaaaccctagcccgctgacgcaataaatccccttttccttttcaaaaatattcattattgcgtcataattcatttaaaccgatttaagtgttttaatccgatttaatctttaaaattcataacta

SEQ ID NO: 105579 - DNA, 635 bp, Oryza sativa
ttaaggcctaacctcgtgaggaggttagagaagagcttagagaagagctcactgccgagctgttaggtatggaggctcggatggaggcacgcatcagggataggtcgaccgatggcactcccggtcccgtagtacatgtgagccccacgcagaggcgtagcagctgcgcatcaactgaggctccggcagaacagcctgaaggccccgccgcggtggaccacataacggtaataacaacttaataacgcatacattatattagcaccacaatacattgcaacatgtactaaggacactaacgaatcaatcgcaggaacccacatcgtgtaccctagtcattagggtgacaccaggatttgcaattcctgccgcagagggtcaagcattcaagcctaccccgaagacccgagtgcatggggcgcagctgcaagccggcaatgccaaagttcaggtggacttagtgaagcccgattgggttggctacactatcccacacccacctaatgacgagattctgacccttggggctgcacgtgggacctttattcaatggcccaagcacagcattgagatcaatataactccaaggccagcgccaagttctcgtccgccgccgacgcgtccccatcaaactg

SEQ ID NO: 105580 - DNA, 813 bp, Oryza sativa
taaaattcatatctaattcatccaagctccgtttaagtccattcaagtctcagtaaatttataaaaatccctagaatccattaaaaatggttttgtttcctgttttagtagtcttatagtgtgttttgcttgtgtgctttgtttgtcgcgtagatttcggccgtttcgtcgatccgcggtttctcgaagatgttgctgtggtctcatcagtgcgagagcaaggcaagtcatgcattacatttgatcatattgtacccaatttacaaatatcccgcatttctattaaatgtcgcattcttttacaatgtcatgtgggatgggtcctattactcagccatttattgtttaccctatgccattgataacttgggtatcaaaatgattagatgttggtttaggaaatgcttagccatgcctagttcaactagtacacaaatggggatcacattattacatagactttgactattagcatagctttggattggtgccaccgtaatggtgttagttaattaaaatacactgaatggtggactgtgggtgcatggttttgctggtcgcacccatggcaattaaggaccggttcacgggaaaccctgggagacttaccgtgcttaccacaagcgggagtgggtaactgctcggtctgaagtatagctcgactctttcctaggcaccggtggcgagggtgggcgtgatggagttgggtcggccggggtgtccggttgtccagctaccggattcaccgcggcgcaagaggggaccacccactacccgttgggggtgggggtgaaaccttagcatggtgtggat

SEQ ID NO: 105581 - DNA, 533 bp, Oryza sativa
tttaaaaacccgcacttatatctcacatataaggctgcgttcggccctgggtgattgtgagattgtttgttttgtcttccacgcctacgcttaccaaactactaaacggtgcgttttttgaaaaaaatttctagaaaagttgcttaaaaaataatattaatctatttttaaatttaaaatagttaatactcaattaatcatgcgctaatacctcaccttgttttgcgtatctttccaatcttctctatctcctcctcaaacacagcctaagtgtcggtttattaggaaaaccgtcatttatattattagtgttggttttttaataaaccggcacctatataatattataggtgtcatttttttacttttagacccattgaagggtcgggaggaccgaaaaagtctcatactatgtgccaagtttagggcgtttcttatcaggagtttcgtagtagtgtgtgaatttgagcccaacatggaaaaaaagaataaaatgcactagtggcccttaaacttgtcataaggtttcactt

SEQ ID NO: 105582 - DNA, 661 bp, Oryza sativa
ttttttaatttaaacaaaacacatgaaattttatgatttttttaaataaaaatatatttttaaaaaatgtgatatattttttaaatgtttaagtttttatacaaaacacatgacatttttatgaaaaatcaattcgggctggtgggatttgaaccttgtacaatggaatcaaaagagctcaaccaccaggctatgttcacttcagctacttagagcatcaccaacagtctacttatctgatttccaaaactgattttgagagattttagtaaaaaaaaaacagcttcaacaaatctcctactcttttacccgagctttggagttcccttctcccgatttctagctccgtttatatgcggacgcgaaactcgctcccaatctcgcactcccgcctctcccttcccgtttccacgcgtggagaaagcgatctttctgcgcgtgaaagaaaaaaaaaggaatttcctatatatgtagtttaacagaagggtccactttcaagttttggggatcgaatttaggctatctgttggagggaggagttttttttacttcctattttcaatttaggaaacccacaaacaattttttggggaaagattatacgtaagtttgtggtgatgctcttagggcactcacaatgcaagccatggggctcgtaccc

SEQ ID NO: 105583 - DNA, 965 bp, Oryza sativa
gtttatctgaaccctcgtaccattcgcaacaacgtaatgttagcatcaatagtttcatggactacggccttgtttgataacaaaagtcttctattagtttagttttattgtttcttggttattaagttagttttttggtttatatgatttataagctggtggatttaaagctttaagtaaagatagagtcccatagctatctcacgtaaggaaaaaaaattctccaacttaatttttgttattgtgatcatgcgggaggaggaatataaagtgatttccgttagtagtgtatagtatgggcctacgttttggttttaataagtcctactcaatcccttggaaggatcactttttcacatatcaaaatccgtttatgattctcaaatttaaatttttggggatggaatttacctagtttgttggtgatgctctaagttgttgagaggcatatatatatactaggtgaaaccccgcgcattgctgcgggaatttagtatgataacaataaaaaaataacatgtaagatagctagataacatcagattaagtaaattaatgcggtttatgataatttaaatttaaataaaatgtagaatggtgattcaaaaataaaaagtaaggtggtatgactttatggaagaagaaaagtagggagatagtttggaccgtagattaataatctaaaggctaaaaacaattgatgtgatatgacttaattaagggaaaaaaaggagaaagataatttagaccatagattaatcatttaagcactaagtgaagatgaactatataagtatataggatatcataaacataataaggatttacattgaaacattatgtgaattatactggatgataatttaatttaatatgtttgtatttgaaaagctcttaaattataaaaactataaaaaactataaagatatagcatgtttgcatgatgtttaaatgtgatgattgt

SEQ ID NO: 105584 - DNA, 542 bp, Oryza sativa
tttagtgcttcatatatgtgtccaaatatttaatgtgataaaaaaagtcagaagtttgaaacatttaatgtgataaaaaaagtcagaagtttgaagaaaaataaaggcaaccaaattgtccttaattaatgcaaggatgatcaacgacgacgttacgtcgtagcttttcatgaatttgtttgcttggactgcaaacgaaaaaatgttcaacactttttcggtttgagttgacagcagttgacaaggatgtataatttggtgcatagcttcctggtcctattacaaccgaattttgccaactttttcatcatctctttttttctttcacattaattcatacaaaaagtcagtgaaaatttggtaccacatgtataatgcttattatattatatgcggcgctgtcacacaacgtacaacgtacgcagacaggctacgacgggtactacgtaaaaaagacaagaacacgcgatcgatgacacacactggttcctgcatactatgcacacagtacagtatggtggaaggctatgagcccacttgct

SEQ ID NO: 105585 - DNA, 753 bp, Oryza sativa
acaacaatatactgggatcggtgaaaataggaaaatatactgaggtaaacttttcacatcaagcatcattttggtatgcatgagcctgttctaaattacactggtttttgtagtggtttcatgatgtctccgatcgtgatatctctaatacatgtgaggatgcacttaaccttctttgcagcagcttcggatgtcaagtaagatcatcactatctaacataccttagacaataggagtacagtattctactagttaattatcacagtttatatatagcagcaacaataggcctttgcttttggttgtgcaatttcttctattaatggcaacatgttttattgtgtggttttctgttttttccttactgatgtgacattccaatgtgtacagatatttctatgtgcatcaattgcattatcgataatggatatgttgaaataactgtgaaatataaatgatatgtttattttttaaattctgtaaatcataattggtttataattgattactgagctgctttatctggagcttttaggaagctaatgagttgtatgagttacgcttaaactttttccagctacgaaatgtttgaatgagagccaattataatgatgtgttcctgtaaaaattttctgtcatgtaagttgataagattttatttatgtgtttaaagatagaagaaataatactgccagaacttgaggagatgcgtactgcccatgttgtctcaattggcacagaatcattctgtg

SEQ ID NO: 105586 - DNA, 560 bp, Oryza sativa
tataggaaatttgactagaattttatgagaattgctagcttcacaagcgtgatccttttgcatctcatgcttccactactagggaatccatcgttattagtcccgatttacaacccctttaacaccaatcgagactaaagattgtagcgccatgtggcaaatgttttttctttttattttcattattttttactacttgtgtattgattttgagccatgccagttgctcccaacatccctaaatccccacatcaaattgacatccacaaattcacaaaaacatactcaacaacaaaatcatccacaaaatcgaatgaacatactcaacaacgaaatcatctacaaattcaaaaaacatctaaaaaaagtctacaaaccacaggtctacatgcaacggcatcacaacaaaatcatccattattcattcatagatcgaatgcagctcgatgccagcgctgtccagcccaccaccaccgccaccaccggcggcggaaaaaagcgccctcccgctcttgcgcctccgcgccccagctgccacgccaaggcaaaagccgatgccg

SEQ ID NO: 105587 - DNA, 738 bp, Oryza sativa
cagtacacaattacacatgcatatagtacaaagttacaagtagtaattgagattttcaatacaggaggcgatgcaagttgcaactccactctctgttgtgtttgaattgactactggtagtggtactcttatacggaagcaaaacctgaaccgaactgcagtggcatcgcatcgcgcaacgcacagcacagcacagcacatgaataaagattaccagtgatgttctccagtactcgatccgttctataaaagattacaagtgatgtgacacatcctagtgttataaatttgaacggatataaatttgttgtactaaaatatgtcacatacagttttagattttttttcagagagaatacacaatatattattcagtactactagtactacctccttgcaaacttgttggttagttcaatattgagctaaccaatattgagttaacaaatgtcaaaaaaaatataaagggagtatatgcctagctagctagtagcagtataagttactcccctcatttctataaggcataactattttttttcatgttacataatataaggcatgcatgcatgcatataattaattagaacctcttctctattaaatatacttttttaaatcctcaactctcaagatctctaattctattggatacatgcattatatttattagggtgattcaaactagaagatgataataattatttcttggtatttaggttaagggtggttgcgtat

SEQ ID NO: 105588 - DNA, 3965 bp, Oryza sativa
aactttgtttttaacacctttttcatatgagttcatctagtgctataaaaatcgatttgaaatttaaaaagccacgtataaaaaatcaatttttacatgcggacgcttaagtagcccgtatgaaaaaatggtccctcttccgcagttcaaaaaatttcacacttaaccctatcttatcctctcctctcactttatcctctttgctccatgtttccaacccctctccctcgtattccgtgggcacgcttttcaaactgctaaacggtgcattttttgtaaaaaaaaattcaaattaatccatttttggaaaaaaaattgttaatacttaattaatcacacgctaatggaccgctccgtttttcgtgcggaggagatgggttccaaaccagggcatgcgaacacagcctcagtcttctctctcactctatctcttctctctctcagaccgagagtggcgcagggcgtggcggcggcactggccaagtgcagagggagcggccgcgggctctggtgccaagggcggcggaggcatggatccggcggtggcggcgcaacctcgcgtcgatccggcgtcggcggcccgtctcggcgtggatccgatggcggcgcgacgacggcgtcgatctggcgtcggcggcccgtccccgcgcggatccgccgcctctacctccctctgttgtcgccgtcgatttccccgccctcctctgcggcgcgacgacggcttcgatccgccggcggcggcgcgacctcgtgtcgatccggcgtctgcggcccgtccctgcgcggatccggcgctgacgacgatggacgacggtgggagcggcggattggccgacgacggcgacgaatccggcggcgcggaggccggctggattgggcagcagtgggctagggttcagcttttttctttttttttatttcgctgaattcattttcgcatgcggctagtataggggaccgcatgcaaaaattggatttttacatgcggttgctctagccgtatgcaaagatgacgatctttgcaggcctagccgtatgcgaaaatcgttgccatccgtatgcaaagacgtattctgtagtagtgtctggacatagatttgtacagattaaaacacacagttgtacatattaattacatccagttagactgaaggacctttcaagaagccatataagtttgtacagattaaaacacacagttgtacatgtacggatgtacccctctcgatcaaaccggggttattaggtaacagcttattgctagattaattacggatcaccgcccatacatggaacatgctagatatgaaggtgacacgcacaacacaatatactatgattattccattgcagatttgatcatgtcactgtaattggatgttaggttgagcaagatctcaggattaggacagtttagcacttttgtgcctttcgtcgtaatgtcgtggttccatgtctctggtgacactatagtaattaacaagtacattcccatgcaatgcaaaaggccaggcaaagataagaactatagctatctagcttggtaaagtgcttacctcgagaaatctcgtgttaggtacttgcatgctaggagttaggcctaggttagttggttttcctacccacccattttttaactggcatatgtgcatcaaaacgtactaaggctgtgtttgttggtggggttaggaaccatctctcacgtacagaaaaccaagcggtccattagcacgtgattaattaagtattacttttttaaaaaaaaataaatcaatatgattttttaagcaacttatgtattgaaactttttaaaaaaacataccgtttagtaatttgaaaagcgtacgcgcgaaaaacgagagggggagttgggaataggctatagatatttatatataaccatcgtacgaataggctatagattgcctataaatgatttgaattagtagttggctatactattaaacttgctctaatggagtagcattaatctctggaagattaattacatgaccaataattaggaagattatgtgattgctacaattaacttcagaatgaggttattcctaacccaatgactagaatgatatccatagcattaaataagctgccatctaagataaaaaaatgatatgacaagtaaataaatgaggaaagagaaggaaaccatgtcttgcatgggatttggtttctacacaacatccaagtcatcatgtgaaataagaaatagtggtatttacattggaagagtagtatatagtactagtttcttgattatgagaagtttatgaaaattatatatagtgttttaggttgggaatggcttgagggaggctgtggtgttgttggtctcggcgtatttttttctcccataataattaaaagagaatggagggatattcgacatagaaatcacaataatggccacctgctgtatagttccacgaaatacggcgaattgtgtattgtacaccactcaaattgaattaactaattaccggaccgcacgggtccagcaacctacagcacggtgcacgtaccattcaatttgcagcacgttcgcgcacacaccgttatctccatgtgatgtgcgacgacgaaccagaggagttgccgtacgtacgtgtcacggcgccacacacccctcgtcctccctgcaacctaaaccgttccacgcacatccgcctcggtcgatgctgcctcctcctgcttgcgttcggccctcgtattccggctcgacgaaccaggaccaatataaaaagctatggcctcaagaaaaagtaaatgtcaattaggataaaaccataatgtgatattctttacctaatatgaagccgagcattgctaatttgctatacgttcgataaaacttcatatgatcagagtacgatatttcgtagcctctggtgtgtgctgcaaatatggggcataacatgtttccacccaatcaaaaatcatggatggtaggatcgtattaaaatcctacaaatatcatcgtacgcaaagcaatttccatatgaagccatagccacattatcttttctttatccatgtcaatcggttacttttgtattaaatcctcactttttttttctattcacacatgcaagtctaataaattaataatccacaccctgaaaatcatatataagaacccatcccttccctttcattctacctttccctcatttctccctgtaactcctctctcatgtcccacggcatcaccacctctcccctctctagtggcgattcttttcccctctctttcatcaacaaggccaccaaggagactagatcggagacagtgagggtggatatcaagacggcagggtgtggattgagggggcaaaggtgtaaatcggggtgccacagcgtggatcagggtggtgacgatggatctgcccaatgtggtggaaggagcggtcgaatagtaggtggcagtgtagatagaggcagcgatggcaggcagagcttcgaggcgacgtcttcccgcaatggagcatctcaccatcgtcctcaatgaaccgtcaggtaggccctttttgacctcatttgtgatggcgacgcgtagaagtttgtttgcagcaacggcacgggccgacggcatggggcgaggccgcttcctaacgcgtttcctcgcatgattctcgcctaccagcagaggcgtggctatgctgaggacacatggacctcctgcatggttcgcacacctctgtagggtgcagtttctttatagttggcgtgaatatttgtctcggatggggtaagacaacatgccagctaggaacgtttggcattgccttaggccatgtacaatgcatggtctccgacttgtggttccatcctccaactaggctaagatgccacagtggaggttcgagagtgtcttcatttgttctagaataacctatagatgtcacagtggtttgaggagaaaagcagtggttctgggagaaaa

SEQ ID NO: 105589 - DNA, 753 bp, Oryza sativa
agttttataatagattgtgtaaaatatctataattttatgaaatatactcaatatttttttctaacatgaaattttaagaattattaaagacaaatagaattataccgtggctccactactcaaccaatcacaatcctccaccatttacttctacgtactttcttaataaccgtgtccaactctaaaaatgcttataatgtgagacggagggagtaaaacacagcacgtattagtgcatgattaattaagtattagtttaaaaaacatgaaattaatatgattttaaagcaacttttctttatatttttttacataaaatacacagatcggaaaagcgtgcgtataaaaagaagtaagtataagttaggaagatggagtaaaaagcacacccttaacccactaacttatgttttgcctcattgtaccccttgaactactaaaattggtttgctcgagcatttatcttcttcgtctctttttatatgagtcatattctatttgcagggccagacataacaccattatcaaagctctaaaatatttttaaaagttttcatgactattgtttgaaatttaaaaccacgatgttcaaatcatgcttagtgctttgaaatatatgtatacggtggtaaaaaaatatgaaaaatgctgagaggtaggttataatgtatctatatatcaatcctaccaaatttgcttgcaaaatacgatgtatatagttatatatctttatctacttaaaacattaatag

SEQ ID NO: 105590 - DNA, 512 bp, Oryza sativa
caaatatgaaattaccatcacatgaaagtaatttaaaatataaatctaatgatataataagtataatactgttagtatgattattagttaaaagttattgagtttataatttaggacggaaggagtattgtcattattaataaaaaaccgaaaaaaagattgaggacacaaagcactaggatagccagcaggtcggccatgtttgagaggactctcgcggtgcatgttttcatggattgggggattagagacggtctgttatagcaagtataataggggctgaagagccggcgataacaaattcaaaggctgagttggcaaaaagctgatgagagagaggaccagccggcgactaagagcaaggataataataaagcccactttttactattagcctatcttaaagtcaacatatataatagattagctataaggttggctataattttcttctcctctctctatctctcacttacacatttaatgcatttgtcttgaagcttgtgataagc

SEQ ID NO: 105591 - DNA, 570 bp, Oryza sativa
cctccgggcggaaatttcccttcttcctgaacacatgcagaatagctcaggtctttctactatggaacagctagctgatcaatccctgtgtgattttcctaccactaacaatgcctgtgcagatccagaaaatctttccgctgcaaatttttcccaggatcagccaaggtgctacttcatgcgcactcctcctgctggcgggagtgtaggaactggcgcgcctcctgacgtcgactcgcctgcatcagcgcctcgggatgcacccctgtcacctgctgtgtttgcctcaccagggacagcagactcatctcccactccgtcgaccccgcgtggcccgtctgcttcgccacccaccactccgcgcgcgctgtctccaatctagggggggcatgcagatgctgtcttggagtcgccgccatcgcatgggtctgcgtcgtcgtcgtcgtcgtcgacttcgtcagggtcatctacggcaacacatgagtcggctactacttctgctgcttcccttgtaccagcgccagcaccacaacgtcctgtaactaggttacagcaaggtattcccaagcc

SEQ ID NO: 105592 - DNA, 925 bp, Oryza sativa
tggtccaaaatgtgtttggtgaccaaagccagaacagaagatatgttgttcattgcaaattggaggatgagaccttcacatgtgtttgcaagcagtatgagagggaaggattactctgtgagcatatcctaaaggtgatgacacataggaatgtcaatctgataccagataaatacttgttccgtaggtggactctgaagggatcagacagtgctgctacatgaagtcatgtacctttgaacatggctgaagcgtccactaggaaaatgaggtattcaacaatttgcaagaaatcagtgtgcatggcaagtgaggcatgtagaacacaggaaggatacaatctagccctccgttcaattgaagaactgactgacaagcttgccgctattaacttgacccgacaagatcaacacctttctcggcccaacatttgtgataagaatgggaaagggatcaccatgggtgagagtaatacgatagctgagaaggtgctttcagaaagctgtctaaaagatccaacaaaaatcaggcctgctgcgtttgacaataatagtgagtcagcaagaaagagaaacaaagtgatgaaagcggtgcaagatctcaggagtccatttcaggtaacaaaactgacggattgaagtacagggtatcagtccatccttgatgtctgattatgtaaatgcaatagtgtccttgtgcccccttctcttaactcgctgacctgtaaggaaagaaggatttgctgcacatgggagaacggtgctagccttgttgacttcttctttttttctttttttttttttagcaatgccctgctggagttaatgtgctataacgtcattttggcactttggtagtgattgcgctcttccgtatctgaaattcttttcttccagtagcatagcatgtctgcaatgcaatgttg

SEQ ID NO: 105593 - DNA, 696 bp, Oryza sativa
aggtgagttcccaacctcaccaaacgaacacagccttagtgtgtttgcttcgatgacataatcttgtgttgctgcgatcttagtttgattataatttcttaaatagaaacttataattcaagtttttaagtttttattcttcttttcatgatacaatttgctaaagttccgaattctttcttgtgattgcagggaattctacagctatctggacatgctttctcgacttaaaaaacagtacaatcccccgaactctctaattttcatgtccaagccctacccagagaaagtatgcaattgcatcacctatcttgtagcattatgttttccgggaatctatagcaaatcgatgtgaaggaaagctcaaaacttttaattttcacaaccatcattaccaatgatgcacccaagcctactagctactacccaatgggtcacactgtcaaccctcttatcaatcgccatagcggctgataactacttctcatcctctagtccaatatttctaaattgtggagcctctgccatgcaacttgatagcaataatcggagttgggatggggacactagctccacgtttgcaccatcagtgaaagggcttgcagctagagcttcatatcaagacccttccctcccatctcttgtcccttacatgacatcccgcatcttcatttcaaattacacatattccttccc

SEQ ID NO: 105594 - DNA, 2016 bp, Oryza sativa
ttaagggctgtccctttcttttctttcatgcgggccaaaaggggcattcggagctatcaccgattagcaatttcatccacagagtgttattgaaacctaatgatatatagcctccatttttttcactacaacacaactaatgggacctttgtgctagccaaatcccagtccagcaagcagatgttctaatcaccaaacctgactaccagcgtggcgaagatcttaaaaatatagagtgatgcccactgtcatgccaaggctgtgtaggggttggttgactggtcacttagactcatagagtcataggatcaaaaggtgcgatagataagagtatatttcagcatgtaccacacaatatcatttttttctgaaatatcctgtctttgcgaactgtgatggttctgtttcgacaaggccatcacgtctatgaattgcactgctgtcgaggaaagccatcttgtttgaagcttttaattgggggagcttctgattctgggagatgctccgccaacaggccctatatcttgattgaattgcctgaatctgaggtgatatataactgataagctagctgattccttacttcggctacatgtgcccattcattggagttgaaggggtgattagctgtttctaggatcctgtattacagtaggcaaagtagttagtcgctcatcatctaatcgacaagtgatcctccagccaaaccctgttctaaaagaggactattataataacaaaagtaccatgcaatatcatttgtcatgtaacttcatggtgtccttatttagttttgtcaaaactattgttatcacattcctatgtgaagtgtgcatattctagagctagctacccattagtccatctcgaggtcgggaataatcatatacccgttgggcgggtgccattggcgatatgaagaacgcgacggtggcacacaattatgggaaggtggtcacaccatggagtgaatctcggcatggcagagggagcccaaagagatgccacgctatggatgaagccgacttggcgaaacctgacatctggcgagccaactatataggctacatgtgcttcgtaacatgtttaggccaatttaatatattcgacataatattgtagtcctgttctcatccatctgaaatggcatagatgcccattgtaacctattgcgacctatctagtatgggcaccgtttatctttattgacttaattttaaaatttataacaaatggaaaccaaatgcggatccacatatttatacttaattaaaacaaatggtgcaacactttttttctgttgtacatatgtactatctcctttggatataaaagataagcataaagagataatcgaactagactaagggaacctacagctcgtccataaaaagtgtacataccaatgagaggtttactacttcacaattgtgtggtgtaggcacatgtatacgtaggcttaggaagcatcgtgaagcgaaggatggcaaatccacttacgtaaccatctaaccttcaaaaagtatcaacggtgcgtgttattgaaattaaactggatgatatacggtacgcttcatcgaagtgtcgcacaacttgggggagtaagcataatggaatggaagtacagttatggtagaaatgtgaactactgcagcgttgtttagtccatgtttagttttttgcaaatttgtgattgccctgtttaattagtttcttctctgtcgctgtctcaagtctatattttctggttgcatttttccaaacggccaaacatgttacatgtatttcgtcgtataaggaaataaaaagcattgcactatattttcatttccaccatctaagattatttttcccgttaggttaggtcgtacaatattaatagctcgatcagatttaatgttgcttattaattcacaagttgcagagctacgctagttgaacaaatgtttttgcacgaacataaataaaacagattataactaaagtcatttctaataggttcatccagatgacaca

SEQ ID NO: 105595 - DNA, 581 bp, Oryza sativa
tgacatctagcgagccactggatcccctctcacacgaagcttctatcggcagttcctccagagtatggactgtaggtgacgaagaattcctccacatgagcaatttcggtaagtccaatcctgatttgttcagtgtttagtttacatgctctgaattccttcacatctgaagctttcttaattgtgctttcttttttttcttcaatctggatagtattgtcttatttatactatctgatagaggttgcattttcagaaattttcatcatgttcttttgtgtatgcttgcaattgtagcaaaattgcctgacttgaacaagggtatgtctgctgtatgtgctgatgtacttcactgtggtgtatatcctgcatttatgtccagaagtatatagggtatgtacagcatgcaggaaagaatactcagtggtgttgtgctggaatttcagtttgacactatgtagtgagtataatatgctatcaaatttatgctctgagtttgacacagtggaaattcagtatgtactgagtttcatatacgatgctctgaaatttgacctgttgaacagttatctgaaccttgt

SEQ ID NO: 105596 - DNA, 1965 bp, Oryza sativa
ttgtgatgctcgcctacaaaaattcttaattttacatacacatgtgggcaggcggttgctatcccacttggaaaatgtgataggagatcgaaatcaaaccagagaatatagaagataattctatattcggcaatttatttagtatattttgagggttgtatgctgttaaactataaaacctcctaaactgtgaatttaatagaagaatatatagtggatgtatacaaccctcaaaatctttactattccaaaaattgaagatgtttccgctagaattttgatacgtcatccgtgtttgaatcagttttaattttatgtattgattttaattttatattcttgtaaaatcatgtcctttctatccgatatgcgcgcgatttgcccttgccgcatgtctgattgggactgcgtcatcctcacccgcgatttgaaaaatgaagatgtttttgtcaaaactatggtacgtcatccgtatccgattcccattacacgtaacatttatttagaagtcacgactcgcgagcgaactacaaaagagagtccgtgcaatgtggataccaagcaaatgaaactcgcagagtccgtgtggatatcacgtacatcattgcccagttcatacgattctattcgtattacactgtacgattcctatgacatattagcatgatttcaagtcagtctccacgcatactcgtactatcgtacgtgctaccagggattatccataaaaatcggttttagtttcgaaaagaacatggcaattgaaataaaggatgatcgaaattgctgattccatctttcatcaatttcagctgtcttacttgagataaagctggaggataaatcgatctcgtgtttttggagttgcttataattattcctacaagccaaatttaaaattttagaaattaattttgaattcgactttttggttttttgtcatactttatcttattttacagcatttgcttttgagtcgctaagaacatgtatataaaagatttgcacataaatagtattttatttgctaataagtgatttggataaggacatgaataaacgaaataatgggttgtaattatttatctacaaaatatgtacaaattaaattagctctacctattacaacacatgggcatcttttctagtctactaaataaattgccgaatatttttcatctccgcttcaggctttattcatgcatgcatgtctcagattttcatcttcgtatgattaacgagcatttggtagtactattggactcaaaagtaatatttgattttcatctccgcttgattaccgagctttgattttttttagcactgacttccgaagaaacattgaaagcctagtcttaaacattttctggcatgactaaaagctactccctccatccgagaatatatataagaagttttagagtttaacatggttattaagaaagtagataaaagtgaatgttagtgagttgtgactgaatgagtagtggaggtaggtgggaaaaatgaatagtggaggatcgtgattggttgggaaaaaaatattgatggagaaattgttatatttttggataaatcctaagggctaaaagttgttatattggggacggagggagtatattttcattgtttttactagtatttatacattttaatccagtactaaaatggtactcttcacaacgtacaccatgtgcaattaaacatcacagcaacagtgatatttatatatttttgttacgatgcatgttcattgtctggctaacatatgttcacatcaaggcctcgagggtgaggacactacatacgtaaggagataagtgcctggcaaaggggggtgatgttgtaatgttgttaccagcaacatgttgcactttacacaatgtcaaattaaattcaaaattaaattttctgggcacagacaatgtagagatggaagtgggaggcgtcaggagaattagttgt

SEQ ID NO: 105597 - DNA, 1628 bp, Oryza sativa
caaatcgattaatccgattactgcccttgcaaaaaaaaaactcagattactgaagatgaagaataatgcatcatcctgatccatggtttggaattttctgaaatttcggccccaccagcaagcgcaaatctccccaaaatttttagtttttatcaaatatttgtaaatttggttaaaatttattcaaattcagtcaaaatatattaaaaattcaaataatttcagtccaaaataacccggcaatcatgaattttttaaattttcggcaaccaccgaaatttcggtggcaaccaaaattacaaaccctgtcctggtcgctttgccatttagccaattaaacaagtgaatgataatcgcgcattgcaatggtggtaaccaaaaaacataatgatttgctcttatccttttgaattgagttttggagcaaattacttatctaacctttcacaaaacaattcctggcagctctatctatatataggactcaaaagtaatgtttgattttttttttatggcacagctcttctctctttgtttgttttaccaagtaaattgggtattgatataccgtgttcaaagtcgcagctgcagtgatatcaagttgtatattttctttcgcagtgcctagctaactaatgggatgtggagactgagcatatgtgaagtgtttcccatttaataagacagtagtgcgacaatgttattgcaatgtacatagagagaaaataatctagcgccttatttaagagttgtgtcctccaacgcaagaggttctgcaaagtcccaatagagttgtcctcttaaatccttatacatgcaaagtcccaatagagttgttccaaactttttcttcaaactttcaacttttccattacattaaaacttttctacacacataaacttccaacttttccatcacatcgtttcaatttcaaccaaacttccaattttagcgtggactaaacacacccgtagttttaaattggtagcccaagtgcttaattaatcaacagaaccaactacctattgaaagccttccattgactcttgaagaaccatcgaatgcctagccttcgcatctcgctctgtttttctccaattaaacaccacaactacagtgatatatatcaagtgatatgaataattcttgttgcgatgcacgctctgtttgtctatattacatatatattgcctccggggtgaaaattgctgctacttctgtacccacatacatgaggagacccaaccttggaaaacgcataccactcaacagtttcgaaattcatgtttaaatgtactttgcacagacagcttacaattggaagtggaaggcatcagggaaattactgctactcctgtttcttggacatgttggagtgcatgaatttttggctcctcccatccaaggcctactctttttcttggtagctaatctcgctaaaccattatagctcattttgcgacaaggcatagaagattgaaatgaaacaagtgaaataataataaaaaaaagtcatgcatgcataattcgctggaattttcgaaagcaatggaagtcgaaattaaacgatgtattttttttatcaagtgaacagagcagttgaaaacagggtagtgagtcttggcaa

SEQ ID NO: 105598 - DNA, 1658 bp, Oryza sativa
ggtttcataaactataacacatatatgtaaattttgtgaacaatgttaacaacactttgtctgatgaagaaataataaacataaaagttatagatcttggtgagttatacaactgtgttgttgatgacttttttagttgaaatcatttagtatttgaaaatgttgtttgaatttgtcgtattttcaaattcaaattcaaatgattcaaaataagttatatagaaaaataaccaaaataaaagctatagatcttgatgagttatacaactttgttgttgatgatttttttagttgaaatcatttagtatttgaaaatgttttttctgaagttgtcatatttttaaattcaaattcaaaccgttcaaaaaaaagtttatattgaaaaatgaccaaaataaaagttttaacacttgataagttatacaactttgttgttgataatttttccatttgaaatcatttagtatttgaaaatgttgtttgaagttgtcatattttcaaattcaaattcaaactgttgaaaaaaagttatatagaaaaatgaccaaaataaaagttgtaaatattgataagttatacaactttgttgttgacaatttttccatttgaaatcatttactacctaaaaaattattttgactaataaaataaattattatactgcagttaattatttttgctacatgtcaactcacaaatataaacatttcatatgacaaatggaaaaaaattctacatctcaatcgggcattagtatagagcccgtcacggatgagtcatctgtgatgaccatcatccgtgacgggcgccaacttgtggcccgattgagatatgtaatgttatctcaatcgggcctaaatacagcccgtcactgataggtgtcatccgtgacaggcccgggttttatgcctctctaacatgtctgtgcgaccatatctcaatcggacgctttttcagtccgtcacagatgtaaggttctgtaccagtgagggtgtacatactgtagactagctagccattagtctattttgaggtcgggaataatcatgtacgcggtgggcagatgccattggcgagataaggaaggcacactgggaggtgtggtgacatcgaggtagggctatcaacgagccaagctcgagcgagctcgtctgcccaagctcgagctcgacacaagttcgagccaagctcgagccgagcctatcgcaccttcgagcttttaggcaagctacgagctcgagctcggctaccgagctcggcaataagtagtataatatatatttgtggacccccgtttttataacaggaatcgatcgtgtaaacagtaccatttccctggatcaagtagtttggtacacacgaattcatagctggaatatcaagtgcacatacacgagtgtctaatacgaattattacatcataggcccgcaggcatagtcttaaatcatcggaccgagaggtccggaatacatccaaaagcagaaatagataaggcagcggaattcaggcagcggcatgccattgccacaggcaacgaccgtactaagacctactggacgccatcgtcttcatctccctcctgatagtaggcaagggatcctccgaggcttcatctcccgcttctgataaattttatatttgcaaggatgagtaccaa

SEQ ID NO: 105599 - DNA, 1697 bp, Oryza sativa
aggaccgtatgatgatttcttcttttcccattttcggttttgcacataggcacatttccctttttgggcctttacctaatttgaggctaatctgggctcctttgattcctttacaataggttcactctaatatcataaccaataggttcacctagatgacgcatctaacttttctttctatgaagatgcatgatacatctaacttaaatatgcttgagcatcgtgaagtggccggagatcatgattcacattgtggccataagaatgggtaggggcgaaaatggtcatggaaattcccaatcgacccagtgttgttttcgtctaaggggtactgtttctaacattaccattattggttgtatatgaaatttgtttttttctaatttctttctgcatcatattcatgctaatactgagtaatttaaatgataaatatggtcaaatactggccgactgagcgtcgtttgcaaagagatgctaccaattcagatcatttccaatcatttgcattcctatttgaagccactggttcggtgcttcactaggatgtggcatgtagcgacctaagcatataggacttggagacaccaggaaccaaaggagaccactatgagttggccaaccaacaagcctaaacaagagaaccaacgtctaggtagccaacgtccttagacgcaatacaaaactgctctggctttactctaagacaactgcctctttctatgagcactgaacatgcaagtacatggtttgcaggccagtttaacacagcatatatagaacgatctgtttgctccatcctactcatacacctgcaacggtaggaggcaactgaaccatatttagtgaacatattacaatttttataccgccagtcaacataagcttgatgaatgtaaagagtgagcctatataaaaggatgtgtgcttgtggaggatggtggtgttatatagtgtttgttgtcccatgtcgcatatcattggtcatgatcgagtactttttaggtatatcacataagcagaaagaactaggagcgaaagattcaactccgacaacatgtaggaaagataggccggtccgaatattttggggggctggaacaaaaatgccagtatggatgcaatttaatccttatctgtacttataaaaagcaatagtgtttctgcccgattttcatccaccgacatgctgtctagatcgatcctgtcgttggagagcacatggtttttttttcacgtctttcgattcacgtctgattctattgtgccagggcatttcatacttcaggtggcacaaggacccttggcagcgggccgcgcatggatgggccactgctgccatctcatgtggatagattagctgcaatcgtaatatgttactgccaatcaaactcctcgttcgatgtcaaactactccatcttcatgtatgagtaagtccataatcatactttaaattaaaacaagaaatagaaggaaacaatcaatcatccagaacatacaacttagggggtcataaaaattaaaagtcaagaattcctatctcatcgatctaattgcatattgaagtgatcctctagatctctccggtaagttgtgatgtgtcgtccctccatgctgaacaaccacccatctctccctccacactgcctcactgagccatttaccaaccaaatccgctctattttgccaactttct

SEQ ID NO: 105600 - DNA, 1696 bp, Oryza sativa
taagctatatatatatgtgtgtgtgaagtgatgtatgctagagttagtgtaatattactgcagcaggtgcctatatatattgctccagtgaagatttagttttttttttccatacatgaacaatttagaaatggaagtgaaaggcattgggaaaactaatgctcctacgacatggatgggtcgagatgttctttgacagtacttcgacgttgatagtagggatttgacatgagccacaaagctggccatatatgccttctaagcgtatgagtgtgtcatcgaatttagagtgacctgtttagaatatgggagaaaaactgcaatgacaaatgatgggaaaatggccatatagtgctgtgctggtgctgagatgaaattccattcatttatcttgagggtataaacagaagaaaatagtagtatatttctatatgctttgtgctgagattttgatgaaaagtaaggagtacatgttgtttgctaataatatatcaatcacgagtcagtacagttacacaaatgcttcgctaagaaagaactattattaggtaaatctagtacattcatgtcacttcgtattcgtaatatctttgatccgagctacaagatagtaaattaagttcgtataaatatgcgaaacacagtgctgttgctaagaatacttttcccaagatattattttccttttctgcataacacatttatctttgcagctgtctaaatcctgcactacaccatgccattgtgacacgaattaagcttgcaaagttctttttctgcggaattctcagctaacatggcgtttccgaaccagcctggcagtgacttttttttttttttgaaagaactacggtaggggaagcccccaccgttaagattttatattaataaaggggaaaaaattacaacaaatttaaccactgtaataatgtatctctctcagaatttttgactctatgaactaaaagggagagatcattcctaaagagaactctccaagagggaacagagggaacaatgttttcaaaaattaaactattcctctgcttccaaatgttccaagcagcataaagcaccttctcaacaaaatgggtagagttatatgaatttctggccgtgatcaacatttcaccaaagcttaaagaaagattccaaaccacaccaaattgcacccaacattgagtgctaaaaggacactggaaaaataagtggagagttgtttcccttgatcctgttgaacaaagtacacagagcaaggaagcattttgaggggagcaacgccttctgtctaacatgtcataagtatttaaccgatcaatcaagaggagccaaccaaacaccttgactttcatagtacaactgctcttccaaatccatttaatataaacaggcacatagacatgagaaaaattcatggcataaattttctgtgaagaaaaaataccgttgccccaaacatatgtccaacgatcactctcatcattaagatgctccaaggtatctgcagctgacattgccaaatattcctgaaaagcttgctctgaaagtggcaaggcaaagagctgaggtagatcagaagtagagaacatcaaaactgagagatttgaattcctagcaaaagaatatattctatgataaaccaagtccctgactttattgttccacaaatcttcccaaaacaaacaagattttccat

SEQ ID NO: 105601 - DNA, 973 bp, Oryza sativa
aaaaagatgaaacaccattaagtatcaagtgcaacatttcgatccaacaaatagacatccagatacattggctgaaacatcacaaactcataaaaatgtaccatgtcaaatctgatttcttcctcgtcttcggtgggctcctccagtgatggaccacttgagtagaagaagagtactccccttcataatgcttccttcttcaggtcttttgctagtgaagtttgggaaagctagtagggaactgcaaccagggagagagttctagtgagtccagaatctttctttcgtccatcaaagcaaagcatggcaggaatcccaaactcatcattttttcttcttatcattcgtaattctactatggttttgatgtcttcttgtgtcgctatttgaggtttgagatcaagggaatagctaagcttgtgggttgaagtgagtaaagatctgaagctatggtaaataataggttgaaacagaagaatgataagaataaagtacctctctgaagagctactttcttacttgactttctgatcaatagaaaaagccttgatgtcctcagctagttgacatgcgatccaaccaaggaggcaatacttttgcctgagttcctccagatcctactcgtcgggattaccgtgctcccgcaggttgttcaccatgcgttccatagcatttttactttctaccttttactatcttggaatcatgtagatgtaaattgcttttattgcagccctaaaggtggcttgtaccagctcttagtcatcatacgtacccattacatagatgatccgccaagcccaagcctgaaagcaagggtatgatgaccactctctaaaaacttaaaactggtccccatgagaacggagactaggtgaggtccgaatgtgcgaacaacacgaccccaccatctgtcaccccatcgatgccacctctgacgccgacacccctaagcgtcatcacctgccaccag

SEQ ID NO: 105602 - DNA, 756 bp, Oryza sativa
aagcatttgatctcctttgccttagtgctatgtttctttttcgaatgtgaatggaaactgcaaaatagactatttatgctattgatccttacaagtattattaatataacatttgaagcaattcgattatatattagtgagattcaacaagcataatgagaatgattgcttagttgctgactcttgtaggtgcatttttcccccccacgatagtggtcaacatatgggaaaatggtgtgcatataaaactggagatggttatggtctcattagaaacaccagctgtgctttgtcctggaaatctttgtaggttgggatttttaccattatgtgcattaggttgcacataagtagtcttggatgttctatattatcatcttcagcttaataacattggctgaattggtgattctaatagttgtatattgtataaacttttctattcatcatggagatgcagtaaaccaggttcaaacaactttgatttaagttatgaaccacaccatatctatagacttattatttacatgttataaaattccaatcctctgtgaagattgtaggtttgactagctcccagctttgcatatggagacgtagtgagccgagaagtatttttcaatctcgtggagcctcattcaaccgtggcttatgtatgaggtgaggaacatgctttaagtttgtaaaatgacatgccttttgtttcgaacaaatgaaaagttagatgttacatatactactgaaattactgaattg

SEQ ID NO: 105603 - DNA, 634 bp, Oryza sativa
ataaagagtaggcggcggacgggtcgtagaggagtatagtggcagcgtttgacgagatttctaaagattataaaaaataaaatccaacgagacaataaattataaaaactataaggtccaaatttaaaaggttcgggcttatgaaaagtaaaaaaaaccaatgataaaatctcaatgagagtaaagaagggaggcagcgggcgagccgtattggagtacagtgataaagtcgctgacgttttggtggaacttccagaaagtaaaaaaaatgaacctaaacgataattatgttcgatttttaaaataccaatgacaattaagagaagaggtagtggacgggccgtagaggagtataatggcagcgtttgatgggacttttataaattataaaaacaaaacccggcgggacaataaactctaaaaattatatgatctaatttttaaatgttccaagaagaacgaatagaaacagtgctagatcgagaaagcaaataaaaaaaagatatgacataattaaggggtatcaactggcgtgtgacttttataaaaactataaaattaaaaacacagtgatgataatgtttggtccaacgagataattatttaataaattttaagtaaaattatattaaaa

SEQ ID NO: 105604 - DNA, 1715 bp, Oryza sativa
tattgtgttcttttaatatttttattttttatttttatttttagtcgtttcaaaattatattcctgcttgaactctctttttaatttgtccaatttcggattttattctatttttcattccgaatcttaattagtattattgggttcttatatatactcttatttcaatattgcttatatttaattccgaatttcagttaattttaaattgtatttctacctgaactcttcttttcttttcttttttataatttctatttttttattccgaattttaatattttcgtattgggtttttatatagactcttcttccaatattgcataattttaatttcgaatttcagttatttttaaattgtatttctactcaaactcttcttttcctttttttttttgctaatttcagattttattttggtggtctgaaaattaattaatctcgtattgggttcgtgtgttagtttaccatgagcctatgcttttcacagtaaatctagaattctaagcacaggagccgtgcagccagacagagtatgaagggccggtcggcactcggctcctgggcagctgcaattctaccccgtaacggtttcattaaagaaaaggaaaaattcgtgcggctgcaatcctaatcctactccttaacggtttcatcaaagaaaaataatccgattctgcctgattccaaatatgagcagtagattgctatatttcatccacaacttattataatttaaaaactacaattgtactacatatatattgctatcaacctacaccgttataatttagatccactacgatctaacggtgtagatttttctttttttctccgattaatgtgagaatttctagtcccacagcgaacgtggtgcctcctttcaaggctgttttaataatataacagatagatagatatctggtcctacctgttatacacacattacgttctgaagtccgtgttacagctggctacagatgtatagtccgctgctcttctctttctttatttatctttttaaaatataatttatatctggtttatagccctgtaattgtacttgctctcagtggcttgtggtgacatcgcgcattcgcaggtcaggtcgagataagagactccactcagccggcagggctgcctcctcgtgttggctttctggtaattttctttccccccaaaaaattttccggcctcgacgtggtcgatgcgatccatccatgatgtgatgtgaccaactcaccaacggcggaaagccaagcccatcgagcgaagcgaaggccgccgcggacagcgagagggcgcaatttttgtgtagtactcactccgtccacggtataagtgattttaatttttttttttcaccactcgtcttatttaaatttttttttataaatatataaaataaaaagttatgcttaaagtataaagtaagtcacaaataaaataaataataatttttaaaaaattaaataagatgagtggttaaatattgtaaacaaaaactcaaaatccctatattatgggacggtgggagattatgggacggtgggagtaaaagcgtttccacttcattataaaaaaggcggcggccgcgctggccacgctcgggcaccaggaaggcggagagagaagaagttttccgcatcgcgaccgcgcggacgatgcaggctggccgtcggatcgggctgaccgcgtctcgtttagaaata

SEQ ID NO: 105605 - DNA, 1979 bp, Oryza sativa
catcccaagagattatttctgctgatctcaagaagaagagacggagccccagcttgctgggcaggataatgttcagaaagaaagtggaaggcagctaggtcatgctgctgatctggtggatgcactgtgctggtaaaagcttgcaaaatctagtagcgctccaccactatgctgtcactggagatttcgactttgaacgaacgagcttgttctgtttgtgagcattcctgttccttagggtgcaacctttttggacacgtattctgtcacagagactgatgacttgtggtaagagactctgagcacatgatctgtatcggttttccttgacatggacaaattttctttttgtatttatggcctccatggttgtgtaaatgttaatttaataagttaaaaatttgttcttgttcactggaatacgtacatgcaattctttttttctgttgagcggctccaagtttcaagacctctctatactgtttggaaaaatccatacaccgacatgagattacaggtacagaagtagagattttggaaaaaaaaaatatatcacaaattcacaaataaaaagcattggagatggattgcttctgaattctgatactgcagaggcagatatccattgtgccttttgaaaccacaatagcgatctactgttagttgccccgtagttgtagccatttgaatgcaaaagcatttcaagattcttttaggtagggtgaggtcgccaccagtactcatcccaagaaggattctctcatcacagggatgtgaccttctgactttgcatagtatactactactatatttactttataaacagctgaaaaataccaatcatgctttcctttcaaataaataaaaaatcatgccggtgattgtcgtaatcatttacgaggtgtacagtacatcaccggcccagctgatctcaacagaaagaagcacaattggcgtaggcctcatcatctagaagcaatacgtcaaaacttatcccgagtcagcagcacaaaggatggccatattcagatattctaaaggcggccgtgacaggatagaaggcaacaccatcaagccactggggtttccagacgctgaccgatcccaaaaacaaacaaaagtctgaagcactaatatacttgcgtcaaatacaaaagaacggcatcactgcgtctgcatgctactgacaattttctcaaggctttatattcctcgagtcatttgcgttgcagttgcagacacctggatgcagttctgctccaataattagattatcattcaggttgcagacaggaactcatccaggcccggtgatgcctgggacggcaagagcttgtctttttctttcattttttttgtgttatttttctgctgctgatagactgatgatggcaattgtttgtcacttgtcagtcatgtactctgccttgtaccttttgttgctggatagcgttattcggcaacgtagccatgttatcgtgtcttatcctgtaatacatccgtcccaaaatatagctatttctagcacagtactttgttctaaaataaagctatttttctacctaccttctcctctcaaccaatcacaactattctttttttacctattttctcttttcaaccaatcacacaccttcttcaatcattctcatctactttcttaataccgtgccaacctcaaaaatacttacattttaggacggaggaagtaggctttctttgggttgtaatgcaggccaaatggcaacttgtagaatggtttcagatccttcacgccgcgtttggtttctgaaggggactgagatttcgtctccttcccatttggttatagttatctgtttatcaccacaagttactgtttgcttgtgttcttggtccaattcagactgctgcagtgctgctttcttgacctgcagctcatccaaattccatgtatacttttcttgccatggttatcctttgtaacactaaactgtttc

SEQ ID NO: 105606 - DNA, 2335 bp, Oryza sativa
gcagctcaggctgcgcgttccgcgacgacgagctccgccgccggtaaacaagaacagccaccgcgaccagcgccgcgaccggcaggaacacggacaagaacagcttcagccacagcgccatactctcctaattaacctcctcgcacctctcactctcacaccactctactcgatcaaatcatcctgcgccaccggagctgagtcggcgaggtggggcgaggtcatggacatggtggtcgtgcctggactgattcgtgtgacctgttgagttgtcgtgggggtttggtttggtgagtggtctaggaaggcaggcgcggcaagggaggaggctgactggctcaacggaagcaggcgaggaggaggaggaacgggagggcggttggagatggaaaggtttttaagccgcgggaaagcggggtgcatttttggggtgatttctctgtgggtgggtagcccgtagccgacgggaggagggctaatctgcaacgggtacatgggcacgtcatagggttgttaggttagtgacgtgatgtgagaacgccttatgttaataacacaggcgaaagtgttccgcaccaaatctctgtttcctgagtatgaacacttttcgggctccaaatggagaaatgtttttgcgttccattggctttatagcactcaataattaattaaacatttgttagcatacagttgtgagactaaacatttatcaataagcgtagcatatatatatccacgattctatgatagagacgccaattgtagtaaaccagtaaatttagtacatatttgtatttttaattttaatatagtcgtctttgtcattgtgttgttcttaaaccatcgactcgttcaactagatatattggctgataataacaccttcacacttttacgcccccacattttttgttgttagtatattacttctgtgaaaaaaaaatgaaatgcattgaaattttgtttcggcatataaaagttaatgatcagtataaccttgaatacgacgattataatctttttagactaacgagattgattgataggacaagcctaagtgttttaagacaatggataaattggtcattgctttaatagaaactacaactacttattacaagctaaacataagagccttactgaatgaatgattgaatgaatgcaaaaatttaattttgaacggaacattttgttgtggataagctagtagtgtgtccttctctcacttagtgaatgtggctcacaactttgatataaaatgcattcccagaattatgtatgaatatatgatacatttttttagaactaatatatgatacttggagtagtctagtagatgcagcactgctctcaacgaaatgtcactatgtggtatttgtgacaataagttgtagttggttagttactatcactttcccaatcactatgataaactacatgacgttaccaaatacgtgtaatgatgaaagtataagtacacaattggtagttttcgctcacatctcttattttaaataaaataaacaattgaaacgctctagtcactcacatatcttattttaagataaataaacatatcaacatgcactagtcatccgcataccagctcatctgtactccctcccatatttgattttaaatatatgtttgacaattcattttacttaaaaattataaaaacattacttgttttgttgcgacttttaccattaaaggtgctctaaacatgtcttatgttttatactaaatttttaataaacgaacgatggaaacatgaataaaagtaaataatgtcatatatttaaaaatagatgtaatattattttgctgatttcaccaatgtgaaaaaaaaactgtccctaagaatcggtcaagttatgtaatttgtgtaacctcccccctccctacaaaagaaactgatggatgttggcagtacttcttttcagctgaaaatttttcaaaaaaaaaaaacttaagcgcgtaattaatctgcataacgcatccgttaacccttttttctttgcaaaagcttcagctctgacctcactcctcactaagccatccccttgcagtttaatttggaggtacaaaacgccggtggacgtaagccggatggcacgcgagaacagacgtcagatatataccaaatcctatgaaaagtaatatgttctttctccgatgcgtcggtgtcgcggcaaacgtcagatgcccgcatgatcatccccggccgttctgttcacgatttcttccacttttttctattccaacggctcgctaatctctctctctctctctcgttgatagcaatcaacagcacgtgatttggaaggggctc

SEQ ID NO: 105607 - DNA, 821 bp, Oryza sativa
aaatttcccgtcgcccgggtgcaaaatcccatagctggcggggcaaaattcacacttcgtcttgtagccgtgcggtttactcttatctgttgatagagtaggaaaacagaagtcataaattaggatccttgttatgagagtaaaatcattagcagctgacatcagagagtcggcatagcagagagtgacataaattaggcaccaaaccaacacacgataaatgcagtttatgaaattcaataaatccgtaacatgagccgtgacttaccgatgatggtgcaggtcacaacggtcgcagagtcgtagtcgtcgtagcgtagctcggcgaagaactgcttgtcgggtgactcgggaggagccctgttgcgcttgttgcgggagcgtcgcttgcggcctcttttcacgtcggattcgtcatcatcggcagcagcagctgctgcttcatcggctggcttcaccgggctgctcctcctgcgagccaggaagctgacatgaacccagagcgcgcgtctgaagctgacggacgcataacccagagccttgacaggtcgaactcggcgccctggaaaaatgttgctactatgtcagtaacatggtttcgtttaagtacattgctaatcatcggttttgcatccatacatattcagttgttactgcagttatgtacgtagtgaggtgcttacaggattgttagcgttgtagtgatggagagcgcggttgacatggtcgacgatcaaggagagttcagcttgcctgcaattgcaagtgcggaattattgttaccgctacatatactcctcatcttaagaaaatgaagaaat

SEQ ID NO: 105608 - DNA, 4225 bp, Oryza sativa
gctggcgcgtttatgccctacggctagccggtgaggcgggtagtgacgcggtggggcggtggcggtggaatgcacggtggggcggtgacggtggaatgcgcgatgggagggagtggcggcgacggaatgagcgaggggaggggaacggaaggagagttagggttaatacctctgcacgaatctaaaagcatatccgacggtccaaaatttgaaagatgggaggtgggattttctgtcaacatatcctatatatctatacaaatcatccccactactaggaattctctacttcctggtgcttccacgtcaccccatttgctattaaccgtacgatctgaatcattcggcagggaatccatgaagcagcctcccagagttccccggttgtttattgggccaaaagaagcccatgttatggcccaactcaacgggtatccatccctaaccagaggaaaacccgaattttttttatttatacttttttttattaaaatatttacaaaaataattttttgtttcgaaaatttacaaatctaatcgcctgccgccctcaagaagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttagtaactttttcatttaagatgttttagatatccaaatattcgttacaaaatataaaacacattttaaaaaatctcagatctatatttcaaacgatattggatggagataaactttatataaaagttgtatatcttgatgagatctataactttgtagtttatcacttttccatttaaaatcatttggagtatcgaataagcattattagtttttaagtaattaaaaccggtgggaagggtttaacacaaataaaaattttgtatttaggtcccttgccgctctttgagagggcgatttttaaaaatcgcccttcttgagggcggcaggcaattagatttgtaaattttcgaaacaaaaaattatttttgtaaatattttaataaaaaaaagtataaataaaaaaaattcaggaaaaccctccagttccatacaccgcaccacctgaggtggcggtgcccgtcacttcctctcccacgtgcgtcgtgtccctccatctatatggcgctccctctgcctttggttcaagcccacctgccgcctcccagccttttcgcctcctctttggaatgtcatgagaaacgaaaccgctgcttcgagatcagacttcatggttgtcatcaaatacatcaatttactgctcccataacgtcatggtgaattcatccttggccttcgcttattactggggaatgcttcaatcaggttctctgttctcctccaccaactctgcttcttccacatgtacgatgttctgcattgataaccgtagtaagtagttttatttttatccctttggatatttgatatgtacagaaagttatttggagatatggtatctacagccttccttctgaatgtgttatgctgctgctgtagatcttcaatctggaaaaaaaaaaaaaggtatgtaccgctttccttaaaccttcctccgaaatttattcagttgtctccaagcgaatgatcaatttaccctattctctttgtcagagttaagttcaatggttgttttaaatagctaaccggtgatgaataccttataccatttaactgaattttattcagtacgtatgtcaatccagctgattagtcctaggttgattttttgaatcaaacattgcagggagtcgcagtaagtcattgatttgttgtacaataagaacatgtgctcgctcaatgtattggcgccaacaattggtcaagattctctcacctgccgccattatcctgcgggtaggcaactatacttctattctctctctgggtttttttaacattattcatctttgatcttggtattaggcccgcagctggctcagattaatctgtcctctttccagccaatgaccatattgcatagatttaattttccctaaactgaagtgataaagcaagcttctacccaactggccacctttattctctgatgatgaggtagtttattatccccaggtcttctacctttaactgtcatggtttttacctttttgagaatccagttttccttttcataatagaagatgttgccgaaggtgctctaatctttctcctttgtttctcatttttcttgccatagtatcatcaggtgattcactaccttaccatattattatcaggtgattcagatgtagtgaaaggatgtaattgcatgaagtgcatgatttgatcaatacacaaaatagaagtgcaactgatcgtcatctgcagtacagggcaggtatttcagtatttcactatccatcagttaagtgtgttagtattcgttctccgtagcttctattttacggaatgtttttttctctttctgaattcatcctgcaaatatcacgttttttgtttagtttaaaaaagtctagaaatgtataagctttactagggaaaattttcagctatttgtttactcaataaagtgcaatactgcattacgaggtaaaacttaactgaccctttcaaatgttcccatagaattttacttaatctattgttcaaagtgtgttgtacgtattttttatatatatttgaaaatatatacactgttaattacacaccgttaacttcacatgcagcctacacattgttgctcgactaaccgagttttttttactgtagatggcaggttcatttgttgtacgtatggctggagctcagaagttgcttgcaacctaatcaggctaaccattcaatcatgacgtaagaatataacaaactggtgaatgtgattcagtaaacaaataagctgctaattaattaagaacttccattattctaggtgaacatcttcacaattcactgctacaaacatcagggtttcaaattaattatcatgtaacattagactatatgaaacaactttcggtcaatatctattactaaaagtttacaactctaggtcatgcaaaaaaatatcccgcagcaacgcgcgaggtattatctagtatatatataggcagtcccttaatattatgattagctttaatttttgttctaatcaaaccttttaaatttgtccgagttaatagaaaaaaaataataatatcttttaacacaaaataaacatattatcaaaatatattcaatgtcatatttaatgaaactaatttggtattatagatattgctaattttttaaatttgattaaacttaaaaagtttaactagaaaaataatcaaggctacttataatacgaaacgaagagaatacatagtatgaacatgatataaacacaatatttagtatttaccctcttcacgggcgtttctgcaaatatggttttttaggccgagggacatggacatgatttctccatctgtggcgtgcatccgcagaaattctccaccagctcagcctcggcaagacactaagacagcacagcaaactccgcacagcagcaagtcggcggtactgtacacgggccgactcttatcgcccggagccggtctcgtctcagagagagccagcctccggtggaggaaaagctcaagaagtccaccaccacttcgcgaaaccccaattccaacccgacttctccactccacgaagagagccagctccgccgccttcaccatggcgtccgtctggtgcctctcggcctcggcctccgccgctgcgccggtggcggcggcggcggcggcgcccgggcccctcggggcctcggtggcctccgtctccctcgcgcgggcggcggtcccctcgaggaggcggcgaagatgggacgcgctcgtggtgtgcgcggcccccgacgaggagaagattacgcggcggtcgcccctcgattttcccatcgtaataatccccctcttcccgattcaccgtgaaagattctatcggtttatgcactgattgttctcgtgtgtgttgaattgagtgctcgggttgaggaatttttttttttggtcattttactagcttatagcatgcggattcatgggatttggggattgggggtggatgaaatcagaagaaatgccatatataggttcgtagctcgcag

SEQ ID NO: 105609 - DNA, 659 bp, Oryza sativa
agggtttcagcacttggatgatcatgggggctgcatttgaaaaaacggcatgatgggacacaatttctcagtagcagtaaaattggtactctaacttaattgcagtaacttaatttctcagtaatttaaagggtaacacaatttttcaccattctcatctaacttaattgcacatgaacagattattattaaatgtgttcagtgttagttacctttctatctcacaggatgctgagttctcctgactgattttctcgtcctggtctagtataactcttgtgagttcttcatcaagttgactctcttcttggttaaccaaaatatgatctgtttttcggccttctaccgactgaattgattcttccagtgcttcagtttgtatgtctggagcagatgatgatttcggactttttatgtcacatccaccattcatgttaccaaatgattcctctccatccaaattctctgtattattattcacagtgtctggttgttcttggaatgatatattcttgtactggttgattatatactctagaaccaaacaaacctcatgcacaaacttttcaaggtcagttttaccatgcagtagatcatgacagacatggaccaaatgctcaaggcgagcacaaaattcagacctgtcaagcagcaatttt

SEQ ID NO: 105610 - DNA, 1171 bp, Oryza sativa
aagtacagtatattaacctacctgtgatcggtgcacgtacacgtttaactccctcggttacgcgcgtagcttaattagatatatatgattttttttataataatctgggttacgatcggatagtcacagggtcgtcgcacggctccgtccaaggagctgagacaaaattaggctatacaggaccacctctttacatgcatgcatgcttgtgtacgtgctctcggcgacgaagctactacccaacaaagcggttgctcgtcggtatgctcctgtatcttgcgcccgcccgtgcgtgtgcatgcggccggccctcgcgtttcttcgctgcacgcgcgcgggtgtccggtgtccgggcctcccggccgcccacacccacgcacacgtccagcgaatgcatgtgttgtgcgcgagtgtcgttgcagcggttcgattaattaatctatactcggagtagtactacaggcgagtaggcgacgactaataatctacacgaacggtttaagagatcgtgtgagcccccggttgaatatcatgcatgtgccggacttgcagagagtccaacccgatagcaaagctagctaggtagcggatctgaatatacctgtcgccgggctcaacacgtgtcaggcgagccctgcgacagccgtcggagcatgagctgcaggtggcaggcgctttacacggccaggtgaatcttttgggctgacaggcacgggccattgattccggcctaatccgtcgtagtagaattggtattgtactacgcaccgcgtccgcgtacgacgctcgcaaccgggtgatacaccacgtgacgtgacacgcggacacggagcaagcgagctaaccgcagggacgacgcacgcacgcaacagcgtgcgcctgggccgcgttgcatccgtgcgcatccgctcggtcgatgggctccgcaccgtcatgggccgtcagcccgtcgtcacgcaccggggtggcagtggtgggccggcgccttacattcgcggggcgcgggttcaccgcgctcagcgtcgcggtccgcacgtcggcggaggcgaaaggccaccatgccacaagccggcgatttgctgctctcttctggggggaaaccgagcgcatcccgtcgagccgccgcccggtgtcctgacgggccaatgcgtgtgcaggactgcaggtgcgg

SEQ ID NO: 105611 - DNA, 666 bp, Oryza sativa
cagagggggtcccactggctttgttagcttcttttccagtgagactgtagcagtgtagctgccctgtgcctttacgtagggttagtactcctactactgtttgtttgttcagctcgtgcttaagttgcgtgcgacaatatttatacaggcaggcagcaagttgcacgtgaaattcgtctgctggttgctgccgctgcgcagcatgatttggatgtgtatgtggttggagtcttttcccacacatttggccggataaacccgacatgatttcctaaccgcgcgcgcttggagatattccgcctggtgtttaccatgatttctcgttcaatcctccgagcgaagtcacaataggcaatgtcgcgcgtttcacttgttacaccaggatttctgaggagattcaccgaggaggttgacacttgaaacaacacgatcaatagtttcttaccctcttcatattcacaaatatacgacaggcaaaaaattggtacgtgaaattcgtctgttgtttgccgctgcacagcatgatttggatgtgtatgtggttggcgtaaaccttatcccacacgtttggccagataaagcccatatgcatgcagatgcagacatgatttcctaaccgcgcgcttggaaatattccgcctggtttaccacgattcctcattcaat

SEQ ID NO: 105612 - DNA, 566 bp, Oryza sativa
ttcctgcagccctccctggcatcaaaatccgcagaattttcagctcaagatttccacggttgcaacgcgagaaagagaattcttgttaccgtcgaggtagaccgcgccgttggagtggaagccgatggacgacgcgtacgttccggccagcgacggccgtggcggcgcggcggacgcggcggtggcgaggccgaacgacatgaccgtgtgccgctgcttgtcgtggtgatcgtcgactttcgtggcggctctggtttcttggaccgcgttcttggcgtccggtgcaaagctgatgagcttggcgcggtcgctctcgctggagccgtccctgccgcggcggctcgccctcgacgccgaccactccggccgccgcgtgttgaggtagatgatggtgatctcgaagtaggcgtcctgcgggaacggcgcgccggcgaggggcgggccgggcagcggcaggctcatcctggcgaggcacagggcgctgctgttccccgccgcatcgtggtcgccgccgcggagcgggctcgggatgctcccggggagccacttcttggtggacgccgaga

SEQ ID NO: 105613 - DNA, 1399 bp, Oryza sativa
cagcagtaaatactgcaggacaatccaactgaccaggcactgttagctttcaccgactgctttccgatccaagatcgaagagaagaaatggataaatggatgggttatggtcaattgcttatggggacgaagtaaatattttatactataaagctaaaagcagcttggaacaagttatccaaacagtgttggtgtagaaaggttttggagaaattgcaatctggagtgtggcacaaatagtccgacataatttgccccctgtaattaaaaaaaggagcattgcagaactatgtttatacatgagttaggcacctgttcatattcggatttgacaaggtttatggtccctttgtatcaaaagatttgtagaggaatttcaaggggaatcctatatgaaaattttctattttaccttttgatacaaaggatttgagctttccaaatcctataaaattgctatgtaatggttcattgtatgtaggttttggaggaaacttagcaagagcttcaatctcttggaaattttctttttagtctatttcttttatgtgattcttgcatttttcgtacaacataaccaaatgaccattcttgcgtttagcaatcctctgttttgcacttgatttcttatcaaaatcatcgttttttggatactgcattttaaaggagtttcatggcagatcacaccatcacctggttgtcttattgacaaactctcggtgttctcctaatcctaggacctatgtcactctcataaacttaagatgttgtatcatagattgccacacttgccaaagatatgaacaaaccgttagcctcgttttaccaagtttaggttccttcggattatagaatttttcagaggtccttaggtattgggatttgaacatgtcttccaatagaatacattcctatatttaaataattcataggattttaagggccatttgaatcaaacgatttgtggagaaattttataggattcaaatcctgaagaattttttcctatctggtcattagatataaaggattggagattttcaaatcctatgcaagttgaatggctcattattcatagattttgggggatacttagtaagaaagagttccaaccttttagaacatttccttttaagtctattttttcatccaatttctttgttttttctgcaacttaattaaacaacaattcctagtttttcctgtgttttgtaatcctctgttttgtgcttgtattcctattaaaatcatgtgttttttctatgcctttgtttttcaatcacgcgtttcaaaggaaccctaaacatgttcttcaacttcatgatttctctttctatcctctttaatataatcatgttcttcaactccaatgcaaactctctctctctctctacccttt

SEQ ID NO: 105614 - DNA, 1890 bp, Oryza sativa
cgcgggttaagagtggtgtttgggtgaatctcattttaagagcccttttgaattgcaggaatggaaaaacggaggaataggaaaaacgtatgattgataggcagtataaaacagaggattggaaaatacaggaaaaacacaagaatgaccgtttgattggaccataggaaaaacacaggaatcggatgagagagatagactcaaaggaatttttccaaaaggttggatctcttgctaactttcctccaaaatctctataggattagtcattccataagaattttaaaggatagtatatgattcaatcctttatttcaaagtctttcataggaatttttttttcataggattggaatcctttaaattttctacacttttactacaaatcaaaggggcccttaagggtggcattatagcgaagccagtttttatgagtgacatatatgcaaatttctcctcaaacgcatgcttagaataatttctactctgtattgttttatttcccattatgttccacatgtcattgatatttcaatccaatattacatttttttccccgcgttctagaagactaaacagtgtggcgtaccagaactttgacaattaacacaaacaaatatcgcaaaaggtcgtgaaccaaatacacccaaaacttgtgctctgctaatgtcactcacttgtcaacaaaccggcgtgcagtaatgcgccatcgatcgagctgtcctagcaaatcgggagcaaatccgggggggtgcagatttgctgaagcacgcacatcacgttccagatccggcagagctcgacactgcctgcccccagcgtgcatcattcttccgtgattgtatcaaaacatcagtggccacctcacttgccaccacaaaaacccatccttcttccaaccaaacctaggagcaagctaaagagatatctgaggtttcagccatgtgaaaaaaagaggaaaaaaaagaaggatcgttatcgccttcataccaagatccttgaaatgcaactctgctgctgagattggccttttgatttgattacggttgttgataggggagctaggaaaaggagatcagctgtgtggtgtgtctgattacgattagacggcaggtgatagtagtagaacagtggtgccacaaacccacaaggcgtggattcacggttgaaacgtggtgtggtgcgtatcgttgcactgctccgtgggatcacaatctcgacccgacaagtacgggcactaccttcttgccaatggatgaagtagattagcaagtcacatcaaagatttagcaacaccatggcctagattacctcggcgggttttattgatgaaagcaatagagatactcttgtcccactgattgatttacgtgaggattccaatagttttgccagtttgatcagattttctgtcccctcgaaatttgattacttcaaatttgaattttcaaatattttttaaaatatcttcttagagagagttgttaatacccaaatttagctcctagagtaagaaataggaagtcataatcaaatttagaaataactcagacttgccacacgaggctagtgtgacaatagccattgggccggtcagacgacggcaagggcggtctgaccggcggcatgtggtcggtcagaccggcaaggccgactctgagtgaggtttgtaagttcttagattttcttgctaaggcttgggattttaaaatcctaattggtttctacctaattgaacgtggaaaaaactctgggaaataagtctacccctcttataaatataaaggagctaagaccgattgaaacaacaacaaatcaatcatcaaaatcaatttatttacccaaacctctatattctacatctccctccttcctactacctatgaccta

SEQ ID NO: 105615 - DNA, 726 bp, Oryza sativa
aaaaatggcgccccgtactcctcctcggcccaagtcccctgtcactagggatagcgctaggcctagctggaattgagatcacctgcagttgctagtatgactacaactttagcagttattcatctaactttggatcgaataacaaggattcagattacacaagagtaatgttcatcatatatattactgtagcaagatgatcttgtagcaaatgttgagaacagtactgctccataaatcttgacagtattgagagcatgagactgctaaacctgtagtccttattcaaactgcacaagatcccaatccgcctagctggtgtagccgctgcgacccgcggtccggcctggtcgaggcttgcttcaggcactgcgaggcgtgcctgcaatttttacattttaatccttttattaaacttattaatagaaaaaaaaactaatagcgcagaaggagatcatgggctcaacatcatctttgaatcgaaagcattgagcctcaacacttgttcgaggtggtacagacttgttaggtatggaagctcaataacataatatcaatattattattagcattgacctctatggactatggttcagataaaaagatatgcatgctttaactaataataaaacagggcgactctctcatccaatagatcatggttcaaactccgaaccattcacctctttttatttctttttctaacaaactttcacatgggaatta

SEQ ID NO: 105616 - DNA, 686 bp, Oryza sativa
cagtgccagcaaaaccggctacagcagtggatcttgttcctgctcagggcgttcgtgtgcaatggctcgtccaattggctcgaagcttatcctttttctctctctcatagagaaaaatgtgaaatggatttgggaatcatgggtacaagcactcctacgcgggccaaatacgttgcaacttgcgagttgcgatacattgcgctatggctcaacgacgaatggcacacgtacaatcacgaacattgtcgcagggcgcacctagacgagacaacaagaacaaggataaagttggacagtcagaggcaaatgcaatttgatgaaccggcagattacattggagcatatatgccaaaaaaaaaagaaggtagtactaacatacactggtggagaaaccatctttgctcggtcgacccaaatccacagtagtcccggttccattaaaaatcgggagtaaaaacgatttttagtcccaatttataagaacaacaggactagataatctttattcccggttggtgttaccaaccaggaataaaaatctaacacgtactatataatccctattacttatcctcttatatcgtccacacaacaaactctctctatctctttttttcctctctaactctcttcctctttcctgccttatctctttctttttgatagatcgagcgagagcgctgcct

SEQ ID NO: 105617 - DNA, 2189 bp, Oryza sativa
acttttcaggaagtctaaggagccgttggagggagcggttaaaattagctttagaccctatttagatggtactaaaactgttttaagtccctatcacatcaaatgtttgaacactaattataaatattaaatgtagactattaataaaacccatccataatcttggactaattcgcgagacgaatctattgagcctaattaatccatgattagcctatgtgatgctacagtaaacattatctaattatggattaattaggcttaaaaaatttatctcgtaaattagctttcatttatgtaattagttttgtaagtagtctatatttaatactctaaattagtgtctacatatagggactaaagttaagtccctgcatccaaacaccaccttatagttgcatgtaaaataagatgaatcatcaatacataattaataaaaaattaattattatagacttgaacttttattaaaaaatctttttaaataaacttctatacgctatttaacagtttgggaagcgtgcttataaagattgagcaagtgtatcgttgtaaattgcatagaattcatcctaaaaatttgagcgtcaaagttcaaatgtaacatatcctatgtacacaagtttctcgtacacattcgtgcacaccaactagcaaatgtcacgaaaaattctaaaaaaaattggatatttactcgtaatagtattacacgtatccccaaagtctcatattcaaattcattatattttagccataaacaaatgaaaaatctaacagtttaaagataattatatgtcagaattttgtcttttttaggctaaaatataatgaatttgaacataaaatttcacatatagctgtaatgctatttgaagtatgtgtctttttttttatagaattttgtgtaacattcatttgttggtgtgcacggaaagcttttatgcgtaggatatattcccgagttcaaaacatttagtatttgtagcatatatttactttttttttcttcggaagaaaattgacgcggcaaatcctgcaagggggctatatgctgcaatttttttcctttataatatgtttatgtgacctatttgtttatataagtaatttacaataattacggagggtatcgtgcgcatttcataaagaacatagatacaatcatgcaaccacaatggatggagatgtgcacttgcaaatatctgttgaaaataaccatcatacacaaactatgattatacgtactacgactaatgaaagtttcatgtttatgtttaagatgtaacacgccttgttactacgatatccttttaaatattattagtaaatttattgaaaaaaagacaattgatcaaagtttacatataaatagcacttcgatgacatgtatttacaaacctgtatacaatattccacaacacatattgcattaagtctactttttttatgtgagcaacattatgctggaacatagaaatgttaactagtactatgtctgcaaaatttaatcatgtattcattctttaaaaaaaggaaaatgaacaagagttgataaatcttatattatgaacatatattctaaaaattcaaactctacctgtcgaatgtattcatacattttttttctcgggatcaaatcccaaaaggtgaaaagtagtacttttctaattttaaatatatgacattattaacttttaaatatgccgtataattatttgtcttattaattttagcgcttatgttcttgcaataataaagcaattcatgagaaaataaataaaatataatttttaataatacgaatggttaaatcatcaacatcatatatttaaaaagggacatgacacgtgtaatcctatttagacgcgcatcataatatatttacacgtgtgcgtgtgtatgtgcggcgatagagtgtgtatggaaggtgtactccgaagataaaaatcttagtagttttttagtataataaaatctatttcaataaatgctctctacgtgtaataaggagtatttgtgctagctgaaaaggacatttttataaccatgatgcttgagaaaaagaaggaatttatctacacacttgggggtgtagtcacagtgcttgtctgctagatccacttttccagacaagtactccattccattttcctctccatcgcggacgcggttttccagtacaaaaacca

SEQ ID NO: 105618 - DNA, 602 bp, Oryza sativa
tgaaattgcacaagcttgctgtaagacgtcaaaggaccatacaggcaaacttcggtgattgtgtgaacagtgcctctcctgaatgatttaagaatattattacatctgaattaatagaagtactaagaattacttctttcgtcccaaaatataagagattttaagtggacgtgatatattctaatacaatgaatctaaacagatgaaatacttactccgtcctaaaatataagggacatcacattcacctaaaatctcttatattttaagattttgggacagagagtattcacttttagatgtggaatgttcggcacaattcgttctatttgcgtacaaatatgtactagtgattgcagacagtggggattagtactggttaatttaatacagagtgtatggttttggtcccaggtactgtagaacattaaagtcagaagtccagcatgcgtggttggaacggtaggctatttccacagaaaatgaaagcgacgagatgaagtgatgaactaacggccatacttttccatgtcagaatgaatcgtaggcaaacacgttagacccaggatcaaatactcacccctaaaacgtgcgcagaggtt

SEQ ID NO: 105619 - DNA, 1430 bp, Oryza sativa
aaatggatttgctggtctcgcaaggcatgcgttgagcgttgttggcttgttgcgtcgccgttgagttaggctgcgttgcggggggtaaacgcgtgcatgatcctggatgaccgctggtggccagggatgaaaacggagcctatcgagaaaattgaatacattaggatggtacagatacggatacaatcatacaaatacaaatgtttttcccacatgaatagttgaatacaaatatggtattagactttccgacggatacacattttagaagtttaggtggatttcgtgttccgagacatatttgtttatgtattgtgtctggtgttattcaatccttatttgtattcgagatcattcatatttatgtctatatcccagctattcgtatttgttttcatatccggctaaaagtacgaaaaccgatgtgatatgaatgctatccgcatgtatccgctctattttcatctctattggtgacatgcagcagcgggggaagagggcaagaggaagtatggcgaaagttcataagatggtgcaatgcaaactttgcaatcccggcggacagtgacagcatgcttgctgactggtggcttgcaacgcggcgccgttttaggacgagctacagggtggacttcgacaacgcctttatgttaatttgctagcttatttggaaggaacaaaatgctagaatttttcagcatgtgtcaaagattccgaagcaactagccgaggatataaaagaagaaattgcggtgtggagggtagctgggatcttctcccattttggagagtaatcgtgttgtgtattgtcagggttctgccctaccttccctctttcccctttgcttgttcacgctgggtctgggatctctcccggactagcgcgacattgtaatgtcgttgtaacattctccttgtttttctttccaatcttaatgaaattggtcgttggccgacccggcaaaaaaaaaaagggcaagaggcaaatcttccgagtgtggtttcgtagcattacaaatttattagcatatttgagtaaaaataagaacaagtgggattgatttgcatcttggaggatcatgaaaaagaaaaatgcattaggtgaggcttgcgatttgtcagttagctgaaaatgcgaaaaaatatcactcgagttttaaaatactaggatggctttaagaatcttgcaacaccctgtaagccctacatgtcacttctcttattcctcaccccactgcccttgtcaccgccatcaatgtacctctctgcctcaccagcgtggaaggcaccaacaatgccaacaagggccaccataccgacctccttccccctatcccttctttcgcccgaagctgaggcgtggcaacctttcccgtctctagcggcttgcatcgtcgagataccaatgtgtctccaactctccatctcct

SEQ ID NO: 105620 - DNA, 738 bp, Oryza sativa
cccaaataaaagacacatgagttaaaaaaaacagtttatgaattgatctagctatactcgatgtacgcgtacatgcttggctttgtcggctgaatttgccggtacaagctgctgactcttttgttaattaagtaaagaaattaagaaaatgtgctcctcgtcgtcggtaccgccgctgacatcatcagctggaacaaatgatcaatcacgaaggccggctgacatgtagaaaacaaacaaactagagatcgacctttggccctgtttggataagtagccaagagttattttaagacctattttttactcaaggaatagctcttcaatgaaataggccttaagctgttttgatgaaagagctatttgacatttagtacactttctcaatcataactaccccttttctctctttctccactgtatcttttgtgcatgtgtcttggtgtggccggctgcatatgccatgccgttgtgctctatcactaggacagggctctatctcataagcttgtagcataaagggagaaaacaacaaagttttttctttaaaaaagagagatcaaattgctctgtggagcgcgtggactgttcattccattgcataagcactgatccatcaaacgcatccacgctgacacggggaggaggagcatggccggggccggtcgctgacggctgcgacggccagacgcttggatttggatcttcggagaagaaatcgaagccaccaccctccat

SEQ ID NO: 105621 - DNA, 1425 bp, Oryza sativa
gtgtcagtgaccgcgggcgcctcgagaggatacgtacgagccgtacgatgcgccaggtgacggctcgatgggcgacacgtcgcgagcccggcggcgggtggcgcgtcgctcgtgggttcgtggctctccgccgcgaggccgcctccggttcaaagcctagccctctctgatctccctgtttttacgtctcttttgcagctagcaccctgtgtttcgaggtgatttgctaaggattgaatacacactttataggcaagctcttcggttatttcttagaaagcacttaaagcaaacgttttcaggtatggagagagggacgccgatttggatatctttaagattgccgcaccagatgcgtgtagcacatggcatgaatcaatggtggttgttgtgtatatatgtttattagtagtagtgatctttatatatgcatcctaacatagaggagttgtatattactatattggtatgttcacatggatgtattgtagagttcctcccgttttatcatgcactaccttgttggatataattgtaaatgagtagaactggggatggtcatatacaattggtacttatgatttgagagagtaacaatacttttatatcaacaggacaaacacttgcaaatacatacatatatactccctccattctaaaaaaagtgagtacatcccaaaacaatatgtaataggggtgctaaaatcaaattttgctcggttatccagcatgtaatcgtttaattcatatgatacgaaagacaacttgctctaatagcatgtatccacacaatcatgttaatttgaagagtagatctattggtttttttgttgttatgtagtcctcgttctcgattcactttttttttccgaggttcacgattcgcatttcagttacacttaccagctgcaaactaagttgggaggtaataaaaacattatcagattttaatattaaattaataggtttcaaatattgacaatgttactagcttgtggtccgtatgcttcaaaataattcaaaaataatacagcttgctgaagacagcattaatatgccaccacaagaataatatactcaatttttagtatatgaccaaactagtcaataatttttattttctacactataaaaatataaaattaggaggtttgtagctaaggatacattttttggtgggaaccataaggctatcaactagagataaaaccatagaattattatatattttttcaaacactgaatcattgatttatatgagaagccgcaaataactagacacgagagaatacattaagcttatacatcccactatttgtcgatgtgatattaaacaaaagatcaatacaactatatatgctcttcccacatgcaaaaattttggagaatacaaacttcaacaaccaaattaagtgttgttttgcc

SEQ ID NO: 105622 - DNA, 1157 bp, Oryza sativa
ttgaagataacttgtagaatatccccctcaaccaaaacggtgtgatatttttggctcattaaagacattataagatgccacattgatcactaatttcattcgtacaaatttaatcatgccattttcaaatatgatcactttatgttgtacatgcaatgattttcaacgcatattgaagaccaccatcaccgccagctagtgtggttttatgttctcttttcacatggagaaatttgagaaaaaaaaatgttgcaacacatgaaaacaaaagaatatgagtgtggtatgtatttgggggtatatataatgattaatttgacctttcgattggtacttttgaagaacagaatcttttgatgatattacacaattgtgtgaaacaataagtatgtataccgtaatgtatatataatgagagagcataggaatgggaacttggtacctgtaatactagtccatatgtatatgcatttatcaactcattgcactgaaactttcaatttaagtcagcaaagataacctatgcataattttaagttcaataatatttgtaggtaacactagattttaagagttatatcgctagctttctgcatgctgcacctacatatctaaagagtaggactgatgaaatgtatatatattgtactattttaacatgaaccatgatcaacattgtatccctctagctagtaatatctgcattttggacatcgacataatagttttccaacaactgcaactttgactactaatttctatatgttgtaagcaattgtaaaatccattaaaatttattattacagtagaacttttttagtacaaattcacgtgtataatttttatttatctgatatgattattcgaaaatatattgattagtcaaagttttgaaagtttgccaaaaacttgtccataatgataggtatttgtacacatgcatcatcatatggagtagtaaaatcattgacacaccgcttttttttccgaatttaatttggtgcagacatatgcaaaactaggactaaaattcatcacactacttgatgagaaaaattatgacccagagggagattgttttattttattggaacataggaaacgatgaggattatgggtacttcagtattttgctcaaaggcatttatatatacgtc

SEQ ID NO: 105623 - DNA, 1002 bp, Oryza sativa
aacttataagtcgaaaccataaccgatctaaagaaaaattactctaggtaagagtcgtaagacttctacacctctactctcagcagtcttaagctaaggttggatgaaaaagcaacgtgaaaaaacccgtaaacaaagttaagtcctaaactcaagattggctattggaagaagcaggcccttaaatactaattttaatggcccaataagaaagaaattgcagcttttcttagaggaagaaatattttatattaaacaggcaatataagcccaagagagttttatctggcgaagaataggactggattgctgtggtgggctggtggcccatacgcctaacagggcacaccatttaatcgtacttcccatatattttctacgtcccacaacgaatctgaacatggtgagatgtaagatagtagattgtgcagattcgttatactaaatatatgtcatatacagttatgtccagattcgttgtactagaaaatattacatctagtactggatttattttttttgacacaggggtaggatgaaaaattagagatagattctttttacaaaatatatagatagatagatagatagatatagattattaattttataaaacatattgatgtttctcaaaaaaatattgactgttgctataaggactaaattatttttctacacaaactaatcttaaatgcatataattgtactttttgtacaactatatagtgttcctatttccacaaaaatgtaatagtaattaccatttcttcagtcttcataaatatttactagtatgtgctctgcattacgtatacaagttaatcaatcaccgccgttataatttagacccgtcaccttttgtatgtgcatatgtttgtttttttttcatttaatgtggtagtataatatctaattagctcgatccacacacacaaactccgcatgtgtttggttttgagatgagatgggatgggttgagttcattcttgatttttgggatag

SEQ ID NO: 105624 - DNA, 1154 bp, Oryza sativa
cggctggacgttggaccggaccagaccagaccaaaaccaaacacgccccggcagtgccgtcgcggtgccagctccaccacccgctcacgaatgattagttcgtacgtattgcgcgcacaaacaaatgtatcaccagtagtagtacaaccaaaaccatatgtagagtggcactatacggtttcaccgaggactgctcgtcgtcaccaacacagtatgtacctttcgttttgactttgccctgcgagccatgttcgattgcaaccgaatctactgtgctgagccaaacccatccttgcttgctcatgtcatccacctgtggtggttctggtgtgctcgagctagaatcggcttctgcagagcacaagacgaccccagggccaaagaccagcgaccagaatacaaacgccaggacacaagaggacaaccggacaaggccacagaaaagaaaggagacgcgaaaaaagaaagattagaaaaaagagaaaaaaaaaacacaatagggagcttgggcggaaaaaaatccggtcgaaaatcctcccggtcggccacttttaattaacaagtcgtctcctcctcatccatccaccacaccacttgcctccaaacaaaaatctgacctgacctgacctcctcctcggctcctcctcctcacccacaactcttcccaatgtcgcctcccctcgagccgcacgactacatcggcctctccgctgcggcggcgtccccgacgccgagctcgtcgtcctgctcgtcctcgccgaacccaggcggcgaggcccgcggcccacgcctcacgctccgccttggctcccggggtcggagtcccccgagcgggaggtcgtcgccgcggggctcaccctcgggccttttgccccgaccaccaccaaggcgggctccaagcgcgccttccccgactcctccccgcggcacggcgccagctccggctccgtcgccgccgccgcagcttgccaggacaaggcggcccccgccgccgctccgccggctgcaaagtaagattcgtgagattcgatgtggggcgggtgtgtgtgcgtgtgctgccgtgctggtactgatcggcgatggcgatgtggagcccagggcgcaggtggtgggatggccgccggtgcggaactaccgaaagaacacgctggcgg

SEQ ID NO: 105625 - DNA, 881 bp, Oryza sativa
attcggtaggtggtgatctcctaggatctttgccatcaaaacaacacttattttttcctctgaaatatgtgatcagagagctgtcaccatacctattctgagggaaataaaaggacttaattagcaggatgttaaatgatttttatattttgtttgttcgtagctcatgtacgtacactacaaatttagtggacagaaatttctttttatgtggtgggtaaagttgtgaatgtgtaacactacctactaaagttcaaatccgggtggaaaaaataaacggccgttatattcatacactaccacataatgtgctatcattgttggttctatgtgaatgtgacagtgatagagtaacactgctaactagctcgcacagactatcctactggtttattagtaggactgtctgtcccatgccccgatcatctaggtcgagcgttttttttaaatttccagacagatatcattgccggttcttgacaccggttggcagtaataagcaatgccctaccgttacctggctgtgctatcactattggttctaggtgtgaatcgattgacatgcagtgagataccttttcattatcggtaaaaaaatactaacaatattgctcgcagggaacactgtcagtaaccccttgccggcagggaaactggcaatgattggtcccatgaattggcagtgttcgatctatggtagtgattaagaagaatgtaatttagcaacacatgttaatttgtgcaaacaagtctttcttgcattatgcaagaacacacgtggctagaagtaccacccttcttacaaacactaatgtaattaatcttcttaacttaatgagaggagagctctctgttctcaaaaaaacaaaagagagagagct

SEQ ID NO: 105626 - DNA, 2462 bp, Oryza sativa
attataaaagcaccagcccaaacgatcagccaagataatcaccatcagctcacggcacaagcacgtatatgcattatctgctcttcttatttttaggttgttgagatatctacagcataataaaatctaaacaacatttgatttatatcttcgattgaatgtagactttcatggttatcacggtcagtgtcatcttcgtggagggctccatgcatgtattaacttttggtcagtttagttctttatattcttgacaattaaatcaataatttaaatctatatattgatgttttattatcaaattataaaatagtgtgagccatatatatatgccttcaccctttgcattttctatgatatagagataaaatatattactctacgaactttaaattaggtcagtgtcatcttcgtggagggctccatgcatgttttaacttttgaaaactataagttggttttatgatcaatttagttctttatattcttgacaattaaatcaataatttaaatctatatattgatgttttattataaattaaaaaatagtgtgagccataccatcaccctttgcattttctatgatatagagctaaaatatattactctacaaactttaaattagtaaacccgttattttataccattaaattaggtctactgaaaaaacaatccaccccccccccaaaaaaaaaccaaaatctcccatgtaagaaaaagcaaagtaacacatatacacatgtaaaaatataaatatatagctaaaaatatacatacacactatgatcagagaaaatcaatggtctctaaactatgattttccatgatataaaaaatattacccaaccaacatacgcagttaaactagatcaaagatgtaatatgaattcaatggtctgtaagtgttcatctattaaatatatatatcaattttaataattctgatgtattcctttaattaaatgaactattattgacctatagtagttagtgctaactgataaatacataatggcacataataattaatatcataataatttttcaaataattatggtgtacaatatcacctgacaaataatttgaatctacatatgtaaaaatgaaaaatgaaaacaacagaatttagttatatttttttcaagtagatcttatctaattttaatatgtgagatattacgattctcaaatattttttttgaatttttcaaaactatttgattggtatttgaaaagtgagaagccacacatgatacatagacatgataactttattaaaaatacttctagcgagtgatatggctatactacaaccccttaatccatcatgagaactatggtcatatatgtaggttttttgtttgtcatatagttttggcaacaaataaacaatcaagtaacacccataatatatattttttatacttgaggaattccgatgtgtcgggcatagttgatggatgtatgtcatatactctactaacatgataacctcactcactttcaaataagaatattgtatatgtattattgaaatttgagtaatattgatttacactataaacaaattgtgtctactatataccacaaaacaactcaatctttaaaaaggattattgtaatcacctccgtcttctctttttccattctcaaaagggtgccaagcatagataataaagcttgctatactaccatgatatagcaaaggcatacatttggatagttaagccaccatgggtacttaattaacgatgcaatcctttatgagggtactaatagtgaattagccgttaaaactgttatccacgatggtcttgatgggcacgattatgtcgatatgtgacccatgtttcaaggtatcgagaaagaaagccttggtagttatgttcggcttcatccgttagatgggcattcatatcaaattttaacattattatcctattaactcatagaagcgatattgttataatatatttttttgataaaatattattggaatatttatacatagatttagaaataagtcagatcgacatgaacagttaggttagtagtggagataatttttttagtcgattaacgatgtattgttcttattttgatgttacaaatacagtttcatctattaaataggtggtgtttggatccagggacttaactttagtctctgtatttagacactaatttagagtattaaatatagactaattacaaaactaattacataaatgaaagttaatttacgagacaatttttttaagcctaatttaatccataattaaaaaatgtttactgtagcatcacataggctaatcatggattaattaggctcaatagattcgtctcgcaaattagtccaagattatggatgagttttattaatagtctaagtttaatatttataattagtgttcaaacatccgatgtgatagggacttaaaagttttagggctgcaggaat

SEQ ID NO: 105627 - DNA, 848 bp, Oryza sativa
acacattcggaaaaacttcaccgttttttaataaccatacaaaattaccattgtcttccgttacgtacacacgtgacgttttacgtactacgcgttctctaaacaatacattttttactaataatttataatgctactacgatctgttcttcctcccatgcatgactctaattcttttttgtgtttctcatatgtgtataccaactacaatttttttaaaaaaaattcttatatttttaattcgtgtagaaactcgatggacatgacattatatacctaccttcccattcctgggttttcttattaatctttttttcaaaggggtctttttttttccttttgaaaattgggcttgaaactgattaaaacgacattttccatgaatagagggttagattttgaatgtcacgcaccgtccccgaaaagctagggttatatgcttcacaaaatacagccgtattgcattctcatttgtacttcatatttttacggccaatagaagcatacaaacaggacagcaacgcagatgatgtggccaaggcacgtaatgttagctagtaggcgttggaaaattgtttgatactaagtagtagagtataaataaattgtcacctccatccactatcaagtagtcgatatgtccgagtggttaaggagacagactcgaaatctgttgggctttgcctgcgcaggttcgaatcctgctgtcgacgtacttttttctttcaagtaaaacagcaccagacggcttattagaaataaaaataaatttgtatataaaactttttatatttatatatgtgttctttgtgacttaaagccaatgctgaaaaaaaaagtaggttaaa

SEQ ID NO: 105628 - DNA, 1072 bp, Oryza sativa
acagacacgctctcccgggtcccgaacatatcgatccccatctggatcgctcacgatccctcgccagccgccagccgccagccgccggccgccggccgctagccggtgctcatgttccatcgcgatcgagaaaggcgcggatgattgtcgcgtgcttaaactattctgaatagtttacaaatacttttatacacttggaagtgtgaatgataatactactggctatttctgtaccattatattacaaacggtatcgagcacggttcaaaggtaactccccactatatatataactggcgaatagctactcgatctcaaaacctatggggtcaagcctttgaaatcggtgttttatatatgtatttcaatgaagatataattgtattccaaaaaatgtgagaatatcccacaataaatgtgaggtttataaaccttcagtgtcagaatggactttagattaatttctcgggaaaaaataggactacagataagaaacttgtaagctgcatatgggaaaaaaataatatggaaatgcagcttttaatgaaagaaaacaaagtataacacttgcatgtacaatctatttacataatgacatatattatattttatatcatttggttgatccatttggctactacatatatatgcatatggacattcgaaaatgatcgggtctgcacatacttttgataatattatatacgcattgatcaactagcgcttccaatggcttgaacaactccaacttggttgcattcctccaactacacctagtacgacgtacagtgatttggtatacgttgtactacgggaataatgcaggcactgtgcaacttacaggggccgatgagagcagtgatcaatctagcgctaactcccaaagtaaagcctttttggcaggtgggagatttgcagttcaatatatccaacttgatgtggccatataacataacgtgcatgcctgcatgcagcctctgcctcttgtatgcctagtgggtagtacatacacgtattaaatacttcatccgtttcgtattataagttgtttgattttttttaagtgtgatta

SEQ ID NO: 105629 - DNA, 1393 bp, Oryza sativa
aaatttagacaggaagcctgttcagttttgttgtactataaaacgttacattttatcttaatttatttatattatgcgacagagagagtattacaagagggagtactacataccaacgtatgtgtcatcgttggctcaaagggcattctgcccggtcggctagctagctgcctagctacccttcgtcctcaggaaattaaaatcaatttttaaggacatttatctggatttattttcaaaggttggtttcttttttaacggatggacagtagcttaattacaaagccagaggcctcttctcttactgttagctagctggaaattaatctcatatttaagtcgttctagctactttattcatcccacaatacttatcttctactcctgccgtcctaaaatataagcatttttagctataaatctggacaatatatccagatttatagccaaaagctgttatattttaagacgaatgtagtagttctagtattcaaaagttattcaaaaatagtactacctccgtcccaaaataagtgcagccatgagattccacgtccaactttaatcgtctgtcttatttgaaatttttttataattagcatttttgttgttatgagatgataaaacatgaatagtactttactcttgacttatgtttttcttttcaaaaaatttttaaataagacgaatggttaaaattgaacgcggaaaaccaagactgtacttattttgggacgaagggagtatcactttggagtactacttgtcacacaatcattttcaattcaaaattttccccattttacccctaaccaccattctactcctaaccaccatcctatatctaactctatactccctccatctatttttgatagtcatatttcatcttggcacacagaccaaggataagtaattgtacttatcatccatttaaacatgctactagttattcctcgtaaacatgcgattcattaatatttacatttctcaatacccatgtagccaatcatgtgtggaagaatggagagtcatacattaaattcgagaaagccattaaaatgataggttgttgaattaaaatatgcctatcaaaaataaatttcagatttagaaatatgactaacaaaaatagatggatggagtattatttattaaggatattatagtttttttctccccttaatatatgctaaacaatttagaatgataagttttatggaacggaggaagtagctagcggcgcaaaacgactgtattttgtgtaactgtgccctgagaagatgtccattaagtactgagcacttaattagtacaccggaactaacgtgagcagggtgatttgataactatgcgacaaaaggcatggacgctgccaaatacatatagcgac

SEQ ID NO: 105630 - DNA, 666 bp, Oryza sativa
aatttccactctggagtatttacatctgtagcattcagcctgcacaaaataaataaccataaagaattaactaagacagcgaagactccataggctcaatgacttgtctaggaagcaacaaaaaatgtataggaaagcaagatgctcatcaacgaatgaaagtattttctaagttcaatctagaagtcccattcatgtaatattgtcttacatgcatgaaagaattctccaagcaagtagcatctagataacatgatcacaaaaaaaaaagttcacacataattttagagtgggaattatcggacaacagttttcatatgcctgttcttgtaacatctcactttcaggagcctgtaaataagcaagtattgatacaatatatttgagcagcagtcttgatagaagcccagtgttattactcattatctatcaaaacgaaattcatgtcactggaagtacatcatgtagtttaatgtgatcaattaaaaagaggtggtcagtgtcctcttctattggatgtgaacaacgatggtaaaattggtgaatacatgagtgttcaaatagaatctagaacgccctgagattttcaaacgaagtaacactcatgctaagggctacatataggcaactccctcttgtaaaaaatacttaatgcccatcaaacaa

SEQ ID NO: 105631 - DNA, 608 bp, Oryza sativa
actgccaaaatttgatgtagctaccatacctttgtcaaatcaaggaacaggaacactgggatagtttccccacaaaaaaaaaaaaacactggaatagtttcattagcctttttgtgtgcgtgtgccaagcgtagataacaattgggatgtggatcatctgcagtactgctgaaagcaatagtagtgatttatgtgggaacccgaacccacatgtcagtcactcttactgcattagtagtactacggacaatctccactgtaacaattggcatgaaacaaacagcccacatgttttgagatcttttcctttcagctactctcctcttccaacaaagtggtcgccgctcggcgggtcttgctcgtgcaattgatgaagctctctctatctcgcaggtacagcttatggcccatgcctttaattgtcacttcgaagaaaaaaaatttacttctaactcgattgaggagcatctcctcattagcaggctcattagcaggtaggagtatctggaagctatccattgcatcggctttgcgatgtcctgtccatttaaagggagtaaaggtatgcagttgatgcgttcctctcatcatttaagggctgcaggaat

SEQ ID NO: 105632 - DNA, 718 bp, Oryza sativa
ggaaacaccattggcaggaacaaccagctaagggctgtcctaggaaaagatgatttgtagaggcatgatatattttcatatgcttataatatcttttcatattatcttttcattatgtgtcccatggagctccttatctaccgatttgcaaaataggctatattttatagatatttggttgttaaacctcgaggcattttgtggacctcagtttccgtttgaggtgtagccttatcagcctcaacctgcttcagttactttgaggcagagataatcttttgaggcagtgttctctgccacaatagacaatttggggcaagagtatctgagacatggggaggctatctcgtaatctcttttgagatagactttgaggctgatttggttgctttgttataaaaacggcccagaaatcacatcggaaaccaaatcgcggaagaaaacgccataggagatccaaacatgatgacgacaccgaggtacgatatttgataatggagttcagccgaggcatacatcttcggggcactgattacgggcactccttcccgatccagtatattagagcgtatcaaagttataacgactcacggctggtcgccgccggcagccactccctctcgctatgctaaatcgccatgcggttacaacaggcatgctcctctatttatgagagatcctaggatagactccgactcatactcgagtcctaatacct

SEQ ID NO: 105633 - DNA, 927 bp, Oryza sativa
gtcataagccttccttggctgattcgggtccagtttctcagtatcctatatcaacctaaagaatgagtttatttatatatataaagaatgagtttgctatgtttatgaatgattcatgttgaggatacaaatgtacaacaatctctacaactgataataaccaaaacagatttagagtttcatttatgatgaatcatagtcaacttgaacttaatgacctagatgttggtagagaagttaatcaactagcctatctctggttaaagacattgaacaagttgcaagactttcagtcctagtgactacacctatcttaaccatgaaaggacatatgcgtcctataaaggatgtaacagtgagtaaggaagatacccataatgattataaatggaagcatcggctaaccatgcaagcggccaacaaaattctaagggacaccaatcttgatgctatcatacttggtggttgtttagtaaccaatcaagcatatgtaaatattatcgctttaaagatgtcttttgtatcatgattttttatgtgtacctgacttttcctgggacggggatcaatggactagcgattgggaaaaggtatttttccggtcgtgacacatgccgccggtgggaggttgacggagagggagaatcgctcgtggggaggccgcccgacgtgggcgacactgctcgccggttgggagagggagcagagagggagagggaggggcggcggtggaggaggaggtgaggggggagggggccggaggggaggcggaaggggagcgaggaagggagggcacggtggaggaggaggcgaggggcgagggtgccggggagggagaatcgctcgtggggaggccgcccgacgtgggcgacactgctcgccggttgggagagggagcagagagggagagggaggggcggcggtgga

SEQ ID NO: 105634 - DNA, 1049 bp, Oryza sativa
aggaagtagcaccctttgcaattcacactatgcagtcccccgcctcctccatcctcaccatgccgcctcccgacctcgccagcatcaaaaggcatcaacgtctcggtgcggcacccggcctggctggcctcctctacatcccccctcccatttgtccccggtttgctccttgctgcagctctggtggtgatgccaccgcgcgcattgctgaccgcactaaataattgaagtctagagataatgagatttaaagagtgatcctatagtactgcagtgcacaaagcaatacggctctcctccatatcgacttacccttctatatatatcaccccttctttaaacattcacatcttatttccctagctagttaaaaagggggcatcttttttataatgtttgtgacgctacacctaatagtatgtttgtagagattgatatacataccacaacagaaatgaaggggccaaggataaatatgatgaggcaaaatttgggaaattttgtttatgttatacgaatgagagtcatcctgaaaacggtaaccacgctagccaatgggccaagccaaatagaatttcggacaagtacaatgattcaccaaatcatcttataacaaaaggtcatgatggctagtaggaaatcccttactcctgaggaacattttccagcatgtcaaatattcattcgatctacctagccacagggcatgttaaggtaaatatattttacttttcctatttttttccaggcaggtctgtataccgtgtaattaattgttggttcagttgcttagtttcagttaccgatcgatatgctatattctacttgttatcaggagcattcttcatcaaagccatagttttactaatgtatatatagcagatttttcattgtctactaacactctctttttgttttataaaactaggtgtatggcatttttttcctcgagccctttagttacttatttattagaaaatggtgtatttactatgtaccattttttatggggaaccgtcacaccccttattggatatgagaatttttta

SEQ ID NO: 105635 - DNA, 1316 bp, Oryza sativa
tgagatttaagactactacgcccaaggaacactcaacctcaaggttaataatatacaagtgggggtcttgtgtacctacaagttcgtgggtatcagagctcaatatatatctctactggagctgaagttagagctttgggatacacatgccatacaacctagagtgtttgccaggcaaatcttttgcttgtggcaaagaattaaccttgatgttcttcgatgtaatctcattgaacttgactcatatgctggtatggccacccttttcctgatgcctcttattcatattgcgctcttgagaaaaacacaaaactctctggaattcttgcctctgttaatccccagcaccatcatttttagttgtggattgctcgtatgtttctaccaatacaaagctgaattgtgaggaagagtaaagagtggcacctctctgtctgcttttttttaccagcaaagtaatacttgttgaccaaaagactggtttatgtgtatatgaggataaggtatccattatttatttattctctctgcatgactgttgaaaacgtaagtgtttgatagtataggagaggaatactgcataacgtgggacgattgtatcctaatataactctaactaccatatactctaatagtaaggaaatgtggactacaatattttcaacagataaaaaaataatatatatcattaagcagcagaacaaataagatgtgtcacaatgagatgtatgaaaaaaaattcttttactcaggaaacttcttccatgctaaaatatgtatagagcatatgcctgaagaatctgcattttacttgaacttgtttagacattggtggttgtcagagcattcaaacataagtggaaaggggtgatagaaaaaaggggaaattattgatgatggtaccgaaggcgattattgtgatgtagtgtgaatgttcataattaaaataaaatctattattgcaaagtgcaaaaccgaagaaggaccccaaaggaaaagcagaggttctgctcaccatgcctgtagaatgaaacgatggatccagtccagcaaacaacctggtttcacccaaaaaaaatttaaaagcgaaacttgtacttgcaacttttcatggtagacagggtttccttaacttgtgatccaccggatattaattcatatgccttcatacactctgctatgcatttgttcttattttcattatgtcattcgcatctgcttgtattacgccaatagcacaaggaattgttaacatttcaaaactttagatagaacataaatttttttgagtaaattttacaaaagtacatgtattt

SEQ ID NO: 105636 - DNA, 617 bp, Oryza sativa
ttccatgatgatctcacctaaaatgtagaaattgtctttaaattgggaggatacaaacttttcgatgtgatatcagaattaacaacaatggttcaacctagagtgcaaacggaaaaaaaggagcatatataataatttcaagagttctccagttggtatgtatctctgtcattttactggaccttcgcaagtgctgtcccattacttttccttttaatttgcttgcacctctcactgtcctgtatagtcatgcatgtgcacatgttaaggccttatatcttaaacacgagaatagaaaaaattgcatacaatcgggtattacggattcctcaatctgacataagtaaaaaaaaatgcgtaaaacataaaaatgaaaaggcagtgtttggatgcaacaatggaaaaacataggttggacctgaagaaaatggtaaaatgtggtgaaaagggggaaacttttatatgtatcgctgtgtgatacaaatgagaggcatcatgaaaacagaaaacatgctagcctccgcacagggccatcaagggcggtgtgcgaggttagtgcccgcacagggcctccaatcggcgagagcaaccagcctgacatcatgttctgcgtactg

SEQ ID NO: 105637 - DNA, 527 bp, Oryza sativa
gtaattactacctcctgctacgaacatatatagatgggtattaaatgcatagaggcattatatatttcgtcgtccttttatatataccacctcatctttcagtaccaattcactattttcgtatcttttgaacaaacataatagcaaactatagtgaacaaaaagtatggatgatggagtaagaggagataagaaattaatagatatcaagttctgcatgtatatctcagtttgatcggacaaggaggcatccaggaaaatttgaccttgcaagcttatggtttcagttggatgaattgttgctctggcacatggtaaactgtggaggacacgatgtttccacgcttgacattcaagatctacagaatgtttttttaagaatttttgtgatgaaagaaatgtgaggctacctgcatatgttcagttcataattataacctatgcatgcaatttcacttccaattcctgcaatatcgggaacacccctcccccgcgtgaacgaaactattttgcccaaagtttcaatt

SEQ ID NO: 105638 - DNA, 582 bp, Oryza sativa
tttggctactggtgatactacaatggtagtcagtagaggcttgctcgcaaaagatgagcaggaatatgtttcatttctgcttatagaacaactactagaatctgtgaaaaaactattaagatatgtagtgcctccactgaccacttgtatcggtgttaattttctatgccactaggccattgccgataactgcatccactatgtttttatttcactctcataccatgagagattcaggtgattatttgtatccaaagactccattatttgtatcctatattcaggtgattaatcatttgtatatacatataagaagatagaaaactgcccatcgatgaaaccgtgatcctcgttttccatgctagtgtcaaatcattatcttttaacacatccttgaccctgcgaagcagtgagcggtggcggcagcaagcaaatgtatcaggggtgttgagctctagctcatgtcggcagcggggcttggttctagggggtgatagaggcagagctcggatgtgagggccagtggccggagtgactagtaaagcatgtggtcacacctttgccgatgcctcctactcccat

SEQ ID NO: 105639 - DNA, 673 bp, Oryza sativa
aaaattacaagattacaatcccggccaggtcgtaactcataaccaggaaaacaaaatagtatacaaccacccacacaccgacagtgccaacacacagacccaggagaaggctagcaccggaccggctgccgctaagcatgaccgaccgccactaagccaacaacggaacacagccgagatcgcccaaaactcgacccttataaccgacacaaaaccccgctctatccaaatcttcgggattgaggaagagaggtgagacagaagaatggaactgctctccccctaggccctccgacggctaacttgcggaagctaggaagccgacaaaagaggatatgaatctagagcgaggttgcaccaattgcttgggaggtttcggcaaggggtgcctagacaatgtctttaaaaagagaagcgacgaaagcaccgccgccgccgtccgtcaaggtctccaagagaactgagactgggctttcatccggcagccacactagagggggtgagacggcatgacaacgccctcaagaggggagtggcactcgaacgccaccgttgttggcccggccaaggtcgggctgtgttttcacccgttgtccacctcctgctgatcgaaagctgttctccattgctccaaccactgacccttcactgtcagcgcgtgtacaccactgca

SEQ ID NO: 105640 - DNA, 598 bp, Oryza sativa
tggtctgtaagtgttcatctattaaatatatatcaatttcaataattctgatgtattcctttaattaaatgaactattattgacctatagtagttagtgctaactgataaatacataatggcacataataattaatgtcataataatttttcaaataattatggtgtacaatatcacctgacaaataatttgaatctacatatgtaaaaatgaaaaatgaaaacaacagaatttagttatatttttttcaagtagatcttatctaattttaatatgtgagatattacgattttcaaatattttttttgaatttttcaaaactatttgattggtatttgaaaagtgagaagcacacatgatacatagacatgataaactttattaaaaatacttctagcgagtgatatggctatactacaaccccttaatccatcatgagaactatggtcatatatgtaggttttttgtttgtcatatagttttggcaacaagtaaacaatccagtaacacccataatatattttcttatacttcaggaattccgatgtgtcgggcatagttgatggatgtatgtcatacactctactaacatgataac

SEQ ID NO: 105641 - DNA, 3686 bp, Oryza sativa
  unsure (1)..(3686): unsure at all n locations
tagctgcatgcgccgcgcctcgccggtcgcgcctcgcctgcacacccacgccggcctcctccgctctattgcccgcccttgccgcgagccgctcgcctccgccgcgccgtctcctccggccgtcaaatccggccgcggcggcgtcggatccagccgtggagggccggatacggccgcaggcgatgcccgagacatgaccccaagccgcgccgctgcgcggcctgccccacgtgccagtccgcctcctcgcgccgagatggggcacagccgtggggggtgtggccctgctgccaccatcccggcgtgccgcgcggtttccggtggcagcggtgggggaaagagggtttcgccactgggtcatccgcgcgtggacgacgtgggggggggggaggttaggtcatacatatatatgtactactagaagatggattattgaattactaaaggctttccttgtaaattggaaaaaaatgtttagggggctaggcaatgaaactctggagtagttaccatcattgattcatcaacctccagaatttctcatgccattaatccatgttcgccaagtgcatcccatatttgtacttaactctgggcaactactctgaagatcccttgtatcatatatccaaagtgagcaatcattttcgcatctgcagggatagagaatttcttttgcctttgggacaagaaatttcccgtccatgatcctcacagaaataattctagggtatcagatttatttgctgaaaggttggccaaccaattttattaacatcaaagcagaaacaaaaagaaagatgacacaacatttgcagtaggttgtcaaaactgggaagtcatgactcatgagacgcccttaagggttaaaatccaaaactaattacaagcgtctacagcagatacagacagctgctattatcctcgactttaggagatcacttcatgaaagaatgcagatttcatccttgactacagtgaacaactccaccaccattttcatttccaccatgaagatgtgcacatgtctttcattccaaactagccagcacaccgtcacctaaatagttgcataaatgttgatcaaaatttgacacgacagattgtgatgatacaagtcagtacacaaacatgtaaatatgaattcgctctgaatatgtatgcatggaggaacataaacaaatcattcttcatatgtcattgcatatgtattattcacttgttgattttgtaatttttgtttcacaatgtatacatcgatcctatacctgcatgtctgtgtagtgacttatactattgtaatccatctcgtcaaaatttttatacaattagtattatgtagtgtgaaagtaattggtgcctttgcacctaggcggctaggccattctacatatgcagtgagcgggcccattctacatatgccttttatcagctgtatgcccctgattccttcacgctcatctgagacccaagcctccatcctacacggctgcaaatcttgtggtcagttgctggccatgacaaactctagaatacatgttttggaaatacatattgtgccctccacaggttgccttgtgccagatcaacaaaacatccaactgaaactacaaggttttatggtcatatttttcctgatgcctcctagtcatatcaaactgagacatacactaagctcgatctctattgatttcttttatcctcctcctcttaccacatactttcttgctttttcacttgctacagtacttacctattatgtctattgacatttgacaggaagtgaatttgtgatgcatagtgagctgaatactgaaagaaggggtggtatatagaagggaccaggaaaaaaatcatgcggttattgcaagttangtngaattggncgaccaggaaatatgatgcggttattgcccttctatgttatatatacaaggtggtcataattaaatttctctcatatagtatcatcaacttcttgggttgatctgaattaaatagtgaaaataaatgtgctatgatttctacatagactttttgtaccattaattactcacccttggagagctagaaataatgaaggtaaggttttgaaacttttatatgacttgaagttatatgtaccgtagtacgtctcctcagaactaagggcaagttttataaaagatgtggtggtcacctccaattttatccaattatccatccctagcctatatagatgtattgcatttaataccctagtcccagtacacttgccaccaatcaactcctctaattttctcttgttcttgaagtttgtgtggaggttgccccttgcgtgaggggtggcttctcctctctcttctcttctctcttccgcatcatcatttaagcatatagtggatgcaatggaaagttaattgtgttgggcacaaccaccactgacaggcagtcaggcatatatacagaggtcaccaggttttgtaatggtatgaaaaaaatggacagagatgaattgccttgcaacaagatgagcagcactatatttcttttcctgattagaacaactaccaatctgtgaaagaactattaacatatacatggaatgcttccacctgtatcggtgttaatctctcatcatgccattaggcaatggttggtaactgcatctgctagatttttaattcactatcatcccagtatgtagctaatttttaatctcagtcttgccacaatcattgatcactaccgatgcctgtgaccttcacaaattgcttccactggcgttcacttctagctctcagctgcaaaatgtatattcctatcctccagcttctcgtgaataaactggaaatccttgtaataatgaatggttgagtgcatggcttatgcagagaccggaataatatattcctttatctaaaaaatgtgcacaatgctgtgccatggctagtactcgtgttggggaaaaggatagaaggtactcctgttcagctagccacggtagctagccagccgctgaagtaagccataagggaagatccatactactggtcaccatgactgtcgtgacaatttttaacggtctactacgggagtggattctaatccctcgaggggatatcccatcgtatatccttttcttctaaatttgatgtaaatagttgtgaaaaaatctgaaaaaaattgacaatgtatagtataatgatacctactagttcacgaaaattcagtttcaacttcgatctacacatcgagaaacaaaaaagacaaatttagatataaacagtacgctactattcatatgctgaatttgtcttttttatatctcgacatgtgagttgagtttgaacttaagattttgtggagttgtatatatgtgttgtatgaatgttgccaaattttttcagaatttttcataaccgtttatatggtttttaagtaaagaagggaacatcccctctcgagggattagaatagtttcctaagttgtgctcaactaataaagtatatggccacttctttgccgctgcttcccacttccatatcacaaaggcaagacagctcaaaatgtctatcttccatcccccattctcttgttggttgttgcttgctagttgctcctacttgcaatgggaagccaatactagtgaacgaaggtgcatacccaaaatttgaagggttatatcagagagttagagaagctt

SEQ ID NO: 105642 - DNA, 768 bp, Oryza sativa
ttgcactgcacaaagcaatacagctctcctcccaacagttctatatatcaccccatctttgaatatcacttcttatatttccctagctagttcaaaagggagcatcttttttataatatttatggcactacacctcatagtatgttgtagagattggaataccacagcagaaaggaaggagccgaggataaatatgatgaggtaaaaactgataaattttgattatgtgatacgaatgtgtcaaatggctatactcgacaacggtatttgtatttcatgggggacgttaatactaagttatacgcgagattgcagtaaagtagataggagagaaagatttttatattggttcaagcctctgaaatagataatagccctacttcagtttatatgtatagctttgggatatattactaattataataggggagcaagctagctaatccagccgatctactaatactcatcaagaactaatttcatgacttggagtcggtggctagctattgttttcttcctcctggttgatcactctccgtgtaaaggaaatttgatcaatgatttctcactttgttgatccacgtggaagcagaacgaacattttcatattgagaatatttacaacttctgcacccatgcaaaccttctagcatagaataaattcaattttgtctacaaatttcacccatctacatgatctctactcctaacgttagcaatttatggcagattgtcattgtggttttcttttcatcatgatatgatgag

SEQ ID NO: 105643 - DNA, 745 bp, Oryza sativa
cccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatgcatgtactctcgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattcta

SEQ ID NO: 105644 - DNA, 731 bp, Oryza sativa
cacaactcattcaagcaatagcaaggcaggcagcatgagccatccaagaagaatttagaacatgattgagagagggggagggaaataatgggtgtattacagtgtgatacaccctcaggtgcagaggcatggaatggttggtttcattttccaaaacaaattacaacacgagatatgaataggaggcatcagggaatatatcttgtggaacaaatcccatgaaagaatctcccaaatcagtatagattgttcatctccggaatctgtgttgacaggggtgacagaatttaccaataccaacgttctcacagcattgtctaaatgactcgtacgcatgtgcacgcacattttctgcttcatgcgcaccaaaaccaatgttctcgcagcttcagatctgattcagcattttctgattcatctcgtatgtgacgttttctgatctgactcttgtacatcttcagctgaatatgatgatgcaactatggctgctattccaacgcatgaatattcagaagtaagcatataactcatacgcatgcacatgttcgctaggtatatcttgcagatgaatataaaaaaaacatattgcaattagatggagctttctccacatgcatgcagcagttgttaagtgtgctgctccatttcattctctctttgacctcttttgtaacatttggctactacacgacatgctaaaaacaattgtactaggagggaaaaaaactgaa

SEQ ID NO: 105645 - DNA, 561 bp, Oryza sativa
ttttcttaaaaaaattgatacccatcctaaatagcaatgttttaatatttttggagtactgaaataatgaaaataactaaaattttaaataaaatataatagaaaatttgaatttttctgtattatgttggaaacaaaatctaacataatttcagttcaaagtatacaaccctaaactacaacttgggagcgataaaagtcttattttctaatatattttctcattgagaaaaacatttaccgctaaactgtagtttcatactgcaatactatatacacacaaataaatgctaaactgtagtttcatactgcaatactatatacacacaaataaatcaatatttcaacatattcagctcataattatatgtagtcatattaggcatatttttaatagaaaatatcttcaattaatatatcctaaaattcataaagacatatatattatacaaaagaaaattgttacttagagtttagaaagtacaaaattaagttatgctaaatattaaaaaaaagaaacgcgttatgtacaaatgatatatagtttcatatatatttttt

SEQ ID NO: 105646 - DNA, 721 bp, Oryza sativa
acgagagtgatcatgattcgttcatgttaaacgagctgcaaaacagagcatactcacctgctttccaataactccgtgccgcctagtggactgaactcaaatctctccttgatttcaggtgctaaaccgagcagtactctctccgtcccaaaataaatacagttttgcactattcacgtttaacgtttgactattcgtcttatttaaaatttttttatgattagtatttttattactattagatgataaaacatgaatagtactttatgtgtgactaaatatgtttaaatttttcacaaaattttcaaataagatggacggtcaaacgttgaacatggatatccacgactgcacttattttgggacggaggtagtattatattctgttcagcttttgcgtgctgatcatgctgagtgctgactgctgaccagggttcacaaaaccgccggtaaccgcgcggttaccgcggttaccgggcttaccgcgggggtacggtaatgtaaataccgcggtaacctcctaaattcaaataaatttaaaaaataatttgaatttttgatgaattttacacggttttgtacggtttttcacggttaccgcggtaaccgcgcggtaaccgtgcttaccgccggggcacggtaaccccggccccggcggttttgtgaaccctgctgctgactagttcctgttagcgatttttctgactcaatggagctcgga

SEQ ID NO: 105647 - DNA, 2545 bp, Oryza sativa
ccctctacgtcggcccgcagcggacagcgggcggcagcgccctcccctccgctggaggggaggtggcaagcggtggcccacggctcgccgagccaccagggcccctcctcctcctccactcctccctctacgtcggccagcagcgggcggcgggcagcggcaggaggaagaacaaacattgatgttcattatttctttttttgagaatttgtgatgtatttgaaatttgatgttatctgtgatatgtgaatctttggtttggagatgtagggaacaacttgatttagggaaatcaatatgcaggcaataaaaaacaaagaaaaaaaaatctttagttcaagttggtaggcatctttagccccggattagacgtcccaatttacaaccccggattaaaggggttgcaaaccgggactaaagacgagttccccagcagtgcaccttggtttagatcatattaacctcttcaaggccggcgcctgaacagtgcgctatggtaattttacgaaaaagcccttcagtttatgggcaattcgatctaggtctctcgtatattgataaaacatggacgattttaagagtctaggtaccgaaagaaattaaactgtgtttcgtggtgaaagggaccaaactaaggtcatagttgagtggaccgatcgaatactggcctctctcgggcagcaagtagatttggtaaggaatacgtacctgaaaatcttccttcacatgcaacgatcggaaccagtatgcagcgtccttgtcagcttcagagcaagaataatagtgggctataagcaagttatatgcttatgtggaaaaaagagataaataaaagtggtgagtgttgtctctcatgaaagagctaactacacacaagttccaagaaatatacattaaattcatagtaataaaaagagggagaatgaagaaaataaagataaccttatagccaacctactatacatgttagctttaatattgactaatactcccttcttccctaaatgtttaacaccgttgacttttttaaacatgtttgaccattcgttttattcaaaaacttttgtgatatgtgtaaaactatatgtatacataaaaatatatttaacaataaatcaaatgatagaaaaagaattaacaattacttaaattttttgaataagacgaacggttaaacattttttaaaaagtcaacggtgtcaaatattttaggatggaggtagtaataagtagtgagctctattattaaacttgttcttagttatctcggatggagatcaattatgacgataccgatgtacgtactcttcttgggcgcatacgtctacgtcatacgtggctgcgccatgcatgcgggcatcataatatatgagcattatatatgccgcaaaaattcgcataccaaccagcaacaaaccctcgaccgcgccacgcgataccctgttggtcgcactcgcaccaccctggtcaggtagtagtactctccggcccgcccgggtccagcgcatgaagccaaacgaaaaggagagatcagagaccaaccgtgggcggggctagctagcacgcggcgcgactatgtgcaatgcgtgtagtactccgtttgtcacaagatggacggacatgcatggatcgatataccccgcgtccggctgccagctgcatgccacggcgcgcgcgagatatgtatgcaagcattttacttactgatccagtacgtcttttacttgccccgccccggtcgcatgcggcatgcatgcattcatacgcatgtgccgctctgcctctccatacagtgcatgcacccccccccccccccccttctcctgtgttcatgcatgcatgctcgcccgccgagggcccggttgtcagcatgccggccgtaataatcaactgatctctacacgtacggccacgaacggcacgacatagcaagccgagagctctcttgatcattgcgcccaggaacacgacccagtacaggtacgggctgtttggttggtggcctcggtttgccacaccaaaccttaggcgcgccataatttttcaggctagtgtttatttgcgtgtcgcagttaagtcaagccatactttactagcacattggcccacgcgtcatactcttatttgctacccaaagtctgtcatagttatggctaacaaattattggccacactttgtgtggcttgccacagttatggcaaatcgagttatacatatagcctccatccaaacagcagtagctccgtgtaacactctcgagcgggtgcgggcgtggcgatcgatcgaacggcaaaccaggcgtgtcccgtgtccgtccgtggagaggggaggggagggagagggagaccgggcgcatcgcgccacagtttggccggggcgcgtgggcgatccccaccactcattccccttttcagtcacgaacagtgtccgcgagatgcggcccacgctggctactgttgcgcggggacatgcagagcccggccggtagagcaatacgtactatactttgcctgcatatgcccccatctcgctaatacacactag

SEQ ID NO: 105648 - DNA, 835 bp, Oryza sativa
aaggctgtacactgttaggcttgtggtaaacactcttaaacaaagataaaagaatatgctttactattctattttgcctttggtgatatattaaaaatggtaaaccaataacacaagaatacagcacaagagcggcataaaatttgatttggtgtgacgatattcaacagataaagctctcctgactgtataagttatccaagtcgtacacccctgtagttccactgaatgcgtaactagaaataagttttgcagttgtcttataaagtctagaacatccttctcaatccaccataactctcattaaaaaaatatcttgtcattgttatgtccttgttggcttgcaaaattaagttttacaagtatcccctcacaaaagtatccttgccaaactactttgatctaataactgagcattaattctaatttaaacaggaaatggcattggcaaggtataatatatagagtgatagtgaattaaattaccgttgcagcatcaacaaattgttgccaccaaatagaaaaccagtgagtatcctcccatttgttctttaatgtaagacctgttggagattcttccacatccttttctgaaacatggtgataccctgaaaggcaataagaaactactttcagaataattcgaaccccgaagaattgttacacgaagtaaagaaaatagtgagtgaaaaaaaaacagaaattgattaccttcattactgtaagaacgcgctgagaatatatccacaatatcctcattctggccagggagtatgtccccaatcccatcatagttatcgtcataatcaactgaagcatcttccgtcggaaccca

SEQ ID NO: 105649 - DNA, 963 bp, Oryza sativa
tttcagatgaactattcaagttcacctttaacaagtagattgaatcaagcttttggtgaagaggttctcaggagagggacaaaacaatagcggtggttccccaggatataatgttcaaatcgttaggtacagtaatatggtcaatggtcatagtagacataacgcagattgctactaacttgcatcacaaaaaaaaaagtatataagcttgcaactactacgtactccctctgtttcataatgtaagactttctagcattgttcacattcatataaatgttaatgaatctagacacatatatatttagattcattaatacctatatgaatgtgggcaatgctagaatgacttacattatgaaacggaggaagtataacagagctaccagtagaactaggatcaacataaataaatttcaaaagtcgctaaatctaaataaatagaccaaaacgaatgcatttacagcttaaggctgattgaatgctttatctaaagttcgcatagggatcatatcaatcaggtttgtatgtagcgtttatgactttcttctctcttaatcttgagctttccattaattctgaatcccatgtgttttgtgtgattgtaagaccacctatggaattactcctcagagatctaactagatgttgtggaaagatcctcaagtagttaacttgcaagtcagtaagaactgcagataaatcaactaacaaaagcacaagcaatataaatatacaaaattcaatcttcttttgacactaaacaggacatttgatgtgtttgcatcacttggttaacataaatatttaatttacttggcatctgttgtaggctttatcaactgccctaatgtggtgtcatgactgctagtcacttatatatatagaacccgaccatccttacactagttcagaaaactaacagttaagcaaaacaataaacaggtaatcctcacaataact

SEQ ID NO: 105650 - DNA, 1682 bp, Oryza sativa
atttcacaactgccatctgtcttctagctgggacatagctttgtacatataagcaaaagtcttgagatggattgcacgtcgacaactcattcactgtgtagatgaattaagagctgtgaggttaggaatgcctttaaattgctaatttgttatgtgtagataggtgagtttgtgtttgaggagtaacctgtcattgcctttttgctgggcaccatccttgaacaatttcttagcaaccggaggtgttgctgtaggtgtaggccttcctctatttattgaaacgatgtgttagttacaatggaagaaatctttattattggaatgcacctaggagtgatcaaagcacctttttttggctggggtatttgtagggaaggatggggttgcttgtttggcttcttcagcagtttctggtagtccctttcccttgtaaaagaagtggcggttaagtctcgtgctaagatttctagtacatctcaggcgaagagatgtatttgattgattattaattattaatgaaaatatttttatttttttatttttaaaaaatatttatgattttttttttcaaaatatgcctcttttagcagtcgaggaagagtgctcactagaaacgatgaagtagctaagccttgaagccaaatggaatacaacctaagagcatgtataaatgtagagcctgattagctcttagcatgtataaatgtaaatgcagtgcgctagaaacgatgaagtagctaagccttgaagccaaatggaatgcaacaataatgtaatttaatttcttgggaatattttgtctccatatcaggatgaaacaatagcgtgtggattggggaagcaccggtattgtggtggtgtaatcgtggttgcgagacttcacttactagggtttaaatcatggtgcccacaaatatatacacacttgagtgtgatatcaataggaaatcagcgatgctatggatatgccgttcgtttcttttaacatgtgttatgggacgcacttttgggtgtgcgagcatggcatgcgtcttcggttaataaaaaaaagtgctgattttggatactttgttttacagtttatggaaaacaagtactatatataacctgtaggttgatggtcataaataacgggctatgcagattatcaccattattaatgtgttgtctctatttttatacggatactcaaatagtattttaatcaaggtgtgattttatgatacgtagtcgttcaacttacagtctaagaccctgtttagatgggagtaaaacttttaagtccctatcagatcgaatgtttggacactaattataaatattaaacgtagactattaataaaagccattcataatcttagactaattcgccatagcccaaagtacatcactagcatacaccattattttattttcactttggtctcgcctcaaaaagcttttgtccctagggtcattcttgtctttttgaaaaatttctctctccgattgagccggaagtgtcctccagcaaactaccatttttttagagtgtctttcagccgtaacacgttttcacgatgtctatcagcaaattacacaaattttgggtgtcctgtagcaaattttgccttttttatgtcaccaaaattacataaaattatcagaaaatagttactcccttcgagttgataatatttgtc

SEQ ID NO: 105651 - DNA, 535 bp, Oryza sativa
gatcaagcacatatacatacttgatacatcatatggtctatcttctaattgaaatgatgcataatagacaatgattagcacgaggcaaattggacagcggctggctgcttggtgactcggcgacgacgagtcgatgtggagatgaatcgacgacgaggcgatgtggagatgaattgatgcaacgaaatagtagacggtaagaagggggttggttgaagtaaggaaagagataagggtcgagggaaactagcgtcttgagcttttatatgtcaatttggaatgagtttaatgggcctatattattgcaatgggctactttcagagaggtactccttccgtttcacaatgtaagtcattttagcatttctcacattcatattgatgttaataaatctaaacagacagacagacagacagacagacagacacacacacacacacacacacacacacacacacacacacacacacatatatatatatatatatatatatatatatatatatatatatatatatatatatatatatatat

SEQ ID NO: 105652 - DNA, 891 bp, Oryza sativa
tttctgctacatatatttcagtaaaaattaatcactgaagtattaaccactaaatatttcagctgatatttctttcgtattaaattgatccctccattttaaactcatcatatgttgggccattttttttctcaatctggcttaaacatggatattactagaacttagaacccagaaaaaattgaaaacttcaaattcgtttgcttatccagaattatattgctgctcacgccattttcttccttgaaatgagtctaggcatcagtctgttgaacttcctgacaaaaagactaagtacaacttggatagcgatgtgtgcaaatcatgctgagattgaactactagcactctgcagtccgcacacactcacatgatcaaacgtacatagatcaaggcgcatcgtcaggggtttgacaccatcgcaaccttggtagcatggacaatttggaaggagagaaacaatagagttttcaatcaaaccagcagatcttgggtggacatcgctcgggccatgacaggcgaagctgatctttgaaggctggctagggcagccattcctagcgtagtaatccatgcggatagggaggggtcgccaaatgattttggagattaggctttagtactcttgatcctctcctgtatcccatccccatcttgttttgcttttgttcccgccttatacataaactttatttcttcttaatacaatgatgtgctccttgcgcattcccaaaaaaaagatcctggggctgctttcagtagttcacttctcatcaagcccaaatcgttaacttattgctcagttaatttctttttttttgacggaaaattgctcggttaatttcagtactgaaggcaaaccttttcgttttcaaaagctaaaaaccgaaa

SEQ ID NO: 105653 - DNA, 777 bp, Oryza sativa
tgtatcgtacagtatctgttcctcattgcgatcagccatctgttcatacaagaaatatttgctaagtctataggtcatatttgctttaacaatcttatatgctaacaatcataaatgctaagtctaagtgtcgtatattagaaccctagataatcattaaaactgtactaatcttgtactaaaactctaacaatcatatatgctaagtctaattacaaatctaataatcttatattaagactcaaataatcttgtattaaaactcaaataatcttatattaaaaatctaatagtcatatatgctaagtctaactgttgtatattagaaccctagacaatcatatatgctaagtctaattacaaatctaataatcttataataaaactcaaataatcgtgtattaaaactctaataatcttatattaaaaatctaatagtcatatatgctaagtctaactgtcgtatattagaaacctagacaatcatatatgctaagtctaattacaaatctaataatcttatattaaaactcaaataatcttatattaaaactctaataatcttatattaaaactctaacagtcatatatgctaagcctaagtgtcgtatattagaaccctagacaatcatatatgctaagtctaattacaaatctaataatcttatattaaaactaaaataatcttgtattaaacctctaataatcttatattaaaactctaacagtcatatatgctaagcctaagtgtcgtatattagaaccctaaacaatcat

SEQ ID NO: 105654 - DNA, 875 bp, Oryza sativa
tgcttgctgacttctaatcggtcccactgggcgtgccaaaagcgtgttgatagaaaacacgaggccagagagatctgcttaactccagtgcaggtccaaagctctccttcgaatgtatgagcgtgccagttgatttgatcctgtaatcaacaagaaatagaaacaaagaattcgtggttaaatctataaatgatagccaatcggctaggtgccgatgacatatcatttatctttgagccgatgtaatatatgaatcaatcggcggttataaatagatagtaaggaactaaatctattcgatcggctgtagatattaacgatatataattcttatattaatatatacttaaatcaagtgattgggatagatcggtcaccatgccgagatagtataaatcacttatatcgacatatatattaataacaggattatatatgtttatagcatagccgatcagatagatctagcgtctatcggctaatactccgatactactctaaatcaagatattaaaacaggtataatgtattaaacaaaagcttaatatatttagattgcgacgatatcttgacacaaagggcggatttaacatgtcattgaagcatatagatcgaatatggttaaatcagataagatcggctgaaactccgatactaccctaatcggcaaccaaaggacaggctagagattgatattctaagcatgacttaatagatcaaactcaactgatgtagcattaagtatgaaaagaagaacaatatctagacaatcaagccgctgggtgtttcataaagtggtagatatctcatataatctaggacaacgtcactatttaacctaatcggctgccttctattaacggatgttagccgat

SEQ ID NO: 105655 - DNA, 634 bp, Oryza sativa
ggcattctaaaatctcaccgtcgattttttttttaaaatcggtggacccattaattttaaccattagatctccatctaaaaaataaatctggtgtccctactttttttttaaaaaaattaccatgtttactctaactaatatatagaaaaagtctggatcgggcaggaaacgttagtattattttttttccttttttttccggcggcatacatacatactccacgttagtattgttttttttcctttcttttgcaaaagtacttttcctttacacgttctgaaaacagtactactactacgcacatcgtacgtacactaggggagtttaggaggtagtgttaatagatatataaaatcacatcttaccgatttaagtgaaaatccacagttagattttttttctttttcttataatttttaataattcttttaattgagagatatgacatgtggtgacctacaagcttttatatgagtgtcacgtgacagcttaatagcgtttctaaaaagtttaaaggacttatatactaaaagttaattaaactttcaataaatactctcaagccgtcatatggccttctacaaacgctcataaatcaccacgtggtattctataatcacaccgtcgatttt

SEQ ID NO: 105656 - DNA, 660 bp, Oryza sativa
ttttgtagtactacacataacaaatgacaagcctgaaccaatatttgagctcaaactttgatgacgtgttttcacctctctattatctgaacctaaaactaaactaatctatctagtaacatactcgtggtaatgctacggtggcatttggtaatacaaatgttgtatatccacgtcactgaaaatatgcttttcattgtttgcgtaatataaaatgttgtacataaaaaactcggagtccatttacaaatagaatgaatcactgaaaacaggagcacttttaccaaacattagctaagcatcacaatataaaaaccaaggtaatgctgattttcatctaactttattctttttgtttgaatatacaactcaataatagatcagtctctttttactatgaggtggtttggtcctccatgcaccaagaaataagtacatatggttcaaaagttaaacatggacaatttcttcttgtgatgttatgaagcaatctgatatatacagtgcccttcctccaaccatagcacatgctcatgtcttgttcttgtttcaagatcagagtagaaattacctctagttattaggtcccccctaatttcacctttatttggcttccacttattggaagatataccctgaagatcactcagcaatttctga

SEQ ID NO: 105657 - DNA, 2205 bp, Oryza sativa
cctccgatcgatcgtatgattcgtatccggtatccccctaccacaaactgatgaattttggtgatgaaaaaagtgattcccaacggcggctactccgggcgtacgtcgccatcggacggtcgaccggcgcagcacgcacgcacgccaacgtgtcgaggtgacgaaacatgcgacacgaattaatcaactatctagtctcatgatgggtttgcgtggggctggctctgggcctgggcgggcgtgcactttgcgggattatcggtacggactattccttgatttgcaccgatgaccaagcgatgtattttgctagttaatttgaaaaaaaaattgaaggagagagacgtacctccacatattgtttaagaagaaaatatagacgtgttgggggattaaatagggggatactagcgcgtgcgtgcgcgccgtggaaaggagccggcgcgcgccagcgcgtccctacacgtttctttttttttcctagatatcctattttaacgtcagtttttttttccttttttaaatcgcttttttcagatttttttaatcgcgtctttctttttcacacgcacgcatgattttttttatatttttttgtaatatattatatatatacataataaaattaaccacatatatataaaacagtagatgattgcatccctggcgtaatgctaatcataaactacatcttctactagtaagtaatcacatacctgtcgtttgagtgcattgcattcgtgtgcattcatcttagatattgctgcacatccaagcattgggatttcggctgaggctagaggtaacagtacatgtacagttctgcacgtgagatatagctagtatcgccgattggcctaacgcccatcaactcaagtgatcgatcgattatgaaatgtgcatgtgcaaaaaaccgatctttacaacaacgaccatcgatctaaacgtccttccttttcatatttgcgtgcgaacaaagcgcctgcattgtcatcacattgaggaccacacaaattagaatgcatgaccttttctgttaggctgagacgactgaactggccacaaagatattcatcaaagagtttaccagattgaactggccacataagtggtactagccattcgtcggttagctaataatcttcaggaccattgcccacgatgcatgccatcgatgccgaccacttctcccggcccattcattttgcaggaaattattttgctcaagaaagaagagaagacagatgcatgatcaatagaaattaccaagatactccatccatttttaaatatttgacgtcgttgactttttaaaacatatttgactatttgtcttattaaaaaattaagaaattattaattcttttcctatcatttgatttattgttaaatatacttttatgtatacatatagttttacatatttcacaatttttttgaataagacgaacggttaaacatgtgctaaaaagtcaacggtgtcaaatatttagaaacggagagagtactatataagggttgattataatgcagtattgagataggtgggaaaatatattgtagtttgtatacttagatgaaaactcgtgtaaaccaagaccaaaaattcgtctcaaatcacacaaaaaatcccacatgcagataagatgataatgaatagctacgtaaaattaaaatctactacctccgtttcatattataagtcgtttgattttttttcttagtcaaaactctttaggtttactttaagtttagataagattaacaacatctacaataccaaattagttttattaaattcaccattgaataaactttaataatatgtttgttttatattgaaaatgtcagtacatttttctacaaagtcggtcaaaactaaagaagtttgactatcaaacgatttataatacgaaactgagggagtaacacaaattcaacttcatttgtaagataaaaaaataataaatttcaaacaactcgtcaagactatttttctggtttgaaatttgttagttttatatctcacaaaggaagtcgaatttatattagatttgctgcacagctattcaccgtgatctcatttacatgtagaagtatgattttagacgatttcagtttccaccgtatatttacccgagataggtaggttaatttggaatcttggagagatcgatgtgtagctgcatgcgtcccggccggcct

SEQ ID NO: 105658 - DNA, 1670 bp, Oryza sativa
  unsure (1)..(1670): unsure at all n locations
atatggaagtggtatacgtataataatacaaggcttgcttcatcagtatactaatggaacagtatgcctacttggatatcattgtttagtagttaagctgttcggcacacttctgctattgtggtcctgtagtacatgcatgcctggccttcccgatttgggcgttcaaaaaattaagcacgggagtagtgattaatccagttgatcagagtgttgtatctgagggaggttggcacttggcagggtgaaagtgtgatccaacagcaagtgatgtttacccctacgtatgtgtatcatttgaggatactgctttagaaggtagtagtaggataggtcgtcaacttcaacaaagatattggcagtgaaggactagtacacatacaaatatacagataggatgtggagagatgttgtcgtcttcgttctaaaggtagtgctgttaagatctagtgaaatgttgatgatgttcattgcaaattgtgatagctgtccgtaacctatgttgatgttgtttgagtcgtcatcatgtttgtagacttgtagtagctgtacttcactgatatatacgtaggtcatacaaatgcagctcttttattaatttctatcagggcatgtcttagcatcttactcctgtaattgtgcaaaaaaaaaaaagttgtccagtagtagttgttaagacgtcgaactttggggtagctgtcaaaatcatttgatataattcacattcagatatatcactaacggtgaaatctacattcttagttcatcattagaaatgattagtctcttttacctaatcacctaccttgtacactaatttatacaagcatgtaagataatgattaaaatcaattcacttgatcatcatgcatcgatgcaacattattgtacgctaaaatcaaaatcacgacaattgaaatacagtagagaagttcgtgttggagttttttttatccgcttaaacttttggattaaattggttgatatatgtaacttaatatgataccagaattaaagatcttaaattcaaattctgaatgagacacacttaaatacaaaaaaaattgtgcaaagtgagttagctcaactagttaggtttcttatggtggatggcccacccaggttctagtcctaggtttgacatggatacctgtatttacggctaattattcgtttcagtgataagtgacgtacccatcgacagcaacacacttatagtgactttgtcaatatcaaaatatgttagtctagtcttaggatgtactcatagaggtaaggtgtgcgcacgtgcggtgcgttcataggaattagtgtatgtgcattgtgagtgtctacgtttataccgtgttttagaaaaaagcaaagttccccgcacaaaataaaaatggagtagcttgagatctgatgagttcccgcacaaaagaaaaatggattggagaagtaaacaatctatggacctgggaggaaccagcaacccaaattgtttgtggcctttgggccatcatgacaccaaccccaggctagctcatgaaccaaatgaaaaggcccaacaaccccaacctcaccgntccttttctactctctctctctctctctctctctctctgatctcttatttgcgaggaacagtttttttttttatccttttgtacgtggtagctcaaacgtag

SEQ ID NO: 105659 - DNA, 921 bp, Oryza sativa
ctccatattgcacatggttctgtgccggcagtccaaatatgtattccaatggtgcagacacctgagaattccccccctgggactctcttcctgccccttctctgtactgacagcttcagcttcagttcaatcagactgctctagtgatgatgaaaaactgaattgtgctccgtctcaacatgcccggaaaagatcccgcactttgtgctctgatagtgttgtacagactctccactgcctaaagagacgacctgccattgcatttgcctactttaaagatacacagagcattgggtttaatcatgacttttcaacctactcagagatgattcagattctatcccactcacgccaggggaagatgttagtttcattgttctctgagcttgtttcaagtagtaatgctagtggtcctgaaattttgccccttgttgatcaccacagaagaacatgtgctactccatgttcactctcgttcatggttgattgcttgatcaaggcatgcatcacttgctatgatgtacaagcaaccatatgcttatttagtggcatttgcaggcttggagttgtcccatctgtttggacttggaacctgcttctcaaatttatagctgagactggtgaatatgagatggttctcgcagcttataatgaaatgaagtgctttcagctgactcccgatgtttatacatttgccatagtcactaggtcactttttcaagcaaagaaagtggatgaggctttgcaagtttgggccgagatgactgaaatgggagtgaaaccagatgcacgtgggtactcgtcatttctaattggtctgtgtgattgcagaaaatatgatttagcttatgttattctacaagagattaatagggagaaggttcctgttgaggccatggcttataacatggtaatggatgg

SEQ ID NO: 105660 - DNA, 559 bp, Oryza sativa
aatgcagtataggagaatgtgtgcgtgctacggtgtaattggtataatgtttttatcgatgcaagcattatgaaaaaatgtgtgcatggtatcttaattgatgcgatttaaattatccttggtcttggtgcataaatatatatgatgattaatttgtgatgaaaggagtataacttttggacagctgaacaataagagaaaccgaagcttacatttcatgtaccattggttatgcattgcaaagtgagatcatcttttcgtaactttagtccatatctctatcggcttagagcaaccaacatagaggagcgcagtaatttgagtctgttgctactttttcccctagcttactgtagcaacaatatatctaatttgccatttaattgtacaccaaggctgtacacacgtctatcgcattcatttattgcatcctcaagtcataaatactgttttcctctgactttactatacaatgttagagcatctgcaatggtaaaggactttactatacaatgttagagcatctgcaatggtaaagtaaggtgctatctaaaaacat

SEQ ID NO: 105661 - DNA, 1108 bp, Oryza sativa
ttataagacattttgggttttgatttttaatagattcgtacattagtcgatgcatatgtttcatatatgtggctaagtttatatagatgttagtgaatctagacaagagaaagagagtccaaaatgtttttataaaataaaatggtgggggtactagaataccggaaaggttcattgatcgatctgcttaactcgtgcagccgcacacgccccctccccaatgcccctgcgtgattagcggatcggatcccgctaattacccatattaacgttaattaccttgattagtatttttttagtacgcaaaaaattgggataagtatggagaattaacaacaataaactttcaacgaaggtttgaaaacttttacgtgaagatttggaacattcaaatcaagattttttgaaatttttaactcagatttgaaaactctcaactcaagatttaaaaactattaactcggatttaaaaactctcaactcaaacttgaaaactttcaactcggttttaaaaacattcaactcagatttaaaaactttcgattcagacttgaaaactttcaactaggatttgaaagtttttagttcagaattaaaacctttcaactcggattcgaaaactttcaactcaaaattaaaaaaattcaagtcgagatattaaaacttaacttatgtttgaaaacttttaactcaaatttaaaaactttcacctcgaaattcaaaatatttgattcaaatttgaaaactttcatctcaaaattaaaaacattcaactttaatttaagaaactttcaatttaaattcaaaactctcaactgatattgaaggtgaaagattcaatttataaaatatcgcaaaaaaagtcacgcgtgtgtgtggacagaaaaagggggcgatttctgaagaaaaaaaagtgtgtgtggacagaaaaagggggcgatttctgaagaaaaaaaagtaaactaacgcccgagttcccgaaaaaaaaaaggagaaaacgagcgtatgcgtgggccgtgtgggtcggaagtgcgcgcctgcggcgtgtatgcgcgaattaggaattgtgctaggtaactccgatggcaatggtcgaggggctgcagga

SEQ ID NO: 105662 - DNA, 1021 bp, Oryza sativa
aatttgaaatacgtcatagataccccgatcctatcctttgcatagtaactacatatgaatggaacactaaaaaaattgacaatatgcattatatcatcttaaatcattctacgtaataaaattccattaattgttcattaaatatcctcaaaagtactataaatcaccacatgtcagaattaaaatacaacatagaccccctatcagcattataaccaaattacaatcaaatattttaaaaaatcaatatgtattatatcatcttaaatcattctacataataataataataataaagatatgttaaacgccctataaaacactcttaaatcataacgcgccatgttttcaaaattagaaaagatccaacgaataaaagtgaaaccacataccatcagcttccatgtaaattacatctatttttcaaccattatcgacggatctatttcctctccccctttcaattatttagctatcaaactagaagagaagcacaataaatagttgtacattttaaaacgacaataaattttaaggtacatgtctaatttctattataactatttttctatttataattagatgaataattgaaggtccatatgcctatacttttctatattagaaatatatcactcagaaatagtcgatccatgcattttacatgtcatccaaatagcaacgaaatacgataaaaactatcaatatatactatgtcattctatatattattccataaatatagatagctaaagcaaaattaatggtgttgaaacacaaattataaattcaagtatgaaataatatttttttatcgatggacaacacctgccattttacatgttgtccaaattgccataaaaagctacaaaatatttcaactacacttgttgcaccaatattatttctcaaacatgaataactaaattggatatatagtacctaagaaacaaatagctcgaatatggatagtccaagccagtacataattatttagagggagaaacaggggtgcaggaat

SEQ ID NO: 105663 - DNA, 708 bp, Oryza sativa
catcttatcattggtttccacttaaaaccgttttcagtcattaaacttaccttaagaagaaaatcataacctgtgatatgccacgccttaaaattagaaaacaaatatagaaatcagagaaaaaaaaagcatttgatcattagctaaatcatttcgaaaaagagtctcctccatccctcgccccccccccccaacctgcacaaagcacttcccaacctttcctttccctctgtggctcgactctatgctcttcattcctctcctctcactattttctttaagatatcaaacttaaagaaacaatcaataattataattataagttatacgtctaatttttaatctaattgttggagtcaaaccagtaatgtaagcttcatgtgcctatattatactactcctatatgagaatataagattcaggcatagttcacatataaatagtccaagccattgaataaaaaattcagaggaacacgcgccattagtcttttgcatgtcaaccgaattacaatttaaaaaaacatgaaaaaaattcaacaacacatgttgcagtagcatgcattgttttgcaaacatgcatagctaaatcataaaaaaaaaactaactcatatataaatagttcacaccacggcataaaaatccggtgccttcatatttttcttgaaattagtatgctcaaataatctgagcaatataaataatct

SEQ ID NO: 105664 - DNA, 652 bp, Oryza sativa
taaaagtaatgtgctcaaataatctgagcaaggaaaatgatcttttgccatttgtgaagtgctataaactttgaaacaactattgcattaaccattgcataataattgccttagataattagaacaacactaataggttagaaaattatctcagcaatgccaacaagaaaatttctgaagcaagcatacttctaaagtatggcacgtgttttccggttaatattcctctcctttaagtgtctcaagcggaacatacgatacatgcccacgcgaatgcgcgggctacctttctaattttaagaatagtcatcagacacctgacgtgtattcttcttctattcacacacgcccatacaaataaattttgttcaatgttggcttatgttttgatgagttcaaacattttttgtttttaaccaagatgataaaaattaaaaggttaagtttcttcgagaggtatatacgtctctctactacttgagaggtaaaaaaaaaaattgaactgtctttccctgttcataaccgcattgagcatgtagcttcttcagctaaaatgaaaccccttgttgtttagaaaaataaatgtacataatgattttgttagttctgaatgtatgcacgtcaagcacaaatgcacaatggtatttgtcat

SEQ ID NO: 105665 - DNA, 687 bp, Oryza sativa
ttgataactgattcatgtgtagccagagattataaagctgttttaggccttgtttgatagccataacctacccaggatttttgctcccaaacaaggacttggagctgtttgtagtgcaggaatttaattggaaatagttcaattcctgcaggagcataaaaattttctgtgttccagacagggcctaagtgtggcgcattttatataggccctagttttcaccagttgtttgcaggaatcattcagaaataaaaaaaatgaatttaaattataaatgaataaatgttaaaacattagatctgtgttggtttggaaaatatggtgttgggatggggggctgacatttcttgaaatatacagtaataatccaatcttttcaatgttggatccatcgtattcactagatttcaaagaagtgcagctagacagttcagctcattctttatattctcaaaaaaaataatctttgcttcatccatatgaactaccagatatcacttttttcattggcaatagttttgtgttcataaatgtctttgcttatgttctttcttttttttgtattttccctctgatcttattatcatgtttcacgtgatatccagattttttatattttcgataactcaaaacgttgcactatggatgtcctttctcattgtttttcagaattcaagtttctcaaaa

SEQ ID NO: 105666 - DNA, 2748 bp, Oryza sativa
ggagttagcatcagaggcagcggtggcggcagcgcaggtggaaggaagcggcggagcgagcgggaacggggaggatagcaccgacgagcggcatggggaggcggagggaagaggcgcgcgacgtgaggagggcggcacaggcgtgaggagggcggcgcaggcggagggaagcgtccgagagagcggtggtttgtgggttttctcttttttttttctttttctttctcccagacgatgtgggttcggtttgtggagacgtgataaggagttggtccaggtggctgggtgggttggatccaggattgtaggattggaagattgcatgattgtggatgaacttgtactttttatattagtatagatggagtggaaaaatctcatccccttgctaaccaaaccaacgcgagcactagccatcagtaggcccactagctaatcagcgcaaacgccctacttctcgatctagcgcgcatttctggcccacttcgttgtgttttattctggcccaccagcgaggaagtgagaggaaacgctgattagcgcgtaaacgctaacgaccaatgcacacgtgacacgtgttaggtttagtctttttttctgtcgttacttttctttaggaaaacgctcatttttttcttccacgattatttaaattttgtcaccgcatgcatctttttttcgtgatattttataaattgatttttttcatcttcaatgtccattgaaagtttttaagatttgagttgaatttttgaattttgagatgaaagttttcaaatttgacttgaatgttttgaattttgagatgaaagtttcaaatctcgagttgaaagttttaaatctcgagataaaagttttcaaatctgagtagaaagttttaaatcttgagttgaaacttttcaaatctgggttaaaagttttcaaagttgagttgaaagttttcaaatctaacttgatagtttttaaatcaagatttgaaagttttaacatcagagttgaattttttaaaaaaaattaagttgaaaatattcaaatattgacttaaaaatttttaaatctaattttaaatctaaacttgaaagttttcaaattttagttgaaaaattttcaaatcgtaaataaatatgagttaaaagtttgtttcagacaaaagaaaataagaatgaaacttatgcatggcagttttttatcaaaaaaaatgagtgtgggttttcttatccaaaattaagcgctattagtcctgcgaaacgcgcggcgcctcgattcatgtcacgcacacgcgaggtaggaacccccaagagaaattaagatgattagtgttgatatcctcgccacgggaagctcactgatgtgatacgaaggaggttagtgccaatgacactgacactgtcaccgagaacctactcataagaaataatgtttacattttaacctttttgaaaaaaaaaatacgaatagatcctcggcaccagtgtcattggcaccgaccccttcactgaattagcttctataagaggtgagggtgtcagcgcccgcattattagtgcagagatattggacctccacgccaacatcaccatgagtaaaaaaagatttatttttagaataagtttttccagatgtgcatttataaactaagtttttataacaagtactaaaatgaataaaagtccagctgacccaggaccctgagaaaattgggctttgagatgggccttacttcctaaagcccgtggaaacctcaagcaggtccgtggcatttctctttttctttttctatttttataaataactagcaaaaatatccgtgcgttgcaacgggtgaaaagttctaatgataatatacatttttcatgcataatcatgtcaatgacaatgtttgtattttaacgagcgacttgtctttctataaacgattttttttcttgtgcgattttctcaaaccatttttaaaaaatggcgcatttctttctaacagatttttcctagcatgttctttttgtttttttactgacgacgaaaaccatatttttctcccttttttgcttttcttttctcgtgtgttttttgcatgttttttctgacaattattttctcgtgcgttttttgcttgtttttttcgaatgttcttttttgttttttccaatacaggagaatatatgacgaaataaaaaccgtgtaatagatgacaaaaaaaatggatggatcctatccagctcaagcgtccatcaatttagcgttttttcgacagatttttcagagcgatttgttttttaatagatgatgtttttttcttatacggttttttcaaaccattttttagaaatggtgcgttttttctgacagttttttcctcgcatgttttttttaaaaaaatttccgatgtttttttaaaaaaattctgatgaaataaaaccgtgtagtagatgacaaaaaatggatggatcctatccggctcaagcgtccatcaatttagctttttttttcttacagatttttcagagcgatttgtttttcaatagacgatgtttttttcttgcacggttttttcaaaccattttttagaaatggcgtgttttttctgacagttttttcctcgtatttttttaagtaatttttttaccgacgatggaaataattattgttgcgtgtttttttttatggaaaatggaaacctttttagcgtgtttttttgcgcttttttctaacttttctcacacgtttctttgaaccttttattgtcgtgca

SEQ ID NO: 105667 - DNA, 1163 bp, Oryza sativa
atacaaatacgcaaaccctatttctatgatagacaaatatttatccaaaaagaaaaaaaagaaaaaaaacaaacgtccatacgagaaactacgtttcgctagaaaaaaacatacatataactacatttatctctttttttatgtcgtccccatcaaaatagtgttaacatttagcacaaataattttaataaatttcatcgaatattaatccccacaaacatgaattggtgaattagatgtataatacacgaaaaaaataaaaatatatattaacttgtatgtttgcaaaggatcacagtttgagaaaaaaaaaattacgtggtcctcaccatcgaagctattagatttttcgaagtagagtccaatgatcaaccctgctaatttttaaaagagaaaattatatatataccactaaaatgtagtactatcgattaacaccacaaacaaactatgtatactctatataataaatcaactcaagacataaaaaaaatattttcatctaccttattttaaactgtctaccttattttaaattgttagatctgtatattaaaaaaacctactgatcgatcaggtcgtcagactgcgtatgtacagcacatgtatccagttccctcctcacggactaaacgaacccactggatctcgcctctttgttttccttacaacaattaagttaaccactgaataaaagatcctaaaaattaccccgaaaaaatatccaccataattttttaataaaattggtagactaattacttcataccattagacatctaacgactttctaccaacttaattatatttcccaacttgtataccaggtctatttaagctaaatcaatctataaggtacaaataaatccgtctatgaatgaagctcttttttattactatatatctccatcttataatggatcctaaaattttataccccctccatcccaaaatataacaacttttagcacttacggtacattaccaccaacattcatgtcccaaccaatcacaatcctccacctttcacttttctcacatacacttgatttctcaaaccaatataacatctccctattaattctacctactttcttaataattgtatccaactctaaaacttcttatattctgggacggagggagtagaaatcaaggagga

SEQ ID NO: 105668 - DNA, 1273 bp, Oryza sativa
tgcatatagacaaatgtccaaaaacatgttccctcttaacgcaattcccatcggtccaacttacctctatagttagatatgcatatagacaaatgtccaaaaacatgttccctcttaacgcacgcccgtacgtcaagtgatcgaaacaaacttccaaaacaatccaaaaaaatattgataaacatagatttagaagagtataaaaatattttttttgaaaaaaaatcctatacataaacattcatcacaaaatttcaaacaccattaaataaggtgccagcgcatttgcgcggactaccttcctagttatatactaaaagtccattaaacttcctacaaacgctcctatatcgccatgtggcactctacaaacgctcctaaaccaccacgtggtactctaaaaaagtagtaaaaaataaaaaaatatcctaccttaatttaagtaaattggtgggtccaataatattccaaaacatcagatctatcttataattaaaaacgaatcccaatttcctatcgtttgttttgccatgtacgtgtacggcctccgcacgtacgatctacacccaacctccctttccttctctcttgattttctaagaaactctcactttttatgtatggtaactaaaaagatgtctaatcccaactttatttctactcggttagacgcataaattagatcattcgttgtagtataaaaaattatgtaattataataggaaatcccagaaattccgagaaaaatacaaaacataactaacccttaattttcacttaaatcggtagactacttattttataccactagatcagatctattgagaaaataacgctttattaacaaaccgaaacaaaatcccgtgtacttataaatacatactactgttcactgtgtgagatgtgtacgtacatactcctactattcgccgaaaaaaatagttctactgtgtgagatgtgcttggatgcccctaagaaaaaactacatggattttaaagaagatgaatcgactagattacaaggcacctaacatcctaacactactatagaagatgtcgtatctgccagttcgtaaaggatcatatgtgtcagattttcattggcaccaatttatcattaccaataccagcaaccgacacctatgagaaaaatagaactcaccaaccacaccaccactgccatcatcctcctggatccattgtcggctccctcaagcctaattccctgccgccaacgtctcccggattttacagcgaaaaccaagaggccaa

SEQ ID NO: 105669 - DNA, 1731 bp, Oryza sativa
ttagttatgtgaagtcgaacaaatgttttatatgccaacacgtaacacttatacaaatgcttctaaactttcacatgatggaaatgattttgttgttgtattccttatgtattatgcttatttttatcatatagattagtttcatatataaagagagacttaaatttcaagataatgataataaataatcgtgattggccagtgtagatgtaatcgggacaaagtgattttagtttaatatgagtgacattcaatatatcaaagtctataatctatttcatagtatagaatattatttttcaatttccctgattataacgtaatttattgtacttataacgaatacgatgaggaaggattacttttagcattgtttttacgatcaataaataacatgcccgcgcagatgcgcgggcttcgttcctagttattaaaatatataaaccgatgggccattcttgctgcactatgattttttatcagtcgtaccaactgaaatggcatggctagaaaggtttaaaactaaataatgttttcgaggatttattttaaaattttaaaatttttaagaaatataaaaaatcaaaggtaaccgttaagttatcagctttattgagccaagatcgaggaaccagagtggtaaataggttgagtttttgtaagaaaagataaaataaagtttaaattttgagtcaatggactgtatatgcgtgagctacgataacaaattttgttttaaacccattttgtggggaggcactatgattcgattatatatggttcttggatttttttttatgaaaggttgacaatattgatttgtacaactgcttggtctcttgtacaacatgacgctcgtaaattgcaaaactatctggtgctatatgcaactcaaactgatgtactgatctctgtttggaacgcatgccaggatactttatttctataacatttgataattaaattgtatatatatcattgtgaaaattgtatgttcctaattagtaaggccaacaaggacacattttctgcgaatttcgcattacacatgcatgaacgcagagcgctttatactgaaaaagaattaacaaatgcataataattaattgcagtgatacatatatcgctcgagcttttttactggaaaagaattaacaaatccatatatcacaaagtctcaacatatatagttgcacagttcgtgcatccatgatcatccatatctcggaatggagctaactagctagtaaccttatctagcaggaagacggcggatgctcgagccttcactactggtaatagaatcatggaagctcttacgaagccttgctaaatttttttttgataacatatatgcgtacggaggatatatatatattcagactactactatttcttcgtgaatctgtccctaattaaactagatatagctagcagcaggtgccgctgccatttccgccggacttggagccgacgagcatctccaccaccgtccgtaccacgccgccggcctccggcatcagccactcctccccaggcagcgtcctcgccgccgccgccagcacgccggagacatgcagcagcaccaccaccaccagcacaagcttcgtcatcgtcgtcgtcgccgccgccgccgccatcgccgttaattgctgtgtgtcgcgaaaaggggagacagatcgagatgaaaggttttcgctagctaagccgaaattaagcgctaagtgagat

SEQ ID NO: 105670 - DNA, 813 bp, Oryza sativa
taatttatggttgaggatagaagggtggttgaggggtagaataaggagaaatttgagtgtgatgtgattgatgggacaagtagtacttgggagtgacaagtattgttggacaaaatttgaatgtaggaagataactaatttgggacagaggaagtaccctagataattgaatgtcaatcagtgaacaattaagtcctacttgtgctggcctaacattattctgtattcctcatttctcattatttttagtagaacgaaggaatgagtggaagcacatcatatgtttactttgaatctgcaagaggttacatactatactattgaaaggcctcgactgaaaaaaaatgtcacagatattactaggttcagttgtatatgcaacttgagatgttttattggaggtaggatttgtgctgttgcttttgatgtactccacctggtttatgatgtatcgcagttgacatttatacatacttttgaccattcgtcttgttgaaaagttttgtgcaaatgtgcaaaagtataagttatgctcaaagtacctttaatgataaaacaaatcacagaaaaataaatgataattacatatttttttaataagatgaatggtaaaacgtatgtccacaagtcaacggtatcatacattaaaaatctgagggagtaattattacaattgtaccaaatcatgaattcacaactcatgcttttgatatataggagtatcttttagtgaattaaaataaataacatccttcgcatttgtgcagcttgttgggctcctgaaatctgtcggttacctaactctagcaattg

SEQ ID NO: 105671 - DNA, 744 bp, Oryza sativa
agctagccattacccattggttatattaattaacttctcattaatctcattgatttacataagttctttttatatgattggttttacagaagttagttatactaatttcttgttggtcataaatgtcagtgcgtacaacagagatatgtgtgcacttgacttacattttttgttgaacaaatattcatattcatattctttgacttgaccaggataaattcgtctgagctagctaggctagccgcagtagaattcaaaagccagcatccatatatttcgttgcactggtggccatgcgagttctgtgacagtacgtggaccctccgtaaacggtaccatttccctggatcaagtagtctggtacacacgagttcatagctgaaataccaaatgcacatacacgagagtctagtgcgagttattacatcacaagcccgcaggcattgtcttaaatcatcggaccaagcggtccggaatacatccaaaagcagaaatagataaggcagcggaattaaggcagcggcatgccattgccacaggcaacgaccgtactaagacctactgagcgccatcgtcttcatctccctcctggtagtaggcatagggatcctccggagattcatcttccgcttctgattaagtttatatttgcaagggtgagtaccaaccgtactcagcaagccaccacatcaacaatgcatatgataggggtatttcaaaggatggctatggttcttttgcaca

SEQ ID NO: 105672 - DNA, 1379 bp, Oryza sativa
aataaactggtcttcatgtttcctgttcttcctttttgtggtgtactaccggaaaagtgcttcataggcaacattttttaagctctagctaaagatcaatccaagaaaagaacactgaacaccaatatctaaacaatgagtcaagaacatgtaacgacctaaaactggtgagggaaaaattccttttttgtttgataacggaagtgagggaaaaaaatctatatattgaaaactaaatatacatgatttcatcacatacctttagcttatgagggatgatcgaatgagaagaagattagaagaaaatagagttcagccatgaactctaaaccctaaggcaataggatgggaaaaagaaataagattcgctgaactgaaggaatataatcattttcaaatttttaatcagtgaggagaaggatcaatagatcgatggatcatcatcacctgatgttagcttccgttttgtcgtccatctttagttctctgttccacacggcggcgactcggcgagtagcaatcatagcaagcaatcatgggcccgtatttgtgggccgtaaggcctgacaacgaagtgcctggaggcccaatctagctggactgaaaaaaggccgtgtgcgtgtgcggtcgaaagaaaaaggaataagttcaccaggtctgtcaaacttaacagcgagattttgtgagatcctttaaccacagaactaaaaatgtgtacagcaagattttttagctcgtttaaccacaaaattagaaatgtgtacctctaaactcactcaaaccgttaacagaagatcccatgacaatatttttgccccagatttgctgacgtggcatcctagtcaacaaaaaaattttaaaaattacgtgagacccacatgtcagctacacattttttttctcctcttttcttcttcgcctctcttttttcccttctctcttccctagcggcgggcggcaatgggcgaacgcgggatgcgggcggcgggcggagagccagtgggcctaggaggctagcggcaagtgagctcgatagcggtcggcgcgtggcgagcggagcggcggcgggctgcgagtggagcggccaacccccgccgccaccaccgtctctctcacccgccgccagctatcgacccctgcatgagcggcttcacggcgacggctgtactcctcatcaccgttgcgctacatggcgcccgcaggtgaccacccttattcccgcgcccggccggagaggggaagggaggccgggtgaagtgggggaagatgaggccaacgggagagggggaaagagacagcgcctcgccgctgcttgctgcgccgtcctcgcccgtcgcttgccgccgctgcagccacgctcgcccgctgacgccgccgct

SEQ ID NO: 105673 - DNA, 4008 bp, Oryza sativa
aaataatgtaaggattattgatatgcttgtatgttgagctcttaaattgtagatttggatgtttacattgttagagacattacaagatgagcatgacagggagagcataatcctattcagaaactacacaatcatgtaatatctctaatatgcatgttaagatgtaataattactggcggatgatgatgtagtatgtttgcatgttaagttttaggatacagtgggttataactctatagaagatatagatacacaaacgcacaccatatcctgataacaacatttgagagaccttgctgaaatatgttaaagctaacgaagttattatagatttcttcctgtcgataaatactttatctggcactgaatttaggcatgcaattactcgttattaatttcagccctattgagattactcataaattatttgtcaagctaaccccatcctatgcaggcataccacatggatctatatatagttctatacacagttcaatcatggagcacacagtagtttccaagcaagcaagaagcatcttcatgctctctaaatgcatactaatttatcatatcatatttttctcacctccttagttgttagtctcatcttagaaatatattgtataggggaactagttcgatcgaaaggataatagagccaacgagatgtggttggtagatcttgaccggatgcccccgtgtaaactgactttggagcaatgcatgcatatatagattttatatgcttgatgaagaagcattagagatgagcatatcaaattgtcaatgcacttgatctatgcttgcatggattagatgacattaaaatattagtgtttttttattcgtggtaataatggccagagtgctaattaactagcaaggccaaggcatatatgtaagagttaccaaattttagcaggtaacaaactgaatatactcatgtcattgtctctctaccaaaatttgacatttacggaaatttctttagatgaaaatattaccaaaatttgataaggctacaacccaaacacattcaatgccaccaaatcgtattaaaatttggcattaggttatttcaaaaacgaactgaacaaacccattgtctgcaagtattaagagagagtcaaacaaatatagcctaattgccaaaattaaaaatgaagatccacatatattaagccaaactgaagcgatatgtttaccagcaaggtctgacgtacagaagctctgttgatgctgaaccaagtaattaacacgtatgtaaccaacgtagagtacattgttagcccctcaggcacccgatcaagattattaaacttaataataattaattctggattcctcagattattgtagaacagcacattggtatatatataagtatatggtatggaattagtatatagtaatacgcacttgtactttagcgctgcttgtttgggtgttaatttaatttagctggttggtcgggtgaccaaccaatagcgacagaggtacagcttgtccggttaaattataatcccccgtttctaaatatttgacatcgttaactttttaacacatatttaaccgttcgtcttattcaaaaacttttgtaaaatatgtaaaactatattatacgtataagtatacttaagaatgaataaaatgataggaaaataattaataattaaaatttgaataagacgaacgatcaaacatatttaaaaaagtcaacggtgtcaaatatttagaaacggagggagtatattataaagtgagcgtaacacaactagtaattagtttccgtgtgacagaaccggctcatcaggttcaagttctagacttaatataggtgctcgtattcaacggcgagacgtccgtggtataagggtttaagttctagacttaatacgggtgcggtcgacggtgagtcacccgtgtataaagtgtatgcgcgtttgtattttgtttcttaaaaaaattatctacatatcaatatacgtagtactagtagtatcattttgccaaaatttactaggtaaatcaagtcagagttgcgtcaaaaaaatcagtacgtctagctctcttgtctcatcacggtttccataattgatttacaaagtttgtgggtttccaagaaggatggactcaacactttgatgttgtgtgttcaaattaacttagattatgttaatttctagtaaaaatggagcgtatgattaattaagccttaattattacaaactttaatacggaaaggttttttttacgaaatgtactgctttaaccgtttgaaaaacatgctaataataatctgaggtgaaatctgcagtaacttaggcctggtttacttcccaactttttttcaaactttcaatttttccatcacatcaaaacttttctacacacataaacttccaactttttcatcacatcgttccaattttaatcaaacttccaaatttaacgtgaactaaacacacccaaagtggagtactactcagacagctgccactctgctagtactctagctactaatttttagttatttttaacttgacgtttttaaaaacctttggcaataaatcaaaacaatattttgaaatcatttttggttataaatttaatgatatatatttagaaaataaacccatatgataattctaagcataactttagtgaaattggctgcacaaatttcagggtgtaaactaaaaacagacagagatatagttctttcatcctaaactgttgctattttattggggattgaaaattcatcggtccaaattccaaattagaacccgtgtccatgttggggaccaaaagcatgctgcatgcagtcaatcacaaacatgcgaattcttggtccgtacaaaggtagtagaacatagtacgtaattaactgcggtcttagcttaaacttaaacacgcacgagcagactttaaaatcaacacactgctgagacgaattcaaagttcaaacagtagccaacctgctatctacctatatatatgcggctacctcctcgccatgaagctgacacctctcttgctgctctctttagctaaagtgttctccattttctgtctcccgtttactcgacagcatgacgatggcggtagtggcggcgacggcgaagcttgtgctgcttctggcggtgttgttgcagttctccggcgtgctcacggcggcgaggacgctgccgggggaggagtggctgctgccggagggcggcggcgtcgtacgggcggtggtggagatgctcgtcggctccaagtccggcggaggcggcggtggcacccactgctgctagcttagctctagctcctctcagtttccaagagctataaaaatttatttatttatttggatgcacgaaatgtgcagcaaagctcatctgacgagttagggcggatgatggcatgcatcactgtaaatatacactccctctgtcccaaaatatagcagtttttaaaaatgcttacattttaggacggatgtagtattcaattagtttaatataattccttaatcgatcaggatatatgtgtatactggaggcatttggtaattctttttgggtaaaaattattaagctcgatctatgtgtgcatctgtacgtggtatgtattcgcaggaaaaagtcctgctcagattacttttgctttttcttcgtaaaaggaaaaatgtacagctcagataagaaggaaacattttgttttttctttgtaaacggaaaaatctcaggagaaacttattatcggcgctaataagaagaaaacagagcccagaacaaaccatagtgcttggacaacagcgctgtgtattttgaccgctttaattatttatttatagataatgatttccactaaaaatcaattctactctaatatcacgtaaaaatcaaactccctccgtccctcataagtttacttttaggagagagggaaaaaagtaagaggaagacaaaattacctaaacacccttattaagcagagaataatatggggggatccac

SEQ ID NO: 105674 - DNA, 1357 bp, Oryza sativa
acagcagtagggtctcctggcgccgcgcgcccccacctggcgccccacgccacggtggagtcaccacccctctcccctctcctctctccccccttatctcttcccctctcccctatataaggttcaccactccccactctcccctctatcctcacctcctctcctttacccactccaccgcgccgccacctccacgccgccgcgccgccgcattaggccgccgcgctgccgctttgagccgccgcgccgcttgcgccaccgtcgccgtcgccgccgtcggtaagccgtcgcccccccctccctgcgtccatcgtcgtcgccgccgggagagcaagaagccgagagagggagaggaagggaggagccgggaggggaaaagaaaagagagagagaaaagaaaaagaaaaaaagaagagagagagaagaaagtgaaaagagaagagagagagaggaagaaaagaaaagaaaagagagagagaaaagaaagggaaaaattagggggagatttaaaatatttaaaaatattagaaattaattataggattaatgaaaatataattagatgaattcttacagattgttatagattatttttagtaatctccataaggaatcaatttcgcggtagtaatttagatgtaattaagaactaaataattagatgaagtctaggacgtaattttaaattacaaaatttcttaggaaacgcaaaacatcttaggaggaggaataattccacttcgcgaataaaatagccgatatagaattcacctctcgcgctcgtttttcaattcggtcattatttggattttgtttgaattctaatcgaattcaaattgttcttacgcacgtaactatagagaccgagggagccgcggatccgggtgaaggccaagacccgcaagaccttgagcaaggcaagtcatcactattctttgatcacgttgatcccaattgcgaaattaatttttgtttacaaataagattgcatgcaatgatgaacatcctatttgtgattatgccatgccttgtttattgttcacctttaaatccttgtaaccatgattacgtatgagtctctagtcaattatgacacttgcttagaaatgctactttagaatcttgcatactcatatttatcaaatattatatgcttgggcaattacctttgggtaggtaattgaaatgcggtatgtggagacatgagcgccacattgccatgataatggtgacatgaaaggaattaaacatttgttttagaccggggcggacggtggatttgggtggtatccgggaaaggctagtaccgtccccggtcaattaagaaccgagccatgaagttaagcatgaaacgacc

SEQ ID NO: 105675 - DNA, 620 bp, Oryza sativa
gagggtggtcatgggtctacatggacactgtgtgactccactgcgtcacggcgggcggttaaacctcagaatctgaaatcatcaatgtattatttttttaagaaatatattctacaaatacatttttttataaatatataattacaaaatgtaggggcacatgtaaatcagggatcgatgtccagaatattcatgtcatacgtcctttttaaatatggggtgttattgatttttagacatgacgactcaatgcattataaaatgtactccctccgttttacgatgtaagtcatttggtatttttcacattcatattgatgttaatgaatctagacatatatatctatctagattcattaacatcaatatgaatgtgagaaatactagaatgacttacattgttaaacggaggaaataatacacgttttaattttgtactaaatcaaaattctctaaatttgatgaataattcctcggtccaaatccaaatttaaatccgtgtgggagaaaagaaaaatagcatgcagtcactctcaaggtacgaattcttggtcagcatcaagagaaacgaattgaacagaatccaggaaggaacggcttaatcaaaacctagcaggtaa

SEQ ID NO: 105676 - DNA, 2657 bp, Oryza sativa
gtaccttttaacaatttgaaaagtgtgcacccgaaagaaaaaagggatgacttagaaacttaaagcaaagaacacagaagtaatgctcccaaaatatattagttagaaatcaaatttgtgctgaaaaattaagcaactgtgatctctaaatcatatcaataatgttatttaaatcacaagacgtccatgcctatgcacacaccacattctttatactattttacatttaagggcccacattcactataattcaactatgaaaaaaatatgtaacttttggttatattttccgacctttgtgtccaattcaaaagattataaaattatggaaaaaaataatgatatagatttgatcaccgtatataacttaacaataattgaattagatatacgatgaaaaaactgaatggacctaactctgggtaatgttcccaaaaatactcctctcattccgacattataataagtcaaaataatattgttatatttgtagtgtacatattttgaaaatctactgtatacttataaatatatttatgaaaagacaaaaaaaagatacatcttaatcaatcaataaaggatttattctatttttatacaatgaagcaatagtaattaaaacgcattaaacttgtaaaataaatattcttatttatatacatacgtactctctctcctcctctcccctcattcaattctttcttcctctaaagcaatagtttaaaatattattttatttataaaaataaataattcaagatccatattacccatatttcactgtaaataatacgtcatttatagacaactatgcgtgtcaaccaaataaaaatatagaacaataaaaaatgataataactactatatcatcttaaatcattgtacatgctctatagagcactaacagtgtcacatattacgtcttaaatttaaaaataaaatattagaaattataagaaaaacatttgaccaccggtttcgacttaaatatgtagatccattattttcaaccattagatctacttaaatatgtagatccattattttcaaccattagatctacttttaaagaaatcttaagccgctaagagttactacatcttaatagttagaaaaaaaatatttgaaattttaggaacaaaacaatagatcatcggttttcacttaaatcatttataaaaaaataggaaagaaaccgcccacccctcccccaaacttcgccctcctcctcccatgcgcacaaacacaacactaccagtcccctcaccccctcggctcgcgatttcccttctacccgtctttgatatttttatagctctcaaactaaaagtagaaataatcaataataataaaatatatattatttttaagacacacatccgatttctaatctaaattgctctattcataattaaaccaacaattaaaagatccataacgcctatattttgaacttaaaataagagtggtataaaatataaaacaagaaatataaaaggaacatttgttcctacttttcactaaaattagaacaactactgcatgttccatggccataacatttttttaagtgattagatataacattttttaagtgcttagatattactggctttcatgacattatgagttccttcacatattattgcatatataaggcacaaaaaggttagcggtttatagttggttgagaagttatttttgtaattattaaactaatatgttcggactcatattgattaggtattttctttttttttttaaaaaaaaaagatactatagatcaccatatatcagggaagggtggtctacgatatacctatagaaatttatatgtaaatatgtaacaaactgcgtcaattgaatcaactaggatgactagcttggtggtacaaataaaacatattcattaacaataatattatttaggatttgctaaaaaaagaaagcccctaatcattttattaaaagacaaaacaccgcatggttctaaacaaatcaaatctaaatcctttctacataatgttagataattgtttatcgaatgtattaaatattcctataaatattgtctaacaaatatatttgaaaaattatcaaagcaacactgatgaggataagttatggataaacattacttttgaaatggcaagtgacatctggttgatattttgtcattttaagatttttttcaaacataatatctaatacatgtccacgcattgcgtgggctaccttcctatggccttgtttaattcccaaaacaaaaacttttcacccatcacatagaatatttggacacatgcatggagtattaaatgtaaaaaaaacaattacacaattcgccgggaaattgcaagacgaatcttttaagcctaattgcgccatgatttgatgatgtggtgctataataaatatttgctaatgatagattaattaggcttaataaattcatctcgtagtttcctggtgaaatctgtaatttattttgttattagattacgtttaatacttcaaatatatgtccataaaaattttctccaactaatcgaggtgtatatgaaacagaacagaacctcaaccgccgacttctacgcagtaccattccaattttcaccaccccaggggggcaacttttgcgaggcatatcatcagct

SEQ ID NO: 105677 - DNA, 3107 bp, Oryza sativa
tattttaaaatacttatatacaaaagtatatttatttttatttataaattaatttatagtattgaacataaatatagctatatacgtgtagattcatataaaaaagtaaaagtattttagaacagaggtagtataaggtgaagatataaaaggttcgcagctaaaatctctgcttcacaagaaacgatctcagggaaagcagaggaaaatttccttcccattgtattctccttaagaaaaacaaagaaaaaaaattccacccactccaacgtattttgttttatttcctatattttttcctttctcctgtccgaatatgtgttttacaatcctatctaatgaagtttcatttgtttttcaatctctggtttttaccatgcatttttatccttcttatgtgttatcactatatgtttttacaaacatgtttcaggaagagattttagctggttaagcaaatagtccttccttcccaaattaatcatcatataatgaaattcaaaatttcttaaattgatcatcatataaccgtatggacacggatttcatcaaaatacaattaatacagcatgagagaatatgtgcatgctaaggtgtaattggcatggtgttttaattgatgtatgcattgtgggagaatgtgtgcatggtgtcttgattgatttgatttaaattatccttagtgttggtgtataaatatatatgatgattaatttggaaaggagggagtattaaggttgacgttaaattatttgcatgtatgtgatataaaaatcacgcctagcaacacaactaccattgagcaataaatacagtagtcagatggatccgaaaattatgccctccatctatttgatagtcatatttcatcttggcataatgaccaaggataattaattctacttatcatccatttaaatatgctactagctattcctcgtaaacaagtgattcattaacatttacatttctcgatgcccatgtagccaatcttatgtggaagaatagagagtcacgtattaaatccgagaaagtcattaagagaatatatggttggattaaaatatgcctatcaaaagtaaatttttcagatttggaaatatgcttatcaaaagtagatggagtgagtagtgttctaaattctcatatattttgaagttgccgacgtgttcttaaggggaagattgtgaaatcaatattttttacttaaaagtttgaataaagtgcatgggcggtccttaaacttgtaatgatgtgtcatctgggtccctaaacactcaaaatgaatacccaagtcccataacttatcatagtgtgtcatctaaatcccaaatcgccacagccccttcaagattctacatggcgctgatgtggaataccacacggacatgacgtgacaaatgaaatccatttaaaaattttcatttttcatttttatttttttcttctctttcttttctccttctcttttttttcctttcttctcctttctctatgacccgagcagaagaaaaaagaaaaaaaagaagaatgagaagaaaacaaaaaggaaaaagaaaaagaaaagaagaaaacggtaaagaaaaggacacgtcatgtccatgtggcatgccacattatcgccacgtaggatcctagagggcctgtgtcgatttgggacctagatgatacactttgacaagttctgggacctaaatctgtattttgagagtttggggacctagatgacgtaatcctacaagtttaaggaccgcctatgcactttactctaaaagttttgtgatgaactattggttttacaagtgtttgaattgaatatggtgaagtgttttctttgactgactctcattctataagtgatcggcccaactgatcaggtatggccatacgataagagatgtatgtgtggttgttggatcaggttgcgcaatagcgggaccaacagactccaatgtggagttggtttccaatgtggagttggttttggggtaaatttgtgcttcctgatgattctttaatgtttataacctttaattgtttcatatgcttatcatatactatttgggtgctatgagtcacgttgagaaagaatttgtgttcaagttttttttttcatgtgtgaacatgtcttgaggccatgtgagtattatcgatgatggatcgggagtcaacttaagagaagttgatttctagatgatgaagaaaatcatacgagatgctcaggctaaagaaaaatatacattgaagtggagttttcatatggcatatatgagatgtatgtgtggaaatgaattaaattcggatagggatcaaagttcggaaagcttgagttcaattgtaaagagataaattgtatcttcgttgaagagggtttattggggaataggactactaatttgaattggcttcataatttttgagcagttcttttgggtataaatagatgagaagtttagactcaagagtaaaacttttgaaggagagaaatttagagtttagccatgagttatgacttgtattcatgagttgaaacatgggtactttggaggcactttacaaacacacaatttttatgatcctatcattcaacccttcttttgtagacttaaactgtgttcggaaggagaggttggcaacatctttctcgtgcatggaaaacggagttgtttgttgatatatgattaattaaatattatcttaaaattgaaaaataaattaatatgatttttaagtaacttttctatatttttttaaaaaacatttagcagtttgagaaacatacacatgaaaaactcccgaacacaactttagttattttattgggttaattagatacatgccgttataaatttaacggatttgaaatatgccattacaattcttgtatttgtaccaatgccattacaatttttatatagtttgcaacatgccacttgtatacacgtattttacctatattagacaaaaatgccccccctctttaacctctcgtcgttcatcgtcatcgtcacctcgccatcgctgcccacataggtcaccgccggcgccatcctctgcgtccccatcctcatcgccgattcccctcctccggaccatcgccggcttcc

SEQ ID NO: 105678 - DNA, 1801 bp, Oryza sativa
aaaatgttcagattttaaaaaacaagctatggtagagtttgttttgctaaaattacaaagtattttaaaaaaataagaaaaattaatcatttcatcctataatccatccgtcccataaaaaccaacatagtactggatgtgacatactaatactatgaatctggacatccatttgtccagatttattatagtagaatatgtcacacctaattttaggatatattttttttttggggtggagggagtaggctgtaaggcgcgtgtgagggagagaggggtttcttttgggggccgggcggggttgattggcgttaggtggagggtctcattaaaacggaggtgcctctgcctgcaaacacagtgacggtccttccaactgctgggatggctgtcccctagcggagataccaccacagcgacgtacctccaaacaaacaaaacccaacaacgagctttgctatacccctatagctagcaatgcacagacgacagctgggatgaaaagaatatcgatcgatcgatcgatcctcaattattttttctctggattgatcgatcgatctcacagttcgatcgattggtttacacgtgtgcttgttttccactggagcaatagtattttattttgtttatatatatatcctccttgtgttttttttaagaaaaaataatctcgatcgtacgtcctgatcgcgcttttatggaagatcacattttgtgacacccttttgatcgatcgttttctaatgcaatttattttgaatagaaatatgttaaatgtagtacagaaatttcttttgacctcttaatatgacttcagttgtcgaaatgttcctagaattcattaatccctactatcttataaacacaactccgtacttattccctttctctagaggaacaagagaaaaccattcaaaaaaacaaacaaaaaaatcattaaaagaaaccagtcaagaaaacctagataaaaatagggggaaacgggaaaaaaactgaaacttatccaacagaaaaaccgagaaaaaaattgcaagtatatgtttaaaattgcaagtatacttttcaacctatatttcttttctccaaaacatagctacttccaatgtttaaaattttgcttcaaaatatagctacttctcacacataccaacccagttcaacaaaaaacttgagataccaaggaaagatgagcaactcacttcatattttaacaacttctacacttaggttaagatttttttcgcttatgcttatgcttatcaaccaaaatttgaattttcaactttcaatttggagttgattttagggttttttttcattgaagtttatttttcaacaaatgctttttagatcgctaagaacatgtatataaaagttttaattattcacaaattatttttcgtttacaaatatgccgtttcgcttattccccgaatatacaaaacgatggggctttactatttcaatcttaaccaatcacaatcatctcttatatattttttcacgtacattttcatctcaatcaatcataattactttttatttaattttattgctctttaatctctataaaaacttatatgtataaatttttatattttaagatagaagtaaccctaagctcgagcttttgagttgtgaacttgtgaattgtgataggttggaatagtatggatgggtcgtcggccacccgcgcccacaataactgcagtgacgacgacgagaggattatcctgcaaataagcaacgtgtggtgctagccaccgcctcctgtagcgccacaaaaaccgggggatcc

SEQ ID NO: 105679 - DNA, 672 bp, Oryza sativa
ggtcaaacattacaagcaaaatatcaaaatttcttatattagaggacggagggagtacatcttaataacattttactttttccctctttgtattttaagctaaaacttttagaaccatatagatgacaccattatcaagttcaaaattgttctcaatttttttatgagcgtttgcttgaacttgaatgccttgatgtttaaattagtcttaggtgcttccaaccatgtaaactatgataaaaagtccaaaataattattgagaagtaatctgtaatgcatttaacattctaccaaaattagtgtgaactagagcttacatagagagagagagagagagagagagagagaagaaaataacgttagagagtaaagtgaatcattttaaatagttcacgatggagaatcagtataaaattaatttgagggttgggggtgttaaaatggaccttttttcaaaagaaaaattcaggtgaatttccaactttcatattatgagtgccaacttaacttgagattgaatgcatttccagttggaatttgagagcttttgttcagaaaataacgtgatgatgaatcaaactttcaacgtgatcttgaacagttactcagtagaaatgtttcgatcgtataaaaaatgagattcgccaaacacagtagaatggcctctggtc

SEQ ID NO: 105680 - DNA, 1556 bp, Oryza sativa
tttatcatgtgtactgtgcaacactaaccaaagggaaaccagagataatcttttctttaactatccttttagcactgcttgttggcagtttctgggaatctcatggaatactaatcttgaattttaccaaaggatagcttttacaagatggcagttcaatcagactggttttctggagatcttcttattggctacttggcacatctggaagcaacgaaatggcctcatcttcaagaatttgcagccaaccttccagtcttggaagtctctctttataaatgaagttcttcttgcatctctgcagaatgaaggacctcctcaagcaatctgttcttaatttgttgcaaactctatagggttttcatctctcttgtaatttcttgtaaatattccttcaataaataaaaatcacactgcagggctaagccctgacagcactttcagtcaaaaacttaacttgagatcgtatacatttccatcgggatattttggtagggacttttccaattggaatttgagagctgttgttcagaacattacttaatgatcaatttttcaatgtcattgctaacacttacacaatagaaaattttaaattctatatacaggatatgagatttgccaaacaattaaaagcaaattaatgacctccggcgttccaacaaaaacaaatacaggaggtaaggcatcagtcacgtacttgtttttttaataatgcacaagaaatctatgtgtcatagagaagaaaaaaaatgattgaattttattttgaacccctttttgttacccttattgtacaatggaacattacaccccatatccatcccaattaaaaggttttacgcaaggtaaagaaaattaaaaggttttatttttaagggtcacaaaaaggggttcaaaataaaaaaaggttcacctatattctcacactacaccccatattcatcccaattaaaaggttttacgcaaggtaaaaaaaattaaaaggtattacggtacaaccaactattccatggtagcttatttggccaatccatgtgaagttttcgtgctagctggttgagtctactcccttcgttcatagatttaatcacttctagattattttagagagattaagtttgaatgagaaacactatatgtgacacccctctcaaatgaggggtggttgagagtgagcttttttttttagatctttttattttttttaattttaataatagacattttcaaaaaataaatattcaaaaactgaacttttggccacgccagtcaaagtgcatggcaagggctggcgtacgcgtgacaggccagcactgctacaccagctgcgtgtggtacgacagacttatatggccacgccaggtggactggcgtggccaaaaggttcggattggaaattattttttggaaaggtcaattaataaaactgaaaatagaaaaggtctaaacaataaaaaaaattcgttgagagtagaggatggttcgggccttaggtaatgttggttgaaaaatcgaggatggttagttgaggaaaagagtggtataaactccat

SEQ ID NO: 105681 - DNA, 633 bp, Oryza sativa
ttcctctatccaataaaaatatggtcattacaatgcattatattgtatctctcaaaaaaaaacaaatttcgttccttcccctcaacaaaataaaaaatataaccatttcatccttaaaaagcatggatggaccttaacacatcccacctcatattgaaaccaaacataggcataagttcaattcactcttctccactttgtccatgtgctgtcttccgtaatttttaggcacatcttatccctacttggattggaccgaaatccaggttcccgacccatccacttgtgtgggctgtcctagttttaaataccagcccatacatgttaatggactggaattgaggcccacctgaacgaggagcagcccattacttgtataatctgtgccattcggcctcctcggcctattacccctaatggccctgataatcaatactcatggctataattaagcccatgtagaaacagttgttcgaccgagccataagtcggccacaaatcccttgatacgtacgggactaaagatcgcatatgttcgttgtagccaccaatcgaaactaaagatcatctttagtcccgatttttaatggatttgggattattatggatttcgtcaaaccccgggggatccac

SEQ ID NO: 105682 - DNA, 857 bp, Oryza sativa
tgcattacgttccccccaaatctcaccggacacaagcatcagtagagttcgcagaggggctcgtggagtattagggggttcagcaacaaggttccaccaaagttcgacggaggggcagtcattctatttactcaattggaggtcagtttgtgtctattgttggatttcggcccagattctcttagtgactctacatttggccagtaggtgcagggctgactcatccgttacacagcacagggggccttcgcttcgttcttgtccatggccatgcctctactcaatatcaaactccaccaccaccaaccactcaagcagcacttccatcaacaagttcatgaaaaacaggttcctcatcaccggagacgcacggtgaaactcatggccgacgtaccaaccacactacccgtccttctctttttctaatctaatctgtggaaaaaaatattaatggtcgaagctaaaacagtaacaagctcaaatataaagcaacggatggagtaaagacatataattaaatcactgtacaaacgtacaaatatcaattcaatgtttgattttgtcgctactaaaaacaaagaaatttcataacccaatttcaaatatatgtcagaggagctaaaccttcgaactagctagtagtaggtttctagttctggctgctccgcgcgcgcattgggcaccggccggctgcgccccgaatccccggcccgatagacggatctcagagaagacaaaggcctctggtttggtttggaccatcgcgagctaccgccacagcccttgtcctgcctaccgcttgctccgcgcacgttccctctctttcgatattagcaagaaaccatggggggatccac

SEQ ID NO: 105683 - DNA, 619 bp, Oryza sativa
tgcccaaacgatgcaaaagatgtcagactatgcacagtgtttagtacatgtcctccattggcatgcttcctttgctctgggacggttactgttgtgcttctattatccggctgcatttcttcactatttttgaattcaacatgtaaaagcctgtacaatttatgttacaagcacttttacaaatattggtacgagtacgtagtactggatgttaccagctatagagcttgattgagcaaactcacggagatagcaaggacaaagaatgtacttcctccattccacgatgcaagggcccctttgaatcgcaggattgagaaaacgtaggaatataaaaaacgtaggattttgatagaaatataagaccttatttagatgggactaaaacttttaagtccttatcacatcggatgtttagacgctaattataaacattaaacgtagactattaataaaacacatccataatcttagactaattcgcgagacaaatctattgagcctaattaatacatgattagcctatgtgatgctacagtaaacattctctaattatggattaattaggctttaaaaaattgtctccgcgaattaactttcatttatgtaattaattttg

SEQ ID NO: 105684 - DNA, 736 bp, Oryza sativa
tcctgcagccccgcttcaacttccacccgctgcatctctctctctcgctttgtcttcagctgcatataacgcgcgaagagggaggagacggtgaggccggcgaggaaggcggggaggccggcagcgacgcacgaagagggatgaggcagggccggcgagctcgctgttctgctccgcccggtgctgtgtggtgagaaaaacgagacggatgacgtcgcggagcttccgctcctccccgatgttgagtagccgcttcaacttccacccgctgcatctctctctctcgctttgtcttcagctgcatataacgcgcgaagagggaggagacggtgaggccggcgaggaaggcggggaggccggcagcgacgcacgaagagggatgaggcagggccggcgagctcgctgttctgctccgcccggtgctgtgtggtgagaagaaaggagaaatgataagagaggaagggagaggctagcgtgcagacgtggcatcctgacatgtggggctcacgtgggtcccacgctgacacagtcgccacgtcagataaaaccgggtcaaaaccactaagagattaagtttgcactggttttgtaagttgggggatacgttgtatcaggttttatggttgggggatgatcttggaactcgatgacaaattgagggaccttcagtgtacctttttccccacggcgcatacacggctctacgcggttgcttgcttgcaatatgctcgtgcag

SEQ ID NO: 105685 - DNA, 712 bp, Oryza sativa
caagaatgacatatcctttggattgggcaccgatgccacgcaaaaacctgtggtgccaaaaccggagttgggaaaacctccgagacctcctaagaagaaggtgactgataaggcggaggatcccgagatgcataaggaaaatccagtgccggaagtgccaccagagattgaagtgctggaggtgcccatggagattccagtgctggatgtccaaatggagattaaagtggctgaattagaggtgcaatttgtggcatcagtagggacagaaatagaagaagtaccaggattggaatggaacggtacagagtcagaaatatttgaaaacccttctcctacgaaagaccccgaggtgcaagacaccacggttcctgagaaggccactaccagttctgaggtgcctagagtgcttaggagccacgactccaagtccaaagatgagaacaaggagaagttcatagtaaccgtcttcagagggggtaaggaacgtgccaagctcagagatgatgacccccagaaggccgctgaactagccgggccaacatactatgttggtgtttggtgcatgtgagtatgagttctaattaattatatgaaaaatatgtacaatacgaatacatgtgattgttactaacaaacttcttctataggatgcaatacatggatgctaagaagaaaaaagaacctatcggcttcttggatcaggctactt

SEQ ID NO: 105686 - DNA, 548 bp, Oryza sativa
agtctagagttgaaaaaccacctagtgttacctaattaaaatagcgaagcatctacctaaaatcatgctagtggtaccatgagaagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataaactgggtgtcgcgtcccaaaacgactctaaaatacatcctcaaaattgtgcatagaataagtaaaatccatgtgaaagcctccaacaataaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttattaaaagaaaaaaaccctaaaaagtctttttcccccttccccctcttgggccgg

SEQ ID NO: 105687 - DNA, 522 bp, Oryza sativa
  unsure (1)..(522): unsure at all n locations
tccaaagggtatatatttggcaccgcccgggccgaccggattgtggaatcccctctgtcaatgcgacctgttgtgtgttaaatataaggcttnccgtgagacattaaccggngggtgcataatatggggatgaaaaactgtgcgcctgtatgaaccacccatatttggcaatgggcccggtgtttccctttttcggggagaaaaatggctgtttttctatcaccccccgagatatacatttaaaacacccccctttccccctgtggtttgtgagaaaattaaatataaagccctccaatgggggaataggaacccccccttctttagggggcctttaataaacgcgccggggtgttggtggtgttatcctcaccaagtggacccttttaaatttttgtacggcccctatatgccccgcttcttttttggtttttttttcctttctttttttttgtcaccagatgccggcgttttttcctgccaaagaatttaaaaataggggggcctccctcttatggttcc

SEQ ID NO: 105688 - DNA, 1741 bp, Oryza sativa
  unsure (1)..(1741): unsure at all n locations
tgctgtgncccttttgttcactgtcgtagnccctggccacgaccgcggccctccgcggcccaggtcatcgtcgtcgcgagcctccgtgaccgccgccctccgtgactgccgccgtcctccgcgccccatgtctcatcatcacgagcctccagccctccaccgccgctgctgccgggataggatttggcatgggagaagaaaggaggaggaggaggaagagagacttacttgtgggacccaatgttaaattggagaatgtgaatggagagactgttggactaaaaggtaaatttggctctcaaattttttagatgactggccaaatgctcatttagagagctcaaaatagccaatctgttggagatgctcttacacctgatccagactagcaacctcatcttttcaattatacttatacttatcagccaaaatttatattttcaattttaaattcagagttgattttgggttttttctcaacgtcgtttatttttcagcttttgcttttaaatcgtaaagaacatgtatataaaagttttattcacaaattatgtttcatttgtaaggtccccatcaagccaaaacggcttattaggaaataaaaataaatttgtacataaaacttttataaatgtgttcttggtgacttaaaaaccaatattgaaaaagaaattactacgttgaaaatatctcaaaattaagcttgaaaattcaaattttggttttttctttggctgattaggccaaccgatgagagcctaaatatatagtttcattttttttctccaatatactaaacgatggggctgtatataccgctaatattgcatacatgccaaaggcctgtgtttactcctcccttctctggctcatcttttaactgtcgctcccatcgttttaaacctgaaccagctgatacctacgaacatacgcagccaattcacttgcctcttcctcatcttcttcgatcgtcatcctgttcgttctttgggtagagctggtcagcaaaaaaaccttttggtctcgatcggcatgagaggtgtcaggactcaggagatacagatgcagaagaatgtcgaagcttagtagtacatagaataaacagggctactggaaaatggaagtacgactaccactgcccgagcatgagacacgaatgcacctggaaatgttgctgtagcagcagcacacacaacaaagtttcatagccatgatgtgtgcgtctattgtttacaccactcatggatgtctatcggctcgtcagaaaaatccctttcgccatcttaccccttgttagtttccaactttttctttaaacttttcactattccatcacattaaaacttttctacacacaataaacttncagcttttttctttaaaacttttaattttggcatgaaaactaaacacaccccttattcttacgaactactactatgtaggattccaccccatgttttctctagctacaattgcangnagaaaatttttgaagcaagcaacaatcgttgcacaaccttctgttttgggacgagtccggctaaattcttgtaggaatgatcacttgtaatttcagaagtcagtcaatatagctacgtttggaccttgcggtcaggaaacacccagatgaacacagcacttgaataagtacagccattaaccttcaacaattatcatagggtgacctaattgggaaccaacgtttcattttagtgcactggggcaaaacagcccacta

SEQ ID NO: 105689 - DNA, 1031 bp, Oryza sativa
  unsure (1)..(1031): unsure at all n locations
ccctttcaaaattttaaaaaagctgtggataggctctcacagtctataatacacaaggccttaagcccacaatttcccgtgcaaggaattgcacttagaaaggcccaaatccaaaaccgggcatcttcttatccgacctaactttagtataattacccttaaggcccattttagagagttgcaacgggatcctacataaatacccacccggattaaccctttttatcctctcgggctgaatttggccccaaaatagccccacacnttggcccatccggtgtaccaaaaaatttcctcttaaaagtgagaattgtaaaggggttcaaaatttttaaagggattggttaaagcattaaaatttttgagaagaaaatgcaaacttataagtctgctgaaaagctttccggtgacagttttgaaggacatgtcactatccctattccattttattcttctgtagtacaagatatttgactgaccttgagatctgcaagaaaccaaatacagaaacatatcaaataaataatgtttttacctgttaaatcaaggtcaggaagcacccattatgcatttgaatcaatgatgaaaaaacatagcaagatgtattgttaaacttacccttcaccatcacgcatcctagacctaaatcgaggttctcgttgggatgcttgactaccaccccttgatcgcgccattctcttgcgttggacacttccaagggcttccttatccttctctatatctcatatagtatgccatgttttttttgagaaaattcgatccatagcacagaaaaaaaaatgcagtaccaaaaaatagcacaagaagtttccgctttcgattcatagcacagaccaccggtttttcttcgtcccgtagcacttccgtcgcattttgaagtaacggtgttagattggagtggagaaatttttcatcggactcatttgcccttcgtctcatctccaacgacggccgctcaacacaaccgtccgcctcttcatatccatcacacgacggcactcatnaacata

SEQ ID NO: 105690 - DNA, 737 bp, Oryza sativa
cccattagaacactataactaacggccaaactaatggtcaactaacggaatgggtatgtaagggatccaaataaaaactcaggggtatataagagatcaaacaaatttcaggggcgtagaagggattgggtgaaattacatgggcatatagggaattgccccttattattttaggaccgaggatcggatatactactatttatttatttatttattgtttctgataaagccgaacttaaaacttttggtacgagcatgaagtctgtttaaaagatatatttaggttgcgacttagtacctccatttcaaaatttaaatcttattttacaatataggtatttctatcaccatctacactacttattatatcatttacttttcattcaaatttcttctcatactacccccaatcatctttttacttaaccctctcaggctctcacatttattgatgaggcatcaaagtcttttcttctcaactttaatatctaatactaaataacatagaaatgcttatattttaaaacagagaaaatataagtcgtgagtcagatgtagcttaaaaaacagttctgaataagcttatgcttgataggttgatcaactacaattggtaacatgtaaaacataaatgaagcaacaaaacataatttacataaaaaaacttgtatatctgtgtttgttagtgggttaatagcctatgtaaaaaatagtctacgattaaaaaccatgaaacc

SEQ ID NO: 105691 - DNA, 1991 bp, Oryza sativa
  unsure (1)..(1991): unsure at all n locations
aagaagctgcctttaaaaagccaaaatgggcgcttttaaactcccggaaagattggacagttttggggtgaatataccccttttgggtctaacttcctggggacatttgttccggggttccagggttaattggggctttttcttccccagtaaatggcttatttttaagggaaaagctttaccaaaaacttaccaaaggctgttagataaagtgtgcagcattgcatcgcatgctttccggaaagcgtcagcttgaataaccaacatgctgagatcttgctactgcttagcattagcttgaataagcaatgcatgttataatgatctaatggcagacatgcttggcttcatgcattgaacaggtatgctttgaatgtgaatgtcgagcgggttaataatgttctattgcacaagaggttgcttgaccaggcccgtgaaccaatgaatgggctggtcttcgatgttcgtcgttcgcaggtgattaatgcataacatgacctgtctacctcttttctgaaaccgactaggcatcgcttgatgaccgtcgcatgctcgtatattggctagtgtctaggataagacctcaacattttcataaccaagtgctgttagacaccacagtaccatgtgacgtgttgtgtaatacgatgtaccttttgtgccatccttacaataatcagttaatcactatcctgtagaagtgtaaatcacatatccttgattttgaaactgcatttgttaactgctggttatttttattttatgtacaacagctgcttttgcttttctaaagcttgtctcactgtttcaatttgttctgttggaaagttactgagctataactttgttcctgcaagtcagagtaatagaaaaggacgatgattactatttttttctcctcctttttgtgcatttatctctttaatattttcatacgccataaatttgttacagtttgacttaacacatatatagagattattatcggattataatatgagaagcacaaacttatgaactgattaatgggatctactagcctatgtgttttgttgaacatagtttgatatctcattagaacatatttcatatcaactacgtgaatgtgcaccttttaggctgctactctggatggaagcactgaagttgagcaatcaacttcctttaagcatgaagtacaagatcctcagtgctcatcgttcacatcgagagaccaaaggtgattttgattccagcattttttgtcattgagttgagttacaaattgttttggatagcatcacatcagtacagattagagatggcaatggtgaattcaccgtcgggggtcaccgctgcgtccccatcaccgcggtgaaaaaatttcaccgtccccgcccccgtcaaccacgacgggggtacattttctccagccccgatcaccacgcggtgattttttccctgtggtgaccccgtatcaattagggattagggatcgtagcatgagctgaccttgcatcgtcactgtcgtagcttaccggggggcggaggccgaagccatggtcggccgtcggcggatggcgtgctggcggtggacgacgtgcgggcgagtgacgacggaaggcgctggcggacgtcgatggcgatggcggctcccggtgactacggctgcaggcgccgtgcctgactgcgcgtggacggaggctcccggcggctgccggcggcgcgtggacggaggctcccggcggtgcatcgacgggtgcccgcgccacgcgagagaaggcagcgagcggcggtgcgcctggctctcggcggattgacggtgcatggtggcacgcctgactcccgagcttcccggcggactagcggacggcggtggtgggctggtggctgcgtgcggatctggaggatttggtattttgggtggagaatttgaagttgactggnnnanntnnngnaaaagaaagagcccatttctccaggcaatccatcacacgaagggccgctcaaat

SEQ ID NO: 105692 - DNA, 3828 bp, Oryza sativa
  unsure (1)..(3828): unsure at all n locations
ggtttatatgaaagaatttacctgtagtcattagtattatttatagatgatgtatcttatgctaaagttttctaaaagggaattagtaaatattttttggaaaaaaaaactttcaaatacgactattttatagttatggtgtaattatattgtaactacattataattttaataaaaaaactaaaagttacttaaaatttatattgaagttatatgtgttttcaatatttaaatataagttataaaagttatagtatatagttacactatatttaaagttatatttaaaagtttttgaaaaaaacttgtggcagtttttcttaagatagtctcatttagagattctctgtaagttggctggtgcaaaaatgcaaattcttctatattagtatcacttgccactgtacgagcccattatcaattatatgctgaatatatttgactataataatacctttgacttgcttgcccgtattctttttcctagtcggtaggtttaacaactactccctctatttagaagggttagacatatttcatattttagtttttctaaataagttgtttttatttgtagtctcaatacatcaaaaatttaaatggagaggtaaattaaatatttgatcaaaacccaattagccattttaatactcattggttgtatgtatgcattttgatctttgctacatgtaacatgagttaatttcttcttagtcttggtaacaaagaaatatgtgtaacttttatggaataaatgagtatttcaatgacttatgcatattgattacgggggtgtttagatctaggggtgtaaagttttggcgtgtcacatcaggtattatatagggtgtcacatggggtattcgggcacaaattaaaaaactaattgtagaatcagtcagtaaagagcgagatgaatttattaagcctaattaatccatcattagcaaatgtttacttagtaccatattgtcaaatcatggagcaattaggcttaaaagatttgtcttgcaaattagtcgtaatctgtacaattaattattttttagtctatatttaatactttatataggtgttcaaacgttcgatatgacatggtgaaaaatttaaaggtgagatctaaatagagcctactataaagttcacaatgaagttaggatcaggagcatatccaacgcaagcgccggggactcgaggacacccctcgagatgcatggcccgcctcttaacccttcattcttctcatcatggatgagatcttgggggtgctgaaactccttcaaatatgaattattcctcatttttctttatccacagaacatatagaaatagaggtattctcttcgttgtcccaaaagaacgcagcctaaaatagaatgatatataatctattccctttgttccatgttataagtcgtttgatttttttcctagtcaaacttctttaagcttgaccaagctcatagaaaaatatagtaatatttttaacacaaaacaaacatattatcaaaatatttaatgaaactaatttgatattttagatgttgctaaatttttctataaacttaatcgaacttaacaaagtttggctaggaaaaaaagtcaaacgaattataatatgaaatggacggaatagtacaataaagctgaatatgtttacgtcttggaattttttggacgcagagagtacactatatagctaggcagtgtgtccaggttcacgctgaacctggctggaaaggtattaggatattgcagcattggaaacctttgtccagcagctggacaaactatcctatccacttgaacataatgcaacactttcctagtttgagagaggaaaacaatgagttgaaacttgaaagaacagtgtggcagcaaagctcgcacgttcctcggctgaaattaatattggttcgtcagtcgtcacatagtacattatttggtggggccaggtgtattttaagtgggcccacatgcttgtgtggttggatacttggatccatattccaaattacacctcaccataaactcttttgacaaatttgaatgaagttagggccagtgctccttggtttacaaatataagcattctaggttgtttggtagatgttttaagtgaaggtagaaagactttgatgtctcttattaaatgagggatggtttgatatacgagaatggtcgagatgaaaaaatcagaataaaagatgattgttaaagtaatactttagtaattcttatatttgtggatgaattctgaatgtttgaacatttatatttgtggatagagggaggatgatttagtcagaagaggatatatgatatgaaatgtcggaccatgcatgtaatagaaatatgttcgttgcatcgttgtcattcttcttcttcattaaaaaaagatggacttttggcctaataaaattgatcttgtgggattgggatctgatcagttggaataaataaatttcgattggatagtggactacttttccccattttgttgcacctctttatatgctcgggcttcgatagtatctccatccatttcttcttatctttctgaccaaccacttcacaccctagctaattgtgtattcttagtataaaaagaagggaaaaattctaaataccctttacaactcaatgctatttttattttttttcctctacgtacaactcaatttcatacactaacctccttaaagtcaatttctcttctaacttcccctcaacatctcatttttatctattccatttagttatttcaatttcttgtgttccatgggcctctagcatcatgggataataggaactcataccatctcgagaggctgggatcatataaactacagctgatgtacaactcaacaagtttaccatcgtgttttgctatcatcgatctcgcttatgcgggatttgggaaagcaacaagctggaacatgaggaaggaggttgccaaagacaccacgccaaaggcatatgatgcacgaagaattgaaataataaacttaaacaataaggaggaatcgataaaaataggatgtggagggaagttaaaagagaaattgacttaatgggtttgtgtatgaaaatgagttctagaaacacaagtgatttgtagagggtatatggaattttccataaaaagaaggatttaaattatcccatatattctctcaagaaattatcccatccaaataatggaatgattcattctacactatccaagttattggttaattagtactcgctctatttcatattataagtcatttgactttttaattcctagtcaagctttgttaaatttgaccaaatttatagaaaaaaatagcaacatttaaaatatcaaattagtttcaccaaatccaaaattgcacacattctgataacatgtttgttttatgttgaaaatactactatatttttctataaacttgatcaaacttaaagaagtttgactaggaaaaaagtcaaacaacttttaatataaaacggagggagtattaactattccatccaatcatatttatgttagtatttatataaacttttcaagcagtaaccattaaatatctaagtctggaggaagggctggtccaattacacatgttcgagtcgtttgttaatttgtaaatttcaccagtccgtctcatcaccctacattccagcaaaaatgattttcaaaatgcccaaaatggtcaaaatgtcaaagcgacggtgagcacgtgtttcatagtggcattttaaagaaacatgtttttgggatggcattccagcaaaccgcgcgttttgaacatggccaaagacgtcaacaanngaacatca

SEQ ID NO: 105693 - DNA, 1057 bp, Oryza sativa
  unsure (1)..(1057): unsure at all n locations
tattgnnnnnttttgaaccccttcgtgtgacggatagtcccgattttccaatcgggactacgaatctgggactcccggttcaaataaccgggactaaagattgatctttagtcccggtactaaagatgctcctgttggtgttaccaaccgggactaaagataatttttctttttttttctgtttttaatattgaatattgatttcacaccctcccctcccaaatccaaatcatcacatatcacagaacatctccaaatcctcaaatagatcatctccaaatacatcacaaactctttaaaaaaatagatcatctccaaatacatcacaaactctttaaaaaaatagatcatctccaaatacatcacaaactcttaaaaaaattacatcacatagttctaaaaaattcatcacagattcacatctcagacaaaaataaatcacagattcacatctaaaaaaaaatcggccggcggtcactgccgtcttcccttcttccctccgcgccggccgccgtcgcgtgggcccccgagccgccgtgcaagccgccctcgcgcggaccccatcgccgtcgttacaaccaaccatcacagtctacgggcaggtctttcttcgagtggtcccccccgccgccgtctattggccgacccccgagcctccttcgcctcgcctgtcgcctgctcccttttttgggaaaaaaggaaggataccaatgctcttttgcggtgaagggaaaaaacttgaagcattacgtggcaaaggccttggacgtttcgcatttaagtccttacatatcgcatctttcaacaggaatatcccgtgcctaaaacaccctatttttattctccccctggggtgttttaacccgcgacctaaataatcttaggggccttgtaaatggtcctcaccatgggattaaaacccgcgttctcaaaaattatttctttatctcccccttgtgttggcattctattgtccggcttattaattatctcaacccgggatcttaaaaagaacttttattgttgcggttttgtagcactccccacctctccctct

SEQ ID NO: 105694 - DNA, 637 bp, Oryza sativa
ccgcgcattgattgccgtcagtgtgatggatgtacgatcgcgtctccaacgccagcgttgatgctatgatgctaatgttcttttgttttactttctcaagattgttttttccctggatagcatgctccaagattgagtaccatatgatagctttgaactacttgtctagctatctgcacaaccaactagcgacctcggtgattaagtaccctccataagccatcgaggtggcgttggccgagacccttggccctaatgctggcaacatggccagatgctcggatgacaacgcgtgatgaccacctgttgaacatagtgagggccttggtggagacactatggtggacatatcgtagtgttatctgcatgtcgatagccaagctcacaccacggcacaacagccacagccacaagcggaggggtcggtcccttgaaagagtgtttttgttggatgtgtggaattgggtgtgtttaggagcatggacggcgtaggagccttcgaggctcgagggagcccttgtgtcaactgcttcccagctaccatgcaccgagcaccgatggccggtctcaccggaaattaccacccagcatggctcaaacatgaacaaacctagatacataatccaacatataacag

SEQ ID NO: 105695 - DNA, 1111 bp, Oryza sativa
acgactgagacacgattaaagtttcgaaggtttgtttccagaacgttaagaggagaggtcttatgaaccttcttttcgagaacgaaaccacgtatgtctaacaaatggcataccaaaaagggaaaagaaaaaaggtaggaagagtggctttttctgatggtacaaaaagtccaaatcgattcaagtgcctgtttcaaatttcaaattcaaatgctgcgtttgttcattcgtgaggtccatgctccacctgtttgtaatcttgtttaggaataagttgtcgtcccttaacttggtttgattgacatttctaatttcaaatatcagaaatcttcaactctaaactatacaaaatcgtacaattagagtcccatggtagtatagaccccatttcctcctatttttgtttacgtggcagatatctgagcccacatgtcaacatgctgagtcacccatgccgtttcaacgtgctctcgttggctgtttggcaggatgtcctcctacgcctgcagcgcgtccactgacatcgattgatagagacaccgacgctgtgatgatggtgtgcatgaactgcatctccctcagctcatcaaggtcaaatcaaatcattcacgtcgtaacgagcgggctagagccggattgcaccattcacgctgtaacgagagggctagtgctgggccgtcactctacctctagggccatcaccactacgctcaaggccatgccgccacatgcatccaagccgcctaagccggcgtgccattgttgcgccttgagggcaggccactgctacgcgttgggcccgcccagacgcgactgtgcctcaatgctatccgattctacgtgtcggggccaaccaaccgatgcgctgttgctccatctaaaggctgcaccgtggctcgaccatgaggctggggctgcccagccaccactccggcttgagatggcgaacttggcgctagcggtggagtcatcatcaacctctatgcaaacgctgctgccgtcaggagctagcaaacaggcaacgagagagctcactccgttgacacggcattggtgataacatgcaccgtgtggggcgacaaacactttgccctcttcccgattataaaaa

SEQ ID NO: 105696 - DNA, 1331 bp, Oryza sativa
  unsure (1)..(1331): unsure at all n locations
ccaaccgggactaaagagagggtagcggcagtcccattagatctttttttttcattgttttttagctagagtttaatccctatattttctcccaaatcaagtgggatacatatcccaaatcaaacctcaaatcaaagtaacatcccaaaacattcacattacaaatcttaagttacttatacacacaaatcaaatacatcacaaatcttaaaaaaattacacacaaaccaaatacatcacagattatacatctcaggtcatgcaacaaatcataaaattatacatcttagtgaatcacaaattgtaaaaaaaaaaaagatgccggtagcggctgccgcctgccgccgctcgccactgggcccgtgcgcggcctagccggccgcctgctgggtgggaagggaggagggggaggagagggctgcgtgggaagggaggagggggagganannnccnnnnncngnnnnnganagngnggnggcggnnggggaggaggnattagacctatcagaaaagatgggggaggaaccacacctatgtatacgatgcgtaatataggcattttaaaatatttaacggtcaactaatggtccactaaccggaatcnnnnnnnnnnnnnnnnnnnnnnnnnnnnnnnnnnnnnnnnnnnnnnnnnnnnnnnnnnnnnnnnnnnnnnnnntgccctttcctttactgtcaacctccataacttggcgtaactctcggtcaataaaatgttttctcgctgtgaaaaagtggtttccctccccacaattaccccaacanancgagtccggatgcattaaacgtggccaaacctggcggttcgcccaatgagcggagctacactcaccattatattgggcttcgcgctcaacgtccccgcctttcacgtcggggaaaaccttgtccccgccgcgttgcctctattgaattcctctacccccctgcggcgagagggtgtttggctattaggagggcgtcttctctctccttccctacaataccattcttcccctccccacggtccggtctcgctcgggcggctgttcttttttccacccaagggcttcctctcttttctcaacttcttgnattttcgtctcgaattacacttctcacctaaatccctccccctacgctcactaacctccttaagagcccccttcgtcggccgtttctctatcatggtccctctccctcccgtcggtcccttctaactcccctctatcaaagccgggcgggtccacccgtcgccgcgttctcgacaccccagcttctcccccctaaaaccccctccgcttctactctacgccccttctctatcacccccc

SEQ ID NO: 105697 - DNA, 1158 bp, Oryza sativa
cgcgatgaccatcagctcatacctgcgaaaacttgcagtaacaggagggggggaaatgaaggaactgtgctccacagaagtcaaaaatataacttcaggtgattttcaaatagttaacggtaacagctcatacctattataatgtgtttccaagtatatgacttggtaacagctcatacctattataatgtgtttccaagtatatgacttcgccttttttcagcctcgcagaaggatataatgactttttcaatcccttgtctgccacaatgcttatgctgtatttcaacctgaagtaaagtaatcaggtacatggttagtaggagcaaccttagctcaacaaaaacctagacaaaggcttctaaaagctgaggagttgagcgctgaaacaaacaagcactcatatgcaacagaaaaggctgcagtacgtgctggatggaactttcatgagcaaatgagtagcatcagatggtaggtcaagaaagtaccatggctcgttgcagagattgtactgtattgtgacttccccaacaaatcttttgtgacgtaacgcattctgcatagaatatatcgaaaaaaaccttagtacagaatatagacaaagattgctcatgataacaaaaactaaatgttgcaagtgaagtaaaatgtctttgaaatgaaaacattgataacagaaagaggaagtggaaaattacagaagctgctgctctttgtgtcattgtgcgctcaaccgcaactcggagcagtgtaggcttcaccacttgatgtatggcttaagcgaagctcaagataatagttccaccacctttgtgcaaagcatgtatttcaaacttagcaaaaaatctatggagagtgttcaataaaggttttttcatcgcagattcaaccacacgaagcccttaaaattggttcaagcaaagaaaacacagtagcctatatgtatttttttcaacttaataccttaccatgcaggggggtttattggtaaagtaaaaccaaaccaacccgcaaggccgtgaagggcattggttctttaggttaagataacctcggaagcgcaccacaggtttaacagcccctctattaaccatatgctctcacctttgaggttaaaatggcacccaacaaaaagagactctcttttttgggcggaca

SEQ ID NO: 105698 - DNA, 1089 bp, Oryza sativa
ggtataagatacgttcatgattgactctagtgcaagtgggagactgttagtgatatgccctagagtcaatcatagagatgattgtatcacatactatgtttacatatttatccgactttgttccttgaaatagataaactcgttattggttaatgaatatgtgattctttcatgagactctttatgttatgtgttgctatttctaaaggatctctgatcaaatatcatatgtggaacaaatatgtttagatgatcagcacatgtattaattgatgatcatgtctcatagatcatggtatagagataccaaattaataatgtggacacatgttagtgaacatgttgttggatagacccaacataagacacggcaagagccatatgagttgtgtcatcagtgatctcattgagtgttggtgttgaatccttagacctaaaattatcatggttctcaacatgtgtagtagcttacttacggactgctaaacgctactccgtaattgggtagttataaaagtagttttcgggtatgctatgaaacatgtagtgggatatgaataatcaagatgggatttgcccctcctatggagagatatctctgggcccctcgatgttgtagattatggaagtgcatggccatgccaaaggtgattgaggagtcaatcacaagttatataatctatcaacaggttcgagtgaatgattgagctattagaggatggcacatatctagccttgagcttaatcgatatcgtgaggcaaaggggttcatacaagtatacactaaaggttcaggcgatatgatttttatgtaggcccggtgggtcaatatgttctgctaggggccgctgttgacccgtggaccgaaaaggattttcgggttacagccgagttttattgaccctacagggtcgacacttaatggggcacaaataaggggattggatggaaatcaatttagacttaattcgatagggatcccaataggagtcctaccggcccttgaaggcccaatggagggacaatttaattcctggagggtgggaacgggggagcatttgtttacattagaaaaccttagcgtcactt

SEQ ID NO: 105699 - DNA, 903 bp, Oryza sativa
  unsure (1)..(903): unsure at all n locations
cgcgcacntcgcnnagaacagcgcannccggccacatgggnaccagggcgacacncgcgaggcccgaaaaacgaacagacggagagaganncacggncgaacgaacggganacaggcgangcgcggggagaagaagaggagcccggagggagtagagagctgagagcgcganncgacgcggcggagaaacgaagcgagcccagagganagcgacaggcgagcgacaacagcgaacgagcgagaacccgagaaaggccgacgacggacgccggacacggngcagangaccggcgccgccgttgcggggccggcngctggcgggcgcggggggtgcggcggcgcgngcgggcggnggccgcggggggnggccgggtcccgngcgccgcgcggcgcccgcggcgccgccggngggcgggggcgcggcgccgggccgcggggccgggcgcggggtccggggggcgggcggggcggtcgtgcgcgntcgcggtgggccgcgggcgtcgccggcgggcggggnggggggggggggtggggnggggggggtgggtgtggggtgnggggggggnggggggggttggggggngcggngggggnggtggggggggggggtttgtgttttgtttttttttntgttntttcttttttttnttttttttttttntttttttnttgtnntttgttttcttttttttttttttnntttttttttttttttttttttttnnttttntttttttnntttntntttttttnttttnnnnntttntntntntnnnnnnnnnnnnnnnnnnnnnnccgagcaaaaggagactgacagggcatttgctccaatgcaaattattgtatgccttgagaattatgctcaattatttgaattctggcttagtgtcctttgatgagtaa

SEQ ID NO: 105700 - DNA, 734 bp, Oryza sativa
  unsure (1)..(734): unsure at all n locations
gcgcgcnnntttaatgactgcgtgcgacaacaaatagcttttttctactgcactttttcggaaacataagactttctcagatctttaatttacaccgctacaccctctttatagttcacataaccaaccgtatgtcttcttgccctcnnnnnnnnnnnnnnnngnnnnnnncnnnnnnnnnnnnnnnnnnnnnnnnnnnnnnnnnnnnngnnnnnngnnnnnnnnnnnnnnngggnnnnnnnnnnnngggnngggggggggggnggggggnggggggggggggggggggggggggggggggggngggggggngggggggggggggggggggggggggnnnnnnnnnnnngnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnngnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatactggttttgatagttgagggagtcgctgtgtctggttttctagtggagggacgaaaatcggattcgttgacaagttaagggacctaaagtgaacttattcatagaaaatataacgaggaataaggagtgcatacaannngggcgtc

SEQ ID NO: 105701 - DNA, 1528 bp, Oryza sativa
  unsure (1)..(1528): unsure at all n locations
tcccttaagtttttcccccacaccccttttttcccccccgcaaatttagagatatgtaaaaaatctccagttgccccggttctccccgtgaaattctcggaaaaagcccgccaaccgaaaatgagccctcacttgttctttctttcaaggcaaggtataattccaccggaattcttcccttctattaaagccaaagttcccctgcccttgaaccccaaaacccagagtttaccaaaagacatgttggtctttatggacactgttcaacaatcccaaaaaacaaaagctgtcgggtggttaatttgtagtcccagtcccggcgaagcatcacgtttgccaattccgttcgccccccttttggttcgggcgtatggcggtacgtgttcctcacttggtaccaagaatacccccatactccattcctcatccgcaaagcaacgacttgtccccctttcctcaatggttaacttttgaatagatatttgcaaaatgtgggtatattttcttaacttgttttggactttttgggggctttttctttagctagccaagcttgaatatatcaagacttgagatcctcctcgatcacctttcagcttccggcgggagacactggatgtgcaagtattctgatgtgatggctctaagtgagccacaagaggcaaccggtagatcttgtagagcactaggttgacgcgacaacttatagaggtggaaaaaaagctagaaattcatggctcagatggctcgtaatgaggtttgctcgtagtgatttaaactcgtagtcttaataagtcgcaggttgcttatttagctcgtttgtataagagatcatcatatctttatatagttagtgcttcttatctagtgtcttttaattacatctaaattatttgtgtttagtgaattctttactagttagtgtttattattatgtttatctatgatataatggtaagtttgagataataacggtggtatagttgcgttaatgagcctaatgagcttaacgagccaactcacgagatgcgccgaattggctgagctcgttaagataacaaactcaaacaagtcgagctttaatgagccgagagctagctcattatctgcctaccagttaatttgtcaatgctcattagagagtagatgtgcccagtgtttttttaatcctcccaggtcccaaaccttctcactcaatcagacttattttgaacgggtctgagtcaaatagcagtgatacgttcaacaaatcagcttttttataatgcactttttaggaaacataagtctttctcagatgtttaatttacgccgagacaccctctttatagttcacataaccatccgtatgtcttcaagccttcctgtgtggtcctttagacagtatatttcaagtttcatgctntatctacaagaaactgataccatccacatgtttgtatgcacttagtgcagcaagccgataccaatcagatctatggtgagatccatcacactagcggccgctcaattnnnnnngcccagtgca

SEQ ID NO: 105702 - DNA, 1165 bp, Oryza sativa
  unsure (1)..(1165): unsure at all n locations
cgcgtcnttgattcctctggaaacnncnnncnanaacanngagcaattcaatgggtattttctctcctgccttctttaggagattccgagcctgtgaactgttaggtaagatttcatattttcaaactgaagcaagacccacgttaattggatcaaaaaacaaagcagtacacatttgtatcaacaacaaattaaataaacaaaatttatacaatttctttggacaacttatttcatacctcattttcattgaaaccaaatctatacatgcatatgtactcctacatgttacaccaaccatgacgcatacctgtaacctgcttccacgggtagagaaacaatctttagtcggttgacccaaatccacaatagtcccggttccattaaaaaccgggactaaaaatgattttttagtcccagttaataagaggaaaatctttagtcctggttgttgttacgaaccgggactaaaaatcatctttagtcccggttggtaactctaaccgggacctaagttcataccaacccgggactaaagatcatttttagtccccgttgattccatgttaggccgtgtcagggccctaggatctttagtcccgggtaataacacccacccggactaaaaaatgggttttagggcccgggtttcctctctaactttctaaatctcttgcctaatatttaactgcccttcctttccctccttttctttccttttttttccttaaccccaaagaacccttgggttccttttttttttccccaaaaacctttcaaggcggccggtccggcggcgaaagcttcgagggccgcgccaaaggccgccgggcccgggggccaccccgaaggcgccttttgcgcaggattttgttggtgggcccgccccgcagcccttagagccctctccgggggaggccttctccgcttgtttcgggggccacccccctggtcgtctcccccggaggggaggagggaaaaccccttttaccccccccccgattttcttttaaaatggagactcgggatcatttttggcgctggagaagggaaattctgggtgaatcttttttacacacttcggcgcggaattctttcaaaaatttgtggatatatatgtggagaaaaatctttttttataaagaagtgtggggttctttgggat

SEQ ID NO: 105703 - DNA, 1078 bp, Oryza sativa
  unsure (1)..(1078): unsure at all n locations
tgatgatgtccctgtgtgcactctgttgtgcgctatcttgcaggatatgtgaatttgtcaaatttgtttaataacatgtgcaagggtatgttaatttttttttataaaatgtggaggatatgtttgcctttttaattttttttaaacaacatgtcgaggaaatgtaattgggaattagtgcactacttaataataacaaatcaaattttgtacaaatatgtttgtactaattaatttagcaaattagtttgtactaattaataacatttcgcaattatgtacacaaactagtacagtacttaaatttgtgcatattgtatattgttaatatacaatttattttttatttaaacaacatgttgaggaaatgttattgtgaattagtgcactacttaataataacatttcaaattttatacaaagttgtttgtactaatttgagtaatttaaaatgtggaggatatgtttgcaatatgtcatagtacagtacttataaattttttaaactatttttgctgagtgttaatatatggcctattgttaatatacagtttattttttatgttagaagtttgaaacgatggccgatagtaataaagggactgaagagaagagtttaggggaggaagagcagtcgcttgctgttgtggttgctccagaaccaacggtcccaccggaagatagttccgacagcgacgtagctgatgaagacaatgagtactcattgccaagcgatccttgtcaaagcccnaagccctgagagaaaggaaaaagggccaccggtgaataaaagcgacagggactacatttccccctatagaaggggtaaataaacttaatatgttaacagttcaccatgaatacctattacccgagctaattcgaaaacttgtattataaccttctttagggaaacgcgcccacggcgaccaaaaaggcagccgaggaaaaaagatcccccaaaagacaacaggtaccaacttacacaacccgcttaaagaaaaacgaacggtctccaaggcaaaaaaaaagaaaggcggaagaaacctaatttaaaggatgaagggttcattgtgtt

SEQ ID NO: 105704 - DNA, 566 bp, Oryza sativa
  unsure (1)..(566): unsure at all n locations
cgtttagcaggtgcggcttcgntctaggatgattagctgacctagccccgataaggactcaaaaagcctaatctgagtcctagaatattatannagcctgattggaatagaccccccttnagggccttaagcgcggggtggaggtttcgctagggcgttcactgcaaggcctagccggcctttgttttccttctttagcattgacggttccngagagctattgaggcctctaggagccataagtttgagcccccccctatccttatggtaggtcccgaggcccccttaagattncccttcggagccccntttatggcttgccactggacacaccctctgctcttnttatagancgccggcctggaataggggccaatttaannnaaccaaagagaaagccggtatgggctcccaaaaaggcctcccctttattagggctttttgggcccccccatataagtcctcattaanaggagatcccgcctcgcaaggcgcctctccccacaccccccccctgagggggggggncnccggggggagacccccccccctcctcccctcggaag

SEQ ID NO: 105705 - DNA, 542 bp, Oryza sativa
  unsure (1)..(542): unsure at all n locations
taaaaaaaaattnntttttnnnnnnctgtcttatctgtgttgagagannanaaaaaaatcctttcccccgnngnnnnaaaaaaaaaatatttttttttttttggatttttcaaaaaccccgcttgtgttgaaaaccttttgtgagggcgagcagagaaaattttttgaagggaggggcccccaattggcccccaaccccttttattcataaaggccagcaagatattgtctgggtgacaaaaaatacaaaagccagcgcgataggggttcncaccacttgttgacgactctcncattaaatctcagggtagtatagacgcctgttncgaagaaagcgacagtacgtacgcaggtcgacagaagccccagacctcaagggaacgctgtatcttatgtctgtcggttcgcactttgtctgagctcattttgtatgctctcagggcgaaacttatgaaaacgcagcaacgcgctttttacggtcttgccttttctggcttttgctccatgtccttctgcgtatccctgatcgtgtgatacgtata

SEQ ID NO: 105706 - DNA, 1621 bp, Oryza sativa
  unsure (1)..(1621): unsure at all n locations
gaagccttacatgcgcacggacggtgtgggaaaaaatgttaaagggtaatgattgttgagtcgcatgtaagcatctaagaagttagtagttatgtaatagtggtatataaggtgatgtgtgattatatcgcaaattgacgaacatttgcactcaacattttgcatattagtttgtactattttttatgtgcaattaccatttgtagggtaacatttacatttttttatattttaaaagttttatttaaaagaggcttaaaaatttagcccgagcaattttttatgttcacttaccacataaaaaattgctactatatgttttttttaaagtagtaatattaatgtttcaaacattgaagtaatatttacatttgaaaagtagtagtcctaaggtttgtctatttgtatgtacaattaccatttttattaaaactactgtagacaatttcaaatcacaaaaattaattaataattattatgaaataaatatactcaacactgtaaaaatcttcgcaggcgggcggtccgcctacgaagatagttatgccgaatagggtttacatcttcgcaggcggaccgtccgcctacgaagatcgtttccctatagaaggacaagctcgcggcaccaaaatttctaagtccaggcgggaaccctagaaattttggcaccgtcaggctgccaaattttttcgcctcccccgtcctccgccgccgcccgcctgcgaccttcaccctccgaccgtcgtcctccgcgcgccgccgaccttcgagctcgcaccgggcgcgcgctccaccgcgccgctagccgtcgatccagctttaccaccaaccgctcccgctgccggccgcatcgccgccgccggacgctccaccaccgtgctccaccgaccgcgcgcctctgccgccgctccaccgctacgccgccgccggcccatcaaccgccgccggccgctcccccccccggcccctccaccacgccgacggtctctccaccgccgccggccgctccacggacgncggcaccatctctctctctctctcgcagtagcagtctcacggccgaacggcttcatcggcctttcatcgtacacgagtgaagacgtcctcggccgaacggcttcatcggctggtcgtcatccatggccgaacctcgttgtcggcctttcgttcgtcgtccacgaccgaagctcgtcgtcggccattcgtcgtccacagacgtgtgtgcatgtgggtgtttctttttatatgtgtgtgcatgtgggtgtgagaggtatatatgtgtgtgcatgtgggtgtgaatgggaatgaanggggtgggagcctcnattaagggcctaacaaactggggaaaatgggtactttattgtcataatttggaccaatgtagccattcatcttgcctggctatcaccgcatatgtccagtaacattatggttcctcctcggctccggtcgggacaaaaacattaaaaatgtgtgcttgttcactaaatgtacaggccaacttncttggttcttggggggaagaatggaaattttatttccccttttgttcccaggaaaggaaaattctaaccgtatgggttaacttaaaatgtccttctggacagacatttccttt

SEQ ID NO: 105707 - DNA, 601 bp, Oryza sativa
  unsure (1)..(601): unsure at all n locations
aaatatgtccnttttgtaacctcgtaggngcgtgaaacttttgtctatccagccattacttccttaagcttcatcagatacaaggtcgcagataacttcgtgtgctttactgtacatctggcttgcagaggtgtctcaaaatcgttcatcagctgagtaaacttctcatggtccctctcgttgtaagttaggtcctcaacatcacgcaacattactggaatagtctcattattgacatccttccgatcaccagccaacgaggattgaacaaacatatcatgtttgtgttcttccttgttcagaccaccgccagctttatccccaatattctctagctattgctctctatgcttagtccaacatgagtaaccatccatgaagcctcggtagatcagatgcatgcgtgttttggcactattctaaagcatcttctcattcttacgatcaaagtatggacaagtcatccattcattgtttgatctgctcttgacttgctctacaacatttatgaaatcagcaacgccccttcaatactctatgctagatcggtcacttttatacattcatcttctattcatctgcaatgtatgaaatgaaatta

SEQ ID NO: 105708 - DNA, 1431 bp, Oryza sativa
  unsure (1)..(1431): unsure at all n locations
cattgnccctgttgacctccntngaanagccaaagcaatgggtgggccggaaaaatggcgaaccgtgtgatcgcacgccacgtcggccagccgtaccttgtaccgtgaggcctgctgcgcgagtactattgggctgcatcctgggcttccgcctgtttcagtgaggcggcccgcggcctactgccataagcttcttttccttctaatgctacaaaagtgtgcatggagtttgaagaaacgattttgctaaatatttattgacaaatttttctccaaaaatttaacagatgtaattacagtacaatcgtagtgtattacactgtaacttgcatgtaattacactgtaactatagtgtaacttgtatctaactttcaaaaatctctccgtaacatgttatttcggtaaaatggaggtcgtgggaacaaattctttcatatatgtgtgtgctatgatttgttttcttcctcaccaaaacaaatcttgtaatagatctaacgatttaaaattatgtgaaacttacatataagttatactgtagttacatgcaagttacagtataattatatataagttacagtgtaattacactatgattgtactataattatatctgtcaaatttttgaggaaaaatttgttttgaggaaaaatttgtcgacaaatgtacaggcagtcccacaagaacagctgggttaccttataggaacagctgcccaaacatggagcgtttccaccaaaaatgggatagctgaattcaacatgacccacaattcatgaactgggtcatgtttttttcatggcacactcgaacgaagacacgaaattgacaaccaaatcaaattagtctgacttcaatccaatatcagtcaggacaagactcaaacaacttctgcccctcaattcggagaaaatcagttcaaatcaaaccggaaatttcaacatcagatttttgacaaaatcatcaaaaggatggcataaacacagcccaatcctaacaaaactacaatggagcgcaaaataacagatggccatggcagggattgataacataacagatgcagagtaactaatccctgtccaatgttaagaaaacatttaacagatcgctcaaaacacccaagcaaataggatgttaagcgcaacaagaactcagtggtcaatgctcagatgatgacgattcaaagttttagtttcagtctgttcctcgtttcttcaaccactcaagtgccaaacacagcaagatcatcgccgggattacatctgagataaatagccaaaaatttcaccatattcacagccatcaatcaggccaccaaaacaaaccaagaactaagcaatttttttcttgtttcttcctactgcttaacgcaacaacacaccttggtccaaaataaacagctaaatatcgancggggcagagagtcatcatct

SEQ ID NO: 105709 - DNA, 973 bp, Oryza sativa
  unsure (1)..(973): unsure at all n locations
gtatacatatagagattaaggaattagtttcttaaaataaaatatatcatattaggtaatttaagtgaaaatcgacgttggatttgacagtgccacgtggtagttttggagcgtttgtagaagtgccatatggcagtttaagagtgtttataaaaagtttaatgaacttttagtatataatagatagatattttttatataacaaatagattttgccttcatagcgcaagaaagcagaggtatcaagcagaaacaagaaccagagtatagttaagcttgtcgatgaatgtcatttttttttaattgtatgcccttcatgacctgatctgcagagatgggataaactcaagattgtatatgttctattgaataagaattacatgatctattatgtatatttgtgattaaagtattcttatttctcatttgagcaatatctaatcaatgattttgtataaatgttgtaaaaaatcttagacatatcctttgtttgaaatttcaaactgtacatttgacctttaattgtcagtgtatacaaacagttagtcttgttttgatgcataactccttcaattgacatatataatttatttctataataaaaaggggtattgcatattaaataaagcatcttatcatataatttttggatttctatttttgacttcttgaatacataataacatggtatttggatcttcgaaacatttttttttctgtgtttatcaccactgtgttcatatgaaaagtcaccatagcgttagcacgggcattttactagtaatataaaaagtaccagttatttagttggattaacacagtgattgcgattagcactggattaacactgtgatcagcacacgaagcaaaatcaacattatcaatggtaaaatcaggtacatattcatgtgtccattgtgcatatagaagtgcaataagaatttatccatcacacaacangngatcaactctg

SEQ ID NO: 105710 - DNA, 646 bp, Oryza sativa
  unsure (1)..(646): unsure at all n locations
aagatatgaaacaagagacgaagagacgaacgggaggaaaaangagagacaangccgacgagatagcacagagatagacaggagagcagaggacagaggccgngcacacagtaaaagnggaacgggngcgngngnnnnnngnnnnnnnnnnnnnncnncgnnannnnnncgcagcagancnncnngacgnnnnnnnnnnnnnnnnnggcgacacgatcccgtagatattcttgtgaantnnnnntntttnnnnnnnnttnttttntnnnagnngcngttgtagtatatatacatagtgtagacagagatattttcttttcgngcaacaaaacacatgtttgtgtagaaatcatctgtagtaggagagaatattttgtaggagaggccccaagtacccacaccctttatatgtagagcagagaatttttcgggacacaatattaagaacgaggtggataggggtgcccaaccggtgacgcctctccgcgttaaatccgcggttatataaaacctcntttcaaaggaaaaagcacagttcgtatacncaggtgaaaagaagcccagaagttttncggggaacacgtgtgtttatatatcnctggggtttgccacccatnaatagacggtcattatgtgagatctgtca

SEQ ID NO: 105711 - DNA, 552 bp, Oryza sativa
  unsure (1)..(552): unsure at all n locations
ctattactaggctgtaggattatacatcgtggatgaagtccgtccaagntgcctgtgtgacngaccccccttaagacaaccggatgtctaatcagtactatcctttagcacaccccgcagaacgagttttgccttgcacaacactgtcactgaattacaaggggtttaacgggcccangtctgaaanggccaatacaatctcttaaacaaattgtatggctctgcaccttactggaaagatggcccttaacggaaaccaccgtccgggtttttgttcgcccatcccaagagtctaaaacttttttaaggtccccggggaaaacacggaggtggataaaatagtttactttctaaacacgaagagacctatattttgttcagaacacaaaatatttgtttttntgtgttgtaatacacagggcgcccggacgcaagaatttcgccggttttaaacaaaacgaaaaaactccgggttggacacaggggttgtttttttnnnttgnnnnncnnntaaaaaaaaccccacaatctatatgacctataggacgtcta

SEQ ID NO: 105712 - DNA, 627 bp, Oryza sativa
  unsure (1)..(627): unsure at all n locations
aatgaatcagatcgcatcactacaaaccaagagagacggagtaagagttgagagcagataggagcccagagatcggatatttctctcgaggcagcgcgagggaagggcgaatgcattataantttctcatcgcgaatggatttttaacanatntnnnnnnnnnttgtatcagtaagatatacctggaggtgtttgtataaaannngtaattatatacaaggtgtttatatattatgatatcccgcggacatctgtctcccgcgcggatgttttttaacacatcatgcgacagtctttgtgntnttataaacacataatagggggcttnggtttttagaaagagtatctttattccacaacctcgttttctcgggcaccagaaagaattctttatttttgcgagatagccgcacaaaaccgccacagggttttgtcgcagaaacacttctttcagagattgtccacagccaacaacatgtgttttaggagcccgtttgcgccccttanaatacttgtagcgnccacatacctcntagttatatctgtaccagagagtccgccaagagaataantgtttctcgcgggttgatccaanacattattccgataaagcccacgggtcggtct

SEQ ID NO: 105713 - DNA, 2401 bp, Oryza sativa
  unsure (1)..(2401): unsure at all n locations
ggcatccaatgcattagctcacgctcggctcgccggctagctaggaatgcagctagcagccgcagcgctgctggacgagggtgcacttgccggcagggtcgcagttgaaggtggagctgcagctagtgagctggcagttgctcgggttcgccttcgagcagcaccggcactgcaggcacaacggcgccgccaacgtccctactacgccgctgccgccgccgccggcgatggccaccaccaccggcttcgccgtcttcatcggcaccatgtcatccagctgatccaacgcccatgctagttaattgatcgatatacatgcatacacacaacatagtcagttaaatgtcatccgatccgtcagaaaatacagtacaagttcatagaagaaaccagattgagcttagaatacctcgggactgcacggcgacgacgatgaggaggacggcgaccaaactcgagagaggggaggtcatcctcctgcggcagttcgccatggctgtttcggtcgatccctatatataccacgctgttgaatgataacaacttgggaatgccaacgcttgaggagatcgaatggcgagggacgacgagatgtgctcgtttatatatagcgacgacatgttgcatgccgagggaacaatataattcctaacgtccatatgcatacatttagagggctgtaaatctatctatctatctatctatctatctatctatctatctatctatctatctatctatctatctatctatacctctctctctatatatatatatatatatataacatatttaactaaaaactttttatatgtaataataataacaataacaataatatatatatatatatatatatattaattatacacttttcaggagctttaataataataattattattattgttattattattacatataaaaagtttttagttaaatatgttggttatttatagcggcttaggataaaaaagatttcatttcatttataactttcaaattattaattttagaattaaattaatagggagctattaatttatgaaactcatatttatgaattcaaaattatttacgacctatagggtttaggttgaaaacaagactcaatgctatcaattacaatttgcaattatcagtttagaattttaaatcaaattaattttatattataaatcattttgatctttcttctagtcgaacttatttatgtttaatcaagattataaatacttcgtatatctattaattctaagttctagaaaaaacaaatcatgatagtccttagttttgcctatccttaccttgcctctctcccctctctgttgcgatgcggtggtggatcgggtgagggaggcggttgctgatccgacttgttgtgtcacgtcctgttctttaaatttttaaatttgcctaattttagaaattcaaattcgtgtttattcatgtaaaatagcttaaagaaaacttcataaaaatggcctaattactaaataaattaattaatgccgtgctagtattctttcttttgttaattggagttatttgactaaaatttcacattcgagaacaattactcaacgattccaaatcctccaaaatttgaaatttccagagaaatcctgttcctcatctttccttcctgcttcctcccaatacgtcctgttcttctggtggtctttcattcttctncccccttcccccccccccgacacacacatgtaattctatcggttaggctgatttgatggggcctcaccggaatgcttgaatttcgaaaatttcggtccgaaattttcaaaattttgaacaaaaattagttgaatttgaacaaatttaccaaaatttatgaaaaaatttaaaatttcgggccgagtaatatcgtatcggaaggggtccgacttttcaaccntggacacacacatacgaaacatttctattttcgacccgctattcttttatttcccatcacctaaagctttcctctcccccggcatatcacaattttcctcccttcacaatcaaaaaattggttcttattattaccccccggccgtgttaaaatttaaggcgccatgtggacaacccttttgccgctggttgcggttgcaaaaaaaaaaaaaacaggggtgttttttcccccaaaaaaacaccggttcttgtttgtcaaagaagtctttgataaacccacataaaaatttccccttcccaaaaaatttttttttnaaaaccacgcgaaagggtaaaacggggggggggttttcgttcccacccccaaggggggaaacccccctttttgggggcccccccccccaaaaaaaaaaaagcgggggtttttttttttttctgtgggggggggggggggggggggggccccaccccctttattaatata

SEQ ID NO: 105714 - DNA, 690 bp, Oryza sativa
  unsure (1)..(690): unsure at all n locations
ggtaagccgacggtggtcttatcggaacttttgtctggaaccactcgtagacacaatattgcctgccgtaccactggtacacgttttttaccagggatggagggggctcccaatcttgagggggcctcacaccggccccttaaaacaccattggtgttgtgtctcttaacccttcctctcaaagaaggttgtttgtctcaaaaaacacccggagaggttttgtttccgccatctccgaaaagggaccaaaccttgtcttattggggggcggaacaaaaccaaggattgttgatttaagaatccctccctctttagcaccccaacacacccgtgtattttttttaagaaacaaaaaaaaaaattgtgtcttttcttcggtttaaaaaccatataagcctttttggcaacaaatatcttctgctggtgtaaaaaaagagaaaaaaaaccctcgggggaataaaacaatgtcctaggagctttatatataaaaaaaataangcgcgaggtggcgggttgnngnnngccccgggggaggcgacgattataggnnnnnnnnnnnnnncnnnnnntnnnnnnnnntnntnnnncnnncctnntnnnnnnncnccnncccccgcgcncggctctcgtccgcgcttctctaccccgtgtccgttgcgcacacatctcccctgaaggcgcgtcacgtct

SEQ ID NO: 105715 - DNA, 1189 bp, Oryza sativa
  unsure (1)..(1189): unsure at all n locations
atatgctattgtggattcatgtaactatgtattttctgatgaaaaagacagtatagatcacacatatcacaagtaagtgaggtataggatatgtctttattaatttactagcaaaatgcccgtgcgttgcactgggtaatgtcgtgttcgataaatgttgattgaatgatttttttaatcacaaaggttttaaacaattattccacgtgtacgtgtatgatatgaactatgttcatgactcgttagcgtgatgattgtatcatgggaggaacaaacggtgaatgccttacgtcacttttacgcaagagtagatggacaaaaatttgtatgattaaaaaaattgtatttaaaataggtaagtttattataaaactaatgaaaaccagcttttgcatatttactcatagtctcgtagtggtgacacgtggatgatatatagcgcatagactttaatatgtcatgtttcgtagaaatttttatctcaaacaaatattagagtaaatatttcgatgattatgatgtgaaaaataaaaaaatagttaaaaaatatcactcgtctgtgaagtatgtacctgtacacttatttttcaacggaaatcaatttggtggattagcaaactataggaaattgaacgcaattaacaagtctactataattgtagntttttttaaaaaatatcaattgcctggttagataggcttattcctctcgctacacattgcgaatgtcgaatgaaaagggtaatgagatttttattatttggatgctatacactatatttaaaagttgatgaaaattttttcttgattttgcaccgaaggccatttctttcttctatattagcctaccctagattgcctttcctgttttcccaaataaaacttaaaattcggataaaaagtccaaaggatcaccatgggcaaattggccttggcggttaggaaggcacggtcgaaaaatcattccttctggaaaaaacgccaaaaccggccaaacaaaaaccacgcccaaattatcggccctgggttttttattggtttttcactaaaattttttttgggaatgataatattcccccttaaagggacaaaaagcccaaaatttcttatcaaaaatttttggaaaataaaatttttttgcctttttaacccccaaaagcgccccttttaaaacacctgtttgggggag

SEQ ID NO: 105716 - DNA, 1712 bp, Oryza sativa
agtcgtgtctaaagcgcaggagaatcgacatcaactcaaacgataaatcgatcggacgatgtcgagaaccagacttatatatgaatgggccaagaacttagaattgacacgacaaactaggccaaaattcacatgtctaacaacagaggaggccgccagccaaaccatgggctggttgggccgctggatgcagggtttcttctggacggtgtggattagctcccaatgacggttggagggtatttccgaccattccaaccatcacaaccgtcattggaaggctatataaaccctgaccttctaacttcactcacacacctcaagcaagagctctctcatattctctcaagtttagtttagtagtatctagctagtggaataggaatagagtagaaatcaggagtccggaagtcttcggaagagttcgggtatggctctagtagctttcctttcctcttttctaagctttgtaattttattagaatactcttctatatacatttatggtattgaaatactttccgagtatatgaatgcctactttacattatgttcatgttatactaaatatacggctagcttatctgggagatgctttggtgcgggtataatggttgcttatgcaattactctatgtcattacgatgatattagagtagtatctggtagtttagacatggtgtctagattacgggatatcattatttggggttatatgctgcggatgagagtgggccgctgatggtgacagctcagtacgggtattcctccgcgcgtgtatataatcctaagttaatttcctggggagggtattcctccgtatttagccccggttgtatggtcatggtgggctgtcgtaaggaactcggctgttaggggtggcttctcggagtaccaggagggcatcgaatagagggtattagctagtatataggttagctagaatgtatgtatactatgtatattagaagtataggaatagattatctttctcttttctttccacttagcttagataatatattatgagaatgagtaactactgcttgtgtgtcactctacccttggattattttaacccctgcttagaatatgattattacaagtaatatataaattattagtcaagttctctctatatgatcttcccacgggataaaataaatatgatacccttggaatactctcgggtgaaatgctacaatggtatatccgtgcgcttgcggataaactctataaccataatataccaggaatatttatgcgtcattgctggaaattatatttctagtaatgttgttaagaaatatcaacagtggctataggtgggtacttctattgccaccgaaacatattggatgctataggtaatcccctatattgccacgatgatggcatcgttgctaaaggtggcagtactagagatcttatgatagatgacgcttcatttacgtcacaaacattgaatttttcgtcacgttgcaaaatgtgacaagtccattgcaaaagcccataaaggcccaaacattgtaccacaccattttgagcccgtcataatatattcatttatattaatatcaaataataagtgggctaagcccatatatgcccaacaatcaaacacgataacaacccatatagcacaacccgacgaacatccaatacaacataaatcttacaacctagttaacaccagcaagagaaacaattcg

SEQ ID NO: 105717 - DNA, 1616 bp, Oryza sativa
  unsure (1)..(1616): unsure at all n locations
gaatcctgtgttatttgatcgtaagtgtgtttcgcaggttagctacttacacccttatagatcggtgagcaccaacgctagtctgccattgccgttcactggtctagtccacattgtgtcgtcttctcgttgggagctccctcaactgcgggtgagtggtgccctcagcgtcgtcattgggtggcgagcttcaccgcatgatcgccattgcatttcttgcgccaccaccatctacgagagctcgtgctcctttgccgtcttctcaatccttcccttcgctaggagacgtcgttgttgccatttcttggcagcagaacacctgtctatactatgtcctacacccagggatattttacttcccttgggttgctttagcagctctagggaacagtttaaaactctaggggatcgatccatggaattctcgtatagacataggaccaatttaccataaaccccactgggtttttggtagtagtgtagtaggaatcaaatctaaccatccattgctatgggtttgctatcgtttgtttaatgccaagatttattgatgagatgaatcaaatctatacaagcttatactttcaacacgaactatccatgggtaaccatgcatcagttcatgcatcagcatcagtagctaggcttgcagctagcagccgcagcgctgctgaacgagggtacacttgccggcggggtcgcagttgaaggtggagctacagctagtgagctcgcagttgctcgggttcgtcttcgagcagcaccggcactgcaggcacaacggcgccgccaacgtccctactacgccgccgccaccgatggccaccaccaccggcttcgccggcttcgtcggcaccatgtcgtccgccacctgggcatccagcgcccatgctagttgattgatacacgcacacacaccgtggtaaattaaatgtgtaatccgtcaagaattacattacaagttcagagatgaatccagatcgagcttagaatatataccttgggattgcacggcgacgacgatgaggaggaggacgggggacgaagctcgagagaggggaggtcatgctcctgcagtagttcgccattgctgattcgatggatattacgctgttgaatgatgtaaatttggaaatgggaatggttgaggagaccgactggcgagtgacgacgagatatactcgcttatatagcgaggaggcgtttgcatgccaaggcaagaatcattcctgctaacgtgatatgcataaaattagaggggcgttgataaattaatctattctaatttgagcaaaacgctacttcatcgaatcatgaagctttgcgaatggatcgattgagctcatgtngatagacgattttaaattnaccatcaaagctcggctaaangatagatncggggctaatgctgatcttgacagnttcatacaagcttctcttgtctgaacactatttttttgagaatgcaatagatcctctattggaaacctaatcattcttagaagaagaactacttttggaattcaaacaccttagggggtggggtaataaaccctaatcaattgggctagtttgaaaaatggcattgagggaaagaacattgttccccaactggc

SEQ ID NO: 105718 - DNA, 700 bp, Oryza sativa
  unsure (1)..(700): unsure at all n locations
aaaatggggtgaaccttaacaccccctgggcccataagaaatatggcgccaaggccctatccctttcaaacggggtgtttttttgtccccccggaatgtcccattgtacttcccctgtgaaaggacaaaaaaaatttttcctctttagggttttccccggattttggccggaataatgggcgcttaacttgtggggcttttcttgaatataatatttgaaaaaataaaaaattggggtacgccttcacaattttgctcattattttgcccccccctttatggggttctaatagggcccccacatttattttcccctggccctctagataataaaactcttccccccccgaccatataaatttgggggagttttggggctcctctacaataagggaccctttttttttttaacaccccctctcaaaagagagcgccaagagccttttgggttttaatagggggtgggagataagagggtaataataggctttgcgcaagaagaccctatataaaaaaatttgtgggggtcctatttttagnccgcaggcgcactttctttggtgttcatctccgcgcgggtggtaaaaaaacaatctctccccaccctctctctgttgtaaaagaacatatcacccgcgggtagaagaacccctcttctttgtgtggtttcccgcactataaaaaaagagaatctctcccg

SEQ ID NO: 105719 - DNA, 1146 bp, Oryza sativa
  unsure (1)..(1146): unsure at all n locations
aaacgtacacacccgctttctatctttcggttgttaagatataatccatgatttgttacatattaatataactgacggtcaacttaattcctttacttctctcacgaaggcaaaaccggttgccaaagaaattctgatgcatgtcccatgtacggtgatggatatgaggttcatcggtggttttatgttaaatttaaacgattatatttctattaaattaacaatttgagttccataattagacaaatgaatttttatcctaaaccgccacgtgacgctctaataaatcctaaaaattctataaataaacaaaatatctaactgttggttttgatttaatctgatggacctatcattattcgttttcaccattatatctatcttaaaagtcaccaattaaatatatccccaaaaccgttgccactgatcggtaagtaggaaggaataaaaaagtacggtacgtacataagcacgcccagccccacgtctttattttcattttttcttctttctcacttattagattagatgaaaaacaaaactaataatttaagctcatatgtaaaaatatatgttattttgagttgtattataaccatatttatgctatcggatcatacataaaagatacaaacaaatcgaaatatagattaaataattgtatatcactttaagaaattagacttgcattttcaaaattaaaaattacatagtaaccattcccaaatgtcacttaccctcatttaaaaaaatactgataccattaaacaacattactaaatactgtttttgttgccccagactctttctacccgntntgtgactactactctcttgactactttttttaactcataccttcattccttcttgntcaaaccggctaactgnaccaaggaagttccgattctatcgcaacaaaacactatacagcttcaataaatttcttagagttttggttgtgttacaaggggaataaattgtgcctgccctcaaacctgtgtccaagtgaagaggtgctagntcataggatggggcctttctagttttataccccatacccgctgggaatttctcttttctcgggaggccacagacgcnacaatgagaactattcatatttttccccccccaaagaaacaaaaa

SEQ ID NO: 105720 - DNA, 699 bp, Oryza sativa
attttgaaaatgcaagtctaatttcttaaagtgatatacaattatttaatctatattttcgattggtttgtatctttatgtatgatccgatagcataaatatggttataatacaactcaaaataacatatatttttacatatgagcttaaattattagttttgtttttcatctaatctaataagtgagaaagaagaaaaaatgaaaataaagacgtggggctgggcgtgcttatgtacgtaccgtacttttttattccttcctacttaccgatcagtggcaacggttttggggatatatttaattggtgacttttaagatagatataatggtgaaaacgaataatgataggtccatcagattaaatcaaaaccaacagttagatattttgtttatttatagaatttttaggatttattagagcgtcacgtggcggtttaggataaaaattcatttgtctaattatggaactcaaattgttaatttaatagaaatataatcgtttaaatttaacataaaaccaccgatgaacctcatatccatcaccgtacatgggacatgcatcagaatttctttggcaaccggttttgccttcgtgagagaagtaaaggaattaagttgaccgtcagttatattaatatgtaacaaatcatggattatatcttaacaaccgaaagatagaaagcgggtgtgtacgttt

SEQ ID NO: 105721 - DNA, 567 bp, Oryza sativa
  unsure (1)..(567): unsure at all n locations
ggagatataggtncgcgactctcccgnagtgtntcagggataatgtgngctgataccccntatatgcatgtgccgcgtcgtttgggagagatgtgtctctccccggaaagtatcaaacgccccaccgtgtctagaaataaatnnagccgatgggatagaccccttctgccttattcgcggggtgtagtctccgggaccttcttgcccgcctagccgtctttttttcctctcttgcagagcggtgcncaagttataggagcctttgagctaaattaggcccccaaaaacatgagagataaagcgcccaaatgtncccctcaagcacctaatgatttcaaagaacaacactcggcttttatagaagngggggctgtaatatgtaaattatatnaatcnaagataaggggtggtggggggagagaggccccccttataatgattttgnccccgccgaagagccttnnnnnccgagcccgcgccgcgcgcgtgtccttaattacnccgggggnggggnnnnnnnnnnggggggnnnnnnnttaatgtatgaatcatacttatatatattat

SEQ ID NO: 105722 - DNA, 669 bp, Oryza sativa
  unsure (1)..(669): unsure at all n locations
taattgacttcgctttggcttcgggccgttccgggttgnggggtaggcgggtattaagcttccacttcaaaagggggtgaaataaccggttttttcacacaggaattcatggggattaaacgccaagagaaaggaacattgtgtaagccaaataggcccttcataatatggcgcagggaacacgtataatagggcgcgccgctggctgggcgttctatctcataaaggttccggtcctccctgtgccatggcttgaccaaaaattcgacgctttaacgttaaaaggttggtgcatactctccacaggactctttatagaatcccaggcgttctctccccttgaaagcttcttcggggccgttttcatgttcacgaccctctcgttttaccggaaaactcttgcccgctttttcccttcgggaagagtgggctcttttcttatatcatacccttgaggtaatttcaacattgaggtaagtggtttggctctcaaactggtgtgtgtttgcacaaccaccacgttaagactcanaccgttggcctctaatcgntaacatattgctctttggtctcacccgtgtacaaacagtctttattgctctgtggtatcncacccttgttataaggatattccacaacgaggtatgttgacgcgtgctttgcatatct

SEQ ID NO: 105723 - DNA, 1158 bp, Oryza sativa
  unsure (1)..(1158): unsure at all n locations
atgcgcnattagatccccatgtatgtacacgcaaaaacatctttaatttttagaataataaagactagaaaagatgtatgtgtgttgcaactgagggaggtaaaatagacatataaaaaacaagtgagaagattcgagctcattgtttcatgcgcaggcctaaactcgacccatagtaaaccaagtgagacccaaacacatttaactctaggccacattgctgccagcattgcagcccaaaccaaaatgtgtgtggatcaatgaacctgtcagttcaaaaataaagagaagcaacgagcatgcttctccttccgacaggatctccgtaattgattcatataatgaccctaaattttaaaaccagatatccaatccataaaatttataatactgtttatattgcctctaaagtggttttggaccttagttgtacgaattttaaagtttaatcgggcgattttgaaaatactaacatagtatacttacatatcataatcattggcccttacatatcataaagtttagtactctgtagtgatgttatatgctagtattctttatataagtgtgagataaggggataaaacggacatttaagtgaagatttacatgtactatgttcaatgtgcatatcacatagtaaaactcatccaacatatatgcaacccacattgtatgccaaatatatagacattttgtaaaatcaccataaaggattacangaacgatatttataagtttaggtgttatatgtccggtttaaaattcaagtgtttgttgacttttattctaaagttaggttatatcatggacttttccatcgaacaacgaaatgtgtgtaaggcaataaactgtgcggtggactattgcccggccatctcaaacttcttttgatggcggctgagaatcaagcttatcccttgggtccacttcctcttttgtctggctgccgaatnggaaaaaaaaatcaccccctttgggttatggcggggctcatttctttaacttttaaaaatcccacaataatatttaaggtgtggcccatcataaagatttatgtggccgaaaaaaacacctcccctttttttttaattcgagaaaatattggcgccacttattgaaagggtgttataaaaaatttggaaaaaaaaaatcggg

SEQ ID NO: 105724 - DNA, 1269 bp, Oryza sativa
  unsure (1)..(1269): unsure at all n locations
gagttataaaccaactataaacttatgtgaaagaaagagagaaaaatgaggagtgttgactctcgtgcaagagttaggctatacacttgcgaaattgctaattagcacaagtcgcgcgcgtttctggcctacgcagccctcaccctcgtgcagtctatctcttccctttttttgtttttcttgcttctctttttccgccgcggggagaccgtgaaacgtttttttgctgatttttttattttagaaattgaatctttcatctttaatttttgctgaaagttttgaatttgatttaaaagttttcaaggtttaagttgaaattttttaaatctgagttgaaagttttcaaatctttagttcaaagttttggaatcttgacttaaatagttgaaagtttttatgatttgaggtgaaagtttttaagtttgagttgaatgtttttgaatctgagatgaaagtttttaaatctaagttgaaagttttcaaatctttagttgaaagtttttatattcgagttaaaagttttcaaatctgacttgaaaattttcaaatcaagatttgaaagttccaaaatctgagttgaaaatttttaaattggaggtgaaattattcaaatcttgacttgaaaaattttaaatccgcgttcaaattctaggttgaaagtttttaaatcttagtggaaaggttcccaaccccggataaacttcgctcgaaagtttgtttccctcccccaaccaaggggaggacccctccccctggggggtttttttcctcaaaaaaagaaacccccagaaaaaccccccttagcccttttttggcggggaaggggggccccccccttcccttcttagggcatacccccggaaaaagagaaccccccancaaccttcttttaaaacatgttcccttaaaattttgttgggggaaaagtggcggggagaaaacacctaacccccccctctttntgaccctatttatccccccttacttctttttttaaccacaagccactacgtattttcttctttaacacctcttccaaatggtggcacccctttttttgtctccccctagcccactcgggaggtctgcacatttttccctctcgcgcggtggctttgttccccctaaaccattatcttgccttgcggggtaacggccacaaccttttggttgcgccgccctattttaagcaaaactttcctgcgccattttgtgaagcgaacacaatcgcctattttctctcacaccagctccaactttttagct

SEQ ID NO: 105725 - DNA, 667 bp, Oryza sativa
ttgaactcccaggaggttgccacacagggcccaaagggtagaatgtcttcacatagtcacgcaaactaggcacgaagagctcttttagagcttttgcccactctacatgatcagggtccttgcttttgtactccacaagcacctgaaggtaatttcatttgatattagtaagattaagcctattcaagatttttcgccgggctgaaacacactggacaaccaaggaggaactaactaagaagaaagtgtgagcgtgtcaagagtcgaacatgggaccacgaggttgaagccgcacacccctaccactacactagatattggatcttggctattcaagactttaaaaatgtaattttaatttcccacaataagtaatccgtataaatacgcccgtcatcgattaagtatgaagcaggaatcaatgcacacttgcatagtatcctcatcttttcatcaaaaggttttgtcaatgttttatttctcaagtcttgaacaaaggaagtgcctatgccgtgttactgaaattctgcttttcactctaagaaaaaaataaaaaggactgctcaggttcttggttcttttaaatctctgaacaaaggaaaaatcatgggcattaaccgaatgtctgttcttgatctataatgttgtttcaaactgacatcaatcc

SEQ ID NO: 105726 - DNA, 566 bp, Oryza sativa
caccaatatctcttttttttttattctctttacacggggaggggggagatgttgttatattttgtgtgtttgccgggtgaaacaaaataccataattacccccaaccgcctccctttccggtgttttggtgttctccccaccaccttgtgccgggttggaaccccccaccctccaagaaatttaaaaagcgctatagtgttaaaataacacccacccctccccaccttaaaaaaaaggggaaaaggtgtccctgttttccggaaggggggaaaaaaaaaaccccccaggagtttttttttttaaaaaaccggtttttttttatatttcccggggtttcccccccccaccttggaggttttttctttaaccccccccaggggccggaacctttggtgaaccccttaaacccggccctttttaaggttgtgtgcctataaaagggccctttttttaaaattttttttcttgggtacccccccattttgtggaaaaaccgatatccccccttaataaagtaaaaccgccccccccaacccaacgcccaacgcaacaagttatttattaa

SEQ ID NO: 105727 - DNA, 1222 bp, Oryza sativa
  unsure (1)..(1222): unsure at all n locations
cgactcttatcgattattgtggaaaggatgactttgattacaaaaaccgtttctattttttagaataaagtaagatacgactttcccccttccaaaaaaagatacattaagtttattttcaggacaaatccatatataattgggaaaatataggagcgataccccattttaaacccaaccccttttgtttttttggccttaaaaaaagaacccttttggaaaaatgtctccgcaagagacaaaagacctacccctgggaggggtccgttccaaatccggaagtttaagcggacccnntcttttcattatattattctgttgaaaatttgcaaataaacaggccggttccccgtgtcatgttgtttttgccttccccnccggaagganaggagaaggacgacccggcggctaaacgtcttaagaagctccgaggacgccgcgctgctcgtccgcgtcacggtcctcgccggcgacggccccaggctcgccgtcctggacggcgcccccgacctggccggcggcgacacgatggcgctgccctcgtagtcgagcaggctaggcggccgcgccgccgggccgaagctgacgcggcgccgcggcccggcgcgcgagccgacgatggaggaaaggatccaccgcgtcgcgctgaaggagagcaggaaccggaccttcttgaccgccgtccgaaagctgccgaggagcgacgacgtcgtcgtcgtggacgatcgcctctccggcgacgccatctcgatcgatcggtggagacgttgaccaccggcgaagacgacttggcgtgcgcgcctgcacgaagcttagccgcgcttactttgtcctcctctttgtcgttgaggctttcgagtcgtgacaagcaaccgaacgcgggccgagcgagagagagacgaacgaacgatgcgtttggttaacgcccgaaaggtggtgatggaaagtttgtggagagcaagaggcgttcccttgtgtgtgcatccgcgttcatatagcggagagacgcttggaaatgtcagccctgatgtatgttggcgtgtgcagtaaataagttactcggtgtaaagaaactgcacggaatgtagcgtacgtcggtacatgcatacacgtcgtgcgtgcacgagtacttggtcattacgtcattaactagtagtgctactctactagtagagtattgctgtctccgctattacctggcaatcaagcagctgctagcaag

SEQ ID NO: 105728 - DNA, 2827 bp, Oryza sativa
  unsure (1)..(2827): unsure at all n locations
ttttataggtaattgcaaacaagacgggcaggttctccatacttgagaatagatgtgtaggaaaccaaagttggataggaaatgnaaaaanaataatggttctatcaacccaagggtccatcaatttattctcgcgttaatcgacggtttttcggancggtcttaataataacggcagtttttttttctcgcgttgattcggacagtttctcttacctttgtttagaaaagaatggtttttttctcttgttaagtcagacagtatttctcaaccgtttttagaaacaacgattttttctcatgttaaatccgattgttttttcaacccggtttttttataaccggtattttttctaatagtttttcagaagcggcatgctttttataaactgtgtttttttcttgtgtggttttcccaaaccatttttcagaaatggcacatttctttctgacttttcttcctagcatgttctttttttttttgctttttttactgacgacgaaaaccagatttttattgttttttcgccactttgggaaaccgactttttttagttattttttccgctattttttctcgggctttttttcgtttttaaggagaatcggttatacgctatttttttttcttcgctttataagagcaatcggacttttttttttgcttttttatttttgttggacgaaggaaacattttgaatttttcaagtaagtagagactagaaaaaaagcccgtgtgttgcaacgagtgatggttattttaatcttattattgttatatggtttagttaaggttatatggtttagttaaggtgaaatgcactattggaattcgcttggatatgtattttttagaaaatcatgagctacaattaggagttcgatcatttcaagttagcatacaaattttttaaaaagatttcttatatgacttcttttgtatttccaaaaatgactcagatacatatctgtatttctaaaagggaacagacttaaaaaccgactcatacactgatgacttagcaaagtacaagcaaaaacatctttaatttttagaataataaagactagaaaagatgtatgtgtgttgcaacgggtagggccaatataatttgtacatatgtgtcagtgcataaataacagtggataaataatcacagtccattgtttcgtttattcatgtgcttatccgattcacttattaccaaatcctataatactatacaagtgatccccacttagtgtagttattaggattttgctactcaaatacggatctgtatttctaaaagggaacagacttaaaaaccgactcatacactgatgaattagcaaagtacaggcaaaaacatcttcaatttttagaataataaagactagaaaagatgtctgtgcgttgcaacgggtagggccaatataatttgtacatttgtgttagtggataaataatcacaatccattgtttcggttattcatgtgcttatccgaatcacttattaccaaataaaagactatttgtgtgcaaatattttatatacatgttcttagcgactcaaaagcaaatgttgtaaaataaagtacaataaaaaaaaccaaaaagttgaattcagaattaagttcaaaattttaaaatttggcttataggaataagcataagccaaacaatgaggacttcaaacacaagctcgatttgttgtccagctttctctcaagtcgggcaggaattgatgacggacggaatcaacaacttcgatcgttctttatttcagttggcatgttctttttgaaagtaaaatttattcttatggattatttgtaactgtatccctggtagtacgtacgagcatgtgtaaagactaacttgaaatcatgctaacatgtctcaagaatcggatgatccgggcaatgacgtacgtgatatccacacggactatgcgagtttcattcgcttgatatccacattgcacggactctctttcgcagtttgctcgcgagtgtcacttcgccatgaatgttacgcgtgacgggaatcgaatatggatgacgtaccatagttttgacaaaacaatcttcaatttttaaatcgtgcgcgagggcgacgcgatcccagtaagacatgcggcaagggcagatcgcgcttgtgagggtgttgcgggcctagtggggcatgtaaaaaatcgcgagtgagaggacgttgcgggcccaatcacggcggcgcgcaaaggcacatgtggaaagcagactcaggcacgggcccgatcgctgtgtgcgtgtttaaatgtgctggcccgcccatctcggataagaggaacagtttggcggtgtaaggaaaaaaaaaggaaatgatttgacagaaacataaaattaaaacttattcaaacacggatgatgtaccaaaattcgagtggaaacatcttcaatttttataatagtagagactagaaaaaatacatgtgcattgcaacgggaaaatgctattttaattttattattgttatacttttttttagttaaggtgaaatttactatgagaacttgtttggatatatattttttttagaaaatcaggagctataattaggagtccgatcgtctcaagttagcatgtgtgttttttaaagagattccttatattattacttatgttttttataaaagcaatcgaacttaaaaacttacttatgctcggatgacgtaccatagtaccgataaaaacatattcaatttttataatagtagagatagagatagagatttacaaactctcaataaaaagaatcaataaagttgctntctcgtgagncgatctgcactcaatggcacgga

SEQ ID NO: 105729 - DNA, 574 bp, Oryza sativa
  unsure (1)..(574): unsure at all n locations
cgtagattgatataagcgaacacattctatttaatgatgacgtatccattatatctgcgcaaaaattanatataaaaacccacatagtgttgttttttttttatgttgtttaaccccagattattatttccaccacccttccataaatttgtagggaacctcatgccaaacacaacccccagataggctatattcctgttcacccatgtagtttaatgccaagttgtaaaataacatcttttatataacgcgggtttggtatctccagcctgttaattttcccgatataagccaccagcggttcgggctcgcacctgaaaggtttcagttaacacaagcccaattttagaagcgatacaacccttacccctgaatttagatatccttccaagggttatgttattaagaaaagtaccaacctcttccaaaaagggaagaaaagtcggtccaggaaatccgggtatcgccaaggctcgaaacaagaagaggcgcccgaaggaagcttcccaggggaaacccgcttagaatctttataggccctttcagtttttccctcttttaatttaagccgtga

SEQ ID NO: 105730 - DNA, 611 bp, Oryza sativa
atctaagtgatttatactgtctcggcatggcgactgatctatcccaatcacttgatttaagtatatattgacataaggatcatatattgttaatatctacagccgatcgagtagatttagttctttcttactcattcatgattgccgatcgatttacatatgacatcggcttaaagataaatgatatgtcatcggcaattagccgatcggctatcgtttatggatttaaccgcggtttctttgtctttatttcttgttgattgcaggatcaaatcaactggcacgctcacgaatctaaaggcaagcttttggacctgcacaggagttaagcagatctcctaggcctcgtgtttttacatcaacacactgccaatcaaattgtgaacagtgaacttagattcaacatgcgtttggttgaagggattgaatagaataaattcggattatccgttttttacggtggttggtttggaaacaggtgagatgagatgatcgctaacgggcagatccaggcctcgagtcacttgcgctgtggcctgaggccaatgattgttcacccactatgcccaacaagatttcacaatgtaactcaaagtatagctaaaagccta

SEQ ID NO: 105731 - DNA, 2634 bp, Oryza sativa
  unsure (1)..(2634): unsure at all n locations
cgcaataacgcccataaaaatctgactttaataanccccgataaacaccctccccttacaaatgagacttaaacgtccttctatcacccccccccaagggtttgacactgttgaacgcgaaaaaaaatgtcaaaaaatcctttgtgtgggtccctgagactcttgtttttccattttgatgttgttatattgcttttcacccacccgccttattcccttatgaagagaaagttgactaaataacaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgacttggcaataaatcatagcaaccattctctgcatcgacagcctcagcaaagaattgtcgtaaatggaagaagttgtgtctcttcccgacctactccaggccgagccaagggcaatcaacctccggagggcgataccaagcagaagaccgtcatccgcttcaaccagcaatcagaaggaagcttctcctgtgaatgatagcattatgcagtcctgtcacatcatcacagaaccaatcaaggatgcagtcactagaacaatgccagctatatctctccagaatcaaaatgagcagccatgtttgtggtttttagttcgctacttatcatggtgtaatcgaaagtttgcagcaatcatgtaattcataaatataatcatgtctgtaaacagtgagcttgctatgtttagagatgattcatgttgaggatacaatgtaccgatgataagcaccttccctttttgtttaaggcagtgccttgtattcgtgtaataagggagaaatgtgtaatacagacaagttccctgaggattcgtttgaaagatgcggatatgtgatcatgtgtataattgtttactgacaaaggagacctagggtctcgtgtcagaggaactatattctaacctcgagttaataaccaacctgtggatagaaaagaaaaacaattaaactgtgttgggttaaaaagccaacgagacagtagttgaggataggagtttggatacgccttttacagatcaagataaggattgttggaggaaacccctaagggtacccgccatgcctctacattgataagatcggatatacctgccaacagttaaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttccctaaaggtagtcagtgcagcttttgacgcaccacatcaaggtttcactgaaaggcagcaagccaaaggacctcatcgtccccagaagcgtccgcaatccacattaaagaataccacctgttagagataagccgaaagatgattgataaaagagattggcaaagatgttctctagcatgaaagaagtaggccgaaaggtgattgataaacagaaacatgctctgcatcgctcaaggacgacccctgatagtaattgccccgcaacagtcaccttgtcattaagtaagcgagatgacctaggtaaaaatgtttctatgaaggcaaggagtgaaatcttcaactcggtatcagatgctacacggagtgaaaagtgcaagcaccggttaccaggtaatgccatgtcttgggagatgatccaatgggaaagaacacatcaagggcaaaggtgtaaaggaatacgttgaatgctaaatgatgacaagcatggtatcctagtaatgacgagctgatctcgacgcatgacatgaagtgggtaacttgtatgaggttgactccaaagatatgaactatgcaaagttctggaactgaagccccatctttaagtgccgcaacccaatcgaagtcagctaaaggttcaaccagggacaagtcaagtgaagagaagaatccatctgcaacaggagatcgagccaagcagtccagagtgaagaaagtttgttaggcaagtttgttatagaagaccgagcgaaagaagtcagacaagaagagaagaccgnccaacctatttctttgttgccttcttgaatttcggggacgagaatttgtgaagggggtggaattgtcacggcctgataattcatcccaaataaaaatcttcttctataaggattatggaattattaaaattcgaagaaattgcaaacattaaaatcggttagaaaaatccatgtggcccgggaaatttggtaaatttccctgggtaaaagaggcctcaaattactgtaatttcaagacccgaaattttattaacaaaccaccattttaaagtttattaaagaaaactaaaatcctctcttcttcttgggcaaacaatccaagaccccctctccctttttttccccc

SEQ ID NO: 105732 - DNA, 568 bp, Oryza sativa
  unsure (1)..(568): unsure at all n locations
caaccggattaaactccactcaaagggcccgtaataccggtcaccccccagaaatccagggcattaccccccgaaaagcacatgtntaacccaaaggcccaccacaaggcccagaaacccgtaaaaaggccgcggcgcgcggcctcttccccaacagctctcccccccccgccgaagcataacaaaaaccaaccctcacgccaaacggggccaaacccccccacggactattcaccgacccaagccgtttccccctctgaaacatcccctcggcgcctctcccggtccccacccttgcccttaccgcgtacccggtcccctttcttcctctcggaacggccggcgcccttcaatacctacacccgaagcaacccacccccggtaataggcggtcctccacatctgagccgtggcccccaacccccccttaagacccccccttgtccttaccggccacttactctcggagcccaccccctaaaaacccatcttcccccccctgtaacgcaccgcgtacacgacttctctacaccccgctcttagccgttccccccacacctttaaagcg

SEQ ID NO: 105733 - DNA, 523 bp, Oryza sativa
tttcatacttttggagaacttccagctatcaaagagacaaaaagctaggcgcacctctcctaactattgcccataaaaaataatatatttaatattattatatattatatatatttgcccttataaaataatatatttaatatatattaattcaattttctattgtgtgaagtaaaagaagaaaaggtctaggctccgtcatgacggaatctaagataagaacctaacagaacgtaaaaaatgaaaaaagattctagactgttaatgtcttggctctggaaggagatcgcgtgcaagtaaactaacgtcgttcgttcggcgaccccgcctcacttcacttaacagaaagggggccctattgagaattacgagcatcgcataacagaaaatctatttacaagctactgattctccgactaccaattctcaggtctgtgcttcggttggagtcttggtccgcgggtggaggttcgcgagggggatattctgaaccagacgctatggcatattgccagcccgatac

SEQ ID NO: 105734 - DNA, 526 bp, Oryza sativa
  unsure (1)..(526): unsure at all n locations
cgacgaagaggtgtaggagatgagatggagagcggcgacagaaggagcgggtgggggntcgtgcaggagtggagacaaaagaggggggaggacagacggactgtattgtccttcgatgaaagaaaggggagaaannagtatggtgtgcggaaggaccagggtatgctccccgagaaaggtcagggaaaagggtgacgcaaagaagggggaagggcgccgaaaaagagtgaaagcgccagcccgagggggagtaacggtggcggtgagattggtatagagaagcccgtggggggggtttttcgaccagactgggggagggtaagcttggacaattttgtggaccgggtggtgacaggggggggggtgaggcttatgagaaagaaggcccggcaacgggggcctatttgtgggggttcgggggccgtgatgggagcctaagtagctcaaatgttatggtcgtgcgttaaggccgtggattgtggggggcgccagtattccccgctaggagtggaggtgaatcccgttg

SEQ ID NO: 105735 - DNA, 650 bp, Oryza sativa
ggggagcacctctatatagaaaagatgagtgagtgtgggtgtccaatgatacaagagcgctcattatggggtggcgctcggaggaggggaatcacttataaagggaagcgcgccagggaacaacaccaatatatatttttggggtggaggacgatgtctactatagtctcccacaaggggcaccctttgagactagtcaggagacacgtccccctggtcaaaaaagaagaaaaaagagaaaggggggggactgtagtcttacaatatagaggtccattggggcaacaccaccccctcgtgtttaaaggcccataaagggaggtcacttcccattgggggtgaatattatttcccacagaacacggtgaaggggttttttactctattcggggggggaagagcggccttttttcccaagaacggagccggcccctgcacaaattggtgtgtcaaagggccatttttcccccaatacgccccccgggaaatgtcagggaaacttttattacgcaagagggcacagcacgggggtttccccccggccgccgggaggtcaatattcattttggaaccccgaacaaaggataaaggttttttttttagaggtggaacctttaccccccgaaggaatggctgccttcttttgaaaa

SEQ ID NO: 105736 - DNA, 596 bp, Oryza sativa
  unsure (1)..(596): unsure at all n locations
gagtgttattgtacctactaaagaaatgaaaggccgattacttctccagataccggattctaggaaacaagcaatactttcccagctccgccgaagaataattcaaatatatagagataggagataggggaatcttcccttgcgaatctcttcttttagttgatagagtgaggtccacatatggtgcatttgactcccgtgcatgctattttcgtgttcatgatccatcttagccttcttttggattcccctattggtagttcccactagcagatgtgtgtttctatggcataaatagttcctggacttcccttttctttgcacttacttcgacttcgatctgtccctgggtctcaccacttccttcctcaaggcgtatcaatagtagacatagctcgtagtcacttgcatgcttttgacttctcttctctgtgtgatatcgctatttgtttttctcctnnctgctggtgttttccagagggttcatcgtggnnnnnnggggggggggggagttgataccgacgccacttttcgtgggcggggcgagtgtggcggaaaanatttacacgggcccttttagctgcggggtatttgca

SEQ ID NO: 105737 - DNA, 512 bp, Oryza sativa
gttattcgggtaaaaattgtgttatattagactaacccgataaatgtatttaaaaaaggccattataccttatgtttcttgggcattttaattgtctagctcttaatgttggaaaggataccctctctttatcggttttgataaaggccgtttgattattagtgttttcctcaaattagacacctaaattttgcattggtcttttttattgcagcatttagtatattatttcgtttttcttcggtcactcgtcccggctattttccttgtaagttctaaatacaaggagctctcttcatggaatcatatatgattttttaattgacccttactccgaatactatttatttgggagtttgtactacaccggtgttctattactccactttaacggtttctccatttttgctcgggatacgctactctatttatgtttctcatctttacatggtacacactttatctatccatggctttatcttctttaaacgatactatctcatttccgcacc

SEQ ID NO: 105738 - DNA, 723 bp, Oryza sativa
cgatgtatatgagacggtgtaataggcggagcgcgttgaaaagagggacgtggttatagagggaagtaggggagagaggcacaagtaaagaagaggaaaggtgagcgaggtagaaagtaagaggggtggatctaacgaaggcagtagtgataggagtatagtggtagggaggagtaaagagaacggtgagtaggttaggagtgtgaagagtgggagatatagagaggagaattagggacgggtagtagtgtgagagagaaataagagaggaagggttggggggagtatgtgaagagaaggagaagagagacaggaagagggtgagtgggggcggggatgaggggggtatgaggagggaagttagggggaggggtgaatgggcgggatagaaggtgggggtaaggagggtgtatagagcacgctaatgggagtgaatagaggagagttgtgggggggggtaggagagggggaaaggggggtgaacgccaggtaggcggcggtaaagagcgtttaagacgggttaaggggcgggtaacgcagtcatataggaggtacagcgtgtgacagcttgaaccggcgagtaggcgccacagggagaattagcgggggactatgtctggcaagagaggtgcactgccaagggggttaacggcgtgtcggacgggagtggcagtaaggacgctatggcgatcaacggcatgtcgatatgggcgctgtatttgg

SEQ ID NO: 105739 - DNA, 593 bp, Oryza sativa
  unsure (1)..(593): unsure at all n locations
cgccanccgcccgcctgggcgtggtccagaggggaaatcactgaacacgccgcgtccgacggaagtgtgaaacccccatggccaaatacacgatcctgctgtaaaaacaaaaatctcccggtgaacctacaacccaggagcgcgcaaatccggggacacgaaacgtagcctcacaactagaaacacccagtttacagccaagcaagtccgcggcacccgcgaacagcagaaaacaaatagtcgatactactacacccggacgaacaagcaatattaaactccttagacgaaacgataattcttgctcacatacaacaaagctaagcctcaacagttccacatgtcccgcacaataccatcacacacaaatccacatgtctctcttctcatacactccagcgctatcacagctcacgaagatcttaacgacttcggtacatcacacagcgactctttcatacccctcatatactacaccctgtgctcccgcagcacacacactcgcgtntagcacaagtcaaacatcgaactcacctccaagaaatacagactactcacactacatccgccttccacacagacatataaccact

SEQ ID NO: 105740 - DNA, 653 bp, Oryza sativa
  unsure (1)..(653): unsure at all n locations
agggaagaaagacgtacagaagagagggaatgaggattaagaggtagaggtcgtaacggngttagtcgtagcgttgatagagaagagaggatgagagtgatgaatataagagaagtagatttaagagataaggagttaggctgtatacgggtgatcatgagagctatcaaaggtaatacgatatagcggtaagacatacgacagagcagtaagaatatatagttaaaggcgaagagtcagcgcatacgagagaagactaaggcgtaagtgttagaattcgcatagagcgtttatgttaatgataagaggatagagtacgaatagagtaagagcgggcgattgaatatgggtgacgtaggggtgataggtacaggagaactgaataagagatctcagtaagtaaaaataggcgagatatttattaggtccgggaaggttttcaggaactatatattagaagaagagaaattttgtgtaaccctagtcaacggagagactaagacgttgattagagtagccacaagcaacccgggccctgtttaaggggtacggagcctatttgcgggcccttttgacacaaattgtctttaccagagttagcaccgtaattttggtaaataacggtatttaccgcccttgaattgatcgtaaag

SEQ ID NO: 105741 - DNA, 915 bp, Oryza sativa
  unsure (1)..(915): unsure at all n locations
tgaagagtttctggtccttcctctacttctcttcctcgtcgccgccaaagctgccgcaaccctaaggaggaagttagtgtccatggcatctgcggcatgggcctcaaggggtggctctgctttgggccgcatgaatagcaatagcagcatccacgagcggtgacgtctttgatatcggggcggaggctcgaggtcactggcgagacagcttggcatccatctacagagtgacatggttctaattttttaaaaattctagcggcacgcaacaaatttcaagaatagtagtggtatttttttagtatgtcatatttgcagtgacatggatccaattaaccctttttaataccgtgaagcgttttatttatcacgcaattgcgtagcagaaccgatggtgacaaaatattttcaaaagtagttggctaggaagatagcttgtgaaaatggggatatttttacaggcaattgttttaagacgacaactagtgatcattaaacaagggcgttcagttatattttcacaagtgtttcgaattttatccactagaggaaaaaaaagaaagaaggtgccaagaaaaacacattttttattagtgcctcacttataatataatttgtgacacaaagtccaaatgcaatagaatgaaacaaaagtagatgaaaagaagacgcgacgacaccaatcaaatggaataaataaatggaacaatataaatgagtgatgaaacttccctactatacattcatgcttttggtatcgtatattcttgattcttctaaccggcatgttgcagagaaacgcacgcagcaactgaacaacggctgcgtagtggatcggcccaaagccgcgcggagacagcgagacgcgatctgcgggcagtcatccatcacacgncggccgagcaatcagcgctg

SEQ ID NO: 105742 - DNA, 523 bp, Oryza sativa
atttgacttcaagaccaaaagcataggtggctggtttggctatgtggcggcatatatgggccaaggatccgttacccctcgagagcatgtagctttcttgctcatgtggttagaaaagttcctcttctgtggatccagttgtggccctacaaccaactggcaatttctagccgaagccttagaatcaaagaaagaatttcctttgggcaaaatccttctcggctatctgtaccaaatgttgaacaatgcatcggctaaaacagccgtcggctcaatagttggagcaggtggaccatggtagctgctgcaaacttggttaaacctgatagtcattaaggttgtcaatcagccatctgtaacagaaactgaattcccaagattagagccgactgttaacgatgacggagaggaactcactcatcggagatgcacatcatatggagagtacgcctctacaccaactgatgcaggagcaaaactatcggccgatctgctcaaagattggttttgtagcttttatgag

SEQ ID NO: 105743 - DNA, 740 bp, Oryza sativa
  unsure (1)..(740): unsure at all n locations
ctcgtggctgccatgtggtgcgcccgcgggcagtgcgcacgtagaccgagtccaccgtgtattaatgaacataattcctatgcttgatgaaatcattgtcaaatgggggagaagtaatgtgaaaattttggattttatgaaatcattgtcaaaagggggagaagtaatgtgaaaattttggatttttggagaagcatggtgaatttttgaagagttgttgagaagagcatgtttttggttcaattgggaatttctttcttttaaaaaggggaagaagttttcttttggattttttagcacgatgtgtacatttgtacgaagtgtgctttttatttttccaaacaccaaaacatttttatgagtttgccaatgtgttcatcaagggggagattgtaaaattaaagatgtttttgattattattctgtgatgaacaattgggcattggagattattggttttgttatttggaatttattcacgaagtggttttggtgatgattgggtttacaggtgaatcgcaggattgttatttcatgtgaccggtcagactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagnctcgacgagtgtagcttcctatgaagaattcgggatgagtaccgg

SEQ ID NO: 105744 - DNA, 549 bp, Oryza sativa
  unsure (1)..(549): unsure at all n locations
tccaaagaaaaattgtgcaaacctgctttctgtataaaacagaggatgattcatatggtttgtcatggcttatcacttttggggtgatcttgctttggttacggcgttgatgtgcaagatcacccccacacttgtctttgtatctgggatgctttattggacacaaaaagaaaaaacaaagacaaaagtgaagcggaaaggactcacttggttggaagaccaaggaggcgactttattttattttattttattcatgaaagctagacctaagataactagaaggaggcctaaggactcatggcattaaaaactaacgaatcaagggggacctgaggactccgggtagaagctaaaagagactagattcacaacatctatgtgacgatcaacttctaacggatcaaggaaaacttttaaacgatggccatttaccttaaagatgttaccttcgttgtcgcgcagagtgacagctccatgtgatgaagcgtcgactacggtatatggacctatccatttacttcanagtgttacatgcaggcgtcacattg

SEQ ID NO: 105745 - DNA, 1139 bp, Oryza sativa
  unsure (1)..(1139): unsure at all n locations
cttgcatgtgatagatccatacccctcttaacaaccgtgttatggggcaatgggctgttttcccggggaaggttaaaaccggctcctgaagaagcggaattcacaaaccgattttaccaccgatgaagtatnacacccttaagcccngatgagttgaaggatctggttacagtccagattggcgtgtccntgcaaagggttacccaggaccaaggaatgtgttactcggcacttatataagaaaagtggtgcctnaaagattttacagaagnagactgtgtatggaagttgattttgcgatttggtaacggtgatggtaatttcggcaagtggtcgccgaaatggaaaggacgtttccaatttattaaggttgtgtctaagggagcatatatgtgcaaagggcttgatgggtnaagtctatggcgagcgcttcaatggcaaatatttgaagaaatattacccgagtgtttgagttaatgcatgacagccgatatgtttccatcgccttgagatggccgatatagttatatcacccttagttgtttttatggtgtaatcggttgtggtttgccgatgaccaatggccgatattgttatatcgcccttagttgttttataattttatcaatgcttttgacattgtaaaattaggggggcacatacatatcaaaatgcaatgcagcttacaaattttttgagcacatatcaaaatgccatgcagattgtcaagacagtaaagtattataacgtcttagccgattacaaaatttgtaagttctattacatacaagttattgagacaagtattgctggatagccgatatagccttctgcctaatctgttccacttcttctatggcttgggcatcttgagcgtcagttccagggataactttcaaggacttggtcatatcagcgacattcttgatagccgattttagctttgccttttgttcttcaacagcttgcgggagatcggctagctttttgtgctccatatccagctcggcgttgcattcttgaagttgtgccatgagatcaatcttacgagcttcaagccgatcgatatttgacttgattatgccttcagacagctgatctagataaacttctcgacatgcgtagcacaagtgtaatag

SEQ ID NO: 105746 - DNA, 1528 bp, Oryza sativa
  unsure (1)..(1528): unsure at all n locations
aaaactattggttattttttcaaaaaccgtggtcaaaataagaaatttgtctcttaaaagattaaagttgtttaatagtatgaatcaggggtaggcnttaacctttagacatttcactccaaatctttgattcaaatatttctaccgatggccaccccccttataatttttgtatgacaatggtgtgcacacaaattgttgctgtcaagatgtacgctccccgatccacgtcatggatattttactacattaagacgtctctgttatttttctgtgttaaacaccatctcaatccctttaataatcgttgtcgacatatatacttgccccaacacatttttctcgccctgaactaccgccattgacagattagacacaccctggtcatcgtccgttggccacaaattcataactctcgcctcgccatttcaatttgtcgatagagggtgtgtttggatcccagccattgaatgccaacactcctgtggcgagccacgccatggcgtggcattccaaccgccaaccaagcagccctagaatatttgtggtgtgcgactgatcgactaatgggccttgcttgtcgttaatcgaacatgtggatatattcagtagactgttaacggaaacggatcctctgcagtcgaaccaatcatatctacttccttcgtttcacaatgtaagtcaatttagcatttccacattcatattaatgttaattaatatctatctagatttattaacatcaatataaatgtggaaaatgttagaatgacttgcattgtgaaacggaggtatattctttttggaataattctattttgcctccctcaagtcttgcctctgattgattagtatccctcaactgcaataccagatgtaaggcctcctccatcttcaaaaaccggagcaaatcgaatccctcgactgtttggatagcggttttatcctatgtggcactcatgggacccatatgtcagtactaatctctttttttttctttttactcacatccctcttttcctattctctctcctcgccgacgagcagcaacgcaatgacgacgacgaccaggaccagcattgccacccgcacaacatcgatgactgcgacgacgaccagtgcatgcgttatctcaccgaagcatgagtgcataanccatgttcgcttgttttccaaccgtccctaacgtcaggtctcgagggccaacatttgcggggttccggtagaccaaaggtcccttctcttccncaccccgcgggtgtgtcgcgttgaaaaaaggttgccagttttggctttcctatccatgctgtggaagaggaaggagcccatttaggggcagaatgggagaaaaaccacaggaagtgggaaacccctggcttttatttttccattggcaccctaatgacctggggtcccacggttttataaacctaaaggcccgtaaatgccctgttaaccgaaacccacgttcaaaaccgctttgggatttatttgccttggtggaaattcatgacaaataagagaccca

SEQ ID NO: 105747 - DNA, 963 bp, Oryza sativa
gattggatatgtttacatgttgatttgtataattcaataaattatagataatatttaattcttgcataagtaattatttctacttgcatgttgagctttagattgagtatgttgtatttttataatttatttaggtatattcataaaacattgcgtgaaaaatagtatattttagtgtgcgctagaaatgttactatctaaacaatattgtgttggtctaaaatgtccaattaataggcctagcagctcgggcagacatgattgggccagagagagcccagtctgctgtaaagaagcgaccaggcccagctgcagggagcaagtgcttcggaaggaaaaactccatcttgactccctcaagtatcttaatagtaaaaatcgagtacattgactcactcaactattaattaatactaagcattttaccgagctcattggtttgcgaggtggttttggctgacctggcagcctaagcatttaaaaattaaaaaatagatgtggggcgcacatgtaagtgacagaaaaaagaaaatctatagccacaagtccgacatgaagaacttgagatagaagcttgcccaagcgggggttgccggcaagccctcttgactccgaatccaacaccatgtggtgattgggataactttgtgcagcaacagtaggctgcagaagcaaaaatagaggatgcttggggtaaggatcacccaatgggccagattgaggaaaaccctaggccaactgattgtgttgcctaatcaagtgttagaagaacataatctgatggataaggatcaacaggtgcagctttttctggctaggctcaaaggagatagctgacagggaagggccaaagcatccatccttttatcctatggaaggtctattggaaaagattgatcatttgtgcaaagctagaaatcatgcatacaactttgaattctggcccttcagctctgccctatg

SEQ ID NO: 105748 - DNA, 625 bp, Oryza sativa
cgtttttaattctcccttcccgcggggagtagtctttccctcaaaacgcggataacgctcgacagaacatggagtgaatggcccggctatggcccggacccgaaaaaggccggcgcgtggcgttttctataggttcccccccctgcagggattacccacggaagacatgtgtgctatgggccgcacaaggccccgaccggtaaaagcctggccgctcgcgttcctcaattccccgtcacaccgggcgttttgatcctttcaataatcccctcatcacttcccttcttcccggccggtcacgcgtccctttatcccatgggctctatgttccccctcttttcgcgcggggttccgcccctgcgtcggttctgggctacatccccccggtttaaccccggcgcggtccctattggggtaatatacgctctgggacccacccggacgaacaccattttccctctctgccgccctccttttatccggtgtttccttaccgggttcttggccggcgcttctcttacaaatcccggttatacacgggggctccaccaaaatatccccttttgctcttcgcggctgatcacaatcgctcgacataaaacatcgtgcgctctaatcatcaccg

SEQ ID NO: 105749 - DNA, 1086 bp, Oryza sativa
  unsure (1)..(1086): unsure at all n locations
ttagatgtctacactaagcatacagtagatgatctcgatgacaagcaaggtcaaggtttcatgtcagccgatgatttggaagaaatagacataggtccaggcgatcggccaaggccgacatttattagtaaaaacttatctctggagtttagaaccaagctgatnnnnnnnnnnnnnnnnnnnnnnnnnnnnnnnnnnnnnnnnnnnnnnnnnnnatatataattcttatgtcgatatatacttaaatcaagtgattgggatagatcgatcgccatgccgagacagtataaatcacttagatcaaaatatatattaataacaggactatatatgtttatagcatagccccatcagatagatctagcatgtatcggctaattccaagccctcttggaatgaaagtgcaccggcatcaccttatttgaactgattgatgaagcgatgagttctccttcaaagatatgatccgatatgagtgcccgatgatgataccagtcttgctcggggacgccaggctccactatggcgatgcagacatcctcatgacgacgaggcggacattgagggacggtaagatcaacacacagcacgcgcaagttaccaccgtgatgaaccacttgcccttgacgaaaaaaatgtngcggnnnnnnnnnnnnnnnnnnnnnnnnnnnnnnnnnnnnnnnnnnnnnnnnnnnnnnnnnnnnnnnnnnnnnnnnttgagtatttttagngccacataaatagggtggcggaaaaatggacatagttgttttctgtgagaaattgtaatcccttacantttcccacaacattacgagccgggaataattaagagtaaaccctggggcgcctcatgagtgagctacactccaattaatgtggtgccgctcaccggcccttttcaggnaggaaaaactgcctgcccgctttaataattaattcgacacccgcccggggaaagggnggtggttattggcccttttccctttttttattaatgaattaataanntcggggtnggggggggggggcggttttccttctttaaaggggtattcgtgttcccaaaaagcgggggaaagcga

SEQ ID NO: 105750 - DNA, 1986 bp, Oryza sativa
  unsure (1)..(1986): unsure at all n locations
gaatcacatgaangcctagtgacacctctgcgtggcgcggatgggtaggggagggttatgtggagggtcttgtcacgatttccccctttgcagtatcatggtgatactccaatcactgtcgtcgccgagttgtttctctgatcggcatgaccggacgtcagtcgccaagttattttcctgatcatcatgagcatcaacagacagccacgcaagtgcatgtttccatatgatgcacgcgcatgacagattggccaactaattaggagctgctagcagcactttctttcccgattgacataatatatacagtgtcgtttgttgaagcagttattctcctcaaattaaccgtccagtgcgcacaaacctcatacatgtgaacttcaaagatatgatccgatatgagtgcccgatgatgataccagtcttgctcggggacgccaggctccactatggcgatgcagacatcctcatgacgacgaggcggacattgagggacggtaagatcaacacacagcacgcgcaagttaccaccgtgatgaaccacttgcccttgacgaagaaaatgttgcgggttagggttgagatcagccattgtatgcgaggtaaagttttggggattagattgaacagtgttcttgggagaggaagggatacggggaaaaactgccatctttttggccggagaagatttagctctccaaactagattattccgagaaccatgtttcggaaacttccctgcagattgatgggctgcagcgggcctgggggctgaacagtaacggtccatatgaccagactccaaacaagaaaagcaccgtaaaggcctaaaacaattagaagcattgtggcccttatccaaacaatgcgtacaggaagacaatggatttgaatttaaacaacgcgcagaaataggatcaccctccttgattggctccaccggcctggtcgctggagcatcatcggagctagggttctccaacccctaaagcctctgaaaaacagaccttcttttctggagaggagccttcaaacgctgaaacaccgacttgatcgagatgtcccgatgttgaacaacctgggcataagattttcctttctgaaccatagaatttttgtgcactgatgtcttcttagaggagaccaatttccgttcatcagcacaatcacggctccaggtctcgaattctcactgccaaatagggcccccatttctccagagataaaagcgaaggtcaaaatcatcacaggtaaaagatctaacgtgataaatccacagcccaacttgcttagagcaaacatcaaaagagaaactacgatccaacaaatgctgaacattgaaacccgccggagatccaccaatagtggctcataaagcgaaaatgcgatggactgaacttcgagaagaagtgcaccggagatcaaaatcgatgctgtgcttcctccctaattgcaacgccaggggagaagtcccagcctcccggcggcgcaggcgttaccatcacagcgatcaccggaaatcactcatatcatcgcctccaaaaaaaaccggtttttgtgtttttatgtgggtggtttgttgcaatggagtatgtgtgtgaagacacgtggcatggacaccatgggggcccaaggggcaccttctcccccccttttaggagtnttnntctttnttttctccttcctnctcttcttcctttttctctcctttcttcctcttctnctctcctcctttttttttctctcttcttttcctcnttcctcctctctcctcctnctctccttctctctttttctcnctttctccttcttccttttctctcttctctcctttctcnctctcctcnttctccctttntctctccctctctctcttttcctttntcctcttcccttctctncntcttnctctctccttnccctccttatccccctttnccttttcctccctntctcttcttcttttcctcctccttctcttcctcc

SEQ ID NO: 105751 - DNA, 2199 bp, Oryza sativa
  unsure (1)..(2199): unsure at all n locations
agcctagttttaaaaatcaaagacgctctatatataaagtctccgggttttaaatgggggtttcttaaaacccaaccaaccgcataagaggagttgtaaaaagaaaggtggggtgttttaaacgaacgaaccacggttcttgtggaccggccggacccagctattctttttgtttcaaataattccggccccaattggtagataaatttcttccagaggtaaggtccaaagtggttgtaaccatgctcaaagccaaaaattggaaatttgggattgcccaaatgacccgaacaattcggctttggtgtttccgacggtattccgtcctttaaactaaccgtcactgaaaattctcacccgtgatttcctttccccggtcaaggaaaccttgtctttttctttcgggaattcttccaacgcaaaaaggacttccaggggatttattctggggaaatatttcggccgcaagtaatgtcgtcctcccccaaccatttaataccccatcagcggagtatgttaaggtaagtcttaaccggttagatcccctttcttagaagcagttcgattttctcttatctaacatccctctctttttccgggttgtttggaatntgtagcatctctccaatcaagtcgcgattccaagcctctcatacgaaaactactattttctcggcccagtggacaaccctgattccactgagtttattattggtaaaccaataggatccccttcagattaaccaccccagatctaggtcactgaaagaatactttcaaatcttggcggtttatagagaaagtcccacctgaaaaagttggaccacatggttcaaacgtgtatcagcaagaaaaagggttcactgggatgaaattggaatcggccaagaatttgccctcactatagtaaactcggccaaagatgaacccttgagggcaactgctttttatttggggtcaaacaccatcaatgcctttttgtttaatcaagggccgatgactccaactttaatcgatatcaccatgataagtggattagatgtaacttcatcggctaaccctatgagtatgaacaccaagaactaatttgacttcaagaccaaaagcataggtggctggtttggctatgtggcggcatatatgggccaaggatccgttacccctcgagagcatgtaagctctcttgctcatggggttagaaaaggtcctcttatgtggatccagttgtggccctacaaccaactgggaaattttagccgaagccttagaatcaaagaaagaatttcctttgggcaaaaaccttatcgggtatctgtaccaaaagttgaacaatgcattggctaaaacaggcggcggctcaaaaattggagcaggtggaccaagggagctgctgcaaacttgggtaaaactgaaaggcaataagggtgagaattagccatttgtgaaagaaactgaatttccaaagattagagccgactgttaaagaagacggagaggaactcacctattggggaagcacattatatggagaggacgcctttacaccaactggtgcgggagccaaaatattggggcgaactgtttaaaaataggttttggtagcttttaagaagggggttcaaaagggggatttatggggaatcaaacacatttggaaaaagcaagcgggatttagaattcgaggacatcaccaatgacaggatattaaaaggcttgagaaatcttttatttggaaaaacgccaggggttctttcagtggggagtaataacgggggaaaaaaccgaggtttccaacagtgtttataagccaaggggtccggccgacaatttgggaagggacaaaccgccaaaggggtaatatttggcgctaagaaaaaaaggccgggagaaaaagtcataacttttaatagaggggcgggtgggttaaaaaacaaggaacgtcctttgggtgggaagggagacaaaaaagaaggggaacgctttggggagcaaaatattttctaaggtgggggtggaaagaagctacccatttatttaccacacggggtgctatggtgaagaaaaaaaacatttcataaaaaagacctctccgcaagagcccccacacacgtgcggttgtaagagagaaaactcagcggggtgcggagaccgttacaaacactctttccagagtggcgcacaaaaaaaattagtactccc

SEQ ID NO: 105752 - DNA, 2066 bp, Oryza sativa
  unsure (1)..(2066): unsure at all n locations
gacagcggtgaccaccctccatggcgcctttgctgaaattaccaccctccatggcgcaaatattcttggcttcttcttgttgctctagggctccatccaatggatacgatacggctcgcgaaagctagaggaagaatctactcaggctagggtttgttccactaatccgctcggtggctgtgggcggccgcagcgacgcagtgatggttaattatatatatagcggcgtgcgtgttgcatgcgttttttgcggcgtgtctgtgtgcgtagagagagatcgagagagagaggagagaaccactcggatacggtcgggctcccttcctcccaacgagaacttagaaagtttgcctctgttacgaatcgactgctgagagagagagagtagattttatggtgggacatatttttccttaatatttaaaatcttttagagattgtatgtggtagatatgtagtgtttaaaatttctgagactgaaatttggtttaagattgtaccgcaagaaattatttaaggaaataaaatgtctgatagatggttactccacgataaaaaaatggttagatgtttaattaattaaataattctagctttatggatattcctaaataaaaatggtttaatttcaataattaactatttaaacttttttgtctgcaccgtagtttgctttttggttttttttgtttatcatgtgtttcattaatctatgtttaaaattttctaaatacccttctttcggaaagttttctgacaataatgtgtttgtgctatgtctctaaaaaaatattttctctttttattacacactcttttccttttgtttgagactttgactccttttggttgtttttcttttcttcctcctcatgcagttctcatgctgtggaataagttcatattaggtccctcaatttgtcaccgagttcgaaattcatccctacatcacaaaactggatacaacgcatccccaaacttataaaaccacgcaaataaggtcctatcgtagtattgtttcacgtgttgcctacatggcactccactaggtcttcgttccacgtggcgcttacatggtaacttgatccgaaaaaataataaaacccacgggacccacgtcagctatacacaaaaaagtaataaaaatgatgggcccatgtggccccacatgtcatcctccctactttttcattctttcttcctcttttgcttctacaactatatgttatccagccactgtcgggagcgccgcgctagcggagagggcagacgggaacgccacgagggaggaggcgagatcgtcgggccggctgacgtgggaggagcggcggcgctatccagccggcgggagggagggaaaggagcggcggtgcacggggtcggtgttcggaggaagggcaggagaggagtgacaccgcgtggggactggtgggagagagcggcccggaggccggcgggagaggatcagcggcgcacgctggcccggagggtcggagggagaggaacagcggcgcatgccgtgccgccggaaaggtcaaccaacaggagcgctgcaaaggtaggaagcgagctcgtaagggcagccagcgagagaggagcggaggtgcgcgggggtctgcggccggcgggagagcggcggcggtgcacgaggaccggcaggagggagcggcgcgcgcactactacaaaagtgatttatcttacgagaccccatgattttttgcaaacggaccataactagtggcgtttataaaaatcgatggtcatttttgcatgcagccccttaagtggcctgtatggaaaaatcgattttcccgtacaggcctcttaagaggacagtatgcaaaaatgagatcattttcgcttgcggctcacttaagcgaccgcatggaaaaatcgatttttccatacggaccacttaaggagccgtatgcaaaaataaaatttgaaaaatttaaaactagtttatctcactcatatgaactttaaattagatgattatttttcctaaaagtttctaaaatcatgctctatcntgttnntgccacttgcattcatntcatggcca

SEQ ID NO: 105753 - DNA, 1528 bp, Oryza sativa
  unsure (1)..(1528): unsure at all n locations
agtcggtgacacttctgggacggagatccacttcacatagcggcgttcaccggccagagatcggaccactcggggtgaacattaaagtttacgctttcgaacactgtcttcatcgttccagcttcggtaatcaccgtcttcgaattcacggtggcgaagaatatggcgccgaagagttcggcacttggctcaaacccggaagtccggcacgcccagtcgaagatagcgtccggaccagcgccgacgggctcaactgcgggagctcaacctggaaaaggcgaagaatctccggcaacaacgtgttgcacggaaaccagagccccgcctcaaaaaatacggcgaacaccactgtccggttgtcgatgggtttcggtacaacggctttccccgaggcgaaagcctgtccctcgactaaagccccagagctgaccaactttgcctgctcgccatcgtctatgagagaaatccctaaacaggcggtggtgtcgttgtcaatccggccggggtcgggccctttcgccgaagaggggttaggcttgcggggagccatgacgaaggatgtatgaagtggcgaaaggtgtgtgcagtggcgaacaaggggagtgagcgagaagtctaaggggccaaggggtgccgtgagagtaagaacggaggaagagagcgcgagcggtgaaagtggcaagtctggcagtgaaaaggtaacggggaagcatatatagcccaacaaggcgacgtttcgcctacccaccagtaataaagcgccacgtgtcgcgagggtaggcaaaacggtaaattcccatcgaccgagctgcacagtaaaaagcccacaaagggaagacccatcactgttcctttccgcccgataaaaaatatatatcacagacaacgaactttatttgcaggaacaatgtaggtttcggcaggagcatcggtcgaaggggggcgccacatatcataccacataccacatggtttgaatggtctcggccgaagctccaatctcacccttgcccgtgagaggcttgttggcggtatggcatgaggcccttcgaccaaaatctgccgaaggctatgtgaggagtggggagccaagcccgagacgtcaaaattagtcggggagaagccccccccatggcgaagactatggaacaaggacggcgcgagaggcgaaggatcgtgcgggtactctgctaagccggaggcctcttgggcaaaggatgcagggcgaagagtacatgccgaagggagacgacttcgccaaagcaagcgcgcccccgcgagggccagagaagccttttccggcccatcaagcctagaggccattgggccggcgatcgcctaacggcccatcaggagtccataaacctctattacactatatacccatgtaaatgtccctttcataagggtaaccatgtaaattcccctgtataaccaaaaccctagtagtaagaacctataataggggctataaatagtccttatagggccnagccgtctctcaccagtcgtcttactngggctcata

SEQ ID NO: 105754 - DNA, 575 bp, Oryza sativa
taagtatgcggaagaaggttctgatattcctcacccctaatattcattcaagccgcctttaacttccctatttcgctaatcgtaattgtatggcccgattatgaatttgacttcccctgcaacggttcatatacgtcgagtccttcgttgtttacatccgcgtgtgctacgcatcgttacctgcccttgggccctcgccctttcctctctaccttcccttttcccctcttttaccccgtttcctcctacgatattattcgccgtcttcttttgacgtctcctcagtcctctcttcgaccctaatccctataatcttgctctggcttcggtgacatcatcatcactatactctctcctacctttccctcttttgacattgtctttctcatctcacaattactcttctctctctctctgtatactgcatcctccctgttcctcactatcttcatcttatttctctctcatcctcctttcttcatattcaccttactctctcatccactctcattctccccatcgtccgctcactctcatctatctatctcccgtacttactccattctaccttcacc

SEQ ID NO: 105755 - DNA, 512 bp, Oryza sativa
cttatagaacttatcctaatatgttttttcgtatttgttgtttcactgattcaatcatttcaatcaaaattcaacaagagttattttcccttatgtgcaaaatctttactgatactaaatataaccccttcatataaatggttctactccatctatctgttcatccatttctccttattttagatgcccaaaaggacactctagtcgacattctcccccctttccgagtgaaggatctacagcgcattgacacgacaaacctctacagcttcgccaacgtgcttgccaatgtagtcgccgcagcgcggctgtcatcagggctcatactcaacaccttcgacttcatcgagggtgacaacatttgcaggatccgcgacgagctctccatccctgtgtttgccattggtccactcaacaaactcataccactcgtcggaagaagcagctttcttcccccagattgtgattgcctgaggtggcttgacacacaagcccctagctctgtgttgttc

SEQ ID NO: 105756 - DNA, 1149 bp, Oryza sativa
  unsure (1)..(1149): unsure at all n locations
attgaaaccactggtagatagctnccggcgtggaacggagctaggcagcgccgggccgggaagaggaggtggcagcggccggctggtaggagactttgctcactgctcttctctctctttttttatctttttaaaatatatgtttatagctggtttatagcatgctattgtacatgctcttagagcaccacaccatagctaataagtgttcctagaaagcttaataaattttaataaatttttatcgtatggtatatactccgtagatagaagataaattccgtcgacggatatctcgactcaccagtatggaaacaggagcgtatggtagtccatcattttctccgtgtgagacagaagtgtgacacccttgtttaatacctagggcaggccgccataaagtccgaaaataacatcccacctcccaaactaattagctaacttcctgtctgagctaggaatcccacaccggtattacctgagataacgaaaattcttcgcctcggacgaccggcgtgggggagcgaaatcgggcactcttttcccatgcgacacgcatgccagtgggccccaccatttatcttgcctccacctgccacgtgcccctatcaaacatgtttcaccaaaggtattcacaatgtttcactatgtatatatataatgttgtagtatattgaaatattcttttgcaacaaatcacccacatattttggaaaccctctattaatgaaaatccgttcattntttgttccaccaaatatgtttcacctagtgtactcacaatgnttcactatgtatagatctaatggtgcaatgaaccgaaacattcttttacaacaaatcaaccacattttttgggaaacctctattaagagatattgttttatttttttgttccccccaaaagtgtttcacccaggggccccaaaatttttcaactttttaaagattcaaatttggcggggcactggaaacattttttcgtttttggtggaacatatttttatatataaggaaaaacaatgcgcccgtttaaaccaatatttccaccaaaatgtgttcccccgggtccccacaaaatttcacacttggttgagataaaattggcgggggcctgaaatctttttttcctttttgttgaaaaatttt

SEQ ID NO: 105757 - DNA, 550 bp, Oryza sativa
ttgtgtaaagtgactacctatccattctgatccagcacctgtgcgatagaattcgatctgaacctttaagtcgcaatggctttgaaaaaattagtgttctcttcacccagcagcatccacctattcgtgcaccttttttcgcaataaagctttttaaactcaaggagcttaaaagtttgcgacttgacaatttctctgaaattccattcaaacatggtcaagggcctatgctcttctattaggtctaggaaattaatcacagcattacaattgaccaagagagcagttaactgagacaagtttttactcaattgcagcaaactttttctcaaaaattttagcttgaaactgatgcatcttgccggatcttcataactagtgtccattgaccaaactctgctgacaagctcgaagaagccttccatttcaacccaataattctcaaatctaaaaattggagactttgggatatattgtgggccaggggatgaacagtggtgtttggaaaagccaaagtccaagatggacttgtaaaaacccatcaaagcgc

SEQ ID NO: 105758 - DNA, 584 bp, Oryza sativa
  unsure (1)..(584): unsure at all n locations
ggagagccatgatgaccncttgtttgagctgcttggaatttggtgatagcgtcatggtatgctgtttttgacagatccttgttggatccagatatccgatagattgctttgccttcgcagcatccatatattgtatcctataaaagcagcttgttaataataataacatgtttatgtattatatcaattttttgtatgataaatgtgcactcatactcataggcaccatgcaccgagaaagtttacatccatcttttcccgacgattgatggcatgcagatcagcgaaatttagccagaagaaacctttgctggcgacagcatcaggtggtgatcgaattgttaaattagttaggccttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacttttgcatgtgttcgagtgcttcgacttcttaccccttccaagagttcgagcgacacctcgcgcccccccttcgttcccggagaacgtcacccttggtgagtta

SEQ ID NO: 105759 - DNA, 500 bp, Oryza sativa
  unsure (1)..(500): unsure at all n locations
taccgcgccatacaaccctgcaggtgtagtgggttactcacaccttgaccagttcactttgccacgcccctaacgcgtagcttcatcaggatgattcacctttcctatctcaccacctcgcctgctcttctccgccaacactctaacagttgggacttcctctaggggacacgatacggcgcttaacggacctctccctccaaaaactctggtctgcgtggcacagttacttaagtggcccttgctttcagaatgcgcgctactttatccttggcgatcgcgagacccagcctgtaagtaggagttcctctcccaacctaggcacacccgcaccccttctctgctctcnccttgattcaaaagggacattgccatacaccgctctagtctataaactaaacgtgtcctcacaaacctgttactcatatcacgaagctatcctaagccttcacgttacgactcgcgctcttatatgccgatcgcgcaacgcgtaatccact

SEQ ID NO: 105760 - DNA, 1976 bp, Oryza sativa
tatcagagagacaagagagcatctttttttcttctgccccttcagtcagcagtgctggcagcatttgggaattgtgtggaactctagtcttaatttctttcaggtggtggtttcggcccgcattcagttcaaccggaagggttttttttggaaattttatttattgctgcttggcacatttggaagcaaaggaatgggaaaatctttcgaaatgagcttccctcattcagttcttggaggcctttattcaaggccgattttcttctgcatatgtgtagaaaaaaggatcccctaaaacacacagtttttgattggttacgaacagtgtaatcattttgtttccttctcggtctctcgtaatttgtaaataacctatttattccttttataaaatcacactgcaaggcaaagtcctggcagtatttctagtaaaaaaacaaatcacccacatattttggaaaacctctattaagtaaattcgtttcattttttgttacacaaaaaatgtttcacctagtgtattcacaatgtttcattacgtatagatctaatttgcagtgaattgaaacattcttttgcaagaaatcacccacatcttatggaaaccctctattaagggaattcgttccattttttttcaccaaaaatgcttcacctagtgtacttataatgtttcactatgtatggattaaatgttgtagtgaactaaaactttttttcactatttgctaaaatattttttttatataaggtgaaactgcgcccgatttaaacgatcgaaacattttcgatctacttagtgaaacaattccgatatacttggtggaacaacgtgcaacatttaaaaataattcaataataagctaatattttttcatcggaatatatacgcgtgtgattttgttttaaagatttaattgcaacgaatttaatggtgcaatcggattatgatttagataaataatttaagaaaaaaaatagtttaaagtagttttacatgcatgacgtgggtatgacatcagcatgactgtgggcgcccgattttcccacccccggatcgggcgcccgatgtgtatttgctttcaaatcttcatctaaatctttcggggccgggaatgatggtgaggaagtcttagacgattgctttcagtagcaacgcaaaagactcataaaagatatagataggattggttcgactgcagaggatccgtttccgttaacagtctactgaatataaccacacgttcgattaacgactagcaagccccattagtcgctcagtcgcacggtactccacaaatattctatcgacaaattgaattggcgagagttctgaatttgtggccaacggacgatgacaagtctaatcggtcaatggtgatagttcagggcgagaaagatgtgttggcgcatgtatatatgtcgacaatgatagttaagggattgagatggtgtttcaacacagaaaataacagaaacgccgtaatgtagtaaaatatccatgacgttggatcggagagcatacttctcgacagcaacacttcgtgtgcacatactgcacacacgtcagccaaaaataaaaggaataagttcattttaggtctcttaatttgtcatcgaatttgcaaccagtgcaaataaaatcccaaggcggttttggacggtggtttcggctgacatggcatctacgtggcacttaagttatgaaaaaccgtgggacccacgtgtcattgagtgcccgatggaaaataaaaaagcagtgggtcccaccttcattgtttttcttccacttctgtcctttatttgctccttctctttcacagcatcggatggacagccacaactcgccacccttctccacgccgaccagccacggggtgggggagaggaggggaccttggtctgacgggagccgccgatgctgggacctcgagagctgacgctagggatccgtcactaagagtgcatttagggtg

SEQ ID NO: 105761 - DNA, 539 bp, Oryza sativa
ctgttggttgccgtttattcaataaggttccggcctccttggacaaggctttacaaaaaaatggacttttaaagtttaaaggtgggggaaaccccgcccggatttttaaaggattcctgggggtttccccttggaaagttacttggggggtcttcctggttccaaaccttgcccgtttaaccggataactggttctcccttttttcttttggggaagagggtggcgcccttttctttagctctaccccttgggggatcttataaattgggggataggtgtgtttcgttcctaaacgtgggcttgtgttgaccaaatatcctcctattataccccccacactggggctctttttacgcggaacatatctctctgggagtccaccccggagaaaacacaatattattcctcttggggggaaactcttggtaaacagttatttccctccccggtgttttttgcgggtgtctctccacaaatttttataattgggggctcaactctgggtgcactatagagaaaaacaaattggtccttgtcc

SEQ ID NO: 105762 - DNA, 1199 bp, Oryza sativa
  unsure (1)..(1199): unsure at all n locations
cgatgtcanggtgaagcgcctgttggtggcgnnnnnnnnnnnnnnnnnnnnnnnnnnnnnnnnnnnnnnnnnnnnnnnnnnnnnnnnnnntgaaaattttggatttttggagaagcatggtgaatttttgaagagttgttgagaagagcatgtttttggttcaattgggaatttctttcttttaaaaaggggaagaagttttcttttggattttttagcacgatgtgtacatttgtacgaagtgtgctttttatttttccaaacaccaaaacatttttatgagtttgccaatgtgttcatcaagggggagattgtaaaattaaagatgtttttgattattattctgtgatgaacaattgggcattggagattattggttttgttatttggaatttattcacgaagtggttttgggttcttcgtgctagtcgagtcgatgattccgctcgaagggaacagtgcagtcccgaagagagggggaaggggaaacgggccggcccaaggaaggaatctaattaaggtaattcaaccagataaggcacctagccctgatgggattaatgggtattttcttaagaaatgttggcccatcatatcacacgaaattttactgggtagcagcacactttnnnnnnnnnnnnnnnnnnnnnnnnnnnnnnnnnnnnnnnnnnnnnnnnnnnnnnnnnnnnnnnnnnnnnnnnnnttgggttttctatagtgtccacctaaaataggttggccgtaatcaatggcaattagctgtttcctcgtgtgaaattgtttttccccttcacaaatttcccacctacattccaagccccgaggccataaagtgttaaagcctggggttgccttaacgagcgggcctaactccccattaatttgcgcttgcgctccactgtcccgttttccagatccgcaaaaccggtcccggccacgctgctttaatagaaattgccccacccccccgcgtggaggcgcgtttttcttatgggccccttttctcgcttcccttcttcacttaccttcttgaccttcggctctcggctttcgctcgacggctttatgacttccttcaaggggcgtgtacgcgttattctccataaatataggggttaccaccggggacaaaactcttttcgtcataaatgccccctcactgggcccccctccctcttaaatgccctctcttctttcct

SEQ ID NO: 105763 - DNA, 527 bp, Oryza sativa
ggaatttatcattgaatctcttaaatctgaaattgataaattaaaatctcttattcctaatgataatgattgtgaaaattgtgaggttttaatgaatgagatttcaaaaattagagatgttaatgctgcacatgatttgaaaaatagatcttctcttgcttgtagttttgctttgcacacacgcacattggatgagttgtttttaactaaaaagttgttgcaaaaatatcaaattgcttttcatgctagtttgatgtttaacatgatttctgctaaaaagttaaaacaacctcatgatgttttggattgctcaacatgtaatttgaataagatgaaactaaaagatgctttaggtcgtgttgagtacatggaagatgttgtgaaaaacaatgaactgctttcttgccccaaatgtcgtaaaagcaaaggtgtcatggtagattgtgaaaattgtgctaatttggaaaaagaggtttctcatttgaaaaattctttgctaagattttctgatggtaaaaagaacctca

SEQ ID NO: 105764 - DNA, 733 bp, Oryza sativa
  unsure (1)..(733): unsure at all n locations
aatgaagtacgatccnttttagctaaacgcccaaggccaatggaacatggacgctgagagcctgagaaggtcagtggttccacgctaagcatagctccctgactttttaacttccatctggactttctttaccaaatgatgatttaataaatgtttgtcacatgccaggcttcttctgccgagaagggcctccatcagcgaccgcataaagtcatctcttctgttcaagagagagaatcgaacaggctgtgtttagtttctgaaattaaggagaagtttgaagaaagttggtagtttaaaaaaaagttaggagtttatgtgtgtaggaaagttttggatatgatgtgatgtgatggaaagttgggagttggggggaaatttggtgtgaactaaacagggcccaagtatgcaaacttcttaatcatttttttccattcttgctcttatataggatccagttcaccaagcttaattgatttgtttttcttgaaggatgactccatctctatcggagcaaagctcggaacagctagatgaagccagctctcatccgatctctaccattgtgactcctctccctgtactgccgctagcaccgagcgcctctcgaaccaagtcacccagattggtccttgaccatcttgccaaggcctaccgagtactggagaccactgcccaggaagccccctttgactcaatcatctttacgtggagatgggttcggcaggggaca

SEQ ID NO: 105765 - DNA, 977 bp, Oryza sativa
  unsure (1)..(977): unsure at all n locations
gggggcagagaaaaagagggggaggggggaaaaagaaaaaggggggggaagaaaaaaggggggggagaaaaaaatttancnnccccnccccccgaagagatgaatgagtagagaaanncacnnncnnnnnnnnnnnnnnnnnnnnnnnngagaaaaaaaaaaannnnaanaaaaaaaaaaaaaagaaaanaaaaaaaaatttttggggaaaaaaaaaaagnaaaaagaaagggggggggggggtaaaaanaagaaaggggggggggaaaaaaaaagaggggaggaaaaaaaaaagaagggcggagagaagaataaaagagggaggagagaaaaaaaagagggagagaaaaaaaaaaagaaaaggagggagaaggaaaaaagagggggaagaagaaaaagagagacgcgggaggagaaagaaaaaaagaagggggagaaaaaaaggaggagggggggaagaaaaaaaggtgggggagaaagagaaaagagcagggggaggaaaaacaaagcgggggagagaaaaaaaaagaaggggggagaaaaaagaaggggaggaaaaagaagagaggggggggaaaaaaaaacgggagcggaaaaaaaaaaaagggggggaggagaaaaaaagaggggagaaaaaaaagagggaggggagaaaaaaaagggggggggaaaaaaaaaggagggggggaaaaaaggggggggggggaaaaaaaaggggggggagaaaaaaaaagagggggagaaaagaaaaggggggggagaaaaaaaaagaggagagagaaaaaaaggaggggaagaaaaaaaaaagagagaggaagaaaaaaaggggaaggggaggaaaaaaaaagaggggggggggaaaaaaaaaacgggagggaaaaagaaaaaaagggaggggaagaaaaaagaaaagggggaagaaaaaaaagaaggaggaagaaagagaaaaaaaaaggggggggagagcagaaaaaaaa

SEQ ID NO: 105766 - DNA, 662 bp, Oryza sativa
aaagaagggcccttggggttttgtggcctttgcgggttttgcccattttttttcattggtttcgcccgttttgtggtttccgggaagccctcttaggttgggtagaaccgtgtgccccggcgcggcgaccgaggccacaggttcattgtttgttaacgaaaagggggccattccccaacccccttcccccgcgggtggggggttcctttttcataggggccgcggcggttttttttttcgttatggaacggtggcggcaaccccaattatttttagtgtgggtagctcttttgggtcgccccacgcgttgcttttttttgtttccctcccggttttttattttggaatggtaggcggaaaaccttttttctttccgcgagcggctagttttccgtctttcgtccagcctttttttttggccggtttatattactccacctttttttccaacttttttgcaaggttcggtttcccctattaccggcggccagttttgtggagattctccacatgttataactcccggtaatacccctactttttcctgtttgtgtgcgggattttaagttttctcttttaagtgttccgggggttatatttttttaaaaccctttctggtgtattctcggttattaacgtttcccggagtgttttttttgggg

SEQ ID NO: 105767 - DNA, 532 bp, Oryza sativa
  unsure (1)..(532): unsure at all n locations
cgcgccctgaggcccgcggctgggnccnnncnngngtgtatagagagagagagagagagagagagagagagacacacatatatatatatatatatatatatatatatatatatatatatatatatatatatatatatatatatatatatatatatatatatatatatatatatatatatatatatatataataaaaatataaatatatatatatatatatatatatatatatatatatatatatatatatatatatatatatatatatatatatatatatatatatatatatatatatatatatatatatatatatatatatatatatatatatatatatatatatatatatatatatacctatatatatatatatatatatatatatatatatatatgtgtatagatatatatatgtatatagatatatatatatatatatatatatatatatatatatatatatatatagatatgtagatatgtagatatgtatatgtataggtggggatgtgtggaggcgcggggtaga

SEQ ID NO: 105768 - DNA, 735 bp, Oryza sativa
  unsure (1)..(735): unsure at all n locations
ccatattgaagcaagcattattgtttgcagggattgcagatttttttacccttaaggttaatctttaaagatactattaatttttagtctaagtttgctttagagtgtgaatcaccattcgatctctttaaattgaattgaacttgctagttgttctgttatgaatgatgaagctgcgtaggaactatattgagttccggtggttgtagggaaaaaatgtagtttgcgaagtgatgtgaaaatcattttgtttcttatacgattgtacctttcagcaatttgcaatttttaagtcagcttgtggtatggctgcaaaacagtgattcatgcacgaatcaaaacatttatttaaaaaaatcgagtactatgtgaatgcactgatatacttaaaaaattagcgcgccaagaggcgctcattatagcccgtgtctactttctaattggttttcaaaattcaggtctacaaaaggttggcaaatgaaatattcgatggtgttattaaccgatgcaacaagtttagctaaattagctcctatggcactcctgctaaaaatagtaactagtacccttcaagaacaaccatcaaaaactggatagaaccataactaaatatttttacatgaattcactaagataaaaaagcctaaaaataccatagttgttttcagnnnnnnnnnnnnnnnnnnnnnnnnnnnnnnnnnnnnnnnnnaggggcttatcaaggttcaaacacct

SEQ ID NO: 105769 - DNA, 3325 bp, Oryza sativa
  unsure (1)..(3325): unsure at all n locations
cgctgtcanattgatgtcattctnnnnnnnnnnnnnnnnnnnnnnnnnnnnnnnnnnnnnnnnnnnnnntcgaatgaccgatgggacggcagctgtattccctcgccctgtcagtttgtcaggcggcgtgcggcgtgctccgtcctgtcccatcacaataatgagggacttcacatcctcttaccccggtcagagctggtccaaccactctaaactgaccccgggcttccgttttctggtgcgaacgagaacccgaaagtcctcatccattgaatggcaaatgacaagggcgccctacatgatttgatgggccccgcgcagtagctgatgtgcagatagcttcttggctaaggcacaagacatatagttaatatagagaatattttcccttctccctaggtagcactcgcagcacatgtgtatccccttagagtataaaaggaggaccatacctagcgggaagggggatcgaactctggatccccgagccaaagcttctctaaccctagcttgtacatcggaaattcaaaggctttgcaagcagagaagaatcatcatacacacaggagtagggtattacgcttcatagcggcccgaacctatataaatcccttgtgtctcttttgtctcaaaaacctcgaatctcacccgctgccccccgccgaactcaaaaaaggggggccttaaggttccctggtggaggagatcaccctccatcattcacttctacctacttttggaaatgattgaaaacagatgattatattgtggacggaggtagtattgaaaatcaaaacctagttttggaaatgaataaaactgaagtggtgtataaaatgaaacaagacctctacaaaataataattgagatatcataccatatggaaatgaataccctccgtacacgtacctagtgccccaatagtaggtgtggcacctccatatacaggataagcgcatgttcaatggtagagacgagtatggtctcttaaacagtataagattatttagagaatgtgtctttacaatagttgagacgataaaggctctaatcattaactcaaaaaatattccttttgttaatattcttttcttctttttaccctcatgcaaccatatttccatattgtagtgattaagagtcgttgttaagccattgttatgcatgacaacgatgttttgtctctcctgtttctctttcttccatgttaacaagtattcctaattagcaacgctaagagaccactattgacaaccattgtacatgccctaagtctggatcgtgttggtacggggcatggtttataattatagaagtgtgccgataactttttaaagtggagtatgttacgtaggagtagatctcttcctccctgcactgatccaccctaccccttaaaactcactcatcgttttcatatccctaaaatttacccgatcccttttatactcctgaaatttcaacttgatcccttccatgctcctaccgttatattttccctcatttcactgttacgtttggttgcaaatgtctattttgtccttgatgttttaggtttgaatctaagcttaaaaaatgattgaaaattttgtttgagtacatagtatgtgcatttatgaaactaatgaaactaaataattagtgtataaaattttggcataaattttgaaaataaaaaatataataaattaaaatttttatttgaaattttaataggacaatggatttttttacgggagcattcataaaaaagttattgtgagcattggtagtcctatctttgtatgaatgctccttattttttatgactttttgaaaaaattaaatacatatttttatttcattatctaaaataatttttgcgagaaataatgcatcgcacaacaaactcataataatagtctcatgcgacaaacttttatatttttaataatgtaattcataaatttctatgttcatcgaaagggtaaaattgtcattattatagagattagacggtcaactaacgttcaactgacgggaggggtatggaagggatcaaaatcaggggcataaaagggattaactaaaattgtaggggtatgcaagggattttatctttaaaatatatttgggtatgcaagggattttatctttgaatatgtttgggtatctcataagcccaaactggttccaatatgcttttaacgcttcatgacggaatagctttaattttttcgattttgctatatctcacttgaaagattttttcttatctctcacttgattttctcactcaaatttacagtgcattttcttgtaagttacagtgtaatttataaatcttacattgtaacttttgtaagttacagtgtaatttttgaatcttcgcatgtaaattttaaattttatattggatttggtctttttcttgaggatatggtaatttagtgtccattatggtgtttcttaattgttttttgctttttattatatcacggattttaatccaaagattaaaaatctgtgtgatacgatcataaaaatcttttgaaagatgtataggtactccctaatttttttaagctgcatttttaagctccaaccctaaaatattcttggagttggatttgaaactatattaaggttagtagtgtagacatccttttcatacttcaggctcgtcaacactctattattttagggttgaagccatgccaaacaggaccaacattaagttgttgatgagcaacccggcctgaccatgctaggattgggccctaaatataaattaggaacaagttcaattaggtcccttaaacttgacagcgagttcaaatttcattcttgaaccgtaatatcagatatagcggtccctcaattgttaaaaccgatgtaatataaggtccaaggcagtttggatggccgtttcagctgacgtgacgcttacatggctaatttgactcggttttcatatgacatagtacatgaaccaaaattgaacaatttaaaaattaaaacaaaatatataggttcatatgttcaaacaataagattaaaaaatagtggaagctacatgccagtgggccccacttccttcccctcatcctctctcttctttatcccctcccgttctccttcttccctctcccctttctccttctctaaatgcggcaggtggcacatggctgaggtggcgggcagtggtggttgctgtgcgcgacctatgatgaccaaggaggggccttcactagacttgagcagcaatggaggagaggccttcggtggacctggggcggtaggtgcactggtcgatggcgaacccgatgacgctgtccatggccc

SEQ ID NO: 105770 - DNA, 1885 bp, Oryza sativa
atctgtatccgtaaaaaaatatatgtatccagactatccggttctgtatccgtattcttttttctccgggcaggcggacggttttcgtgtcccgaatacactttgttttcatccctaggaccataggacgaggagtacgtatgtcagccaggtggagccacgttaagggttttttctatagacctaatggtggtaaaaaacgggtccaccaaatttagggtatgtttggttagagggatatctctatatgggagatagtgattcagctttcgtgtgtgtttagctagtagtcaaaggtggatagtatggcctgaagatgaaatattcccctgaaatattggatgagcgtattcggccaaattggccagataagaatatccaccttttctaatctcgatcattagtactccgtaattgattagcaatatttaatttttaattagtaaccaaattatcaaaattagtattgattagatataattattctattttattggtaattagtataaattatgcttatttaagggtaattaacatatatacgctgcagtccaacagcactcatgggcccggaatgctgaaacccaatttgctcatggttaccatgttgacatgctacatgagtagttaagagacactactttagaggaaaaaaaatagtagcaaacgtagaaagggaatttggataatgctaaacctattagtggtaaatagttaaatttccccatctaatcggcaaccaacactaatccagtgcacgtcataccatacgaagacgaaggtacgtatgtccatacttgcttgattttctttagtgtctccctatttttttcctgtgcaaatgtccatgacaatgtcatgcttgtattttttttaatatggatttaatctataattttgcttttgcaaaacatgccaatattttcaatctacaagttccagtaatggtgctgagacccaacaaattaaggttgcccagaccccaacaggtcttaggcacatccactcggggaaaggcccaatcccaatctccctgcatctgcccggaccccaacaggtcttagtcacatccactcggagaaaggcccaatcccaatctccctacatctgccaacagtttttaggcacacccactcggggaaaagcccaatctccctacatctccccactcggggaaaggcccaatctccactcatagcctacatcttcccactttagaaaaggcccaatctccactcataggagaagggtggcttactcctcccaagctaatcaaggtgaccctaacaaattaaggttgtgcggaccccaacagttcttaagcacacccacttggggaaaggcccaatctctctaaaagactagtccaataggggaagtgtggctctcccttttaaggtggattcctcctcccaagctaagtaaagtgagattattcagaggctcatatggtcgctgcccgactacaactgaaccacttggtcctttgttgcgtctttaccagcgggtaatagtggaggatattctcataagaagatcacagggtgaattatcttaagcttagacacattaaaagttcatttttgagcgctgatgtacacgtactatataaaatcgattttgctatatctcactcgaaagatttttttcttatctctcactcgattttctcactcaaatttacagtgtattttcttgtaagttacagtgtaatttataaatcttacattgtaacttttgtaagttacagtgtaaattttgaatcttcgcatgtaagttttaaaatttatattggcttgggatttttattgaaaatatgggagttagtggccattatggtgtttcttaatgtcttttgcgttatgggatttaatccaaaaataaa

SEQ ID NO: 105771 - DNA, 859 bp, Oryza sativa
  unsure (1)..(859): unsure at all n locations
gcatgcgcnntttgaattttgatatgcgccttgctccctgcatcctagaatgaggaattcggtatcccctcatataaacaaaaatatgttttgcgtgaagaaaaaatagtatcacgatttgtttcgaaaaacctctaggttttggggcaaaattaatgtttcaagctgaaaccccatgtttaaacttatacatttatttttttcgtatatttatgcataataattgcagcaaaataataagaggtatttctaagtaaatatatacatgttagccttatttaacgagcatcaatatgattgtttatatatatacgtataagtaactgattaatgtgtaactattagtagtcagattgtgtcgtggtttctcaatcgtgcaatgtaagagtaggaagaaataaagtatatacgagtgatatatattttgagtctagtaatgtgaatatatactaaaaatgttgtataaaataatgaaattatgatatttaatgtaaacatgggatttctagaaacattttacctcataccctagggtttctcgaaacaaatcataatacatgcactactggagaagtgatctttgttgggtcggatgatttccacaatagttagaaccgggactaaagattgtttttagtctcggttaaaaaaattttgatctttagtcccggttggtgtttccaacccggactaccgttcatccaatatcagaggcatgtcagggggccgaggatctttattcccggttgatactaccactttagtcccggttggtagtaacaaccgggactaaaaataaaaatctnnnnnnnnnnnnnnnnnnnnnnnnnnagctgcgagcaggcgtcatcatggggcg

SEQ ID NO: 105772 - DNA, 3200 bp, Oryza sativa
  unsure (1)..(3200): unsure at all n locations
gtgcgccaacggcacgctcccctcctcctgacctattcattgctacttctcccttcgcacacatcgttgtcgctcctactctctccacgtgtgccgcngcccccttctccctccacatgcaggtgacgtcgctccctcgttccccgcccgtccgctacaccagcctcccaatatgaaaggggatgagaagaaagttggagataggattgttgtgtactcatgggcattttggtacttttggctaataaatacatgctttttttttgtttttttatatacaaaaccttaacgtgtaatggaaacacggtcaaatgataacttcaattttaaaaaataggatcaaatgcaaacatgaaaatgtgaggttagattggtagaataaggtcaaataagcaattatcctaatttattattcttcttagagaaaggtacctgaactaatttaatggttcacttagcccactaaagttttttttttgccttatcttacccctaaactgttaaaaatgtttcactttgctccttaataacatgtacattttcttacccgtcatacaagttgcattttaagctaaaatgtaccagcggtattttaagctaaaatttgttaggagccatagatggcaccattaacgaagttcaaaagtattttcaaattttttttcatcgatgtttgcttgaacttaattttgatgtttgaatcactttcaacctaagtaaacagtaagaattctttttttacaaaaaatgttgaaacctaaattgtgaacgcatctatgttctaccaaatttccagagcaaaattgacttagatagagagagtaaaaaatactgctaggggggttcgaggtgtaaaatgagaaaaaaaagtttaggtggttaagtgctatgatgaaatggtaacttttttttcttactctttattacgagccacctatcttgtcgtcatctagtccaccactgttctcacaaattaaggattattaaagcctattagaaacatatattgtttgtatggactttgggattaattagttagtaaacaaatgttaaaaaataatgtaaggttatactctctccgtcccaaaatataataagtggctattaaggagagaggtaaaagaataatgcatggttgcctctccttgggatgaatggagtatagccgtataggcctggacaaattggggctataacaaagggataatatggttaatttagtggtaaaagtcacattttataatactgggttgctttatttgggataaggtttaaactattttatgatgcaaggagcagtatttttccaatgccctagctaagctagggcctattctttttagatgacgcagcatattctgataatataagataacttacttataacaatgaattaaatattacattatagagttaacaaatagcttcaaaaagttaccaagcaaggctaatgaataattatttttctggagcattgtactttgaagcatggcaccaataatgatgtattgataatcagccccagttaattagctcattccaacagggcagtcattcagagccacaggcaaatcttcccaaaatataagaccatgaaacgtcaggacaacaacaatgaaggaatagaagtaaaaggaaaaaaaaaaggatcgatatttgaaccttggagccctagactttaattagtaatccatataagagctaagtgtataggttgacaaggaattaaaatacttaaaaagaaacatacaaaatatgtgaaaaaacaaatttccaaaaactatgtcgaattcaagctgggagtgctaaaattgacaaaaatggttcctaaacttcctatcgtccgttcgacaagaagcccaaatcccaaacgctttaactaggcgggtctcaccgaatctttatctactcaccaaacaccatcaacacatatatttctccaccacacactccaatcttatcccatctctcccttatctctctccactacaacactacctcatcacgagcagcgacagggctcttgtcctcgacggctatctccttagcttactcaagggcagcttggtcagcctcggcttcctcaacgacaacgtggcataacatcagcggtcacttgttcccaacagctacgcgatgagcttgaacttggcttccacaatgatccatgctttcatcaagtgtggcgccgcataattgcagcatactagtgtcgagttcggcgacagtcagtcactggagaggagaaataagtactttagactgtttttttttatgtttcagccaatatgtttttgatgttcctttgtattggatcaaaatcttgcagtgaggttttttgtattgtttcatattctgtccttgaagagtgagattcgtggatgtttcaaacgctacactaaaatgttttaccatatgattcaattatgtttcaccaaaatacacaatgattatagcactttgcctttgcttaagcattggagtatttatgtactccctaccattgcatgtggctgcaaggtcagtaatcacagtaacctactctactagaaaatgcatttttcccgacgtggaggtcttattttcacagtcggacatgactcttggagccaaatgaccgtctaaaaaaaatataaatcggcatgacgttcgctgtccgcctgcgaaaatctattttcgcacgcgcctctattttcacaggcacaccttatgtggtctgcctgcagaaatagtacctaccaaaaaaatctagtcatcctcatccgtatcctctcctccaccatccttatcctctcctctccaccactcgtttcccttccccttctctctctctctctctcccccacacttagaagaatcgcccggctccctcctttcccacgtncacgcgcccgcgncttccttcttgacgacgacgacgaccgcgacgccgccgacggctccatccactctagatccgcgtgctgccggctccctcctctcccacgtccgcgccgctggctccctccaggacgacatttgcgcgccgccgcatccctcctcaccgccggtggcctccctcctcgacgacgatgacgacgactgcgacgacgccgacggctccctccttttccacgtncgcgccgccggcgcccttcatgacgacgtccgcgcgctgncgnatncctcctcgccgncggngggnctccttctcgacgacg

SEQ ID NO: 105773 - DNA, 1326 bp, Oryza sativa
caattaaaagtagaccgggctataatgagcgcctctgcgcgcgctaattttttaagtatatcagtgcattcacatagtactcgatttttttaaataaatgttttgattcgtgcatgaatcactgttttgcagccataccacaagctgacttaaaaattgcaaattgctgaaaggtacaatcgtataagaaacaaaatgattttcacatcacttcgcaaactacattttttccctacaaccaccggaactcaatatagttcctacgcagcttcatcattcataacagaacaactagcaagttcaattcaatttaaagagatcgaatggtgattcacactctaaagcaaacttagactaaaaattaatagtatctttaaagattaaccttaagggtaaaaaaatctgcaatccctgcaaacaataatgcttgcttcaatatggtatacttagtcatatacatggacattctccaataaaacattttgttttttttgacgcaaataataaaacattttgtaatctacagctcataactcaaaccatattgaccatctcatgaaaagtcacattacacatcacaaattaattccagccacaacttttagttcatgtgctcacaaaatgaatttgcatgaaaggggcagggctgagtagcaaattgacgcacagtaacagcagatgcagatccagtagagtgaagggagcaggattttagtgggaatcaactttcgtaactgtggcatttggggagttcatataattctaaactaacatggtaggttgtctgtagctcatatacaaataatctgcacccaaaccagtgccaaaatatacgaacaaatgcagaaattcgcttaggcaatactgcaaacaccttaagtgcgcaaaaaactgaagtaaatttaaacgatgtaaatggagaggaatgaacctgcagatgtcacagtgttcagtgcagatgtcgatggtggcaccgcgatgggcagaaggcgggcgggccgcagggcgctcgacggcggcgagtctctcccacgagctaggtcaccgggcggcgctacggcgcatcgatgggcaatgccgcagcgggcgacggtcggccgtcgacaaaatgcctccaaatgctgtacatcctgtagtgtctgaggatggtaggtgggtttggccaccaaccaggcaaaaccacacaattcccccatccttggccttgcgcttgcgcattagggtgagccaaaaagaaattaaaaaaaaaaacaactggaggttcttttccttaacacataaatacccgacaatgccctaaccgctcgacgttcataccgcagcata

SEQ ID NO: 105774 - DNA, 692 bp, Oryza sativa
  unsure (1)..(692): unsure at all n locations
acttttactgccatcttttttttagcgctgctctcacttgatttgcaacatatcaaaggatatttttcttttcggacgaaataagatgaatttttttgacaaatttatattcgtccttcaataaacagcaacatttacatgtagccaccaagtgtccttttgatcactcaaaagatcatcatttgagcaagtttaataggatagccaactactagctccaattcaactatagccaatccaatagcttattcatacaatagttatatactacactattaatacctggtcccacttgtcatacacacactgtctttgaatccgtgctacagctggctacaaatatatagcccgctactcctctttcttctcatttatatttttaaaatatgtttacagctggcttatagcctcctactgtacctgctctcaaggctgctgatcgctgacagaccgacgagcgcgccgcaacaacgaatagccgttggatcggagacatcgacggtccagatcgaccgatcccctccccgccttcctcttctcccccctactgcgttggtagggttttacgcctcactgcccaccgccgccgccgtcaccaccgggcgcggccgccgccaccatgagagccctcgtgnnnnnnnnnnnnnnnnnnnnnnnnnnnnnnnnnnnnnnnnnnnnacgncagcattaat

SEQ ID NO: 105775 - DNA, 702 bp, Oryza sativa
  unsure (1)..(702): unsure at all n locations
gcgctccnttttgatgacatgcnnnnnnnnnnnnnnnnnnnnnnnnnnnnnnnnnnnnnnnnnnnnnctcctaatgtttgttataacctaaagaaccctgtgctttctttttatgtattgttattgcttctttataggcttgtagctttacttgtgtgcttcgcgtagtcttcgtcgttccggaggttcctgaagcgtggtttgcggtcgtcgccgaaggttcggaagaatatccattgatagcttgatttatctcaaatttatgttaggggtgcccatcgatccgctagaggtggaagcggttttgctcgatatttcttgggttttggttgaagattgaagcctacaaggtaaatattcattatttctcaccccgattcacacccgctcgttgaattgaattgccatgtggtaatacatgtaaaatgcactagtcattaatttgtatggatccataagtcattcatagatctgtctcgggtgctatgctaaatttgaattaatcattttttccatctatgccatcatcgntaatgtttcacattagccaaatatttttttgcattgacgaaaaatagaattttttttatcttttcgttagccatgactatctagttaaggtgacgtgaatgtgtgcaaaaacctcaattttatcgtagggtaaaatgggcatttcttcgttgttttattctaatgtgcctg

SEQ ID NO: 105776 - DNA, 729 bp, Oryza sativa
  unsure (1)..(729): unsure at all n locations
tagtgctttatctntgaactagaaaggtagcaagcgcacatgcgtgggcatcttgtttaacatgtttgaaatttgagcccctttacgatgctctatttgatcgaagggtttagatctatttatactataccatcctaaatagcagcagtagaaacataaagtgacactactgtaaaaaaaagtgcgaaagggtataattatcatttagtagttactaaacctatttttattcctttttggcttatttcgatggaatatgagcgatgctagcacaataaataacaacagattgatcaatctagctgcaaaaaaaatatataaatgaaaaggttacccttaatcaatgtattagtaaataacgaacatatcagatcatttctactggtagtataatactatcagtagagagatcaccattcaaaattttattacatatgtatatgtgtgagtgattttttattgaaatacctttgtttactctattctaatttatttgggattatgttggttatgattttttaattacccttgcatcatatgaattgtaaactaaaattatgtgaaactgtgaagtcttgaatttataagaaaatatggtgtcgcaaccatggaattggtttgtatgaaatcatatataatnnnnnnnnnnnnnnnnnnnnnnnnnnnnnnnnnnnnnnnnnnagcgnggatntcagtgnnnntcaaagnggntatcaggnctacatccct

SEQ ID NO: 105777 - DNA, 880 bp, Oryza sativa
ccacgcatacttctaaaagaactcatatgtgggctgtacatattcgtatctcatatatacatatatatatatatacacacacacgcacacgcacatgcacacgcgcgcacacacacgcgccaaattaagatgtaaaagtacgtgatgatttagacatggcaacggtacagcactatagctaatagtacgccaaactaaattgcaaacaagccaaattgagtgtgtatcatgaacgcatacttataaaagaactcatatatcgtctgtacatattcgtatcgtagtgttataaaatattctatccaatactagcttcttatattttgagacggagagaatatcatgaaagcttcttgtgtgtattttcatgctatctgtccatccagctatatataacgaccgacttattgattttgtttgttcaataaatcgatctctatgaaatgaaaattgaattcctcaggatatttttgtcaccaaaaagatatagatatactgtatcttctcagtactcaacacaaacgtactaataggtaccacacgttaaaactttaagctatgcagattttagaagttacgggtcattcagattattttcaccaactacggatggagatttacaaatagatttcaataattttttacttggttttgttttgatgttgctggaatattctgctctcttgagagaattttgtagcaaggggttatagctctagcttctttggatgtaaaggctgagatttatttctattattaaaaaaaacacttaagctatgcatggtacctcgggacagtaccttttataagtaaaaaacgaactaatttcgccaggttttaaagttatatatgtaacgacctaacctatttgagcatgtga

SEQ ID NO: 105778 - DNA, 1461 bp, Oryza sativa
  unsure (1)..(1461): unsure at all n locations
cccgcccattgttgacatagctnnnnnnnnnnnnnnnnnnnnnnnnnnnnnnnnnnnnnnnnnnnnntccttgatggggatgctcaggatggagccgagcgctcccacctcgcaccagcgtgcaattttgcagaaaaaacccacgccactttaaaatttacctcatatgtagggcttttgcttaggcatacgttgtaacttttatagagatacttttcaaatatatattactactccatccgtctcaaaatataagcattcttggatcctgaaacggtttccgagatgctactttgaccaacaatatttatataagtaagatgttttaaataaaaaaaagttgcatattatgatagtttgtttaataataaatctagtaacatcaattttatatgattgatcttttttatttttttgctattaatggtcaaagtttaaaatgtttgacttatcactatgctaaaaattcttatattttaggacggaggggtatatgctaagcaactagatatattaatatatgctaagcaactagatataactaacgcaaggcatatctttacaagtactggcataaatttaagatgtttgggggcattgaggataaatattatctactcaagaggattggcaagggttaataattttttttttctctttttacattgatttgttatagttgctgcacaattttatgcatattagaaagttttatagagacattttatgaaatgcctcttctcttctagagataattcgccaaaagacacttgcaaaacattcttcaaaatacctctataatactgtagaggcatttaaaaaagtctttataatactagaaaaatatctctacaaaacagttattttatagtgatatcatcaattaatcaattaagagaggtagtttatacaatgtattgcctctaaaacactacctccaagacattgcctataaccttttagtttatccactttcatccaatacacactactctttctcttttccaccttgaagtttgtgaagagctttcctcttgcataagggttggttctttctctctcctctcctctctcctctacctcacattttaatcatatgtgatatctcgtagcttgcacttggatgcttactatagtacttgctttaatatttagttgcacaaatgcaactttccgtcaatcggagaatcttaaactcaaattggacaacatccaatttgttggtggttattggttttaacccaaactggaaaagtatgaacccaaaaactatagcatatgcatgagtttggacagttctattatattggggctggggaaaacaactttgaaactaacgaagtcatcacgagcatctcgttgttgataggtatagtcgtctaccactgaannnnnnnnnnnnnnnnnnnnnnnnnnnnnnnnnnnnnnnngaagccgataatcaattgaagaaggggccat

SEQ ID NO: 105779 - DNA, 1290 bp, Oryza sativa
  unsure (1)..(1290): unsure at all n locations
tagggtcggtcctttattggaccggggacggtactagcttttccaagataccacccaaatcctccgtccgcnccagtagaaaacaattgtttattttatttctcctttcacaaatcatgtcatcaacatcatggcaatgtggcgctcatgtctccacatgccgcatttgataaatatgagtatgcatgattctagaatggcatttctaagcaattgtcataattgactagggactcatacgtaattatggttacaaggattttaagggtaaacaataatcaaggcatggcataatcacaagtaggatgttcatcattgcatgcaattttatttgtaaacaaaacaatttcgcacttgggatcaacatgttcaaaggacagtgatgactcgccttgctcaaagtcttgcgggtcttggccttacgcttggatccacaaatccctcgggttctatgtttacgtgcaaaatttgatttgaattccgttagaattcaaataaaaatccaaataaatccaaatgaaagtcaaatgcgaaagtcgattcctttttattaactttactatctgcgaactacggcaaacccaatttcgatttaaactattttgcgggtataattattttgttgtcataagtttttaattactccttcccgagcattatatccatataataggttagaaatttctattacgagctaaatatcggacgaaatcctagaaatattatacaatttaattcagtctatgactaaacgattaaatataatacacggctaacattcctagtaattaaatccgaatttctaccgtgaaccgatgacttatagagattaccaaaaataatctataataatctataagaattcatctaattgtttagttattaattatatctaagttactaccaattttaatctaatctgtttaagaaacatatttttataattaactcggaatttcgaccgaaatactattatgctcgaggaattttcgaaaataatctatgattaaccccgaccattttttttcctaaatcctcctaatttctcccccaatttcccttctattttctcattttcttcttttctattttccctgtttttctctcctctctttctttttctctcttttctctccctctctttctttttctctcctttttctctcctctctttctcttttctgccggcctctcttttctttttcttttttccttctcttttctcctcccgnnnnnnnnnnnnnnnnnnnnnnnnnnnnnnnnncgaacgcaggagcatatcagtcacgg

SEQ ID NO: 105780 - DNA, 720 bp, Oryza sativa
  unsure (1)..(720): unsure at all n locations
tgcaatgaacagtgccgttttctaattaacccgattttagtgtattttccatataaatttgattccacaattcctaattttgcatatatgcattttactcaatatttgtgttatctgaactaatgaattcaccctagattaatattactcatattttatttttatataatttatttgagttttaattagggttaattcttattccatcgtatttaaatttaattgatccaaatatggttgcgataatattttatttatttctatccccacctaatctttattttaatttgtatttattttaccaatttgtttttgaggtttattcctaattaactattctttactcacgattaataatcatcgagatcaaatccagataaaatagacgaataagatcggcatgatgcaattagtttaaaaagtttttggaaatccatatttttagagttttgattttgtcggtcgaattttcagggtgttacataaacccgaaccaaaggggagaggaaggggaggaaaggtgcaggcctcgcttctagctccaagaaagctagatctaggcaagggcaaggaagagactaagggcaaagaggtcaagaagaaatacgtcgctccacaggagttccaactaggtatnnnnnnnnnnnnnnnnnnnnnnnnnnnnnnnnnnnnnnnnnnnnnnnnnnnnnngctatgaggttatatcaatcacaaagccct

SEQ ID NO: 105781 - DNA, 803 bp, Oryza sativa
  unsure (1)..(803): unsure at all n locations
ggggcctaacttcgagcccgtcacagatgagtgtcatcggtgacgggctataggaatatgcatcccgacgagtacatatacaatggcaaaaatttaggcccgattgagatgacttcgttctgacggcccacgttgtccaggcatgtgatgggccgtcacagatgagaggatctgtactagtgatataacaatatgtgtttctaataaatagttttttttcattgttttattcatgatcctacttgcttgagagagaaaggacagtggaaggtcgaactagagggacaatataggctcttgtcaataaattcaataaacccataattaattttgataatccatgcatgtcatatgatatatattccaaaggaaatctcgctttctttgggagagtcccttgaatccatgtgtcgacttacttccaaattagatttgtgacatagacctccaaacgaccacacaacgaaattaatttaataggaccaattcatgattaattctcatgtgcccaagcgtacctgctgccaatcattaagttgaaattcataaatttcttcctagctagtgctgtacatgcatatatgcacatgtagcgacagtaacatgcacgataatatgctatatttagttagcacaggagtgtactttatataaatttgtgctttgctaaaagttgatcaagatgactaattaatcaccagtgtgatgcacatattcgttctagacacannnnnnnnnnnnnnnnnnnnnnnnnnnnnnnnnnnnnnnnnnnnnnnnnnnnnnnnnnnnnnagtgatctacaa

SEQ ID NO: 105782 - DNA, 1062 bp, Oryza sativa
  unsure (1)..(1062): unsure at all n locations
ggaagtactgtgcttaaccatgggatcctttcagaaataactggggacagggatcaacttgcatatatttaccttaacaaaactaatatgaaaaatgcgtaattcttctatttccaagaggtgaagggtgtcattttaattttcatgtgtgaacgatcgaaaaaaaaaaagaagcttgtgttatgttggtggagccaggacctggccaccatggcagttgcccgggctccaccgtccatgcagcagtagattaggatttaattactgtgattactgaccttgcagccacatggagtacataaatacaatgcttaagcaaaggcaaagggctataatcattgtgtattttggtgaaacataattgaatcatatggtaaaacattttggtgtagcgtttgaaacgtcaagtttcaattgttgaaacatccacgcagggacagatccagaacaaaaaatggggggagggggctcaattacacggtttctttaacctccagttatataggaacctttagtttattattcatggtgaaaaaactaaaggggtactccgggggtatccatagatcttgtgggtgtagggnaatnctnaactngcntattccggaaccaacaataatccttgggaggatcagtggctcctttaaacctgatcgaaccagatcaacgatcccgggaagagggaacttgtttttgacggaaactttattgatggctctatacccccgtacatactttttggcttggccttattctccaaaaaaatcaccggtttacccaatggggaagtcctaatccgtaatgaccccctcctctttaaacctctttaaatggcggtttgactttgggcaatttattttgtttgccctacatatatgggacccttgtttaaaagaaatggttttttgggacaaataactatctctttactcaaaattttgcgtttggtgcgccctacacgggtttttatttcggggaaacacatttagcgaaaccttttgacggttttaaatttttccaccacccccaaaaaactaaaattatggaactgggtcaaaaggg

SEQ ID NO: 105783 - DNA, 1748 bp, Oryza sativa
  unsure (1)..(1748): unsure at all n locations
cggctcccnggtgaacaatctctgcgcgcacccacgcgtggggagctctgcggctccaagcttattgatttacaaccctgcatatccatcccatttcctatgacccatttaatattattcttgtacctaaaaaaacacaagtcatgacatataataagtttggcctcagttttgctcagaaattatgcttcaattatcatcatttgcaactgccccacccccaaaagaaattaagaataagtgtagagggtctgtccttatgcaaaaaagaaacaagtgtagaaacccacatttaaacctaaacaagaacaagagtgaggccggcccaacaatgcatccattttgcaaaacatcccatactgccactcccccccaaataaaatgaacaagtgtagatacaaaacagccataaaaaacatacaaaaactcacaattcccccaaaataattcaaccatcacagcccacatcaattcatccatcccattggacccaaaatatcccaaaaatggtatgttcttgagcaatcatcactggccattcatccatcatagcccacaatatttcatcatcacagcccacatctaaacaattttcccaacatcccattctcccccaaattcacaaattcatccatcacagccatataaaaatttatcactagctaacacatataggaatgcacaagtcatcacagccatataaaaattcaccactaggtaacacatataaaaatgcccaagtatcacagccatataaaaattcatcactagctaacacatataaaaatgcacatgtcatcacagccatataaaaattcattattagctaacacatataaaaatgcacaagtcatcacagccatataaaaattcatcactagctaacacatataaaaatgcacaagtcatcacagccatacaaaaattcatcactagcacaagtcatcatatgtagacattagcatctaaacattgaatcaacaaataattgcactatcacattatcgaatttaaacattatcatcgaatcatcaaatcatcacatataacatgtacacaacaaatcatcacattatgcatcatcatcggtgaggagtacctaccttgcacggtggcgggctcggtgaggaggttgacgtgggctcggggacggcggtcttgggcggcaccgggctcggggacggcgtggagggaggcgccgggctcggggacggcggtcttgggcggcgccgggctcggggacggcgtggagggaggtggtggccgttggggaggccggatcttgagtggccccggcctcggggacggcggtcttgcacaacggcggcggtcggcaatcgatagagggaggcagcggcgtggaggaggtcgacgtggcggctagcacgaggtcgacggccactgggcatagatctggagaggaggatgtgggacggccgtggttggtgaggccggatcttcgagagaggaggaggcgacagcgttgaggacgaggaggtagcggtcttgaggactaggcggagaggaagccggcggtggcggtcttgggcgtggaggacacggacttggaggaggaggaggcggcgtcagcggtggtggaggaggacgaggtggcggcggcggtggatctgagagagtgagagtgtgagagagtgagaggcggcgtcggnnnnnnnnnnnnnnnnnnnnnnnnnnnnnnnnnnnnnnnnnnnnnnnnnnnnngagcaatcagatatactaatccgcgc

SEQ ID NO: 105784 - DNA, 698 bp, Oryza sativa
  unsure (1)..(698): unsure at all n locations
ctgcccgatttaaaattgctatgacatttgatttatcacatataatgaacaaatgtcttatttacatagttcaaaattcctattaattttttaaaatcatataattgacaattgcctttctcacatatagtttaaaattcctattaattttttaaaatcatataattaacaattggctctctgacatatagtttaaaattcctattaattttttaaaaccacataattaacaaatccatttcttcaaagagttttaactggaatggcatgaaacatatgcaattcattcattaaggctccaatacaaattaaatacatcattcacagtgatatgccttccgaatggtctaaacaaacgtaagccacttcgtcttcgggatcatcgtcaaggtcgatctgaggtctgacatgaagattcttgttgtattcttcttcatcgacaacgttgtccacccccacaattcttcgcttgccatccctaacgacgtgcatcttcttttttgcggggtcttttatgtagaaaatctgttcgacctgcttcgctagtacgaatggttcgtctgcgtatccaaccttggccaggtccactaatgtgaagccttccttgtcgaccatgacacctgtgcggatattcaggggtaccgaattcctcgcccctagactagcatagcacgccgcgtcganagcnnagcaatcaa

SEQ ID NO: 105785 - DNA, 916 bp, Oryza sativa
  unsure (1)..(916): unsure at all n locations
ttattgacnnnnnnnnnnnnnnnnnnnnnnnnnnnnnnnnnnnnnnnnnnnnnnnnnnnnnnnnnnnnnnnaagaaggaactaaatctactcgatcagctgtagatattaacaatatataatccttatatcgatatatacttaaatcaagtgattgggatagatcggtcgccatgccgagacagtataaatcacttaaatcgaaatatatattaataatgagactatatatgttcatagcatagccgatcagatagatctagcatgtatcggctaatactccgataccactctatattaagatattaaagcaagtagaatatatcaaacaaaagcctaatatacttaaatgcaacaagatctcaacataaagggcagatttaacatgtcaataaagcatataaaacaaatatagttaaatcaggtaagatcggctgaaaccccgattctaccctaatcggcgaccaagaagcaggctagagattgagattctaatcacgactcataagatcaaactcaactgatgcagctataagtatgaaaagaaggacaatatctagacaatcaagccgttggaagtttcatagagtggtggataccttatataatctaagtcaacgtcgatatctaatctaatcggctgccctctaccgacagatgttagccaattatagattagatagcgatattgccagagattatgtaagatatatgataaatcgacgaattacataaacaagattagagtatcataaagatagaagcattaatcccgagaatgcaagctgtcataacaagttttacctcttgatgaagatcgaaaccgatgcagctcaacccgaaagcaagaactcgnnnnnnnnnnnnnnnnnnnnnnnnnnnnnnnnnnnnnnnnnnagggcgatgncatccgcggc

SEQ ID NO: 105786 - DNA, 1518 bp, Oryza sativa
  unsure (1)..(1518): unsure at all n locations
gatgtccncttgatttgcccataccatgtanaacccnnnnnnnnnnnnnnnnnnnnnnnnnnnnnnnnnnnnnnnnnnnnnnnnnnnnnnnnnnnnatattcagcaaatagaagtctacgtaaaaagtcaaacaataattggctatcatgacttgctgggccattggatttttctagtgtgcatgggtggatgtttcggaagtgttcaggttgaggcctcctgaagaatcatgatttttattagggactagctatatttatgacaccatatttttcaccaaaaaatatttggcatgtatttacattgtaagtctctatattacatatgtaattttagtgtatttataatgtaagtcctaaaattacatatgtaagttttaaagttacatatgtaaatcctaaaattaagtaccaattacatatgtaagtggggtataactaccgtgtaaatttgtataaatatacaattacaaacagaaaaacacaggtgagttggctagcgtcgttggttttcatccacaaggtccctagcgtcgttcgtttaattgccagtgctccagcggaatcggttcgtatctgccctactccttcacggatctcgtagagaatcaagcggctcaaaaatccgagcatcaccaaccgattatctataatcttccccaaaaagagtttttggtttcctacactgaaaatagaaagtaaaaaaactcctccctccaatagataaactaaattcaatctccaaaacttaaaagtggacctttctgttaaattaccaacagaaaattctattttttttctttcacgcgcagaaagatcactatctcccacgcgcgggaactggaggagagaagcaggagtgcgagattaggagcgagtttcgcgcccgtatataaacggagcgaggaatcgggagagggatctccaaaactcggtaggagagtaggtaatctgttggagctgttttttttttactaaaatctctcaaaatctgttttgggaattcgctgctcaaaatcagaaagctagctagttttgcatgtcagtttgatccaaccactgtaatattttaagtgatgcggctcattgtggtgatcagaaagattcactactttagattacacccaactctttcccttgcttcacgccttcttcacattcacaagctagcagcatgagccccgagtaggggtgaaactggtttggatagtttccatccgtacatacatattttcggatttggaaaaattcggtcggaactattcaaaatttatcggattcggaaatgaatttggatttttttttctcggatacgaaaacgaatacagtccgggtgatattcgacggaatcggaaaacggtcagaaactacccgtgactttacatcggatctccgttgtattacatgctagccaatgggacatttttcagccnaccaagaaccagaaaaaccccaaaaacccccctttaagcccccggggcccccgagggccccccaagaagggcggtttttttttcc

SEQ ID NO: 105787 - DNA, 1257 bp, Oryza sativa
  unsure (1)..(1257): unsure at all n locations
tgttgnnnnnnnnnnnnnnnnnnnnnnnnnnnnnnnnnnnnnnnctattcggtgaacaaacaaacaaacaaacaaaatgtttcttggtcaattgaaccaaataggaggactagcttggtggtacaaataaaacatattcattaacaataatgttatttaggatttgctaaaaaaaagaaagcccctaaacattttattaaacaagacagaacactacatgtttccatacaaattaaatctaactcttttctacatattgttagataattgtttataggaatgtattaaatattatatattttaaaagctaacaaatagattggacaaattataaaagcaacactgatgaggataagttatggataaacagtatttttgaaatggcaagtgtcatctggttgatattctatcattttaattttttttcaaacataatctctaatacatgctcgcgcatcgcgtgggctaccttcctagttatatactaaaggtccattaaacttcctacaaacgctctcaagcctccacgtggcacatctacaaacgctcctagaccaccacgtggcaatgcctaatctcaccgtcaattttcactcaaatcggtggacccgataatttagaccattaggttagattagatgtattttatttaaaaagttgtgagaaaaaacatatcaaccattggttttcatttattttcaaccatccgatacattttagatcatatccctactttcagctaatggacaactcatctttaattgtgctagagaaaaaaaatactctctctgtccaataaaaaaagccaacctagtactggatgtgacatatccaagtaaaacgaatctatacatgcctatgtccagatttgctatactacactatgtcatatctctagattcctttttttacagagggagtaaattacagtccatactatgtattcttaaatattcttaaaagttttcatattatgtcatcatttaaccattcttttcttttacacaatagctaactttacatttcaatttggaccaccctattatatccatctccaagtctgatgactcagcaatcactccgcacactatctctctctctccattttctttttccctccgtttgataactgctaggtatagcaagaaggagcacggatatagcgtcttcgctttttgttaggtcaacttctgccttccagtccctttacgcccgacattcccgacctcaatgcaaccataacaatagtgtgcataa

SEQ ID NO: 105788 - DNA, 747 bp, Oryza sativa
  unsure (1)..(747): unsure at all n locations
cgcgccatttgaaacccnattgagaaccgttnnnnnnnnnnnnnnnnnnnnnnnnnnnnnnnnnnnnnnnnnnnnnnnnnnnnnnnnnncgtgtgctctatgctgcggtatgaacgtcgtgcggctagggcattggccaaacatcttaaatttatgccagtacttgtaaagatatgccttgcgttagttatatctagttgcttagcatatattaatatatctagttgcttagcatatacccctccgtcctaaaatataagaatttttagcatagtgataagtcaaacattttaaactttgaccattaatagcaaaaaaataaaaaagatcaatcatataaaattgatgttactagatttattattaaacaaactatcataatatgcaacttttttttatttaaaacatcttacttatataaatattgttggtcaaagtagcatctcggaaaccgtttcaggatccaagaatgcttatattttgagacggatggagtagtaatatatatttgaaaagtatctctataaaagttacaacgtatgcctaagcaaaagccctacatatgaggtaaattttaaagtggcgtgggttttttctgcaaaattgcacgctggtgcgaggtgggagcgctcggcttcatcctgagcatccccatcaaggatcggatctgagcattttgaatattgtttgcgttcaactaatatgttgtcatatataacgtccaccttaaattccgcatcaatccgc

SEQ ID NO: 105789 - DNA, 642 bp, Oryza sativa
atcatatttcatctacaatcttatacagagtctattaaatttatttctcttaacatagtttgacagactagttttatttattgttaatagctaatactatttttacttttagctcgattattaaaaataggaaaaaatacgaattacccccccccccccccgaactatcgcggtcgaccgacttacccttttgaaccacaaaaccagatattcttaacccccaactatgcaaaccggacaaattaccccctcaacccaatccgcggtggttttggtctacgtggcagtccagtcagcattttcctttttttaatggtggggcccacctgtcatatatactatctcaccttttccttttcacctctctcactctcactctctccctctctctcggtgaaaacggtggcgggcggtcggcggcgcacggcagcggagcccgacctgggtagctagacgacgaggcccacgacctgggatacggaggcagcaacggcgtgggacacagaggcgtggtggcgcgggatgcgtaggcggtggcggagtggttcacagagccgcccgcgcctccactgtccctccaccgacgagaacatgggctcgacacactcctacacaaaatgatgggagttcgccgcctcgtct

SEQ ID NO: 105790 - DNA, 971 bp, Oryza sativa
  unsure (1)..(971): unsure at all n locations
gtggannatttgaattgactgacgcgcnnnnnnnnnnnnnnnnnnnnnnnnnnnnnnnnnnnnnngggtcccatatttttttataattagaatgctgactggactgccacgtgtacgccacatagactaaaaccaccgtggattgggttgaggggggtaatttgtccagtttgtacagttaggggtgaagaatgtccagttttgtggttaaggggggtaattcggtcgaccgcgatagttcaagagggtaattcgtactttttccttaaaaatatattaaaagttacttagtaatttccgcagcaaagcgcggggaatcacctagttgctagcatgaacacacccagtgtaatttttctagacccgccactgggtggtagagttgtgcgacctcctacgcatatgtatttattgtattttgatcaactgcaaaacatgtttatgtagtgtgagtttgaataataattgctgcaacaaagttagaacaagtttaataatatagttaactaccaacattaaaaattaacacatcatacacaatcactctagtagcttacctatgcaatagttttatataaacatatatatgatattaatacttgacatatctctcatacaatgttttgaagtttgtgctgcaactcatttcaaatctgtagcattcttatcttctctctgtttcacatgtgtatgtgtagataatctataacctgctattctacatgctcttagtaaacatatttgtgcacagtacctaggcaattcttgcacaccatcatccggtaaattttagtactgcagtacaggggcccagcaagcaaacccaattattaattaccggagatatttttattgttcgtacaaatttccatcgctcgctactgctaccgtacgtctaaacacgacgaatnnnnnnnnnnnnnnnnnnnnnnnnnnnnnnngcgatgcgcaatgcattcaaaangggccct

SEQ ID NO: 105791 - DNA, 593 bp, Oryza sativa
  unsure (1)..(593): unsure at all n locations
tttgatccttgcnattgacnncccnnnnnnnnnnnnnnnnnnnnnnnnnnnnnnnnnnnnnnnnnnnnnnnnnctttcttacgggcgggggngttagcggcagccgcgggcgcggctagtggagggcaacagtggatgggcggacggcgcccactggcgaatggaggtctcacagggagcttgacgcagccccttcttctcattggcaacgccgtggacatggccatgactacccgggcgcctctggttgacacttgacggacgcggtcgacggacgagaacggcttgacggagggacgaacggtctcgacgaccgggaactacgagaggatgactacaggaaccggcgaggaggcgatgagggcacccggcactacctgcacagagactaggacggcccggaacacgccgttaccatgacgacgagggtggtggtgcacttagacgacgagcccccaaggactaacgaccgaccggaggagtcttttttgacgacgagcggagacgactataacgaacacaggcggtgttcggatggaggggatgcgtcgcctatggcaaccttgactcttgaaagcctgaggaggagatgg

SEQ ID NO: 105792 - DNA, 741 bp, Oryza sativa
  unsure (1)..(741): unsure at all n locations
gaagtgcnnnattgtanaacttatgcttgcttgnnnnnnnnnnnnnnnnnnnnnnnnnnnnnnnnnnnnnnnnnnnnnttcaagttggggccggccctcctgaaaaccccccctgttatgaggtggactctatgggacaagcgtgtatcggctaacaagcaaacccattgggatcaaatcggaatcggccaaccccgtgccctcactatagcaaattcagctaaagatgaaccctctatggccgttgtcacctaccattgggccattactattcacaccttttcattcaaccaagggccgctgaccccatctctgatagatatttctatgatcactgggctagatgtatactaagtggatcacgccatggacctggacaacaaaagcccatccgatctccggaccaacagcatatgtggttgcactggatatgtggcagcatatatggtctaacgatctattactcatcgcgagcatgtcgccttgtgacttatgttgctagaaaagcaacttttgtgcgagtactgcttgggccctacaaccaactgacagtatgctagcgacgctattgtgtgaaagagagaatttcctattgggaaagacctcctctgctacttataccaaatgctgatcaatgcatctgacataataaccgtatgctatgatgttggagcaccgtgtccatggaggacgtacaatctttgctcaaatcatcgagatcgaagctgacaacggtcatag

SEQ ID NO: 105793 - DNA, 1660 bp, Oryza sativa
  unsure (1)..(1660): unsure at all n locations
aaatacaatagaatacattttaaaaaattgtattctattgtatttgcctcaaccacttattttaagctatttgcaaagtttatttttaaatgattaatttatccctgtaatttagtagataatccgagaacaacaatccacttaacaatctgttcctgcagacggattgagattctctggagtcaaatgcactgtacctttgtcactgacatgtgggcccatggattatcgggcccacatgtcagtgacaaagtcacgtgtcttcaactgtggaggattctggtctcccggagacagcagcaggtgcgttgacctgattttttttctaattttcacattgcaattgattttttaaaacttctcgaagggtgtaaacgtactttgtaactgttcagttttttgtatgacaagacaaaggtcccggtttttggtctataaccggcacctttcttccaatagtgcttttcatgctatacacaaaggtgccggttttgggtctagaaccggcacctttgttccgatagtgcttttcatgccccacacaaagttgccagtttttggtctataaccggcacctttcttccaatagtgcttttcatgccctacacaaaggtgccggttatgaagacaaaggtgccggttttgggtctagagccggcaccgttgttccgatagttcttttcatgccccacacaaaggtgccagtttttggtctataaccggcacctttcttccaatagtgcttttcatgccctacacaaaggtgccggttgggaatacaaaggtgccggttttgggtctagaatcggcacctttgttccgatagtagtacttatactccatcctttgccactcgagctgattgagcaagaagagatcggcacctctccttcttgcccgatcagctcgaggaggggaggaggttttgctctatttttttgtggtgtttggttaaagattgaagcctaaaggtaaatattcattatttctctctccatttatctcttcattgttgatttgaattgtcgtgtgcgtatgcatgtaaaatacgatatgggtgttgtttttagggataattctttttatcttttttgtgtctattgttggatgaaatgctaaatttgtgttaatgttttcttccatctacgtcatggccgttagtcaaattaatgattgtcaaactatattaaggccacgaaaatatccattgatagcttgatttatctcaaatttatgttaggggtgcccatcgatccgctagaggtggaagcggttttgctcgatatttcttgggttttggttgaagattgaagcctacaaggtaaatattcattatttctcaccccgattcacacccgctcgttgaattgaattgccatgtggtaatacatgtaaaatgcactagtcattaatttgtatggatccataagtcattcatagatctgtctcgggtgctatgctaaatttgaattaatcattttttccatctatgccatcatcgntaatgtttcacattagccaaatatttttttgcattgacgaaaaatagaattttttttatcttttcgttagccatgactatctagttaaagtgacgtgaatgtgtgccaaaaccctcaattttatccganggtaaaatggtcatttccctcgttgtttt

SEQ ID NO: 105794 - DNA, 514 bp, Oryza sativa
cattcagctgctgctatttcagaatcatcatcatcatcattatccgatccatatatgtaaggacagatatggttaacctttctagagttcttcctggcctctgtaaacctctgttcatgcaaggttaccttctgtgtaagatgcgacaagctatcaaagtcttcagacgagaatttctccctgattggagtaatcataccttgaaaagccaaatcggctaactgggcatcagtcaaactcaagctgtagcacttattcctcatctctcaatctctgaatatactcatgcacaggctcatcatgtctttgcttgattgctgttaaatcagacaatttcatctcatgtaccccactgtagaaatagctgtgaaaatgcttctcctaatcagcccaactgttaatcgatccatatggcaaagaaaaaaaaccaagtgaaagccgatccagacaaagacaaccggaacaaccgaaccctcaaggcatccacagccgatgcttcaccacactgagctaa

SEQ ID NO: 105795 - DNA, 624 bp, Oryza sativa
tttttcacaggaaatttgaacaaaatctcatagcaaatatgaacatttctcgagatcaagacatgcctagctggctaattatttattgatttatgggatgtcttcactatttcctatagtaaaaggaagcatgaccaaactttaagctctacaagaaaaccatgatttctcaggtcgaggttccatctagaaagtgactttttgaaaacaaagatgcattatgcatggtccatagtcttttcgcgaatgaaacaaacaagaaagaaaagcaaataatcaaagaaagaaagccctggctactggaaaagtactagctggttaattacagatgagatctaaattaaagcatcagcccctgcccatatagatcatgaaaaatgaagtgggacacacatatgctaccctttttttacaaatcatattatgagatcagtgttggttttcaacaggtaattatttatattgatttatataaaagagataatctatcatattcagaccacaacagcactaattttcatattgctaatgattgaatttgacatctcgatattataatcttgctagcattgtgcaatgttaggttgatcatgtgtgtggctggtttcatatatatgcattaaa

SEQ ID NO: 105796 - DNA, 566 bp, Oryza sativa
aaaatagtcatgtatgctaagtgtacctgtcgtatattagaaccctacacaatcttacatgctaagtctaattacaaatctaataatcttatactaaacctcaaatagtgatatatgctaagtctaggtgacgtatattataggaccctagctagtcaataattatatactaagtctaattacaaatataataatcttatattaaaactcaaataatcttatatgctaagactaaaatagtcatgtatgctaagtgtaactgtcgtatattagaaccctacacaatcttacatgctaagtctaattacaaatctaataatcttatactaaaactcaaatagtgatatatgctaagtctaggtgacatatattataggaccctagctagtcaataattatatactaagtctaattacaaatataataatcttgtattaaaacttaaataatcttatactaaaactcaaatagtcatgtatgctaagtgtaactgtcgtatattagaacactacacaatcttatatgctaagtctaattacaaatctaataatcttaattgcattaca

SEQ ID NO: 105797 - DNA, 752 bp, Oryza sativa
aaaaaaataaaaatttcggccgaaataatatcacatcgggaggtccgatagaacaaatccaaaattttgaaccctgctgtggagcaaggttccagcttaaaaaaggaaagaagaagaagaagaagacaaacagcggaatttcaccgaatttgaatgaaaattcaaaattcagtttgaataattctaccaaaaatagatcgatgatcataaagataagtaaaatccaggagaatcctgtcctccgggctgatcgagcctatgtgaggggatagggtttggcttctcgagttttggtcttcgtggaccgtctacaaattcaacctcaacaaacgacaaaaatttggggaccgacaaatctcgccagcttaactgattaatgctaattatacgtgaaaaagactttttaaaaaaaaagggggggggggggagggagatacaatagtcgtcagatactacggctgaataactcgtacatagatgaatccatatgcgaggggaaaacatacgtatatatggtttctctcaactacttgaaatcttgaattaacctgaacgccttatccgaacaaaataataaaattgttaatctcattcaacttcagcgactaagggcacccacaatggttatctataggctctctataagagatccatgtcagcatattttcctacttgaaagagattaaataaaaagagagagcaaagctatctactaacctggagatagtctattgagaaaaacgaggcaatgt

SEQ ID NO: 105798 - DNA, 902 bp, Oryza sativa
gattttttttcacacgtgcttatctccctctccgtccttcgtttttgcgtgcaattttttttctcatgtgatttttcctttttctcacgcgattttttctctttttttcgcaagatagctaggtaagtttcaacctcattttattttgaaaatttttgactcaaaatttaaaaacttctaacacaaaattgaaaactttcaattagaaatttgaaactcttaactgaaaatttaaaacttttgatcaagatttgaaaactttcaactaagatttaaaatattcaactcatgatttgaaaactttcagcttaaactttaaaatttattaacttgaaatttaaatatgaaagataaattttgaaaattttcaactcatatttgaaaagtttcaacttgatatttgaaaactttcaatccgagaattgaaaacttttaactcgagatttgaaaattttcaagtcaagatttaaaaattttcaacacaaaacatttgaaaaccatgtgttgaagattaaaaaaatcgtgaaaggaaagaaaagaaaaaaaaatcgtgaaaagaaagaaaaggaaaaaaatcacttggggggagggggccagctggcgcacgcgttgccgcgccaatttgccacacccgagcggagcaccccgtcggatccgtacgtaatacacgcgtcgtccatcgagagcggtgctgcagaggtggcgtgctgccgctgggatgcatcaattttttttatttacattttgaggcttttcttttcatcgtccgctctgttccattcgccgccgtcctccattccgttcttcctcagctcccgtcggtggtgcttgaaagagtccgttttggtgctggccttcttcaggtcgtcaagttcgccttggcgcgcggtgcttctcttctt

SEQ ID NO: 105799 - DNA, 593 bp, Oryza sativa
atatatatgcttttcgttttacctaaaaaaaccttttcattttagctttgtataaaggcaaatattcatcataaattttcaaaaattcgtatacagattaacatgtgaattatatattatgaaaatatttctcatatataatgaatttagaaaataaatcttattatggtaataactgcataaatttctagagaattgatgatgaaggttagaaatgtttgacttactgcaaagttataacgacaagtaatttttttaagtaaaacaacaagtaatttgaaacggagaaaatcatatatattttatctttatttttttttggaagtaaatactagattaatcatgcttatgcgcttatgcatgcatgcatgcatgcataaaaagaagattaattaaggcgcattgacatatatgtgcatgcagctaattaacctttttatttaattaatcttttgtactacaaccatagctatagctaaagctggataataattcttgacagaaacatctcgttgctcactgatgaaaaatctaccggactacgacccatggaattattgcaggtggtttcagatcgctgcccggcttaccgg

SEQ ID NO: 105800 - DNA, 642 bp, Oryza sativa
  unsure (1)..(642): unsure at all n locations
cgcccaccaccaccaccacgcgatcgccaccatggacggatcaagcttaataggagatcatcaccatcacagcagcagcatcctctttggcggcgcatcagtgccacctctcctagaccaccaaaccattctcgacgacgacgacgaccaccctaacaaaaccggcagcaacacgaccgcggccacactgagcagcaacatcacagacaacagcaacagcaacaagaacaacagtgataataacaacaacatcagcagcagctgctgcattagcctaatgaacagcagcagcaacatgatctattgggagggtcaccaccaacaacagcagcagcagcatcagatgctgcagcagcagcagcagcacatgagcaggaatgtcatgggagagtgggacttggaggagctgatgaaagatgtgtcatccttgcctttccttgatttccaagttgaatgattgagagggaggggccccatctatagctgccaaaggagtacattgcatatatatacaantatacatatatatacatacatacacattgaaggtagtatttttttccattgacacatatattctctcttccaaatgtacaagatttctcacaccaactccacttttgatcttgcatatatataaat

SEQ ID NO: 105801 - DNA, 639 bp, Oryza sativa
ggcataaccacccctaacacaaagactaagaaataattattatcatcttgtagtttggatcatcctaataaatacaatgcatgcatccaatagaattaaagaacatgagagtggaggattaaaaaagtaataatttaatggagaaggggtcatagttaattgcctatatgcatgcatgccttatggagtattatggaacatctaagaaaagtggtttatatggaatggagggagtacatgtataactaatgagccctgtctgaatgactatttgacactatgcaaactgcatgtagaaaattgtttatcaaaccactaattaatttgatcggagtttgaatgtataataaaccgtgcaacttgtcctcttgcatttgacacaataacatatataatttgtcgatgtttgatgtcgcgattccgatatttgtatagtgtggggattgttgataccagggtatatacgagattgtagtaaaaaagatggagacggggatttttatacaggttcgggcccctgaattgtcaggtaataaccctactcctgttgaccgaagccggtcgttgctcttattcaccataatcacaccagtacaatatttggggtagcttatctatctgttgtcgacatggtggtct

SEQ ID NO: 105802 - DNA, 1232 bp, Oryza sativa
tgttttgcgcatagggtttctgtctcacgggatgatgctggtgtgtttcctaattcatcggtgcttgaataatccgcgaagggtttatagtccgtttcatctgattgtgttctctctttgaatcaggtgtcgtgcagagcaacgagtcctccgcaaaggtcgatgagccgctgctcctgctgaggcatctgtagatgctgtgaacggcaagattcctcctaccaaggttacttcttattagggatgaaaacggatcgaatacggacggaaactagctctaccatattcattttcatatttttttcggaatcggaatcggaaaccccggatacgaaaacagaatcgaatattgtcgaatacagataggagcgaatacaaaatggaacgaatacggtgacgaatattaatcggaacaaaaacccctcaaactaagcatcacaaatcaacgaatatttccaaattttagtgttaataattttgctatatccaattttgtggttgagggtgacggcatctgcaaaaatcgaccttcattttctcatgcggctccttaagactagtttatcgcactcatatgaactccaaattggatgattcttttttctaaatgtttgtaaaatcatgctctattgtgttagtgtgttcttactgctattattttggccatatttttcttgtgactttgttttatcaattaaaattttgaatttcaaaaaaataacaacttcaaataatattttgaagcggtaaataattccagctgaaaaagtcatgaacataaaagttgtagaactcatcaagagctacaacttttattttgatcatttcttcatccgacaaagcagtagtaacattgttcacaaaatttacatatctctcttataacttatgaaactatatgtgagatatgtaaattttgtaaacaatgttactatcgctttgttggatgaagaaatgaccaaaataaaagttatagatcttgatgagttatacaactttgttattgatgacttttttagttgaaatcatttagtatttgaaaatgttgtttgaaggtgtcatattttgaaattcaaattcaaactgtttaacaaagtcacatagaaaaatgacacaaacaaaagttgtagatcttgatgcgttttacaactttgttgttgacagtttttttcatttgaaaacatttaatacccaaaaaattatttcaatttcatatattttaaaattcaaat

SEQ ID NO: 105803 - DNA, 632 bp, Oryza sativa
attatggactaattaaactcaaaagattgatctcacgaattccttcctaactgtgcacttagttttttgatttatctatatttaatactttaatgctgtgtcccaagattcgatgtgatgtttttagaaaaaaaatttgggaaatcaaacgggcctaatagttcccaagttttttttttcccaacttctaactttgcctcacatcaaaacttttatacacacaccactactgttctatcccatcgtacccattttacacacaacttccaacttgagtgtgaactaaacacagcctaagagttgattcttttaatccctccctcctaaaataaatttaattttctacctatatcactactcccctcgtcctagaatataaggggctattgagttcctaaaaacatcacatcaaatctttagacacatgtatgtagcattaaatatagataaaaagaaaaactaattgcacagtttgcatgtcaatcctcagacgaatcttttaagactaattagtccataattagccataagtgctacagtaacccacgtgtggtaatgacagattaattaggcttaaaagattcgtctcgcggtctccaggcgagttataaaattagtttttttattcgtgt

SEQ ID NO: 105804 - DNA, 572 bp, Oryza sativa
ggttcggcggtgcgatagtagagggtaaagtttgttaaggtgagatgtaggggggggctgaggtcttagccgcgtggggggggacacgtgcgtcgtgccgtggggcttccaccgctttaaagcgtggccaataaaaagtaggagtcgtcctactccttgttcgttctctctctcctcacttaccccacactcatcaccaaatgcaacataacactgttaaaagacaacacttgagtcttataagcacgatcttgagttttattatacttgctcttatgtacgtactccttctaattccataattatcatgtttgactagaactttaacaattttaaatatttagcttaaaaaaacactggaacatagattagttttaaaaagtactttaataaaattaaatatctacttatatttttatatattataattgaaaatatatttggacaaactctgatagcggtacgtaagctcagggatccatttgattggattggtcaatctttttctagctaccaggccaattggtatgcacactctatatccatgcatgctgatagatcatgtcatgcac

SEQ ID NO: 105805 - DNA, 718 bp, Oryza sativa
  unsure (1)..(718): unsure at all n locations
ccgtggctgccatgggtccatgggtcgcagggatcaaatccatccggtgcaaaagctcatggaggatgcagttttatccagatgtagtacagctcatctgaatttcctgccacttcatctgcagtgcaaatggtttctgaacccataggttatgatgctttaagcgtgcggcaaatggtgtgaaaaggccaatggttttcttcttttttttttcattcaggaactctcaaattcaatcaatcctagctttttttttttttaaaataagcaaaaaggaaggcctnatatnactatatgaagcatggagcagtttggtaggtacaagattggcacagggcacaatccgggttgtggctcaaatttgaacacaagatttatattgttttcgggttctcggacaggtcaaaatgcttcacggcgtgtggcaccanccaaatgatcatacataaaattccatgatgcgaatacaatgttatatctacaaatgcaatcaaaccctgaggttttcacaagccctacaatattaagcgggcactgataaacagccaagggacgagacaccgcgacagaatagaagaagggacaaatggacaactcatacaacaggtgttggtcctacagagggcggatgggttgcnaaatcnataagctggnatcgggaganctcccagcgcgttgnatncatanctgantttctatcattcacannggggcgcgg

SEQ ID NO: 105806 - DNA, 708 bp, Oryza sativa
  unsure (1)..(708): unsure at all n locations
tttctgccaccgaacanttnntaangngnngnnagntannnggatnnaagnttatcgatttccaancctgtgtgtataactgtatatacatgncatacttttgctgcccaattggaagagcttgcgggtggcggagaagaccaccaggcccacctcccccccccccaccatccaaagcttcctccggcttctttaacacccccctcccccccttcgacaccgccaccctgccttccccccccgctccccaccctccccccccctactcctccccctcccccccccccccgctcccaccaccccttcccttcccccccccccccccccccccccccccccccccccccccccccccccccccccccccctccaccccccccccccccccccccccccctcccttcccccccccccccccccccccccccccccacaccccccccccccctcccccccccccccctccccccccccccccccccccctctccgcccccccccccctctcccccatcccccctcccctccccccctccccccccccccctccccccccccctcccccccccctcccccccccctcccttctcccctccccctcaccccccccccctcccccctcccccctcccccccccccccccccccccccccccccctccttccctttcccccccccccccccccccccccacccccccccccccccc

SEQ ID NO: 105807 - DNA, 1415 bp, Oryza sativa
aaagaaaacatgaaggaggtcccccccgttcgtgcgcctgtgcaaccacttcttcttaggcgtcatcgcagacgtcggcgcagccgcccggccggaagaattcgttcagcctgaagtccagtggcccgccggccttcgcggcaatcataaggctgacccctgacctcgtcgacaagatccggcgtgccgaggaatcgggcagcggcgctcgcatcaagttcaaccctaacatgtacaactcctcggagaacgtgagcttccctcccctccctccctccatctcactccgtcgtcaagttctgtccccgcgagtttcttctgaagttaaaacctaactgatttctaaattttgcttgttatggcatatgtgtcttaagttcataactcgagattattttcatctggaataccagtttttggttttcctgtaacatcgttcctgagtttaggttagttcactgtgtaatttgcatttatatttgctcaattttactgcctggtgcttgagatgctctgaatcgttttggcatgatgctgtgttatcccaaatgttgttaggatcgttaaatacttaaatttcacttgtgatgttctatggtactctcttgagtgtgagctcgtccattgcttattctggtcctgtcgatatgccattcattttaccttcaagttttgtataggattgttcaaatccagcccctgcctgttcattattgagtgattttataaattggcagttcatgttttagtttggttttacttgggcacatgtctccttggcttgatgggaataaaccgtatgatttcttttggtatatgcaccaatggcaaggagttttgtttgtgtattttgcatttctttggtcagatcactgtgagcaaatcattatttgaggcttccactatttggctaggatgaatttggatattttatgctgtttatggttgctcaaagttctttgggaatgatgatccatgcggaagtattaattttgtggaattgcattgttgggccctacttttgtaaccgttagctgctaggaatggcatataaagctcatgtacatcttttatctatggtctttgattgttttttgggtatatcaaattattattttttgtttaatttctaatgagcagttatatatatttcttttcttcaaaaccatttacttggttttgtactaaagaagcgtagaatcacccaactatgtatttggctccagtagggttcactaatctcaaataggaactccaaaactccaaatctcctttcctgtcaagaccctttgtgttcctaactttcttgttcacatgacatgttactccagtgaaactgtagctttacgtctcatcactgacatttatggatcctagttcaactgttttgctttgttttctaaaaaaaaaatcca

SEQ ID NO: 105808 - DNA, 760 bp, Oryza sativa
  unsure (1)..(760): unsure at all n locations
gcgtgnaagtagagccctgtnnnnnnnnnnnnnnnnnnnnnnnnnnnnnnnnnnnnnnnctctatcggcggcatgcccgcgcccccccgcggtcgcggcgccgcttgtgttttcgccgacgaagtggttaaggttgcaaaagtaaaaacttgggatccggaagagtccaacagggttggaaacttatttgcgtgtttccatagagctcctaaagcggttggggaatacatgggctttactttgttctggggtaaataggtatccgattaaaaattcaaacaagtttccggtgtgaaagaataatggggaaatctgggggtgcaaaatgcgtacctaaatcaaattaagttaattcggcttaatttcctgttttcaatgatgaaaactaatggggcaggttactttaagaaatggccaaaccgcaagcttgaggagcattgtttattgaaggtttttacatttctcacataatgatttttttgccttggcggtctatttaagtggacccctaaataactttattaaatgggggtatacggtttctcataaacttttagggtatacccaggttggacattttgatccataagctgaatgaaggtcacttcctttaaaaaagagcttttacatggttatttaaaatattttcaccccattatggaggcttgaaaaataattacttttaacaataaggttgaaacccccaaaggccaatataatgtccctggattctcgttaaaaaacgattgggcttatattt

SEQ ID NO: 105809 - DNA, 609 bp, Oryza sativa
  unsure (1)..(609): unsure at all n locations
tctgtgaaaatcagtatttttgcgtgggcgacgaaggaccgcttgggataatcgcattatccggggggtcatactataccaccccacacggaataaaaaaaacccaaaaaaaagaaaaatngtnngcccgcccgccggccttgaagggaaccgggcggccgaaattgtcgttgacattgttgggcccgccgccgaccttaacgccgtgagggacggcccgcgccgccggaatcgggggtgtgggggccgcctgcccgccgccctccccgccgccgcctcgnggccccgcccccccccccccctccgaaccctcggcgcgcccagcccccccccccccccccccctccgcccccctccccccccccccccccccccccccccccccccccccccccccccccccccccccctcccccccccccccccctcccccccccctccccccccccccccccccccccctccccccccccccccccccccccccccccccccctccccccccccccccccccccccccccccccctcccccccccccccccccccccccccccccccccccccccccccccccccccccccccccccccccccccccccccccccc

SEQ ID NO: 105810 - DNA, 737 bp, Oryza sativa
  unsure (1)..(737): unsure at all n locations
gcgggnttttaaaactctgtctnnnnnnnnnnnnnnnnnnnnnnnnnnnnnnnnnnnnnnnnnnnnnnnnnnnnnctataacttattagccgctgccacctaaaaattaatcttagagttcattttgattttctttttcattgtagatgatttgctcacagtgatctgaccaaagaaatgcaaaatacacaaacaaaactccttgccattggtgcatataccaaaagaaatcatacggtttattcccatcaagccaaggagacatgtgcccaagtaaaaccaaactaaaacatgaactcgccatttataaaatcactcaataatgaacaggcaggggctggatttgaacaatcctatacaaaacttgaaggtaaaatgaatggcatatcgacaggacccgaataagcaatggacgagctcacactcaagagagtaccatagaacatcacaagtgaaatttaagtatttaacgatcctaacaacatttgggataacacagcatcatgcccaaacgattcagagcatttcaagcaccaggcagtaaaattgagccaatataaatggcaattacacagtgaactaacctaaacttacgaacgatgtacacgaaaaccaaaaactggtatttcagatgaaaataatctcgagttatgaacttaagacacatatgccataaccagccaaatttagaaatcaggtaggttttacttcagaagaaactcgcgggacagaacttg

SEQ ID NO: 105811 - DNA, 701 bp, Oryza sativa
  unsure (1)..(701): unsure at all n locations
ccgcgcccattganattgcgcactccaggttcgnnnnnnnnnnnnnnnnnnnnnnnnnnnnnnnnnctactgtttctaaatcaaatatggttggatcttctgaacttacaggagaaaatttggaaaaagagcaacggatcttggagctcaggaatcaggtttagtacacagctcatctgaatttcctgccacttcatctgcagtgcaaatgggttctgaacccataggttatgatgctttgagcttgcggcaaatgggttggaaaagccaatcgttttcttcttttttttttcattcaggaactctcaaattcaatcaatcctagctttttttttttttgaaataagcaaaaaggaatgcctgatatgactatatggagcatggagcagttttgtacgtacaagatttgcacaaggcacaatcctggttcgtgctcagatttgaacacaagatttatatttgtttccgtgtctctgacaggtcaaaatgcttcactggcgttggcaccagccaaatgatcatacataaaattccatgatgcgaatacaatcgtttatggttcgaaaatcgaaaagcttggattccgagagctccccaccgcgtgggatgcataactttgagtatctattagggcaccctaaatagctggcgggaatcatggccatagttgtttcctggggaaaatggtattcggttcccaa

SEQ ID NO: 105812 - DNA, 686 bp, Oryza sativa
  unsure (1)..(686): unsure at all n locations
ggcgttgtaatcatacaacnnnnnnnnnnnnnnnnnnnnnnnnnnnnnnnnnnnnnnnnnnnnnnnnnnnnnnnnnnnnnncattttgtagaatcagagaaagcaaaagacaaagacaaaactgttgtaggattgaaagaattttacacagtacacacactagcgaattctatataaaccaaagacaaaactgttttaagattgaaagagccgatgatgagaaaaaatatacacatctatcactgttgtgtatatggagtatatccaagaaaaaagagctgaccgaaaatccgaaattggaaagccatgacctcaatctcaactcctcaactgaacaactcaattagaagcacgataaactagaattttatgtttattatgataaattttatactaattaaacacgccaaaatgaagaacgtaacttaccggcaaatcaattagggaaatttcagaagaaaaaagaaaccctgatcgatcgacaaagagccctaacaatagtacgatattccaagaaccgacagagagatcatcacccagatcgagatttaattgcaagcaaattaaacagaaataactgcgagcgagcgaaggagacgccggcgaggaagagagaagcatatatgtgttggtgtgtgtataactgtatatacatgcatacttggtgctggcgaatttgaagagct

SEQ ID NO: 105813 - DNA, 527 bp, Oryza sativa
  unsure (1)..(527): unsure at all n locations
ccgcgccatagtatttgcctaacnnnnnnnnnnnnnnnnnnnnnnnnnnnnnnnnnnnnnnnnnnnnnnnnnnnnnnnnttaagcttggagaggctgctttatgcatttcgtatgtatggtaggtacttctaaaccaatgatctttgttgggttgagttcgttagcaccagtgattggcacttaaacattatccttctttcacctagcatttctttaggttctcatgggcaagtttcatttacagaatagcatatggcgttgaatactccgtagagcccccagtttcattgggttgatctgtcatggtcaaggatgttattaagcttggagaggttgctttaggcatttcgtatgtatattaggtacttctagaccaatgattttacttctaaaccaatgatctttgtgaatggacatgttgggttgagttcagtagtaccagtgatttagtgcttaaacagtataattctttcacttagcttttcttttaggttctcatggtaagtttcatttacggaatagcata

SEQ ID NO: 105814 - DNA, 565 bp, Oryza sativa
  unsure (1)..(565): unsure at all n locations
cggtgcattgaaattcctatgtctnnnnnnnnnnnnnnnnnnnnnnnnnnnnnnnnnnnnnnnnnnnnnnnnnnnnnactgttgggcaactgccataattaaatgtatttgaattctcaagtaggcatgcattcttaactatgcataacaccataaacagagtccatttaacatcatttaaattctagtaaaagaatagtaatataatattagttgagaaacataccgaggttgaagtcttcagcaactccctaatagccattgtagcataggaggatgctggtagagtaaatgctaattttatggccaatttccttgctaacatatctgagctaccgacagacttttcctctactaagccagtttcactacctggcatagagctatccaatggtcctgccaccttggaatcatgtgattgagcatttgaaatcgcgctagatatagtctcatttacttccttggcttttgtaggtttgtttctggacagaacatccaaatcagtttctgctaaagatgctgtgtcatctgtataagtcatgagttccctacagtcacaccaaag

SEQ ID NO: 105815 - DNA, 747 bp, Oryza sativa
cacggcggtctccagtacggcgggtgttgctggatctcccgcatggagggctcctcgtcagctcggtcctacctctttttctgcctttttggaaggaggtaaggaaagaaaagtttcctctggaatttcatactgcatgttatatctttgccaagttggtggtcttagtgtgatactgtgattaatttggaccgatgaagatatgtgtattgaatttttctttgcaagtttaaatcagtgtaacactatgaatgtgagcgtgtgaatgcagcttgtagtgaagctttgttgagcttacgcaaagcagagaagggcatcggcgcggggctcctagaggatgctgccacctccatccccttgcgtcacggccgtgctgccctactggtcctctggcacagcatctaaggtcatctgccaccacaaccaggttgcatctccaccgaatgtgaccccactttgatggcggcgagctttgctttggtagtgttgctgtcaatttggctgtgcatttctttaaggggttcatctacgatccattgtagcatgctgatgactttaaattacaaatgagttaatgcataagattctttgtttccaagtataagaaattgatatatcttttgttgaagtatgagtatgctgatttgttccagcaaaatatacccatgtacaatattttttgtggataataatttgataatgctccatccaaatgtagtcatgcatcttcatcaaaatagactgggg

SEQ ID NO: 105816 - DNA, 711 bp, Oryza sativa
  unsure (1)..(711): unsure at all n locations
cgctctttgaattcgtaatctnnnnnnnnnnnnnnnnnnnnnnnnnnnnnnnnnnnnnnnnnnnnnnnnnnnnntgcctccagttccaacttccaaatgatattcttcattgtgcactaatgagatgttaaattaaagttccattgcttctgaacgaccttacaaatgaatttactgtttagagccagtttaaggcattcttcagattatgtgggaatctgtgtaagcttctactgccaaaacagctgtgcaagtgtttaaatatatcgttttagttgagccttgtgtctttgatagttatattgattcttttttttttgtaaaacagataagaatcctgatattaattattgttcttccagtactacagtgttcaacgttagggaattatcttaaactggtgctctggtaaaattcgaaaggtacatatggctatgtgcctcataagaaactcctcaggcaatagggatgattcttgggagaaacaaggattttgttcctaaaagtcactcatttggtcttgtatagttgtatctaggtcatgtttcctcttgtttaattccctcaggtttcctcttgtttaatgctttctacatgattcttgaaatacatttttcacttttaactgctggttctacctcattttcagtggtaaaaccatgccagtacttccagntaatgtggntnggnattgttgttangtgctttgtg

SEQ ID NO: 105817 - DNA, 715 bp, Oryza sativa
  unsure (1)..(715): unsure at all n locations
cgacacagggcacaattctctactgcttgtacatgttcagagctgcaaaaaaatgacaatttgacctttcaagaaacttatttcgcaaataaaccgcgcacaaaacttatttcaaaaataaacagagggttcagcgccaaatgctccggcactgagcttagccacctcagtgccaggtcaaccggcactgaatgtcgtgccaccgtggatggcacgccgactcagtgtgccgacgtgtcaaagttcagcgccacccgactcggcgctgaggtggctaagctcagcgccattgtatttggcactgaaggggggaacttagtagctgtgccgagcattatggtatggctggctgctctgctagatctcagcgccaaataggttggcactgagtatggctggttccgtgccgggtggtttggcgctgagatatatttgacaggcttaaaactatgtttacttctgacacatttggagttaagtgaacacagcaaaaaatatgcagtcattcggttgataaccagtgcgcaaccaaagcaatgttgcgaagtgaaagtcacaactaagcaaaccatttaacatatatagaagcagtacttaactagagaacaagtcttagccatacatannnnnnnnnnnnnnnnnnnnnnnnnnnnnnnnnnnnnnnnnnnnnnnnnnnnnnnnnagaggttatacaggtnncgaanccaaagcgcct

SEQ ID NO: 105818 - DNA, 717 bp, Oryza sativa
  unsure (1)..(717): unsure at all n locations
ccgtgcattagtagattcgtnnnnnnnnnnnnnnnnnnnnnnnnnnnnnnnnnnnnnnnnnnnnnnnnnnnnnnnnnnnaggtggtaagtgttaagcgctgcatcagtggtttaacgatgagatgttctaggaatgggacgtgttgggaattcacatccaacatggaactaaaatcaactctcaattcgagatgccatgcttacgggttgtcgcatttggtgtagatttcatcgatttcattcctctacgattctaccactgtcattgcttgtgtgacttggggagccaaccctcttcccagcttcggggtgtatttcgatttatttcctagtcatgattgattcccagagctgaaacaattagataagagattttaaggtgttaaccctagctagccacatcatttccatacgtattacggttgaaagatgaattaagtgtacatttacttagacttaaggtagttgataggcctattcttcaatcatactccctccattccataatacaagttatccacgtattttaagattccacgtttaaaatattttgaccaaatttagtacgatataaatggaattttacttgctaaaagttatatcataggattgacatttgaattcacttttctatgnatataacttttgtaagtatattataggaatgaccgttgatcatgccttatattacggnataacaggagtatattgcttgat

SEQ ID NO: 105819 - DNA, 714 bp, Oryza sativa
  unsure (1)..(714): unsure at all n locations
gcgtgatataattgataactnnnnnnnnnnnnnnnnnnnnnnnnnnnnnnnnnnnnnnnnnnnnnnnnnnnnntccttgcttagctagcaagaggcacacagcacactacactctgctggtctctaggtgagatgcaacgagtgacagcaggagtgtggctcgcgaatcgggtttagttcttctggtctggttatccatgcgtggcgtggtgtcgtggtctatcacctctgagcgaatgggcgtccgccacctggacgcggtagatttccgttgaaaaagaagcgggcgtttgcaccggtgaagtgcaactcctgccactatcttagattcagaaatgtaacggggggtgtcaggttcaggaccacagattccaattctggagaaccagccaaccaggtgagcatggtcccatcagagtatcagaacgtagtagtatatatatgtgccaagaggttgcacggcgttcgacatgccaacatggacattggcttaacgaacaaactatatatcttgcacaagtgttttgatgggagtgtcattgaggttttttcatcaaggctttcactgaagtgaccatgaaaagatgtggttgttctttgctagatcccgaatacattcgacaggacacatgtgttcatgaacgatgacttcgacgaggctcattcgatgcaactcgatcgnccggcaaaacgaacaatatgcccggtggtaac

SEQ ID NO: 105820 - DNA, 717 bp, Oryza sativa
  unsure (1)..(717): unsure at all n locations
ccgtgcctttgagatcgtatatcannnnnnnnnnnnnnnnnnnnnnnnnnnnnnnnnnnnnnnnnnnnnnnnnnnnnnnnnnnnntttggtgattgatatttttatgctacaagaggaaattcatctcaaggtggagattgttaaatatgtgatccgaattttgggtccacaatatattcggattagttttctagtaggagccctattaggtgcctttcttttatcccctatatatactcttgtaagtcatacgggaaggggtgacgttcccattgtgatttccctatgtttataatcaactcctctatagtgatcattgccggtcggcgcccgtggtttttttccgcaaggattttccacgtaaaattcgtgtctccattgtgcatctatttccataataattttgtcaaaaatatattgtttaacagtttgaaaagtatgctaacgaaaaaacgaaaaagttgaagtttggagttgatcagaaaaagaattgggcataggcaaacccgcatccgcagccgtgcatgtggtggcgcggcatcagggcaccacgccggcgcttaaaaagatcgtgttcagcaaatcatcgtcgcaagacacacatatgtgatcctctcgaaatttgggttgatcctcagatttgtgtgaggataaaaaaaaacatttcgacagtgaatatcttaatngggatgtgcttcgattatgcacttgtaaat

SEQ ID NO: 105821 - DNA, 1391 bp, Oryza sativa
  unsure (1)..(1391): unsure at all n locations
ttcggtaccccaaaaatatttttattgtattatatattataataaaaatatagtcaaaatatattttaaagatcgtgtcattgttgaatatgtcaagaattataaaactggagggagtaaagatcactctacgtttacctcgccaagtgcctagtgcctataaataggataaccgctacttctctagacaaacccgcactccaaaatcagtaaaccttgaccatctcttccactgactactagaaatcggtgataaggagagttagaacatgtgttgctggttcgacaaaccaaatactagatatacactgagaatgggatgcatggggaattcgagaagaacttccgtgatgtgaataggatccaattgtagcagcacggctcactgtatttgatgacaatgtggttgtatagtcaaaggttgtgctacactgcccccatcccattttgggtgcataggctaggaagtggttggtgctgtcgctacctgtcatggattgtgagtctcacctcgatcgaccgagtccacatgcccaacgcttgtccacttccggccaaaacgacggccgaaaccttttaaggtgcttgagatgtaccagatggaggtacctccctcactacttaatcacccaccattgatcagttaagcacaacttaggaatagaaaacaatatattataaaagtcgataattaattccttttacatgtaacagtctctctctttttttgcatccggtttgttacttatcttcgattctgtcgttcacatcttaacacttgtccaaaatccaatttccctaattaattcttcaggttctcatctaaatttagagtccaaagaaacacatataatcctctttcgtccatacacaaagacaaatatggctcgatcaactagtttgatgaatctttgtatgtatacaaaattcttggtcattgtggatcatcagtggtggtggtgttttgtccgtgcggcacttgctgaagaaagatgttcttatcagcaagcagggcttatcgatcctaattcttttactgattaattagaaccccacctctaatatgtatgaaagtaaagttactaatctaaccttccacctaaacatcgagttaatacctaactcacttttttaataccttctgagacatacttcttccttccctaaatgtttgacgtcggtgacttttttaaatatgtttgaccatttgtcttatttcaaaacttttgttaaatatggaaaactatatgtatacacaaaatattttttacaagggatccaatgatttaaaacacttatattncctaattttttaaaatagacgacgggtaacatgttaaaaagtcacgtggtaacattagggatggaggagactttatacaaaccgtaag

SEQ ID NO: 105822 - DNA, 1447 bp, Oryza sativa
  unsure (1)..(1447): unsure at all n locations
acgagggaaaaaaccggaaatgagagtcggtcggtcggtagcgcggctatggacgatgacgggggtgacgaggaacgtgaggtttgcgttctttgctttgtggactttcttcccgctttccccttttcgttttacccgctgcactgcggctgtgcctgtgttgcatcgtgggatacatacatgggatcaatttggaaagctttaagattatgccgagtagttagtagtcaacttacgagaattcgtataggcggctgtgcctgtgtcgcgccgtgggatacgtacttgggacctgtttgggaagctttaagattctgccgagtagttagtggtcaacttacgagaattcgtataggatgggctttcgagcttctgacttctagttttatttttagcttctatagctatagattctcagaatctgaacgagaatatgtatcattggaggagttggagattctaggagaaactatagttgctagaagctctcctaaatagggcttgaaccagatgacggcggaggtgacgtgagattgtgagagggtatgtgagctgcttatcatgaaaaattctttgttttgtccttccatttttgtattgtgtttggcatgattttcaggtggaagcagatgcatctctcgtacacaagtcaagcggctacttgggctctgctgcatctatactaccaactgccattgatgtttgaaagaaagtgaaaagtcactagaaactaatactagtcgctcacaatcaatggcaccgctagcggcatcattgttttttgtatgtcaaggtagaggtgggttgtttttcattggcaactatgtgtacgtgattgtcataacaacctagtcctatattttattctatctattttctgtgtttatcaaaataatcacaatgttaggtttacatgaacactactccataatttcactattaagatgtgtatttttttagatgttgaacttagtccatgctaacactgataacagtttaatccatacatatgcagagagctagagatgttgcgtttctacatttcttcaatcacttgtaaataggtatgtgtcatgatagataattgaagtacaagcgccaaaaggattggtagcactgtgtgtctatcattacctatgtacttaaaaagattgtccattaatcctgtattatcaatgatatgttgaaacaaatgcttaggcaataattggtgtacaactagaaagtggtcatattccccaatagttatatgaaatatttattgggtatgaagtttgagcactggattggctttgtttgcgtctttgcctaattagtataatttataagtctcgntatccgataaactttagtttttcttctatttcaaaaaaataaataaactttgctttaagccaccaatatttctagatgaaaattgagaaccttcacttatatctacaatgac

SEQ ID NO: 105823 - DNA, 1175 bp, Oryza sativa
  unsure (1)..(1175): unsure at all n locations
cggccccttgantttgannaatgagaacctcatgcnnnnnnnnnnnnnnnnnnnnnnnnnnnnnnnnnnnnnnnnnnnnnnnnnnnnnnaacggaataggtagttacagataagattcaatcgtaaccgactaagatcccgagtatttccttaacatacaagtttggaatttaacccaagtccctttaaagatattctatctatacatggcaccccatacctagtcggattatacatgccgtgtaggtatggggtatccataatctccacagtagcccctgagacctttacagtcaacaaaatagttttctctcgtaatcccaaacgataatccgagcactccaacttcttctgccttggtctcccgagtatcaaaatcaaagactgtgaatggctgaaaatagaaaaaatcaggtgcatcgactagatgcacctaattaggtgtagcccccgactaagtgattagttaaaaaaactaaacatatagtcaaggtgtaaataacatccaaccgagtggttttacaaccgaatcatccaaagtatcatacaactaagcatatgagacgtttgataaaatatccagccgactgctttagctttgatataccaaaaatggaaatataaagaaacccgagtaaaaaatactataaggtccataatccaacacatatgacaagaatccgagtaaaaactctcaaaaagatccatcaaatgtgatataaatcgatgagtctaaataacctaggccatgactcacgtcataatcaaaataagcatataacatgccgagagaatgactattcaaaaaccagtcacctcaacaaaacccaaatagtttttgcagcctaaaaaggcctacaaaatcagtataacacttttctgtcaggcacctttttatttgcattgtagtaattccacagaattatctaactgcgtcaaaaaggattttaacagcattgggctatattgtcgtgagcaagtgttgccaaagcaaaaacaaatgcctaagcccctaaggatcacaacttaaccacgctgatagcaaaactgggctgaagtactgtttaggcccaggcccattagtactcccgataccctaatgagataacaccgaaggcatagcgtcgttttgtcttccccgccgaaactcttgccactttccctactcactgcta

SEQ ID NO: 105824 - DNA, 849 bp, Oryza sativa
  unsure (1)..(849): unsure at all n locations
tacccctggacttcatctcaaattccccgtgcatcctattctcagggcatcgcattgtcgaatcgccgagacaaacattttgttctttctcaccgctgcttttccacgtacagagaaagatgaacgatggccagggtttatatctactagtgctatagtagttctttaaagaggggtaggtgccgctagtttatttataggcacttgatgatgaggtacactagctagcactttcacaatgacacaccaactagatgagaggctctgaacgatatcattggcaagacaaggagttgaacttggataagcatgttttcaaatttatccacaaaacttatttttgtttaggacagaggggatagccgataattaattggaagtttggaactgacaaaccatggacaactcgcgaagacaaagaggtacgaagacagatgtgtacatttgtgcacaacatagtggctgtactgcatctagccacggtccatgacatgcagcgacatggctcaccctttcacaataattgaaaaaaaaatgaaaacgatgaatcatgtgaaaatagatgaaacacacacaaaatccacacaaaaaagcattgcattctgagaaggatcaaaattcagggaagaaatgcttatatataatgacttcaattggtacagtgtaccgtactagaattacacatagagtttcacaatatcttctgctcacccggtcatctggattcacgttcttctcaatttttttttatagaacaccggggggggggggggggagggggcttttnttgggttttcccaggtgggagatatcggaattgtttttggggaggccaatccaaggggaacc

SEQ ID NO: 105825 - DNA, 753 bp, Oryza sativa
aagtggtctgtatcttctgggcagctcttgcaaagttcacagttggcaaagagaaaaatttttttttgtgaaggttaactcgtgtgggcagtctattcattgctagaagcatccaaagaatttgactcttgaaggagccgagcttgtccagatgtaggtccagtgtggccaaacctggaaattttccatcatcttctggtataaggctaaagaagaaatcaaattgttcttgtgttttagactacactcaatcttgtcttcgcacaaagttagtgaggtgtgttgaagtaaggaatggagctgaattagctgttcttgggccgccgaagactgacgaggaacaaaagtcaggttttggtttagaccactttggatagcctcgttcttctcaatttggcaagcaaaagattgaactttgcaggttggagaagaacagagaagataaatctcgtctcgatgatatccccattcatccggattcacgttcttctcaatttggcgagcaaaagattgaactttgcaggtcaaagaagaatggagaagataaatctcgtcttgatgatatcaccaacaagacaatgactacggcgcaactattttatttgattggattagaaacagggttagcaatttcgttttgcacatttctaatgggactttcggaacagaaatatttaaaatttaaataaattttgatgagtttgaataaaattttaaccaaattcatagaaagtagactgaggggtaccgaat

SEQ ID NO: 105826 - DNA, 566 bp, Oryza sativa
ggtaccccatttaaaaaaacacataatgtatttttaaattttataataattaatacttaattaaccatgtgctaatgaaattaatcatatgataatgagaaaataatgagttttctcgtttcttatgcgctgaaaatatccctatgtaccattgaatcgaacggagtcgtcggcactggagggataggcacatctagttccgtatcggtgtgtctagcaagccattggaactcaccctgcagggatcacatcatgtggtgtgcatgtagaatgaactaaagcacagttttcagtggcagtgtgaatctgcgaggggctaacgtgagcagtggttgggtaactggtgccagccaacaccaatgctgctcatctcgaattctcggcacatcccattctcaaagacatttgcatcgttgaatcgccgagacaaatgttctaccctctcaccgctgctttttcacatatagaggaaggtgatggccaagggttacatttactggtagtgctatagttcttctcaacctgcgctagtttatttataggcgcttgacgaggtacactagcta

SEQ ID NO: 105827 - DNA, 753 bp, Oryza sativa
attgggcacccctactaaccaaactattatggccacttaattacataaatctgcccagcatcatttcttccgtggatgagaagtatcgggtttgaaatttggtgtggctgataagctaataaaccaacaatgtttctcagaagacagaagtgacagactactaattttctattcaagcttcaggaccgaagcacatcccaaggttttacatggagcacatgcgaaagttttcagacatgcatctccgatcggcaaatccaaataatcaacgtagaaaggacttaaatttcggccataacagaagtgcatatgcacacaatgcggacgtactctgctgagttttcctaccaatgagctgctgagatggtcaatgtcactctcatcggctcacagcctgacacacataccagaagggactgcagcaacgatcacttcccttgtcgttgctagagaacggaagggagttgtacaggactggaatgcgatcagctaacatgaactggaccatactcagatcgacgcagttcacctttgattccccatgaatcccattcttaacttaagggcatgctatcacttctcgtcgtcgaaccaccggcggtacgctgatttctcgtagaaatgaccagggttccgaattttgagtattgagcgatcagcgtgacttggaatattgagtgatcgagtgtgacttggaaaactagtgctattccattcaatggtattacaatggtgttgaaataggttcatatt

SEQ ID NO: 105828 - DNA, 707 bp, Oryza sativa
  unsure (1)..(707): unsure at all n locations
aagtaaaaaacgtgaagctgcnnnnnnnnnnnnnnnnnnnnnnnnnnnnnnnnnnnnnnnnnnnnntaatagtttggttagtagtagcgttcatcgattatttcaccatcgattgaaccgatgatcgtatcaatagaacagatcgatttacagatcatttcgaggccacaacaagattactttcacatgcttggagagcacactagaaacaagaatggatcatgtcacagctgaatcaaattgaaaccactcaagttacaacatccatttttgggcagcaaaaagaaagcaaagacagggaaatttttccacctctcaactaggctgtgaagagatttgcttccattcagcaagtctcccgttaccaaatctcgggccttcaacctgcctgatcggacggtgggaaatatgcggtacctccagttacatactttccaatgagatggtaccggctgtgttgagagtggtggaagtgtaattttgtcttttcacatagataagttttctccagctgaaataaccctagtttcgattccccttgtgtgtggtaacagcggcggctgcgaggtagcgaggtcccatggccgcaacttggtgatgggcgtatgtggctgcgaggtaacgagggcccgtggcccgcatgtggtggcagctgcngcggcaggtgggtgaacgaccatggcggcgacttggtgacaagcacggtg

SEQ ID NO: 105829 - DNA, 1343 bp, Oryza sativa
agaattcggtacccctctgggaggtaacaaaaattttaatgtaaaatttagataccctgtgatactttctttctcaagaactgtaaaatttatcaccaccgtgtaccattataatagcccgtgatactttcataagttcataaactgtctatagatagcattatattatattatattatattatattgtgcacttgaataaactgtacatgggttggtgtatcgcttaggccccgtttagttcgcgaaatgaaaatttctggatgtcacatcggacgtttgactggatgtcggaaggggttttcggacacgaatgaaaaaactaatttcataacacgcatggaaaccgcgagacgaatcttttgagcctaattaatccgccattagcacatgtgggttactgtagcacttatggctaatcaaggactaattaggctcaaaagattcgtctcgcaatttcctccctaactgtgtaattagtttttgtttttatctatatttaatgcttcatgcatgtgttcaaagattcgatgtgatgttttttggaaaaactttctggaaactaaacagggccttcaagttccaagttaatacccggcattcaatttacctgcctacaccttcaccaataaccatctatatgccttactccatattaagggcagagttaacatataaaaaaaattgaagccaggcatccttcctttatttttctttcttctttcttttaggatgttttctttgtaagatgacaagagttgagtgttctattgggggtccgatgacaagatgctctgagaatgggatgctttgggaattttagtcatactgatttgtcaagttatgtacactggaagcttatttagttcgatgtgcttgagattggtttgtgcgattttcttgctcaaagtttgttgcccttgtcaatttttgttttagcactacgaggagaggcttaacgaaaacatggtgtaattaacatagtttctacaataactatatgtgtatcttcttttttttcagaataaattcataattaagtctcattcttgtaataatatgattgggtaccggatattgtctgtgtcatttacgaaggcccgactgaaatcacagaataaccaagccgacctagttggcatggcacttaaagttcaccttgttattccacatgcctctgcaccttcatactccctccatattttaacgtatgacgccgttgacttttcgaacaacgcttgtcattcattttatttaaaatttttgtgcaaatataaaaatatttgtgccatgcttaaagaatttttgatgattaatcaagccccataaaataatgccattcct

SEQ ID NO: 105830 - DNA, 941 bp, Oryza sativa
gattgtacagtgtttttctatttggcatccagtaacgcatatgatattttacaaatgtacctgacttgtccttcagatgcttctcatgttctacattggatgcatcaagttttattgcaagctcactttgaatcttctacctaatgcttctaatatttaggcccttttttatttaatatgtgatgataaggtaatgcttagactagcatataaaagattggcttgattagggttctaaaattgaagttttctttgaaacgactaatgttattatttgctcttgccatagaagtggtttttcaggactcttgataatataactattggtttgggatgataaagcttcagtttaggacgatgagtgctgccctgtaggttaaaatcccattttaactaagttatgtattatttgactagcttgcactttcaccctcttcctttaaacatactgatagtatctgctcataaaattattgtgcttgctatgatttaggtattaaaatcacataccttttataatctatgtaaaagatgtacaaccagaaaccaataggttaacttgacagaattgacctttacaatcctacaataccgtccattccaactttctttgctaaataaatatgctgctgtgtgcattatttggttcacatacctgattattagaaaattactgaaaacagtttggattgtttacctgtttgtttttttagtatggataaatcattactttgcttttggttggtacctttttgtgccccccccccccctgctatttgagatgtttaattaatttcctcatattgggctaaatttgtacctgctggtgggccttcagttaattcattcacagattacttgacatcggcaattgctcttttgatcttacaatcttgatatatacaaaaaaacactatgtaacttgctttttcacatcagaa

SEQ ID NO: 105831 - DNA, 1209 bp, Oryza sativa
  unsure (1)..(1209): unsure at all n locations
gtggccccttgggttccctccaccttttgggccatttgccaatggcaattttgggtggagcgggcagctttaacccacccccccaccccaagcgcaaaaggaaaaggtcctctccaagagcaccgaccaagttgttgccgttctccacatcacgcaacaccggcaagaaggaaaaagctcgcaagagagtggagaaggtatattcagaaattagcatttaaactttcaaacatccctacacccatgcagaagcatcccaaaccagtttccaagcagaagcacatttaacaaaataggttcgtagttccacgacaactaagtgcacatagtgaaccgtgattccttcactatctcaacatatgcctcccattcggtctctccattcaactctagcatttgcttatgtgaaataggctctccccccatatcatatctatcttgaatggataccaccttgtccgaccaacccagaatatccttcgtacgacacaaaagctcctcgaaggtaggcttagattgaaaaacaatcatcttcaccgacatcccatcgaactgactaccaccattactcgactctaggacacttccaccatagtgcacatgaacaactctctccatctacaaagtccgaccacctttcaaagtaagtaatactattagtacatctatttcaattaaacaacgacaagggtactaaaagactaacttacacaagtaaaccaaactagacaatgtggcacaaacttcataccatcacattcattcgattcactacatactacatcgccaatgagaataaaaattcttcccaaaccctacattggaacctaccaaatccatcctaccaactagggttcagtaccgatgaatgaaatcccctcaaaattaacctatagaactcacctaaccgataaatgaagtcgatcttccttgtctcacaaaaacgacaaacctagggttcatgctcttctccaaaacaaatcaccaaatgaagaaaatataggaggattttgagaaggttaccttactccacaacctccacatgaaatcccctccaaatccccttgatttcccatgggttagagggggattagggctcggagaggaacgccgncatcgccgtcgtagttttcatggagccgggaaggggagagaaatgagagagctcgctctctcggccgggggcaggggggccttaaatgtctcgaa

SEQ ID NO: 105832 - DNA, 707 bp, Oryza sativa
atatttttgagctgcgggtctgcagcgcgcgtatacaacagggtgaatgccagatcagtttgccttggtgctgttcttgatccactccaggtacttggtgttaccaccagttatgggaagagcgataacagcaccaaggcaaactgatctctgagacagcttcttcacgggtcaacaaggacaaggatcatcacaccctgtcgacgaatcaccaggtgtgtcttagcttagttatcaaccaatcaacaaccggtgagtgtctggtaataattactgttaatttgcattattctctgggtcattggctgtgaccggcgatcaggttaacttgtttaattattaacttggatatgtgttaattaacactgtaaacattctggtatatatatgtggggtatcagttaacaacactcttgacattagatatatatatgcacttctttccatgtgattagttcataacacaaaacgatcaacacagtacgtaccctcatgttacgacatataattaggactaaatttgtttgcatatatgtatacacaatggttagaaccatcagtaacccaagttcagttgacaaattaattagactggataccgatatataccatatccattaaaaaatattttgaataaaatagttgtaagttttcattgatttgcctacctttggtttgaccaccactttttttaaggaatctaggtt

SEQ ID NO: 105833 - DNA, 530 bp, Oryza sativa
aggactagaatgtaaaatatagtataaatatagatggaatagagcaagggatggatgtagaagcatcgtgagaaattccccaaaatctccagtctccttctctcttatctcctagccttggtgctaatcgccccccaaaagcctacattaatctctaaaattaggtttaaaaaaaaacattaatctctaaaataatcaacattttatctgttacttttcatgtttattgattaaaattgaacctagtttatgtctagaacttgtgtttgaagtttcacaccaaacatatttgaattggcgaagttctaaagtttttgattaaatgcatcgtgttgttttaactgttcggcactgttgcgctacactgttcggcattgtagcatatggtttctttactgtgctaagccttttgctataaggggggttactttagtgtttatttagtaatattagaataactgtaatattagttgtttttatttccgctgttggttgcttcggtggtttgaaaaagttaccacgattactca

SEQ ID NO: 105834 - DNA, 528 bp, Oryza sativa
ctcatactcctcaccgcgatataggatacaatcgttcggacatctgaaaaggttatttcttttcctgtttgaaaaatatgcacaaacgctcattatgctcatcactgcatacatgcaagttatgactttattgtatcttcttattcctgtagattggaggcaggttgggttacaacatccgtggaattgtacaacaacaatcaaagcaatttgttgactatcagcatactgtccgggtgagtgataaaatttgttgactatcagcatttgttgaattctacaatggtaaacaacttgcatgagtttactgatgatgaaaaattaaaaggccattcttcaaatgtttgaggatgattttgtatctcgctgacaagatgagggaccttcggtgtactttttccacagaagaatgtgtgtgttgtcgagttgttgggcctgcgagcctagtgcggagtgggcctgaaagccaaagggaagcctgtagatgccatcgaaaatggaaacgaaaactttgctactcttattcgg

SEQ ID NO: 105835 - DNA, 874 bp, Oryza sativa
taagtcatgtatgctaagtgtaaatgtcgtacattagaaccctacacaccctaacgtgctaagtctaattacaaatcgtgatataagctaagtctaggtgacatatattatacaaccctagctagtaaataattatatactaagtctaattacaaataaaataatcttatattaaaactcaaataatattacatgctaagactaaaatagtcatgtatatgctaagtgtttcgtgcgtatatgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaaatctaattacaaataaaataatcttatattaaaactcaaataatattacatgctaagactaaaatagtcatgtatatgctaagtgtttcgtgcgtatatgctaagtcacgacacatttatgttttaccagtgtaagtcatgtatgctaagtgtaaatgtcgtacattagaaccgtacacaa

SEQ ID NO: 105836 - DNA, 621 bp, Oryza sativa
  unsure (1)..(621): unsure at all n locations
gccgccgnngattgaagaccctttgcnangcanccatggatgncnnnnnnnnnnnnnnnnnnnnnnnnnnnnnnnnnnnnnnnnnnnnnnnnnnnnnnnnnnnnnnnntttgccgttttgcgctgaaaaacggtcgtgcttctccacgaaagcgagaagattatcctttgctagtttgctcggaaactagtcgttcgtcgtcacgtaagtacgatatttatcctctttgctaatttgcttgtaaattagtcatgtgattccgcgaaagtgaattaatctcgaaatcggtttcactagccgattttgatctatcgattttggcgactctattgtttacaccgcaagtcgttaggtgatcttgtgttggccatgaaaaagcgtcaacaccgccatcgcgtcgccgtgtccaacacctccgcctccctctaccgccgccagtccaccgttcgccgcctccgtttcagaccaccgccgtcgccgtctccatctccgctcagtgtccgcctcgcgccactgccgcttccgctgttaccggccacctcccgtgcggcacgccgttaccgtcgctgagcgcacaacctccgctgctgtcgaccgccttatcgggctgccggcgttcgg

SEQ ID NO: 105837 - DNA, 519 bp, Oryza sativa
atctttcatggaaattctgtttttactaatgtcaatgacgactagttcttctgttggaaatgtacatgttgccttctcgtatctttgagaacatactgatacttgaatcatcatacttgcatgtagcagctgttatatgttactccctctgtttcataatgtaagtcattctaacatttcccatattcatgttgatgttaatgaatctagacaatatgaatgtgaaaaatgctaaaataacttacattgtgaaacagagaaagtatgtatattatgtaaaagtaagtatatactgctactaattgaaaaagacagtagatacttgtacgaactaattaaaatgagtacatatactatctactaacttaaaaaataagtatgtactactaacgaaaaatcagtatatactactaactaaaaaagataagataagtatgtagtactagctaaaattcagtatgtactactatctaaaaaaatatatactgctattgactgaatataagtatataccactcc

SEQ ID NO: 105838 - DNA, 615 bp, Oryza sativa
  unsure (1)..(615): unsure at all n locations
cccgctgcnnnattgaanacactttgatanacnnnnnnnnnnnnnnnnnnnnnnnnnnnnnnnnnnnnnnnnnnnnnnnnnnnnnnnnnnnnnnnttagaacatgatggttttccctttatcttgctcttggtcatttttggtgcaactataggtgtttcctcccccagacatggcaaggctacattcatgttagatggctcaggttggttggtatatcatggaagtacacctgcaaaatgacaacaaaaagcaaccttaactaaattttccatgatatacatacacaatccagttgctttttgactggcagaaattaaatattatctactgaattttcccttaattgccctaaatactaacatcagagaacaaactaaattgttgctttgcagtaatagaatttgaattacctcatctcttcatagttcctcctgaacacaatcgctaagaaactcgaagagacaagcttttcattctcaatttaatataacagaaagaggaccaagaaccgtaattgctatatctagctagatgcacccaacaaaatttgtcacacaaaacaaatctgaaaactacaatcatcattagtcactggatggtgaaaaagtacttt

SEQ ID NO: 105839 - DNA, 613 bp, Oryza sativa
  unsure (1)..(613): unsure at all n locations
cccggtcnnntttgataactcttgatatgcnnnnnnnnnnnnnnnnnnnnnnnnnnnnnnnnnnnnnnnnnnnnnnnnnnnnnnnnnnnnnnnaaattataggagtataaaaatattctttttggtgcttcagtcacgcgttacgacttacaaaagtgacagccaaaaacatctcagctaatcaagaataaatattaactagggggagttgtaatattgtaaaaatcaatagcctcattcttcagcaatcatgctatccttaaggcattataattgcagagaaaaaaaattagtcctttcacggcatagtgcaagaattctcatttcttattgccataaatgggatatcaaaagcatctttatttgatggtaaaatttgctccatgacacttaaaatttatgtaatttgctagtagacatcgcaaaaacgtgtcataaataaaagacatcctaaaaaaattggtaatttgttgtggattttttcggctcgtgagagaaattatttaaaaagacgagaatgtccctaaggtcaaaagcttttgagctaatactagagtgaagatggaattcaatgtatcctagtgatgtatttgaggtgatggtaaatttataa

SEQ ID NO: 105840 - DNA, 573 bp, Oryza sativa
cgttgaacccctttgaagacactatagctgctgctcagttattgctcggaagtatttggttcaaggtgtgccccaacctacttttacatccacattgtaacattgttactcaatgggaagtcttgggcccatcgatgccacaggtgtaattagctatcctgtgaaaaggtgtattggatcatgcttgaagaatgatgactataagaacttattgtaactaggtcaatccgaaacactttattaggacaattatagaatactggatctgccactatattttctattaatttagaatttgatacaaaattagttaacggtaattatgcatacaacttgcattgtttctttgatgttccatttgggatgcaaccatcaacttcctctgttgttacttagaattccaactataaattcttgcgaaaatgctagtgattgtatgacatgccttcaatatggccaatgctttcttgtaaaaaaatgtatatggccaatgctccaaatttagtatgaccttactatggaaggtaatgtaaactaaacttaggttaatttcatcctcaaccacacattcaa

SEQ ID NO: 105841 - DNA, 610 bp, Oryza sativa
  unsure (1)..(610): unsure at all n locations
cggtgnnntttaancccctttgatanacnnnnnnnnnnnnnnnnnnnnnnnnnnnnnnnnnnnnnnnnnnnnnnnnnnnnnnnnnnnnnnncataatgtatgcaaaattgttagatgttccaagcatgctttcttaaccaactaattagtgcaccggtggtgtaggcgccttcccaatggtgcatgatttagtgaaagcaagggataaccactttgttagagtcaatttcgactcgtgatttgtcctctatagtcgtcgtttggaactaccccatctataccagagatgcctgtccaccgttatgacaggttagttgtagcaactgcacatttgttgtgatatttcattactcatttactctagcaatcatgtccagggtttacaattttgatgaaccaaagtttgtaatataggaaaatttaaggttaatgattctttgagttgtggtaaaatttctccccttttacagggacctaagcaagaataacttcatgagctcaccagcaccgggtgatgggtttccaatagtaacatccctaaccaccttgtgagttgtctgatgacataaaaactggatatcaaatggacttagtaaggtacatcacaatt

SEQ ID NO: 105842 - DNA, 526 bp, Oryza sativa
aactactccattcgttttcatattgtaagtcgttttgaattttttaatgctaaacttcttgaaattagtttcattgaatataaattaattatattttataatttccttttttaaattgaaaatattgccatagttttttataaatctggtcggagcttaaaaaaaggttcacttagaaaaaagttaaagcgacttataatataaaatagaggtagtatatcacacccatacagcaagaaaaagttaataagtgaaaaaatgataaatggattaaataatggagaaacaaaagacgttcattaggaatcttgtcctgctctaataaatttgtacattaaaatatcaataaattaatatttttaaatgaaaagtcggtagatgaaatgaactttacgaagtggaaacaaaacgtgcaactaaaaatggctgaaaatgaaaaggaaataccaataatgaagaattgaaaacaggttatttgcagcacagaatctggatcgaatgggaccactgacaatgagaaaaaaaa

SEQ ID NO: 105843 - DNA, 603 bp, Oryza sativa
  unsure (1)..(603): unsure at all n locations
ccgctcnnatgaaacacttgctnnnnnnnnnnnnnnnnnnnnnnnnnnnnnnnnnnnnnnnnnnnnnnnnnnnnnatcccctcgtcccctcatggtagtcactcccgtggaggagcagccacctcccgcggccgacgcatccacattggaagaggctgagcacgccgcggccgcagccaccgagggcgagggcgagcacaagagtgttatgcctgtgccggatgagctactggcaacgaccgaaggaggtgtgccgaactgaagacgtactatgaaaagacgttttcgagtggctatagcgtattgagtctatgcactgatttgtgacactggcttgtggggccaagggttgttgagtcgggtgtgtgttgtataaatcgccagcctgtaggtatgtgacatctatcgaaaaggagaaagaaaaatactacccgtcctctgcttctctctttctttctattgctctgttttcttcttcctccctactactcggttcctatcagatctccggtgagcatcgccaccggtgattggggtcgtaacaattttggtatcagtcacttacggtcctgcttgctccctcgcactctcttgacctttgaa

SEQ ID NO: 105844 - DNA, 572 bp, Oryza sativa
  unsure (1)..(572): unsure at all n locations
cgatgcnnnttgnnnnnnnnnnnnnnnnnnnnnnnnnnnnnnnnnnnnnnnnnnnnnnnnnnnnnnnnnnnnnnnnnnnnntgaaacatatacctcatttctttttaactttagaccttacaaccctaatccacactggattatttaattgaaatcgatccgcactgagtcaactcactcccgttctaaatatgtatccttgagatataatagggttgtttgtttttgttgtgacttataacttaattttgaatttaaagagggggggtgtgggtttgggttgtttccattattttttatttgcctttgggccgaagagtaggagtataaaaaattgtactctcagaacttgtttttcgtatatgtctatggtttataagtcactgttcaaaaaattgctttccgtgaaagcctgttatacaatgtcatgaaaccactaagaaaagtatggcatttctataatccaaatgggaatttcatactctccattgtaccttttctcaacaatcaacagccatttttcaatacattcgtcacaaccatacgcggccattcgctgaaccacacaagag

SEQ ID NO: 105845 - DNA, 604 bp, Oryza sativa
  unsure (1)..(604): unsure at all n locations
gcgcgcgttnnnnattagatacactnnnnnnnnnnnnnnnnnnnnnnnnnnnnnnnnnnnnnnnnnnnnnnnnnnnnnnnnnnnnnntgcgataccatggttaaacatatgattagaggccataattatgtgcctgagcatgataacaagtaatcttaaacacttgcctactcactgttactcatgctgcacctttcactaagaacagactttaaagaagaagctattacactcgggttcggcctaaatggnntttttttgggntttttttttttttttttcccccttttttgggagctcactctttactttcatgcacaacagcttaccttgcacattgaccacacattgacgagctcaactctcctatatagctctgcatggaaagcgcatgctactctttgtaggctgactaantcttgatctgtgcacagattttgaaagatgatgaacctcatgcgcatgcatgattgatatatgaagaacaatacctgctgcatgctgagattattatcaccgggttagaacttccagctgattgactaatcaagtgagatggtatgtactcactgtatttgtaagtattgcacgacagtgactactc

SEQ ID NO: 105846 - DNA, 586 bp, Oryza sativa
  unsure (1)..(586): unsure at all n locations
ccggggntgnnaagtaggcccacactttgcannaangngnngggagntntnnggatccaagnttatngatttngaacgaatacgagtactgttcttttggatgtcctccttgaacctaatcttccaaggaatcacccctttcgctcgtgttcatcctggatgctctggagtctgcagggcgagtgacagctcgtccctctatctgtccggtcgtgaaacagtggtccccctttaaaaaaggggaaaaaaagggtaaaagggggggggccccccttttcccactgngtgtggtagtcaacgcgcagtctcttgtatctgatcgccnaaaaccannnnnncnnnnnttnnnnnnnccgcgccgnaagagcatagnnncatanntttttttggatctcctagggcgttctggatctccttatggnnnnntnaannaagctngncttcatntnctnccacttnggnntnnnaacnctatanccgcctgaccccaaatggtgatggnacttcttcttggcgggattttctttgtttctttccattatcgcctggcccttgtaacctgtcttatatgcaacgaactcgttcc

SEQ ID NO: 105847 - DNA, 977 bp, Oryza sativa
  unsure (1)..(977): unsure at all n locations
tgttagataattctaaagatatatcataaaaaacaatcttacatgggagcatcgttctggaaaaggaggcaaaaaatcatagaggataataatggaattgcttatagttctcagtgactcatatatatttgaaccaaatatattatgtgtacgtggttaaagcatgtggttacaaaaaagaaacaaaatatggtgataccaagtaaaattttattcaatatatatactatttggcagtgacaactgacaagtaatttgagataacattttgttgctaatttatatatatatgtttacattttttttgaaacaacatatgtctaaatttaattaaatccacttttataaatacattaattaaaatatacatgagcattgtagcatggttgattttctttctcaaaatacatattttgagtgaccaagcatttgagaaatcaaatactctctccattttttattataagtcgttttgacttttttcttaatcaaactttgttaagtttgaccaagtttataaagaaatatatcaaccattccaacataaacatattcaaaatatattaaatgttagttctgatgaaactaatttggtattgtagatattactacaatttcccacaaatttggacaaagttaaataaatttgactaagaaaaaaaatcaaaacaacacaatatgatatggatggagtacttagtgttctcttgtaattctacaatttacatgaacaaagaaccatatcatttttttgcgcacacaaattgtaatagatcttttttatgccttacaggatgaccgcagagtgatagagactaaacaatgatgcactcaaggactaattaatttttttacaacgatacactcaaggactaattaattttttttacaatgacacaatgtgcaattgtnnnnnnnnnnnnnnnnnnnnnnnnnnnnnnnnnnnnnnnnnnnnnngatttcaatggggggggggg

SEQ ID NO: 105848 - DNA, 560 bp, Oryza sativa
tgcgtctaggaaaatcgcgattttcttgtgcgggtggcgcaaccgcacgcgaaaatccgattttcgcgtgcggctgcttatgccgcccacacgggaaaataaaaatccaaaaaaaaaataaattttcaaaaaacacaaaccctaaccctagatccggatccggcaccccaccgccgcgctggccaccaccaccgccggatccgggcgtggggagggcggcgccgctccctgccgtcgcctcgccgtcgtcgacggtgttggccgcgcggacgctgccggctgccgcctcctcctgctctcggcacacgtcgtcggcccgctcctagccgctgcctcgccgtcgtcgtcgtcgtcatcatcggccgcgcgcacgctgctcccagccgtcgtgagcccgccgtgcccacccgccgttgtcacaagacctacgcgcccaccagccgctgtcgacccctccgtcgagagccgcccggaggagaggaggcgtcggcgccatgcacagcatgaggagaaagtgagagagagagagaggaaaatgaaaggagaggaaagtgagaaaa

SEQ ID NO: 105849 - DNA, 628 bp, Oryza sativa
  unsure (1)..(628): unsure at all n locations
attgaaatcganatcnnnnnnnnnnnnnnnnnnnnnnnnnnnnnnnnnnnnnnnnnnnnnnnaatgatatttattgagtaatccatttcctcagttcccacagtaaatttccttgtgtcaaacatgtagaatcaagcaagcagcaagtgaaaaatgccgaaggcctgagcttattggacatggactcaaatcattcataaaactaattgaatcaagttacatgaagataaggtggaggggtatgacgattgctatcaaaatctgaaccagagaatccagcattaggttactttcaacctaggctgatgcacaactggttcatcagtcattgcaccagcgtcctatatcctccacccgaagagttgcaagcaacaaactaatatatagaggagcagtcagtagaaagttacatctaaagaacatgaaaagatacatgctcatgcaagtcataagttacgtctaaagaacatgaaaagatacatgctcatgcaagtcatactgcctcgacgttagctcattcaacatcatacttcacaacataccggtatctactatttgtcttcacgctatatgatcttatctcctaattttctcatatgaatcaagcatcccaaatccatcaggtatt

SEQ ID NO: 105850 - DNA, 632 bp, Oryza sativa
  unsure (1)..(632): unsure at all n locations
ccccccccccccttgnnnnnnnnnnnnnnnnnnnnnnnnnnnnnnnnnnnnnnnnnnnnnnnncgatgaattgaagctttcagacttaatatcggttgagcagcaagaaggagaattggctatggaatatattcaaagatttcgtaatgtccgcagccgatgttatggtttgagcctaagtgatgagaaactagcagatctcggattccaaggattatcagcatctataagagagattcttttgccacaagtttggcagcctggctcatctaatgcaaaaagtcctagctcatgaaagccgattgcaagaagcaaaggaagatcagttttggagttatcaagacaagaaataagataattttgaagcatgagttttcatactccaaaactggggggcatgtgttaacgccaaaatttggtatgccccaaggagaattatcgcatcgtaaatagtcggattcgtactatattcggttaaagaaattaatctatcgaaggaagcttatccagaagtgacagagtttaaggaggatgcggcatgacaagttatctattaattaagaataatttgttagtttccttttatctttaggaaagtgtgtttagtgtcctataaagttatgttttccttt

SEQ ID NO: 105851 - DNA, 841 bp, Oryza sativa
  unsure (1)..(841): unsure at all n locations
gctaggtctaattacaaatctaataatcttatactaaaactcaaatagtgatatatgctaagtctagatgacgtatattataggaccctagctagtcaataattatatactaagtctaattacaaatataataatcttatatcaaaactcaaataattttatatgctaagactaaaatagtcatgtatgctaagtgtaactgtcgtatattagaaccctacacaatcttacatgctaagtctaattacaaatctaataatcttatactaaaactcaaatagtgatatatgctaagtctaggtgacgtatattataggaccctagctagtcaataattatatactaagtctaattacaaatataataatcttatattaaaactcaaataatcttatatgctaagactaaaatagtcatgtatgctaagtgtaactgtcgtatattagaaccctacacaatcttacatgctaagtctaattacaaatctaataatcttatactaaaactcaaatagtgatatatgctaagtctaggtgacatatattataggaccctagctagtcaataattatatactaagtctaattacaaatataataatcttgtattaaaacttaaataatcttatactaaaactcaaatagtcatgtatgctaagtgtaactgtcgtatattagaccactacacaatcttatatgctaagtctaattacaaatctaataatcttaattgcattacaaatataacattcatatannnnnnnnnnnnnnnnnnnnnnnnnnnnnnnnnnnnnnnnnnnnnnnnnnnnnnnnnnnnnnnnnnnnncattcaacaaactctg

SEQ ID NO: 105852 - DNA, 820 bp, Oryza sativa
  unsure (1)..(820): unsure at all n locations
gggttgtggtgattttgtattatttttgggtgtgtggtggttgtatgaaattatttatttgccttnnncgttgttttaatanctatatttttatatcnnnnncncncnnccncccggtgggtttgatgggatgtcnntgcnacnnncannnnnnnnnnnnnnnnnnncncnccncnnnnaannaaaaaaaacnnccccagggggggggggtgggggggtacntcttttttttttttcccccaaacatctataaattgtgggggtggggggggttgttgtgttgattgttgtgtgtggggtgtgggattagagaattatttgggtggggggggggggaggggaattttgttggggggggggtgggatgtgtattttgttgcgggggggggggagggaggtatgggtgggggggggggggggggggggtatgtgttgggtgggggggggggggggacgatagtttggtgggggggggggggggggatgttatggttgggtggggggggaggggtattatttgtggggggtgggggggggaatattgtaggggggtgggggggggttagaggttatgtgtgggggggggggggggagattttgtgttgggtgggggggggggggggttttatggtggggtggtgggggtggtggttttttgtggggggggggggggggggggtttttatgttggggggggggggggagtaattggggtggggggggggggggggattatgtgttggggggggggtgggggagattttggggggggggggggagcgaatatttttggggtggggggggggggtggaatatttgt

SEQ ID NO: 105853 - DNA, 786 bp, Oryza sativa
  unsure (1)..(786): unsure at all n locations
ggcgaagaaaagatgggggggggggagggaaaaaaaagaaacagggggggggggggcaanaaatcttttctttcccccccccccgcgggatgatgcgacctcgnacnccnnnnnnnnnnnncncnccccccaaacaaaaacaaaanccacgggggggggggggcaactttttggtgggcgagaaaaaaaagggggggggggggggaagaaaagggcgcccgcggggacaaaagaaagaaggcggggggggaggaagaaaaaggggggggggggggagaggaaacggcggggggggggggaagaaaccggggggggggggggaagaaaagagggggggggggggagaaagaggggggcgggggggaggaaaaaaacgacgggcgggggggagaaaaaaagagggggggggggggaaaaaaaaaacggggggggggaaaaaagaggggggggggggggaaaaaaagagaggggggggggaaaaaaaagcggggggggggagagaaaaaaaaggggggggggggggaaaaaaagagggggggggaggagaaaaaagagggggggggggggggaaaaaaaagagaggggggggggggggaaagaaaagggagggggggggggggggaaagaaaaagggcgggggggaggagaagaaaaaagagggggggggggggggggaagagaaaagaaggggggggggggggaaaaaaaaaaaagaagggggggagggaagaacaaaaaaaaccggggggggcggggggggaaaacaaagaacgggggggggggggc

SEQ ID NO: 105854 - DNA, 618 bp, Oryza sativa
tatgccatcactggactcatgatatgaaatgtaatggaacggggatatatgctcttccctctgaacagttcatgatctatatggacagtgtccgacgcggaaaaatggagctctgctgcgatggacctgatcgtactcttacgaggaccaatgactcccatttccatgattgcacacttgaatgtgtagttggcagcactctcgacaagcctatgcgccctgcttgatgcatcatggagaacgaaaaaccactatgtacatgggacctctacctgttaccacatggacttgttgaaaagcactagaaggggttacagcaaggctcagactgtatatatattgtggcgacgtactattgatttgtgtacaactgtccgactcctgatgatcggatcaagaaccgacgtgcacctggctgtgagatgttgctcaagatgactgtgcaaaatgcgaggcgtccatgcgaggcctctgctatctggcgtaaaaacatcatacctggactgacctcactgattaaatcagatcccagagtcgtttgtgtagctaacatggataccacctggacctggaccttaatcgatatctaggaacatttgcgtgattaactctataggt

SEQ ID NO: 105855 - DNA, 696 bp, Oryza sativa
  unsure (1)..(696): unsure at all n locations
cgcgcgattgatatnnnnnnnnnnnnnnnnnnnnnnnnnnnnnnnnnnnnnnnnnnnnnnnnnnnnnnnnnnnnnnnntacgctctaatcgggctcaccgtgcctaatcatttggaaccatcgttgaccctatgccatacctactgtctaggacataaatggacaggcttcgtcagggcaaaatggagctatgctcgcgacctcataacactaactcgtatgagggatacacactccaaacacatgaatacacacttgcacgactatttatcagatttgtggaattcatattcgagccaattgatgcataagtgaatacgagaaacctttaaagtacagtgacatcctcctaatccgacatggaaacggtgacgatactcaattgagtgtcttaagttgcgattgaccttttatcagatcagagtgaccagtgaactgcctacaaccgtaacgcttcctaatagcagttcaatacctttcatgcacgtacctgtaagatgttgctccagtaatcggtgcaaacagggaggcagttaacggatggaatcggcgaactatacgaaacaccttgcgcccgaggacttacacaatcgtgaaaggacagataacacaggcgtatgggtaacagacagaaagagcacatgggcgcttgcggggcaggtttcctatggaactcgcgttgacgcgcgcattatt

SEQ ID NO: 105856 - DNA, 695 bp, Oryza sativa
  unsure (1)..(695): unsure at all n locations
cgcgcgcatnnnnnnnnnnnnnnnnnnnnnnnnnnnnnnnnnnnnnnnnnnnnnnnnnnnnnnnnnnnnnnnnnnnnnntacgatcttatctagctctccgagcctttacatttagttcaatagttgatccaaagccagtgctattttctggagcacaagggtacatgcttcgttgggactagagggatttacgacaggacctctgaacataatcagaatgcgtgtactgcacatttaaagagatcaagacatgggagggccgactctctattagccataggggcactcttacgctgggcccattgagcgctagttcgagatcggaaaccttttaactaacagtcaaaatctgacgactcctgatgtgaaaactgtggcgttacccatctgaatctattaacttgagattcacctttgatcagatcagcgtgtgagatattatgctcatatcggtagcgcttgcacttggtagttgaatacgttcggtgcgtgaactggaaatgtctaacttcataaaggacaattgtcgagtggccaattaaaagctttaacgataaactattcggaaacctagcgctcgagacttaaagtatcttgaatggatatataagcgaagagggtggctttcagagagaagaggcaacatagcggttggcgtggaggggtcagattaagcacgcgttgacgcgcccat

SEQ ID NO: 105857 - DNA, 701 bp, Oryza sativa
  unsure (1)..(701): unsure at all n locations
ccttggggaaacattatccatccctggaagatccgctggttctttgcaaatctgatttccgcacggcaagttaatggtcacggccatcggcatgcatattgccagtcgcatttgtcgggcaggtaacaaacaggtatgttgccaaatacacaacggccttcggtgaaagtgtggccgttcccctaaatgaagctggcaaggtaactttaccgcttggacaggaggcagtccacccaccgagtgtaatgtccgatggcccccccagtcggcaaacaagtctatccaccagacgctacaggctaatatgttgcgtggtgttcagaccgtaaaccactatgtgcgagggtgtagtcacggccatgatgccgccttctttcatagatatgcctacaccatgtttgaagtatgcaacacagggtggcaagcaatatggtatcctgaccagcacattttataaccccggctgcatgttaggccatccacacaccaagcttaatagatgactccatcgagtaccagaaatatgcaatccaaacaaagagatttggcatcccaccctcgacaaggacttttcccagcacaatagaccaaactcgcatgccacataattacgtgtcttcagctcaaaacatnnnnnnnnnnnnnnnnnnnnnnnnnnnnnnnnnnnnnnnnnnnnngcatgcgcctttcaaatgcgcggc

SEQ ID NO: 105858 - DNA, 609 bp, Oryza sativa
atccctgcaaaggagttgtagcatagccactggtggctgctgttgtctatgacgagttaccaatagtcttctggcccagtctccaccatatagaagggaacgaaatgttggatctatgtgatacatattttacatgctcaatagcttgatctacctggattacctagagccctgcagggaaaacctagatttactcaaactcatgcaagcatgctagctgcatgaagtttggactgatgaataaaatgaagtgctggatcaagtgcacctgcctactgttaacttggcatgaaaagaggatacagccttgcttgtggaagagtacatacttataagctgatttttgctcaaatctgacctctattaatgcatggggtatgatggtactatttgcttttaatatcttgctagagtacagatctaataggctaagcctaaaggaagtgtatcacccaagaaatatgtcgctgtttgatgactgaaagttagagcctactatgtaggcaaaaactatgatccagatagaaagaattaaattttgggacaactacacggtgtacacgatttctcgagtcttgaagagcatgccacgtccttaccgatttgacc

SEQ ID NO: 105859 - DNA, 700 bp, Oryza sativa
  unsure (1)..(700): unsure at all n locations
cagcgattgggggccctcataaaacctcaacttatgcaacaccgcctgggtgcttaccgaatccaaactcgcgagttcgaagtccgccaatggaaaanatttgttgcatagtcactctcacagtctgttgtcttggcacagtacccataagtctgttggtccagtcaccaccacatagaagggaaggcaatgttggatccatgtaagacccattttacatgcacactagcttgatgaagctggatacgagtgtgccctacagtaacagcctatattttcgcgaagtcatccaggctagcgccccgcatgagtatggtgtgaagaatagaatgtaggccgtgagcgagtgcacctgcatagttgttatttcgcatcaaaagagaatacagccttgcttgtggtagattagctccataaaagccgagttttgcgcaaatctgtcctctcttaatgcatggggtcagatggtccaatttccgtcaatttttctagagagtccagttttaaaagccagagccccgagcagtgcgagcacccagcacatttgccgagcatgttgccctcgaagtaagcaccccactcggtaatcaaaaccaatggttcacagaataaagactgccgtctggtaccttatacannnnnnnnnnnnnnnnnnnnnnnnnnnnnnnnnnnnnnnnnnnnnnngatttcaatcctcgcg

SEQ ID NO: 105860 - DNA, 697 bp, Oryza sativa
  unsure (1)..(697): unsure at all n locations
cgcgctcatttgaatgnnnnnnnnnnnnnnnnnnnnnnnnnnnnnnnnnnnnnnnnnnnnnnnnnnnnnnnnnnnnnnnnnnnnnnatctctgtacaggagttcttgcatacccaagggtggctgccgttttccacgacgagtgagcaaaatgcctgcgggccactctccactactatgatgggtccgaaatgctggaactattagattctaagcttaaatgctcaaaggatagatgtacgtggatgaccaagagccttcaggagataactgtgtttactgagaactattcaagcatgctagctggacgtatttggcctgattcctaaattgacgtgctacttcaagtgaggctgcatactgataacttgacatggcaagggaagacaacattgcttctggaagatggaatactgttacgctgtctattgctcaaaactgacctatattaattcatggaatagaatgttcatctctgcttttaatttcttgctgagatcttgtataataagccccgcctccagttagggtaagacgcaaggcttatgtggatatttaatgactgaaagctcaggacctactctgtagagatcaaatatgatcctgactggcatggattgaacttttgtgctgctacacggtgtgccgcaattatcgagtgctgagaaacatacccacctcctaacgatttgacatat

SEQ ID NO: 105861 - DNA, 695 bp, Oryza sativa
  unsure (1)..(695): unsure at all n locations
cgcgtgnattatatagatcataatcactnnnnnnnnnnnnnnnnnnnnnnnnnnnnnnnnnnnnnnnnnnnnnnnnnnnnnnnnnnnatcgtttcgagagtaacttttaattccgctaaaagttttgatttgtgagtacctcaaccattcactagtttttgctggcgaacttacagacctgtaatctactgagcggaaccaaggatccttgatcccagggccctggagtgaaatgtccctaacgaatacacaatctcacgatactcgatcgaacagcacacagatgaatatcgcgcaagaacttgcattctactaaccaggatttctctccttatatgagtactaaaaagaagaggccttgaagccaacgattgcgcacccaccaacgaggaattccacaacgagtactaccgaagggcattccaccacggggccatcaagggcagtgccaaatgggactgcggcagaagggagaaccaccaaaacgctaaccacgcagactacggtagagcacgctactggtgaggaagtaagtcgctgtcaagaaccaccatgacgtcaaccaccacatgttgtgctggatcatatcggccgtgatgaaagacctcgccgtcaagaaccaccacggcaccaaccacgaagtgcgtctgtggtgaggaaggaccttgtcgtcaagaatcaccacgacctcaatg

SEQ ID NO: 105862 - DNA, 685 bp, Oryza sativa
  unsure (1)..(685): unsure at all n locations
gacggattgatgacgaatcctatgctnnnnnnnnnnnnnnnnnnnnnnnnnnnnnnnnnnnnnnnnnnnnnnnnnnnnnaaatcgtcgccgcgcgccgttgcttcccgcgcgcacgcgccatggtggccgaccggccagtcgccgccgccgtcagatacaacattaagcaacacttgacagatgatgggatcagccaggcctgggtggccgtttgaaagctgttggccggatgtcaaccttgatcaattcaaaagactgataccttgaatgcacggcgtaactaatttggagccaaattagtcatgggattagctttccggccggatagaacatagtacagaaacgagggtaagcctcactacaccggattaggtcacctgtgatgggtcctaaccatcacctttgaagggccggtttgggcctagtcagagactaatggtcactgttgagtctcagtcacctttgatggtgcccgttagaggtatcaatcacctctgatgggcatgtatttcatgcccgttagaggtatcagtcacctctgatgggcatgtatttccgagcccgtcacaagtgatgatgaccacaccgcagtccgtggttgcaaccccacaggtgacttatctttgaggctgtgacgggtgcattatattcggcctgtcataggtatatcatctttgacggggt

SEQ ID NO: 105863 - DNA, 727 bp, Oryza sativa
  unsure (1)..(727): unsure at all n locations
ggggggggtggggtgtgggtttgtttgtttttggttatttgttttgtttattgggtttgttttattttttnttnnncccnnccaggggatgttggttgtgatggnaacnncnnnncnnnnnnnnnnaaannanaccnanacaaaaaaaaaaaaanaaaaaaggggggggggggnccccacaancaccaacacaaccaaaaaccaaaaggggggggggggaggaggaaggggaggggggaacaggaagggagggggggggagggggagaaggggggggggggcagggggggggggggcggggggagggagggggggggggggggggggaggggaggagggggaagggggaggggaggggggggggggggaggggaggggggggggggggcgcgggggggggggggggggggggggggcgggggaggggagggacgaaggggaggggggagggggggggggaggcgacgggggggggaggggggggggggggggggggggggggggggggggggggggggggggggggggagggggggggggggggggggggggggggggggggggggggggggggggggggggggggggggggggggggggggggggggggggggggggaggggggggggggggggggggggggggaaaaggggggggggggggggggggggggggggggggggggggggggggggggggggggggggggggggggggggggggggga

SEQ ID NO: 105864 - DNA, 730 bp, Oryza sativa
  unsure (1)..(730): unsure at all n locations
cgcgtgcttgttgatacnnnnnnnnnnnnnnnnnnnnnnnnnnnnnnnnnnnnnnnnnnnnnnnnnnnnnnnnnnnnnnnnncctcctagattaagcaatagatctgatcatccttacacatgcgtcagacataccaggattacataaacattacttaatgggaaggatataaaaccaatacgacaccggaaccgtctcaaaaccttaagatcagaccacacgggcttgctgatactcacgtatatcaaacgtttgacttacctgaacctgactaacaaaacttattggtccacgtaaggtcggttactattaaacgagattctccaccaattttgttcaaaatctctctatgcatcttttcaatatcattaataaaagggactatgcttgcgcctatactttgtaagccctccctatttgagttgcttattaagtaccaccacatttgaaaaagcaccaggtgtccgataacaaatacgcgtcatactctcacagaaactagtgggcaagaccgcttattcccttttgatgcttgttacggcctgatgtcgcaaccaacagcatatgactagaaatataggcaatgacctaacgttgttatgaacacattcacaagatagatcttacatactcttggaaataagagatactctatacgctggcaccatcttccgccggtgaagcacaagcttttttggtcccaggaaactattataagggttgtagccc

SEQ ID NO: 105865 - DNA, 694 bp, Oryza sativa
  unsure (1)..(694): unsure at all n locations
gcgggattgaattggcttgatannnnnnnnnnnnnnnnnnnnnnnnnnnnnnnnnnnnnnnnnnnnnnnnnnnnnnnnnnnnnnnnnnccatatgcggatctgagcttacaaccttcggctacagtcgggagtttaaagcacagcgggtttgccgcggctatgaaccctaacctacgttatatgcccgcataatgtgtcaaactcgagccgggaccgaaaggtagccacccatctagaagtattgaactctcttaattgatcaggggatagtcactcctgtaagcatttagatacggcgacctagggaaatgggagacgccctctgagatcgggcccacacagttagccggttagagatgtttacccaaaacctgattagtgaatactccaagttctgatctaccagtgatctctctattcaggcccgagctagacgagctgcaacacaccatagagatgagcctatagcacctgtgggcatatttaccctcagatcttcgtctacaacacctagtgtccccacccgattggattgatcagattcttcataataaggacgatccgtcagcatcgacttcggtccagtcatgaaacgacgatgatatagagttctctgttctagcgtgctggttgaccgaccacaatgaaaacgagatttcggagccgctcactacatcgtaatgcgcacgaagg

SEQ ID NO: 105866 - DNA, 740 bp, Oryza sativa
  unsure (1)..(740): unsure at all n locations
ccgcgtttggatgactnnnnnnnnnnnnnnnnnnnnnnnnnnnnnnnnnnnnnnnnnnnnnnnnnnnnnnnnnnnnnnnnnnnnnnntctgcatattctacgtatgaaacatgtctcaagggtcattccatgcttaaagggaggcccctcaatctatacgcactgccgatagcccactaataatcaagctaatgctgaacgatacatatcctaatcgaactaatctgtacatactttcttctcaacatgatctgactatggctatgcacatttttacccacacaactttactgtctgatgaacttgcaactttatttttccgacatacaagcgtgcagtacgtaaacactgatgtcgtattacacccactacattggatgattatgttgcgaccgtatttagactctcagatgtctttgtaattaccaaatagagtaactcataataatttcatcaacgatcctcttgacataagaacttatgaagcttgcctcagcatctcgtggaataaaagaacgtacatatcatggggaggcactctgatgctgaccggtgagaccgaccggggctagcgattccgatgatgtagcaggcgctactaatctttccagtactaaatgttccagaccgtctgacatgtactatctgtatgagcatccgtgctacttatagggactatcccggatgttagactatatctgttcattaccctttattccccaagtatcaaatgtctttaa

SEQ ID NO: 105867 - DNA, 1280 bp, Oryza sativa
  unsure (1)..(1280): unsure at all n locations
aggggggggtaaaaaaaaggggggagaaaatacggggggggaaaaatcngggggggcgaaaaagaaaaactaaaaaaaaaaaaaaaagggggtgatggactcgataaaaancnnnnnnnnnaaanaaannncgaaaaaaaaaaannnnaaaaaagaggggggggggacgggtttttaaaaaggaggggggaaaaaggggggggggggggaagaaggagggggggccgaagaaaaagggggggggaaagaaaggggggggggaaaaaagagggggggggaaaaaaagagggggggaaaagagaggggggggggaaaaaaaggggggggggggaaaaaaaaggggggggggagagaaaaaaaaacaggggggggggggggagggaaaaggaggggggggggaggggaagaaaaggggagggggggggggagaaaaaaaagagggggggcggggggggagaagaaggggaggggggggggaaaggaaagggggggaggggagagaagggggggaggagggaaaaaggggggggggggggaaaaaagaagggggggggggggggggaagaaaaaaggggggggggggagaaaagagggggggggggggaaaaaaaaagggggggggggggggagaaaagagggggggggggggggaaagaaaggggggggggggggaggaaagaagaaggggggggggggggggaaaaagaaggggggggggggagggaaaaaaaaggggggggggggggggagaaaagggggggggggggaagaaaaagagggggggggggggggaaaaagagaaaggggggggggggggagagagagagaagagaggggggggggggcggggaagaaaagaagggaggggagagggagaggggagaaaaggggagggggcgggagggagagagagaaaagggcggggggggggaggagggagacgagaaaagggaagggggggcgggggcggaaagaaacgaggggagggagggaggggaggaaaaaaagaaggggggggggggggggggaagaacaagggaggggagggaggagaagaaagagagagggggggggggggaggaaaaagggagggagagggggagggagaagaaggagggagggggggggaggaaagaggggagagaggggggggaagagaaaaaaagggaggggggggggaggggaagaaaaagagagggggggggggagaggaaaaaagagggaggggggggaggagggggaaaaaagagaggaggggggagggggggaagaaaaaaggg

SEQ ID NO: 105868 - DNA, 949 bp, Oryza sativa
  unsure (1)..(949): unsure at all n locations
gggaaaaaggggggtggaaaaaagggggggagataaaaaaaagggggggggggnaataaaaaanaagggngattttnaaaaannaaaaaaaaaaaaggganntgatgganctggagataccaaannccaannnnnnnnnnnnnnnnaaaaanaagggaagggnanaannaaaaaaanaaaggggagggggaggaaaaaaaattatttttttaaaaaaaaaaaaaaaaagggggggggggggggggaaaaaagggggggggggggaggagaaaaaagaggggaggggaaaaaaaaagggggagggggaggggagaaaaagagaggaggggggggagaaaggaagaaaaagggggggggaggggaaaagaaagagaggggggggagagaaaaaggaggaggagggggggggaggagaagagggggggggggggggggagagaagagaggggagggggggagaaaagaaaaaggagggggggggggagaagacgatgaggggggggggggggagaaaaaagaagaaggagggggggagggaaggaagaggggagggaggggaaaaaaaagagggggggggagagagaaagagagggggggggggaggaaaaaggaaagggggggggggggggagaagaaaaggggagaggggggaggaaagaaaaaggggggggggggggagggaagaaaagagaggaggggggggagggggagaaaaagaaaggagagggggggaggggaagaaaaaaggaggagggtgggggggaaagagaagaagagggggagaggggggaaggacaaaaggaggggggggggggggaggagaaaaaaaaagaggaggggggggggaaagaaaggaaaggaggggcgggggagaaacgaaataaaaagagaagggagggagagagagagaaagaacgaggggagagggggggggaaggaaagaaagggg

SEQ ID NO: 105869 - DNA, 704 bp, Oryza sativa
  unsure (1)..(704): unsure at all n locations
gactggnatttgaatggcgattcannnnnnnnnnnnnnnnnnnnnnnnnnnnnnnnnnnnnnnnnnnnnntgtataatgcgccactcggcaagctctattctgtgaactattgattttgatagcgcatagacttgcctcatggggaaataacgagatcgggcccatgtgctggcagctcaccctgctcggggctctgtcctatgggactagactctatacatacaactgaccgacacttgcccgaacgaccccatgcattaggtcactattgtatggcaacaagccgggccttcattgacataatctaccctaaaaaaggctgtactcacttttgtgcgaaaataactactatgaagatgcaggtgctcagtctctaccttgtatacttagaccatgctcatgcggggctctagacaggagtgttgggctgacaataaggctattacagtagggcacaatttaaaccagctttatcaagcttgtcctcatgtaagatgagtctaacatgggtacaacaatgccttgcattctatctgatggtgactggaccaatagaattatggtgacgctgactaagaacacaggagtgggagagtgactaagcaacaaatctgattcatctgcggacttgctagtagctagtatgtattcagtacagcaactaggacgtggtttcataagttgagtttatatgattgcaccc

SEQ ID NO: 105870 - DNA, 698 bp, Oryza sativa
  unsure (1)..(698): unsure at all n locations
cgcgtggntttgaattgcnatacannnnnnnnnnnnnnnnnnnnnnnnnnnnnnnnnnnnnnnnnnnnnacccctttacctgaaggaacgttattatgttgccagcaaggtttttcttttgtgctgggaatgggcctagccggggcgggcatgccaaatctctttgctaggattgcatatatatggtgcgcgaccaagatatttataaagctcggtgtctgaatgacctaaaaggcagcctgggttataaaatgtgctggtctggatgccttattgattaccacccatgtttgcttacttcaaagaaggagaaagcatattgatgaaagaaggcggcatcatggccgtgactgccccgtggcaaatggaggcatacggtcggaccaccacgcaacatattgaaccgacgcgtcaggtggatagacttgtgcgcacgaaggggtgggacttctgacgatacattcggtggctggactgcctccgtttcaagggggatagctcccctggcatctttatctacgaggccgcccatacctccactggaagggattgagcgtgtagccactattctgtttggtaacccgccacttcttgcaacgggcaattgctatcccatgtgcataacattttacttgggggcagaaaatcagctttcaactgaatccgaggagctaccaatgaagaatatatggtccaca

SEQ ID NO: 105871 - DNA, 655 bp, Oryza sativa
  unsure (1)..(655): unsure at all n locations
gctggcncnnnattggttagcgtcgcgagcaccccgcnnnagaatagaggaattcggcaccccaagaggggaaaacgagaaagaaagaagaggaaaatgtgacattgacatgtgggtcccatatgggtgagtcagccggttggaccgagtcaaagtgccacgtcagcgaaaccgccctccaaaaccgttgagggagccaaattataccggttttaatagttgagggagtcattctacccggtgttctggttaaagggtatgaattagattcggcgtactttgaaggagtcaaactggactttttcctttagttgatagacgtgggctggtgacctcttctttttcgtggtgagtgggtcgcgatggcctcgcagcgacgcggcccacgtacgccactttgactcggcttcggtgtgccggcttgagactttggcttgacgacgtacgtccgtcgcctacgcggcgggatattccgccgcacctcgccaatatcctcctcctcctccctgcatggagatctccggagcttcggctgttggattcttgcgcacggcaccctgcttttcacggtttttgtgttccatgagtgtacgcagcgccataagacgaaactccagattgtcacagttagctgttgagaatatagaaaaactac

SEQ ID NO: 105872 - DNA, 555 bp, Oryza sativa
  unsure (1)..(555): unsure at all n locations
taagttggcctttaatttgtcgaacaagcggagctttgtctttgccacgtgacacctatcctctatgaaatcaattggctaagctcatgaaagatatgtagtggggggtgagctcaaggaagatggtagcggggtgagctcaagaggatgggaggatggcagtggacatgccaatccactgctgcttgtagctctatgttcactgaccgcaactacgagaatccatccaaaatttgtatgagtgatgcccgatagagacagagttggtttgtttgatagtcataatagccctccagccgtcagctctccaccacctgtgtcatcctcctgccatcgtctctccgccacccatgcgttcccctactctcggctctgtgttgtagtcttcttgacacgtcctcacgtcctcgctcttctccgtttgccactagattgacacaactgcacttctgtactgtgtcatcctcctgctattttctttatctctctcannnnnnnnnnnnnnnnnnnnnnnnnnnnnnnnnnnnnnnnnnnnnnacgatntcaatnntccaa

SEQ ID NO: 105873 - DNA, 1624 bp, Oryza sativa
aaccaatggttgtttttcttccaagcccgaggagaggctctaccgccggcgcgttttccctacagccatgttcccggccggccgcacggtttccggcagcaggcttcggcggtggcgaggcagttgtggcgatgtggggtggcggcacaggcggctagggttttgcccccgagccgtccgtgtgagagcagtgcgagggagacgcgttgtgttttcaatatcttcttggagtactatgtatttactttgatcacaaaaatgatatatctaaatgaatacattttaaaaaatatttttaccttcccttgaagatatattacaatagaacttaaagagtcaaacatatagtgatggaaaaatgaaaccgttgctcgtggctcatatcagatcagatcaacttgaactcgtaattataatggatagagttaagttaggtttttatctcatcaacttataatgagccagctcacgagctactcatttagctcgctactacacaaaatcaccatattaattagtacttaacatttcttgctttattttcttaattatagtggctctctccacctccatgaatctgaacacattccttgctttatttttcctctataatagcctaaaaatgattaggttttatatagttgaattttcaaagtgtcattcaacttatctttagtcctcggtcgtctagtcgacagtttcgagtctctaatagttggtgtgttgacttccgggttgaaatctacaattgtaactatttctttgtgtttagttaccgattcgtaatatttagattgcatttacctacttcttgcagtgttttatcttttgcattgatatgatcattaaccatgtataacggttggtacgacattatttgtggtgtagtgattgcacgatgttatagacttattatggttgataacaactttaccaacatgatattctatcaaagcaagatttaatcccttactataagattgggccacgagagagcgtcatcagtgcttggactcatataccaaacgagttatgtccaaacaaagttgatctataccaaccacttcttgggatgggatccatctgttgatcatttaatagcctgggagcataaccacgataatctaccctcgattaagtcagaagaacatgaattatatccttgcgcgttgcagggacggatctacactgtaatagtcagggtacttaaagtgcttattggtagaagataatatcgtgatttaagtataattataattagtacgttatgacaccagcaaattcactatggcactggagtgtcaattttgtggatcaaccaatggcacattgcacatacgcaccgtgtattgggagaacaatatctccacaacttgtgtcttccgtttaaaaaaaaaactttagtgtgtttgaataattggaaatgaagagtgggattgtgattgaaaaatgaatgaagggttagaattaaatagaagagggattgtttaaagatatcttttggtgcgtgagaaattatttttctatcccattagccaaactgggcctttgtgtctctcttggtccagcagagtagtgcagagttcttggaagcagtggcggaggcagcgtgggggctgggggg

SEQ ID NO: 105874 - DNA, 1095 bp, Oryza sativa
  unsure (1)..(1095): unsure at all n locations
ctggtcnttnnttcggaaaacggtgcgactncnnnnnnnnnnnnnnnnnnnnnnnnnnnnnnnnnntctgcttcgtcatcggtcgctccgtgtcgaggtatcgatcgatcgaccgacggggcgagatcgatacaatcgatccgggtcgaagagagagagagagagagtccccgccttcgcgttcgagctcgtcggattcgcggcggagagaggagggaggtgtgtgtcgaggaggcggggaggaaggcggttatttatagttggaggaggcgcccggggcgggggggggggggggagagaaagagaagaggagagagagaagccaagagcgcgacgcgaatctatgggcgagggccccacactgtggtgccacggcgtggggcccagacgggtgtccttgggtcccaccaccacacacaacacaagtacagaacccaccccggccggccctgtgccgtgcccgtgccgtgccgtggcgttgcctcgcccagcccaacactccagtaatacggtgcggcccacgctagcttagctttccccatgctttgacactgatttattaccacgtagtacaccgccgcgacgacctcgatcgagtcgaaacgctcgttacaacgatgggaaagggttcgacgcggccggcacaacgacgaaaccagccggggcgggcggccactgccagaagggacacacgcgcgcggggaccggacgaccagacgatgggcgcgcgcgccaggagcgagggacgcgtgtgcgcggcgccaccaacacacacaacccgcgcgcgcggcccttgtgagcaagccgtggcgagaccgcgcgtggcggcagcggtgtggtcggtctctcgtcccgcgcgcatggacacgtaccctnannnnntnngtntttttttttttcttcctttcttttctctgtctttctcttcctctttttttcttcctccctcttcttctttcttcctcttcttcttttcctccgtgcccactccttcttatctttttcgcgtcttttgttcgtctcgcctccgctgtctagtttttcgttattctgctactattgagtcacactacactcttgatatcgctttcacct

SEQ ID NO: 105875 - DNA, 510 bp, Oryza sativa
atcgtctgccgatcgatcgatcgatcgacagagacgacgctgctgctgatcctttcaccgtgccgtgcaggaggcagccacagccacggccaccaccagtccacctccaccacccccgaataaacctctggatcgctgcctgccccccccccccaccccccctgccactttccgcagcgcctaatcatgcgcgctgcaggccgctgtctgtctccacgcccccccgtacaccaacgcaccgcacctcccccggacaaaaaagccacttaaaacggtgcaacttgtgtttgcgtttgcgttggccttggcccttgtgattgtggacgaataatcaaaacctctccttccctcttctgctgctgctactactactggtctactgcctttcgcctcgccttcctcacgttggatcccgtggagttgagactgattctcatggaggcttaagttgcggtctcttgcacctgcttcgagtttgccccgcttgatttatataaaggggtggttttc

SEQ ID NO: 105876 - DNA, 634 bp, Oryza sativa
  unsure (1)..(634): unsure at all n locations
aacacagagccgagagtaggggaacgcatgggtggcggagagacgatggcaggaggatgacacaggtggtggagagctgacggctggagggctattatgactatcaaacaaaccaactctgtctctatcgggcatcactcatacaaattttggatggattctcgtagttgcggtcagtgaacatagagctacaagcagcagtggattggcatgtccactgccatcctcccatcctcttgagctcaccccgctaccatcttccttgagctcaccccccactacatatctttcatgagcttagccaattgatttcatagaggataggtgtcacgtggcaaagacaaagctccgcttgttcgacaaattaaaggccaacttaggtaggaggcggttgtgtaagcggagcttgcagcggaggagctcgtggatgaagtgacggtagaaacacataggtgaaagagatgaggacgttaagatggtgccatgccccgcaagggtgctgacccagattgccctacaataagaactcaccccaaacctcacttctcatattgtcatcaagccatccattgtgnnnnnnnnnnnnnnnnnnnnnnnnnnnnnnngacgtgtcngacgcaacgttaacgcggct

SEQ ID NO: 105877 - DNA, 533 bp, Oryza sativa
ctggaaggtgttttcggacataaatgaaaaaaactaatttaataacttgtctggaaaccgcgagacgaatcttttgagcctaattaagccgtcattagcacatgtgggttactgtagcacttatggttaatcatggactaattagactcaaaagattcgtctcgcgatttatatgcaaactgtacaatcagtttttctttttatctatatttaatgctctatacatgtgtccaaagattcgatatgatgttttcgtgaaaagtttttggaaactaaacagtgacttagggaatactccctccgtcccaatatattagaacctaggatgggattagacctatcctaaaactatgaatctggacatctttgaaaaaaattacgtaagcatatgttggagtgaataattttttaaaaaaatcttcatctatctaaatagtctagattctcacaaaatttgtattatagaatttaaaaattaaactgaagctagaagatacaagaaaatccagtagtttttctatattctcaacagc

SEQ ID NO: 105878 - DNA, 640 bp, Oryza sativa
  unsure (1)..(640): unsure at all n locations
ccgacagatnacgtgtatggtggtgacgttgtgtgagtaatgagaggtgttaatcagtgcacgttagaaggaaagaaatgtaaattatagagtagtacgaagcttgactgcttgaggtattcctagacattcaaaaagaattaactgaaatttaaagagaaatcgaccgttgactgatgaaatagcaagtccaattaattacgtgtagcattagaggactgctcgtggtttaatttgctacttctctttcgacaattgatggcttagacttggacgtcgattgatgcttagacaagcacaatgtacattaacggtgactatccccgtatagtaggagtatatagtacgatctggatcgaatctttgggtgttctcttttgagcccaatcaggtaaagcagctagcacacacttgcgcctttgtacgtcacaaaactaagagcgctagctagtgagctacggtgtagctagtcatggtgatatgtgactagctagtgtcgttgtgagaaggtgactcgatggatcagctgggtcgatctcatgcctctctcatgaatgtacgtgcattgcttgaatattcttcttgtacaaactggaattaatactgcttcaaagttcaaattaaccggtcgagttacccc

SEQ ID NO: 105879 - DNA, 718 bp, Oryza sativa
  unsure (1)..(718): unsure at all n locations
acgatgcccttctgtgnannnnnnnnnnnnnnnnnnnnnnnnnnnnnnntccctaaggatgccgctgtcgagctcctacacctaggccagcaagtcatcgtgagagagataaagaaaatagcaggaggatgacacagtacagaagtgcagttgtgtcaatctagtggcaaacggagaaaagcgaggacgtgaggacgtgtcaagaagactacaacacagagccgagagtaggggaacgcatgggtggcggagagacgatggcaggaggatgacacaggtggtggagagctgacggctggagggctattatgactatcaaacaaaccaactctgtctctatcgggcatcactcatacaaattttggatggattctcgtagttgcggtcagtgaacatagagctacaagcagcagtggattggcatgtccactgccatcctcccatcctcttgagctcaccccgctaccatcttccttgagctcaccccccactacatatctttcatgagcttagccaattgatttcatagaggataggtgtcacgtggcaaagacaaagctccgcttgttcgacaaattaaaggccaacttatgtaggaggcggttgtgtaagcggagcttgccacggaggagctcgtggatgaagtgacggtagaaacacataggtgaaagagatgaggacgttaaaatggtgccatgccccgcgagggtgcttaccc

SEQ ID NO: 105880 - DNA, 2065 bp, Oryza sativa
  unsure (1)..(2065): unsure at all n locations
cgcgtgnnatgtanncactaagaacnnnnnnnnnnnnnnnnnnnnnnnnnnnnnnnnnnnnnnnnnnnnnnnnnnnnnnnnnnnnnnttggagatgttctgtaatatgtgatgatttggatatgggaggggatggtgtgaaatcaatattcaatattaaaagcagaaaaaaaaagaaaaaatatctttagtcccggattcttagtcccggttgaaaaaccgggactacaggggggttacgaaccgggactaaaaagcatttctccaccaatgtacggttcaaagatgattttgtaactcgatgataagttgagtgaccttcagcgtactttttctgcattttttttgtcacgttaggtgatgaacatgggccctatttttctattctcaataattaataatcctgaaactgaataagtggtaattacttgtactttctccgtttaatctggattcattaacatcaatatgaatatgagaaatgctagaatgacttacattgtgaaatggagggagtagttgctaagatttcgtaaaatataaggtggacgctgtagccaaaagcgtccagctgcggatgctgttgcggagtggtgcgagctagctgctgccagcgtgctcgccggccggtgagcccatacgaaccagatctgaggatgttgttgcatgaatgcctttatactgctgttgaattgttgatgattactcgactcaaaagaatccaatctagttcaaatccgttgtattaattgtgttccatccaagtgctaggttagattttttgaaacagagggagtatgatgctagctattgctgtccgtgttttgtttgctgttgatgcatgcatgctagtgctgttgttgatgaatccgaggaaaaaaaatcatttctaaaccattctatttatgtcggtggaacggcttttatgcgggtaattttctttttcttttgaaaaaaaaatattttttagccgggtgacataaggacaccgcttatgaaaaacctatttccacatgcggccgtcttcatctatccgtttgcaaaaatagctttttctaggtgagcggccatcctcctgtgaagatataatattttcgcatgcctttgcttacaagcggcgtgtgtgaccacctgcaaagagcaattttggccgcctgcgaaaattgcttttctagtagtaacaatagcaaaagggagactccaaattgtatttggatctaccaaaattaaccctttcattcattattgagtactctctccgtcccattttaagtgcaaccataagtttccgcgtctaactttgaccgtccgtattatttaaaatttttttagaattagtattattattattattatgagatgataaaacacgaatattactttatacgtaacttatgtttttaaattttttcaaaaaaatttcaaataaaacagactgtcaaagttgtgcacggaaaatcatgtctgcacttaaaatgggaaaagggagtagtaatttaaggttatatttatgaatttatgataaaaaagtatgctattaaaaatatgtactcagtataggtaaaatgcgctactaataatacaaataaaatatcatttccagtatgatgtctaattaagatgaatgaacaatgtttttttttcaaaaaaaacttatgtactttctttaaagtaaaggtacacaacgtacatgagagaggaagtcgacacatataacttccagattgtagaaaagaccctaagaaatgggcaaattaaccttataacacaaaatatgtaaaagaggacttaaaaaacttaaaaagcaatcggatcctactttttccacaggaacggcgagccatcttgtgccgacgtcgatggggaggatgattccatggcgagctgcaaaggagagagccgaggagcaaacccagtcggggcctccgcagtggaggttgaagctaccttggccaaacaagaaaaccacagctgcccccagaagacgaaaaaccgaataccaaggaaagaacaccgttcttctgtgttggtcaccagagaaaagttggacggccgacataacctct

SEQ ID NO: 105881 - DNA, 640 bp, Oryza sativa
  unsure (1)..(640): unsure at all n locations
tcgtggnnnntttgatttgtgtgcatgtnnnnnnnnnnnnnnnnnnnnnnnnnnnnnnnnnnnnnnnnnnnnnctcactccctggatcttcttcccggccacggggcacttgggcccgctcgcagatcagttcactccaatcaagctgactttagcgagcccccatccgattaaatgcacccttgctgtccttctttgaagaactccctactcactgccaaaaagataatagtaccacgtgtttggggcatctgcacacaagattttactgttgtgtattcttgtgaaaacatggcttgttgacaattcttgataattggttgacaatctctgttcactgttgtactagctatttgcccagaaaatctatttctggaaccttggactatgagttatgctgaacaatgtttgggtcgtcaacatcgtgttaattaggatagtaagctaggttggtgggggttaactaaattaaatcctagtgtgagtgcacctcttaattttctgccatgtaagatgagatgacatgaaaagatttgagttggaactctgtagcttgtcacatttctggcaatagaaataggggctgccaagcccttgctaaaaaaactgaaaagacttgagtttggggtgtaagaaacac

SEQ ID NO: 105882 - DNA, 808 bp, Oryza sativa
  unsure (1)..(808): unsure at all n locations
agcgtgaatttgtatttcctatnnnnnnnnnnnnnnnnnnnnnnnnnnnnnnnnnnnnnnnnnnnnnnnnnnnnnnnnnctataaactttaggtgtataaactttagatgcataaaaatactatatatagaaaatatttgaattcaaattcaaatttgaatcggcttggtagtactcgtaccctataacaaatatcttaggaaaagatgtaatgtagcgaaatatttgtgaaaaaactgtaaggagtattttgtgaataaagaaatctatctttgacaaatgtctcttactctggatgtcatgtgtaagagtgcgttctcagttaacgactttagtcagccgtttgagtcgtacactctccctagcccccagccttgtcgtcggaggaattttctcagaggataaagctcttggacctttggcctgccttggttgaataagctctgatcctagcccccacccgtgaagttggaaagttgatttccgatttcacggcttagttaatacgcatggcgagaactcttacacgaccagatcttacatggtctttcgtctctacaggatctgacaaggccttatcggctctgggcgtccctagccgaagatcccttaggttcctcggaggccttgtcgagacggcgtaaagggacataaggacaggtttcaacgctaggtgtcatcacagtgagggatcatcgggcgaaacacgttgattgtgatatgggcctagaaatagcctttattgatactgtaannnnnnnnnnnnnnnnnnnnnnnnnnnnnnnngggactccacgttacatggcgg

SEQ ID NO: 105883 - DNA, 1011 bp, Oryza sativa
  unsure (1)..(1011): unsure at all n locations
cgaacgcttnnaaattgatatnccgcatcgnagatngcnnnnnnnnnnnnnnnnnnnnnnnnnnnnnnnnnnnnnnnnnnnnnnattttgggaggaatccaatcctttgaaaaattttcctatatggtcatttgtataaatggaatagctatgcaaaaatcctgggcaattcctttcgattggctcaaaacctcaaaacatagaaattttggaggaataacataagcttcaacctcttggaataaaaaccctttgtgaatatctcttttctggttctagcatttttctcacgtcattcatatagtttttatgtcttttttttttcaatccatgggatttgaggtgtaagggcactttaattctacattttttcttgtaattcctgttttaagaatcatgcgttccaaaggagctggccgcagcccgtggtactctaagacctccactgtcaatacccaaactaacctaagccgtatgatctctgttctttttagctcatccacgggattattgaactcacgcttcgaaaaatacgttttctcgaaatcctttttttctgctgcactgtttggaccacttattttaaactatctgttaactttattttagaaaatatagtttatccctttaatcaggtagataatccacgacaacaatccacttaataatctaaatcaaaaggggcttaagaaattccattgttgtaatttgcactccaaaattctgtggggttgctggaattgtaacgtgagctatgagtgcccgccttgcaacttttccttttgttggttgtatcattccaaaccgaatggaaaagggaggtcatgggggccaaattccggcttttattgacaacaatttatatgctctaaaatttactgcatgtggccggccttcaaaaaatgatcaaaaaatttatagaaacacgtcttgtttaattgtcctnnnnnnnnnnnnnnnnnnnnnnnnnnnnnnnnnnnnnnnnnnagcagaatgtcaacaatnaacacc

SEQ ID NO: 105884 - DNA, 720 bp, Oryza sativa
  unsure (1)..(720): unsure at all n locations
gctggctttgatacacnnnnnnnnnnnnnnnnnnnnnnnnnnnnnnnnnnnnnnnnnnnnnnnnnnnnnnnnnnnnnnatgcttagcatgctgagggcaccacttttttgtgttatcacttggacaagcacaatacggaaccatccaacatgtgtgtgacgcacgagggctgagtctggatacgctgaattcgagtcgtgaggtaccgtatcttggtgcgaatagactacgggcactcacttggcttgtaaagaggaaaagggaacctagagcgactcttagaaaacaagagctatctatctgagaatgcatagccgtcttgggagtggagcaccatgattatgttggggggttactttgtgactattagcgtgagatatggtacaggtaatctgatagcaggacattatgctagagcgtacactctaaagattaaggaaaatcacttcccgacagactcagaagactcagctgctagtttttactctactcgcagtttttggtctatcgttcttgaccggtatcacatcattaccgtgagctcatcaatgaactaaaccaggaaagcatcgagcggatctgctgcatgatgagcacaagcatctgaggagggcagggatctgtagcaggagactacaggtgtagaagatagaagcggccatcatttaactggaatgtgtgactggactgggtgagatggnaacggggtaccataccagg

SEQ ID NO: 105885 - DNA, 735 bp, Oryza sativa
  unsure (1)..(735): unsure at all n locations
cgcgccccttgtagttccttttgctnnnnnnnnnnnnnnnnnnnnnnnnnnnnnnnnnnnnnnnnnnnnnnnnnnnnnatttagagcttatcatctttcgacctcttcctacgggtggcggatggaggagggttagattaataaagactgcctctgcttgtatcgggagttaatttgctagagcgttcagctcttggcgcgttggaaacccccacttattcgacagagcggtctagctaaaggaacaatctactgttatacactccacgttgacacagggtcccctaatgtagagtctactatgcattatcatgaaacactttggagcataagcagaactgttaattagactgaaaagatggtaggggatatacttcactgcgtgcaaggcttatagacgcgtgtacacgtgggccgagatcacaagttcaataacagttttttggaattaaacgaacatgaggaaatgatctgtgagtggactgaatgctccctttcataagacgagaatggatgtgccgtagttacttaaaggacatgcactgtgtgtgtaacatgtgtatccgtcagcacgaacgaaccagaggtgctgcattacacgtgaattagacatgctagtgcttgacgtgtgcaatgtaagttatgtgcacaatacgcgcctagtgatctgtgatcgctgtacataacactcatgaggtgtttgatagactgcatgagatgatggaagtccttata

SEQ ID NO: 105886 - DNA, 703 bp, Oryza sativa
cattttgcctccggaatccagctatggcattgggtccgccaatgttatataggtgccgctatgggaatcctcagcgttatgcatccacgggcgttgtgagctccccggaatccaaccttataagattccgaacccctcttgttagaaagatgatagatgcaaaccctcagtgtgatactatgatcaatttatgaccagtgattttcttttggaaactatcgaagtatttattacattgtgagattattattccatttccataacatttctgattggtatgcaggtgttgcgttgggtttttcatagtccatgaaaccaaagcggggttcttggtggtttggaacgtactggcaaaggaagtcgtttatgacagcgacacggtcttcaaaacataactttaatttcttgtttctataaaactatttatttaaaaatgatatatgtatacttttatgaaagtatttttcaagataaatctattcgtataatttttaccttttcaaactcaataacttgagagttatttatgatttatattcctaaggttcgacttaaacattgccctaaacgacttcctttacgagtatagagggagtacaaactctagaggattttgggtggcgtgagggcaggttcattaaacacttttacccagtttgatgggtcaccacttgaatggagccatttgggtgatcgaatcagt

SEQ ID NO: 105887 - DNA, 727 bp, Oryza sativa
  unsure (1)..(727): unsure at all n locations
agacttgcaactgagtatcnnnnnnnnnnnnnnnnnnnnnnnnnnnnnnnnnnnnnnnnnnnnnnnnnnnnnnnnnnnnnnatgtacagaaatactatatataaaaaaaatatttgaattcaaattcaaatttgaaacggatatataaacttttgacttataaacttttggtctctaaactttaggtgtataaatttactaaaataggaaagtaatgcggtgccaaaaaaggaaaccaggtggagggatgaaggggggaggtggtgatcntntntagtnntatttaacttgcttaaagtacaagatcacccataagaccattcactccaccccttttcattctacattggggattgactcctacattatcaactaaatatgtttgactctctcaaccgtgttgtgaatagccttatgagacttacaaggcacgaacatggttatgagggaccttacagagctacattactcacaaatctacatattcatgaggcatattggttctaggagaggatttaatttatcatgttagtggctaactttttcacttttatcctgactttttctaaaggaaattacaaagcaggccaatcttttacacggaacgctctaataattaaaaaaaataattccttatatttttcccacaccaacctggctctttagacctcaatttgcttgttcgtttttacattgtttaccggcgtaaacggctttaccctaactt

SEQ ID NO: 105888 - DNA, 506 bp, Oryza sativa
  unsure (1)..(506): unsure at all n locations
taaaaaaggttagcggcgaagtcagcccgaacacccccgacattagctcggaggtcaccgaggcagaacgcgccgttgccgacatcgaaaccacagacgactggcgcaccccactaatcaaattcatcagcagcgaggagttgcccgaggacgatacagaggccgagaaaataacccgtaaagcaaagatctactgtatggtcggcaacgatctatacaagaaagcgccaaacggggtacttctcaaatgcatctcgaccgacgacggtagacaccttgtaacatcctgaaaattcctgacattaaaaatcactaaaatttcgaactttttaaaactttttgcatcatgctggaagttatggttgttattgcttgccaaaccataaataagaaacaatggaagngtttctttctaaagatttacacccgagcaatagttannnnnnnnnnnnnnnnnnnnnnnnnnnnnnnnnnnnnnnncggtgtccaatcaatttcagtttctt

SEQ ID NO: 105889 - DNA, 512 bp, Oryza sativa
atgcagattatcaaagctggacacaacaaattgagcctaattaacactatcaacttcctgtgcttattcctgcaaagaacgcagacaaggcccagtcctgatcaagaacagagctttctcaaaaaataatactaccaataatcaagatcagagcgagttgattaaaacagagtggaatgcacacaaaggcaactgattcgatcacccaaatggctccattcaagtggtgacccatcaaactgggtaaaagtgtttaatgaacctgccctcacgccacccaaaatcctctagagtttgtactccctctatactcgtaaaggaagtcgtttagggcaatgtttaagtcgaaccttaggaatataaatcataaataactctcaagttattgagtttgaaaaggtaaaaattatacgaatagatttatcttgaaaaatactttcataaaagtatacatatatcatttttaaataaatagttttatagaaacaagaaattaaagttatgttttgaag

SEQ ID NO: 105890 - DNA, 559 bp, Oryza sativa
  unsure (1)..(559): unsure at all n locations
agagactgaaattgaatgcacctgacacaaaccnnnnnnnnnnnnnnnnnnnnnnnnnnnnnnnnatctatttcaaaatttaacaccgtcatgtgacccaataagatagcttgagacaagccagcttgtggagattatggataccccatatctacatgacggttgtaatttagtcggatatacggtatcaaatatagatggaatatctctatgaagactcgggttaggttctaaacttgtatgtcaaggaaatacccgggatcttagtcggttacgattgtattttatctataatcccatattccgttaggatatggactgtattttgtaaagcggactccttcccctatataaggagggtccgcgtgcctcttgggaggtgattctttttcccagtctatacaattaataacacactcggcggaattatccccggacaggagtagggtattacttctttaataagaaggcctgaacctgtataaaatttcttgtctccaaacccatccattttcctagcttgacagccacccccttttattattgccgaaatcttgct

SEQ ID NO: 105891 - DNA, 731 bp, Oryza sativa
  unsure (1)..(731): unsure at all n locations
gtgggtnnnnnnnattgaaccattctnnnnnnnnnnnnnnnnnnnnnnnnnnnnnnnnnnnnnnnnnnnnnnnnnnnnnnnnnnncttctgctttacgggatagaggcccaacagtagtttggttggctgcgtgttcacttcaccatacggacttcattttcgtcgattggtgatccttttggactttggagcgtccacgttttcgtatggctcccacgaaaaactggttttggtcgcagaccattctgtttcgtacaatagtattatcttttttttattacgtacacgggcgacggcacagagctgcctaacccgtggaacatcgaacaccttcgtcgcttctacccctagtggggatcgggcatcatgtctcgggctcgggccaaccccgcaccccccccgggcgtgcaggattggccgggggctaccacatgcatatacttaccttttttctcttccgtatttcaataaaagcatttttgatttcctgaggactgtgtctgtgccatcatttccttttgaagaatcttggcttgaattagcacgctcgtgctcgaccttgccctcggcggcccgggccggctaaaatcgccaaacggggcccagaaccgagccgtgccctggggcatggtgaactccgagggggaatcggcaaaggcccacaatccggtcatccataaccctcgtcaccgcgctcccggccttgccagtctcgacacgaggatctccc
